United States Patent 8,216,786 (GENETIC POLYMORPHISMS ASSOCIATED WITH CARDIOVASCULAR DISEASES, METHODS OF DETECTION AND USES THEREOF) - sequence listing, part 15

SEQ ID NO: 1345 - DNA, 278120 bp, Homo sapiens
atgatgataatgtttctctgagtagagaatatcaacaaaaatatcaaaatgataaaaatggccacatggagattctagagtctgaaagtacaataagtaaaaaattaaccagaggagcacaactgtattttgtaactaatggaagaaataatgattaaacttcaagataggtcaatagaaatcacgcaatccaaagatcagagacaaaaaagaaatacagaaaaatgaaaaagtgtcagagaaatatgggataccactaagtgtaccaatatacatgtaatggaagtaccagaaggataggagagatacagaagaacgtaaaaaatatttgaagaaatcatggttgaaaacttctcaaattcgatgaaaaatattaatctactcacccacaaaggtcaatagacttctagtagaataaacacaaagagatctacagtagacaaataatagtaaaatctctgagaaacaaggaaaaaaatcttcaaagcaacaagagaaagtgtcttctcacatctaatggaacatctcacatctaatggaatcagtaagattaacagctgacttctcatcagaaacagttgagaccagaagggaacaggatgacatattccaagtggtgaaagaaaaaacaaggtcaaccacaaatcctatagctggcaaaattatctttcaaaaattaaggcagaagaaagaaattctgagataaactaaatgagagaatttgttgctagcagaccaaacttacaagaaatactaaaggaatttctgcagactaaaagcaagtgacatcagacagtgtttataatccacataaataaaataaaaagcattgataaaagtaagtttttatggtaagtaattataaggaatatatagtaagtaattataaaagaaagcataaatgcatgtttattctcttcttttaactagtttaaaaaaacagttacataagacaataagtatataccttatttgtgaatggaaaacataaagaaatgtaatagatttaccaaaaatagcacaaaagagttagctaggagcagaacagttttggagtaatgaaatgagatcagatgtaaatgtgaatctgagaaacaaatgaagataaccagaaaaaataaataaggttaacattacaaatgctagaaatatgcaaacgttctcctttcttctcccatctcctttaaaattataagtaacaattataacaatatattgttaagtttgtaagtaggtgaactatgtattacaacaataacagaacaaaaggaggaaaaagagaatagagctatataggagtaatgctcctatatctcactggcattgttagtataaatctgaagccaatctgataagatatatatgttaagctctagagcattcatttaaaatacaatttaaaaatcaacaaaggatttaaaatgttatacagtgatccctcagtatctgtgggtgcttggtttcaaaccaaggttccaaaagaggaaccccacagatacaaaaattcacagatgctcaagttctttatataaaattgtatactatttgcatataacctacatacatcatcctgtatacattaaatcattttagattacttataatacctaatacaaggtaaatagttgttattctatattgtttaggaaatcatgatttttaaaaagcatgtacatgttcagtacatacacaaccaacctttttttcccaaatattttttatctgcagttggttgaatccaagatgaagaatccatggatatgaagggttgactgccatagaaaaaatattcacttaatgcaaacataatatgtgtaatgaaaacgttaaatgatgttgttgaaaaggtggacaacatgcataaacaagaaaaggtttctgatagacagcttaaaactataagaaagaatataatggaaatgttataaataaaaccacgatatgggagatgaggaattattttcacaggttcattggtagattcaacatagctgaagaaagaattaacaaacttaaaaataggccacagtgtatgcatagtacaagtttcctaggtttcctactgctatggtttgcacgtccctttcaaaactcatgttgaactttggtggccattgtaatagtgttgagaggtggaacttttaagaggtaattaggttatgagggttatgctctcagggataaattaatgtcattattgggggagtggattcattttcatgagcatgaataaattcgtgtgagggcaagagagttcagcctctcttgctctctctccctcttgcatttctgccttccaccatggaatgacacagcatgcaggcccttggcaatgccagcaccatgcctttgaacttctcagcctctgaaatcatgagccaaataaacttcttttctttataaattacttagcctgtgctagtctaacaacaaaaaacagattaagatagaaaatgtgcaccaagagtggggcttttgctataacaaatacctgaatatgtggaagtggcttttagctgggtaatgagcagaggttggaggaatttagaagagcaggctagaagaatcctagactaccataaattgaacactaagggaaattctggtaagaactcagaagaaaagaagaaatgtagaaaaatctgaaacttttaaaagattacttaggtggtcgtgataagaatattgatagaaatatgaaaagtaatggccattttgatgaaagctgagacagaaaagaggaatgtccatcctttttttaaagtaaaggccattctttttatgaggtggcaaggaacttaactgaattgtgcctgtgttagtctgttctcacattactataaagaaatacctgagactgggacatttatcaaaaaaaaagaggtttaattggctcatgattctataggctgtacaagaagcatagtggcttctgcttttcaggaggcctctagaagcttctaatcatggctgaaggcaaaggagatgcaggcttcttacatggcaggggcaggagcaagagagagaagggaggtgctacacactttttaaatggccatgtctcatgagaactcattcacgatctatctcaaggacagtgccaaggggaatggttctaaaccattcatgagaaatttgcacccatggttcaatcacttcccaccaggccccacctccaatactggggattacaattagacataaggtttgggcagggacacagattaaaattacatctgtgtccatgcccatgggttttatggaaggtagaatttaagagtgatgaataagactatctggtggaagaaatttctaagcaaaatattgaaggatctgcaaggctacttttaaccatatgcagtaaaatgtaagagaaaagaaataaagatgaaatctataaccaaaaaaaaaaagcagaatgaaaagattttgaaaattttcagcctgcccacataaagaatgaaaatgtgtgtttaagagaacagaccaagggtgtgaccaagtgaccatttgctaatgagattagtataaatagaagggctcatcaagacaatgggcatttcagagatctttgaggctgctcatcccattacaggcctagagatctaggagggcagaatagctttggggaatgggcacagggtacgcttcacaggccacctggagttgctgctccctgcattcctggacagtgttctttggctgctcatggtgtggttcaagtaaccccaggtgtggcttgacctaccactctggaaggaaggtacaaatggtagactttggtggcatccatttggtgttaattctacaggcatgcacagtggaagagctacagaggcatgacttcctctacctagatttcaaaggatgccatgtgaagcctgtgggctcaggcagaaacttgctgcaggagcagagtcaccacagaaagtcttcaccaggggatgcctagtgaagccatgggagcagaaatgcccctgacactcaagaactgcagagctactagtgtgcaatgccagcctgggagaactgcaggcactagactctaacctgtgagagctgctgagaggactgaccacagcaaaggcttgagggctcaaccccaaccccagcatgcccaggatgtgggacatggagtcaaaggagattattttccagcttaaagacttaatgttgttttccctattgggttttagacttacttgggaccagtcaactcttttttcttgcctatttctttcttttggaatggaaatgtctattctatgcctgtcttacatcatattttagaaagatgtaacattaattcacaagctcacagatgaagagaaattttccttggggtaaatcgtgccttgagtctcacccatatctgacttagatgagacacttgtctttggacttttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaatttttttttgtatttttagtagagacggggtttcaccgtgttagccaggatggtctcgatctgctgacctcgtgatccgcccgcctcggcctcccaaagtgctgggattacaggcgtgagccaccgcgcccggccgtctttggacttttgagttgatgctggaatcagttaagacatttagcagctatggggaagggatgaatgtattttgtatgtgagaaggacactacttttggagaatgaggggtgaagtgctatgacatgaacgtcccctccaaaactcatgttgaaatttaattaccattgtgacattgttgagaggtaagacctttaagaggcgattaagtcatgagggatatcccctcatgaatgaattagtgttgttttcacaggagtgagtttgttattctgagagtggatttgttatgaaaatgagtttggccctctcttgccctctcactctggccctctcttgcccttccaccttctgccataggatgacacagcaccaaggcccttgtcagatgccggtgttatgctcttgaatcataagccaaataaattttcagtgtccagaatcataagccaagtatgtttattttctttgcaaataatccaggctggtattatttatattctgttatagcaatgcaaaatggactaccactatcttattatgactatactagaacctaattatagacatctactatctaattatttggatcttatatcttatatttctaccagaagttggttttttaaaaaccctattcgccagcattcagatcaatacttagtattctcagagttttatgtttttccaatctgatggatgtgatacagtggatggctaagtaaactttggcaagttatttaaattctctgagcttctattgtctcatctcttaaaggatacttctctggattaatgaattagaaaaaaggtattctttctggtcagaacagatcctcatttactgggcttggaaaccatgggcacctttgtttaagcaaaagtctcccctttctccagccaatgcagtgccaccagagtccattggttggcttgcagagcatgggctggctgaatttaaagctcattccccaccttgtctggtactttaatgcaatgcaaactacccaaacatacatgacggttatcactcctcacaggacaagacaacctggcatcctcacacagtactcttcaaaattctcagtagcctcatcatcccactgctgaacagctcaattttctcacttactttagggctggtagaatctgctgattgttgttgtttaggtaaacttcttccttataaggacttcttccaatattatgtgaaattccaacagttacactaccaaacagccaatccctataatttctagaaagccgggagtcaaaagaatggcctcttatttttaaaaaattctgcccacagagaagatacacatgatggtactgagactgttggatttgagagacggagaatcaaaagacattataaagtttgaagtctagatctggatacagtctgaacagacatagttgtgtttaacagccataaaatacaggatgctctctagaattagtcatttagttcttatttgcccctgtccctatactcaccacaaagaagggcagtgaaaggaatatgctgaagcttaacaaaaataaattttcctccatttttatcctcaaatatttttatcttctttacaccacaaatatctcctgaatgagaagcattccaatcctcatatcgccattctagactggttctgtgacaaaacgtaaacagtgttacacttcctttccagtatcaatggggcagagagaaagagctttaggatatctaaaatgcatatggccatcttgccaaaaaattgcacaaaaatatagggaagaacttagcaacaggtgatgaaggaccaaagtgagcatctctacctttctactctgattaggacacctttctcagtacacctccctccacacttcctcccttccccagaaaatacattttcagagatggactatgaggaaatgagttgggctaatagaattcttacaaaaatgtctgcatttcctttctctagtcccccccaaatcacaagaatatgttcaacagtggaaacaggcaggaactaaggctatgagagtctcctggacagacaatggatttcattattaccagcctaatctacttccatggtgtgatggcgaattgtacacactctttgacttttgtaatgagaggataagagaaaagaggagttagaattttctaggtgacttaataattaaccctgaggcttggaccacctaaaactgacttacagaacagctaatctttcaggagttgacagcagcgtttcatcccatctcggagggcctctttgactttgtcattccgaagagtaaagatgaaaggattcaggaagggggttaacacagaaaccaacagggaaactatcttattgtactcaactccctgtgtttgcttgggtttcacgtagagaaacaagcagctgccatagccaatcacaacacaggtgaagtgggaggcaaaagtggagaaggctttcctccggccagaggctgacgggatcttgaggatggtggagataatgtaggtgtaggagacaatcgtagggatcaaagaaccaatgagaataaaaacagccattaagaaaaggataaactctgtgagaagagtgttatcgcaggacagtttgagcaattgccctcggtcacagtaaaaatggtctaatgaatttgatttgcggaaggtaaactgaaatgtggcatagatgggccagatttcagaaagaaatccaaacacccatgacactattaccacccaaatacaggtactgctgttcataatgatgttgtacctcaaagggttacacacagccacataacggtccacagccatcactccaagtaatgcaaactccatggtcccacaggaaaagttgagcgatacatgtagagaaagatactgtctgcatcccaggaagagcaatccccaaagcatcatggggacaattatggttgtgaccaggatctccagggtagagaggtggctgaggaagaaatacatgggggactgcagacgtttatccacacagacaatcacaatgatgaccgtgtttcccattaatgtcactaaatagaagaaaaagaatatagcaaaaagaatgtggtgtagtccttgggacccagggaagcctagaaggtggaattcagtggcactagagtggttgtccatcatttagtccttgattctgcttgttttgaagcccagagattaaaagagaggtggcattgctccacatggtcctgctctcaagagagaaggaagaaaaattaggttaagaaactatttccaacctgagaatcaggtgacatgtccctgctactgtggtcggcacatacatagcttgaggtacatgttgtcatcccaagtctacaagtgaggctctcacttccctgtgtaaccagccccctagaatgggtgaagacatcttcttctactggtggtgaaataccttccttgcctttttccccattaaatataccttctctcgggggcagaggctaagaccttttaaataggccagttttaaaggtgagtcaatcaggtccctccggtcctggagttactttctcttaggttaactgtgcaagatgacacaaaggcattttatatgatgttcaaaggacagaattttaaaccccagctctcatctgtaatggtaatgcatagacccacctttggggccagcagaaaggaggcagaggatgtaagactaacatctctgctgttccagattttaaaatctccattttacagaacagcaagatctctaaatgagaactctagagcttgggataatttcccagaacagatccattcttctctaattccattttccttccaaagttgtgggaggaaggaaagatggcacctggcacagaaaaggaatagatctgggaccgccagctgttaaggatgcctggctctctgcctgtcgcttcattccattattcaaatgtcaccctttccaaagactctttccaatcactctgcccaaaacagaaaagacacacttattattggacttccatttttttaataacagttgttattaccttgtattatgtctaattatttacttcattcctttatttaacaataaacaaatgtagtcatgaacagaacaaagaaaattccatgccctgtggagcttatattcaaggaagaggtgggggctagaccacacacaagacacctaagtaaaatatgcaatagtttagtttgcttatcatgtcacagggaaaaaaataagcaagaaagaaggagaggaaatttaagtgtatttattatttatcaacggcattagaatataaactccatgagggctaggacatgtcttcactgttgtattctgaggctggcacataaaatgtacatacataaattaagtagttatatattttatatatatatatcatatatcttttatatagatatagacagatacattatgtgaaatgaatatatcatagatatatcttatatattaaattatgtattaatttatcacaaggtaaccgaactaatagctgtgtgagtcaagatttgaacctaggtctgtcagatttcatcactcacacagctaactaccacaccttatattatattattatcttatattatttatcttatttatataagatatatgaaataagatatatgaaatatatcttatattatataaaatatacatatattttttatttataagatatttaaatacataagatatatgtatcatatacataaaataagtagtgctgacaaattttgctagatgaggtatggatggatggatggataatatatgattaaataatacttgttctggccagggcctgggccacattccctcaatcctattctggttggttttccttcctgcctcacattaccattttccctcctgcccttcccttgcttaggtaaccccttccctgtctacgtcactgttttactaatggtttaaaaagcttcagggacagaattgatgggaaagctcagtgttctggttttccacaacctctgcataaccagcacgagatgaagaaacatgagcgagaaggacaccgactgtcagggagccgtgactgtgttagcattgggtccaagaggagccggaagtgctctctgctatgcaggaagggtctggagatgagcctatacactctactgctcccctagcccacacttcaatatctgggtgactttgttctagaagataggcaggcccaggatgtcccatcctaaaatgcttttaccctcttcttcatagaggagaccccttggaaagacactcacctttacagaggggcttcgccgcctcttctgatgttctctagggctccgctgaggctacctcctgtcctgctagtgctgagccatgcacaggggccagaacaagttgctgcaatccccactcatggcgaagaagggaaatgtcctcccagaggagcttaggaaaaagcccagaaatgagtgttgggcaaagttgagggtcctctctctctcccctctcctccctcttcccttcttcccaagggtacttaatcaccgagttactacttcttaattagcccacgttcagggagtccccaggcaatcagtctagtgggagcagaacaaactttaagttattcccattttttgaccaattaagttttagaacttttgaaagtttttgtttgacgggaaaacctgaaatcttaccaatcagggacttcttaatactggggctgccttcctgaaaacctcaggtctaggtttccagatgtctcagattctaaacagtcaactacctctgtcgtttatcttaggcttttctcaagtttctctagttattcggagcctaaatcaacccttttcccccagtaggagacaccacaattggcctctaaaacatgcaccaatatcccaaaaaagtctgcatattggtcttggtcaaagccttaacttcaccaaatatcttctaaaaagcctgatgactccttcattcattttaaaaaggctcctgcgtttagtcctgtggaccctacagaatactgtaagaggtccctcccctaaatcgaactctattctgttctattgtctcaggttttcactcctcttgatatatgtgcatctgtatgcattccagcaagattcttccagacttttttttttcctatggcatgtccctgattaccagctggaccactgcaaagtagagagagcataaggacagcttatgtacacagttctgtttgcaacctggaggaactgacaaaatgtaagttggaaatctgtctaatgctggagtaagacagaaaaagtaggaattacaaaacatttgtctgcatttttgttttcattttaagtattttaagtacacctgttaaatctgagaatttcaattggtgcctaagggtataaattgggattaatctttcttccaattccttaaattgcccaagcccaaatacttgccatataattttagagaaattttccaagcatgtatctccatattctttttcgtaaaggctgtgaaaatctgtttgcaaccttttctttctcatttaacaacatataaaatatatctttccatgtcagcacatattactctacctcttttttttttaacataggattccattatgtggatgtcctattctttattagatagacatttattaattaattttcattgttgtttccatttttaattatgaaaaaatgatgctataaatattcttagatatttgtaagtacataaacatgtacttgtaagtaaagtaagtacgtatacatgtaagtacataaacaattatatttctgaaaaagaaaaaaaagattccctagagttggaatgtctgggtcaaatgcagatgtattgaagctattactttttattggcaccaaattacactccaaacattttgtattgattcacacaattactaagactgtgtaatagaaggggtcttgttttcctgacctgttataagccaaaggcataattaaaattttaattttaagttgaagagaataaaaacaagacaccttaaaagggaaatcaattaacaagcctgatgaaatggaaaatttttgaaagataaaaatgaccaaaaccaactcaaaaacaaatatggatatagaatcaacttgagtatccatcaatggatgagtgaacacagaaaatgtggtgtatatatacaatggaatagaattcagccattaaaaggaatgaaatcttgtcatttgtggcaaaatggagaaaactggagggcattccattaagtgaaataagccaggcacataaagacaaataccacatgttctcactcatatgtggaaactaaaacagttgatctcatagaagtacagaataaaataatggttaacagaagctagaaaggatataggggaggggaagacaggaagagtttggttagtggttacaaaatttcagttaaatagaagaaataagttccagtgttctgtggcatagtagggtgacaagtttaatgactatctattgtgtatttcaaaatagctagaagagaggaatttgaatttccccaacacaaagaaatgatgaacgtttgaggttatagatatcccacttaccctgatttggtcactacatgttgtatacatatatcaaaatatcacatgtacccccaacatgtgtacaattattatgtaccattaaaactttaaaagtaaaataaatggccacagatgttgtacaaaatttaatcttaatagagttgaaaatattttgtaaaaaataaatccaaacaaggggccaagatggctgaataagaaaagctctggtctgcagctcccagtaagaccaacacagaaggcaggtggtttctgcatttccaactgaggaacacagttcatctcattgggactggttaggcagtgggtgcagtccacggaaggtgagcagaagcagggtggggcattgcctcagctgggaagtgcaaggtgccaggggacctccctccttgcagccaagggaagccatgagggactgtgctacccagctggattactacgctttccccacagtttttacaatctgcagatcaggtgcctacgccaccagggccctgggtttcaagcacaaaactgggtggctgtttgggcagacaccaagctagctgcaggagtctttttcgtatcccagtggtgcctggaaccccagcaatacagaaccattcgctctcctggaaaggggactgaagccagggagccaagtggtctcactcagtgtgtcccactctcacagagcccagcaagctaagaaccgctggtttgaaattctcactgccagcacagcagcctgaagttgacctgggatgatccagcttggttggggtaggggcgttcacaattactgaggctttactaggcagttttcccccgacagtgctaaggcagcagggaggtctggactggatagaactcaccacagtgtggcaaagtggctgtggacagactgcttctctagattcctccttactgggcagggcatctctgaaagaaaggtaacagccccagtcaggggcttgcagacaaaactcccatctccctgggacagagcacctgggggaaggggaggctgtgggcacagcttcagcggatttaatctttcctgccagctggctctgaagagagcagctgatcctaacaagaggaattctcccagcacagcacaccagttctgctaagggacagactacctcctcaagtaactccctgaccccgtgcctcctgactgggagagacctcccaacaggggtcgacagacagctcatacaggtgagctctggctggcatcaggccggtgctcctctgggatgaagcttccagaggaaggagcaggtagcaatctttgctgttctgcagcctccactggtgatacccaggtgaacagggtctggagtgtacctccagcaaactgcagcagacctgcagaagagaggcttattagaagaaaaactaacaaacagcaacaacatcaacatcaacataaaggacccccacacagaaacctcatccaaaggtcatcaacctcaaagatgaaaggcagataaatccacaaagatgaggaaaaaccagcacaaaaatgctgaaaattctaaaaaccagaatgcctcttctcctccaaatgatcacaactcctctccagcaagggcacaaaactggacagagaatgaaatggatgaattgacagaaatagacttcagaaggtgggcaataacaaactcctgtgagcaaaaggagcatgtcctaatccaatgcaaggaagctaagaaccttgacaaaaggttacaggaactgctaactagaataaccaatttagagaacataaataacctgatggagctgaaaaacacagcacgagaacttcttgaagcatacacaggtatcaataatagccaaatctgtcaagcagaagaaagtatatcagagattgaagatcaacttactgaaataaggtgtgacaagattacagaaaaaaaatgaaaatgaatgagcaaagcccccaagaaatatggtactatatgaaaagaccaaacctatgattgattggtatacctgaaagtgacggggagaatggaaccaagttggaaaacacacttcaggatattatcgaggagaacttccccaacctagcaagacaggccaacattcaaattcaggagatacagagaatatcactaagatactcctcaagaagagcaaccctaagacacataattgtcaaattctccaaggtttaaatgtaggaaaaaatgttaagggcagccaaagagaaagggcaggttacctacaaaagaaagcccatcagactaaccggatctctctgcagaaaccctacaagccagaagagagtaggaggccaatattcagcattcttaaagaaacaaaatttcaacccagaattttatgtccagccaaactaagcttcataagtgaaggagaaataaaatcctttacagacaagcaaattctcagggattttctcactaccaggcctgcctttacaaaagcccttgaaggaagcactaaatatagaaaggcaaaaccagtaacagccactgcaaaaacacaccaaaatataaagaccaatgacactctgaagaaactgcatcaactaatctgcaaaataaccagctagcatcatgataacaggatcaaattcacacataacaatattaaccttaaatgtaaattggctaaatgccccaattaaaagacacagactggcaaactggataaagagtcgaggcccattggtgtgctgtattcaggagatccatctcacgtgcaaagacacacatgggctcaaaataaagggatggaggaatatttaccaaataaatggaaagcaaaaaaaagcaggggttgcaaacttagtctctgataaaacagactttaaaccaacaaagatcaagaaagacaaagaagggcattgcataatggtaaagggatcaatgcaacaagaagagctaactatcctaaatgtatatgcacccaatacaggagcacccagattcataaagcaagttcttaagagacctacaaagagacttagactcccacacaatgacagtgggagactttaacagcccactgtcaacatcagacagatcaatgagacagaaaattaacaaggatattcaagaattgaactcagctctggaccaagtggacttaatagacatctacagaactctccaccccaaatcaacagaatatacattcttctcagtgccacatagcacttattctaaaatcaaccacataattggaagtacaacactcttcagcaaatgcaaaaggatggaaatcataacaaactgtctctcaaaccacagtgcaatcaaattataagtcaggattaagaatctcactcaaaaccgcacaactacatggaaactgaacaacctgctcctgaatgactactgggtaaataacaaaattaaggcagaaataaagaagttatttgaaatcagtgagagcaaagacacaacatactagaatctctgggacacagacaaagcagcgttaagagggaaatttatagcactaagtgccctctctcattactcctattggatgttctggctagggcaatcaggcaagagaaagaaatagagggcattcaaataggaagagaggaagtaaaattgtctctgtttgcagataagatgattgtatatttggaaaaccccactgtctcagcccaaaaactccttaagctgataagcaacttcagcaaagtctcaggatacaaaatcaatgtgcaaaaatcacaagcattcctatacaccaccagtagtcaagcagagggccaaatcatgagtgaactcccattcacaattgctacaaagagaataaatacctaggaatacaacttacaagggatgtgaaggacctcttcaagtagaactacaaaccactgctcaaggaagtaagagaggacacaaacaaatggaaaaaaatttcatactcatggataggaagaatcaatattgtgaaaatggccatactgcccaaagtaatttatagaattcaatgccattaccatcaagctaccactgactttttttgcagaatttgaaaaaaactactttaaatttcgtatggaaacaaaaaagagcccatagagccaagataatcctaagcaaaaagaacaaagctggaggcatcacgctaccttacttcaaattataccacaagtctacagtaaccaaaacagcatggtactgatatcaaaacatatttctgaaatacaccacgcatctatagctatctgatctttgacaaacctgacaaaaacaagcaatagggaaaggattccctatttaataaacgattttgggaaaactggctagccatatgcagaaaacagaaactggaccccctccttacaccttatacaaaaattaactcaagatggattaaacacttaaatgtaaaaccccaagccataaaaaccctagaagaaaaccaaggcaataccattcaggacataggcatgggcaaagcctttatgactaaaataccaaaagcaatgacaacaaaagccaaaattgacgaatgggatctaatcaaactaaacagcttctgcacatcaaaagaaactatcatcagagtgaacaggcaacctacagaatgggagaaaatttttgcaatctatccatctgtcaaaggtctaatatccagaatctactaggaacttaaacaaatttacaagaaaaaaacaaccacatcaaaaagtgggcaaagaatatgaacagacatttctcaaaaggagacatttatgcggccaacaaacgtggaaaaaaagctcatcatcactggtcattagagaaatgcaaatcaaaaccacaatgagataccatctcataccagttaggatggcaattattaaaaagtcaggaaacaacagatgctggagaggatgtggagaaataggaacgcttttacactgttgatgggaatgtaaattagttcaactattgtggaagacagtgtggtgattcctcaaggacctagaaccagaattacgatttgacccagcaatcccattactgggtatatacccaaaggattataaatcattctactataaagacacatgaacttgtatgtttattgcagcactatttacaataacaaagacttggaaccagcccaaatgcccatcaatgatagactggataaagaaaatgtggcacatatacaccatggaatactatgcagccataaaaaagaatgagtccatgtcatttgcagggacatggatgaagctggaaactctcattctcagcaaactaacagaggaacagaaaaccaaacactgcatgttctcactcataagtgggagttgaacaatgagaatacatggacacagggaggggaacatcacacacgggggcctgttgggggttgaggggcaagaggagggagagaattaggacaaatacctaatgcatgtggggcctaaaacctagatgataggttgataggtgcagtaaaccaccgtggcacatgtatacccatgtaacaaacctgcacgttctgcacatgtatcccagaaattaaagtaaaattaaaaaataaaataaaataaaaagaaatccaaaatatataacagaggatggggcttgttattgggggcctgatgaggacacaaatgaggtaaaggcaggtgaaggataaagatagcattggagtgagtcagaaagcaattagaataagtaggcaaagtgagttaaatagattatggcttttgggtggaggtagagatgaggatgggagagcaaatgaggaatcatgaagagaaaatggcttatctagccctaatagatgtctgagtgtggcaaggagctttcagacccttccccaaacagatgtctctttggctaagttctatcaaaacatttctaagcaacgttctgcaaacacctcttaggggaatagaacattttctttgtaaaaacgaagacagatattttctgtcagtagagcccataacattgagagcacaatttaaaagtgtacatctttggtgaaagtggaaaaatttcaaaatagcgtaagatcatgaataaaacattgaaattggaatcaggaaacctgagtgctgattccttctcatacttattagctctgtgatacttggtgtgaattttcagccctctaggtttgaaatatcagacccctcatctgaaatatcagggcattgatgggcatgatgtgtaatttttcttccacttttaccttgtgaaagtcaaggggccgaaatggagctagttttttttttgtttttttttttgagacggagtctcgctctttcgcccaggccggactgcagtggcattgtcttggctcactgcaagctccacctcccgggttcatgccattctcctgcctcagcctcctgagtagctgggattgcaggtgcccaccaccgcgcccggctaattttttgtatttttagtagagacggggtttcaccgtgttagccaagatggtctcgatctcctgaccttgtgatccgcccgcctcggcctcccaaagtgctgggattataggcgtgagccaccgcgcccagccatggagctagttttcaagctttcttcttaatggtgacctgagcctctcagtccaacatgaggactctccactcatgactctttggatggaactcctccacaaagctaacatttttgtctgaatcagttctctctagataacatcatgggccattacagtccacaccagatctagtacataaacttatcctagattaatgattttacaagtgagtagaagtgtttgctgaatatccttaagctcaaggccattccatgtctatgtttgactttcccacataagtatactcggacacaggtaagagaagtcatcatggcccagagaaagaaaaggacattctggcaaactagtagaacagatagggttattacctatccactatatagggttgcattaataatgtatgttattagagataggattattaccccagtggcagagacattacccacaaaacaggaaatgagaaggaacaaaccttactgacctgccacaaaacttcctaactgaccttcacatctaccctcgcttccctctgtctactctgttctccccatagcagcctgcgtgatcctttaaaacacagactagatcaggtctctccccggattaaaacctttctctctgccatttggttaaagtcctgagacctgtgaggctctgcatgatttctagaaatacctttctctaatgtcatcttgtgtcactcctctgctcagtgacactgacatcctttgtgctcctgtaatggcacgctgctccatctctcagagtgctcattgtgattcccaccatgctgtgcctagttagcaccagataccagttaatgattactcctatagatgcttcccataacctcacagacatatccatgttcaggttccctgccaggggctttccagatattacagtaaatgctgcagtgcgctgcccggactcccattcagaaccaagatgctaattacccccaaattgctcccaatcaaagagaaacaccttccccaagattatagcccttcctctaaggtagcctgcatccaatggcctatggatgcagaagtataatgcccaggccccaagtttctgttcaggacaactctgggcacaattcaggacaactctggaaagccgtcctagctcagagctccccgtaggatttaagcctctgttgtgacctcatcacaggtctgtccaaacatcttctccctcatcactcccagatctaagacaaccacgtagtttcttgctcaaaacaactcactattttgtaagtgtgtgtgtgtgtgtgtgtgtgtgtgtgtgtgtttacctggttttatagcgtatggtaacatcggtcttcatcaaatatgctccatagtggggagaccatgtccactctgtttactgctgtatcttcagtacattgtctaaaaaataacagttattcaaaaacaattcttattaaagtttgtttttttaatttacagtgagattgagttcttttcatgtttaaaaaatcatttgcagttttctttaatgaatgtacaggtttgtaagagaacattttgcataaatcaaacaaatctttatttcatgtttctgtttttatgttttgtttctatcttgcataaatatttcatccttaggcagttacacttaacagtcttttagactcccgggatccgtgttttcctttgaaaagcctatgttcatactccaaggaaattaaaaacaaaccaaaaaatcccattttttactttttacatttaagtctgtttgagccatcgggaatttattattttttggaagcataaggtatagatccagggttttggtttttccagatattctgtgaatgtaatacatatttctaggacaaagggaaggtggtgacaaggaagggagaagagagagagagcccccaaaaaacaaacttagaggcctgccatggcaaaaaaaaaatacctcctcctctatctgggttgggacacagagggcatccatatttggatgtggagaaacaagagattagaatgactatgatattaataagggccaaagaatatcagcaatggaaagataatgttttccaacacttcgttttacatattgtaagcctgaaactcagaaatcgagtgacttgttaaggtcatgctgcagtttactagctgagttgacatgagtgaccgggaactcctagaccacccttctacaggaggcagtcagctgttgtcagcagggaatgaagcaccagtaggttgagtggagtgaccttcaagaatcctggcaaccctgagattctgagactcacaaatgtgcttttgaagatcagcagtcttataatcaaagacagatgctttaaggtgaataagttacatactggaacacagtaaaagctcaataaatacctcagcaatgagtgtggcatgtccttatcaataatgataagtaaatgtgcctctggacatgatgaagaggatccatgagcgtaagtgtgcagtttatgacaacgtcagtgtctgggatggttgctggagtgccagggagacacagccccttgggactgagcagtggagaaagggggaaggggacctcacagctggggatcctgaagcttcagactctcctccatcctgtaacactgggatagtgaggccagacagcaggaaagggctggagaagagcattgctaaacaaacttagcttgctcttgtcagcttactaacatctaccatgctcttctataccccaagacgacctgtactagtgtgttacataacatgttttatttaattctgaaattaaccttatgagggaggcattactatccccataatattggggattttttattgaataaaattccagatttttatctgcgttacatttacttaatgaatgcttagtcaacaactactatgtaaatgttacatttcaaacccaggtcgaactccaaagccccccaccacacacacacacacacacacacacacacacacacacacacacaactgaggtgctggacccagttctcatctgcctcttgttgctgtctgactgtacccattgttagtttaagcatcagcgttgtacaacccaaaggactcctggctttcccttgttcccacaaggagcaccctgctggagtctaaagtttcccatttggcccagctcatttcttaaaatcagcaagacccaaaggtttcaaaacagagtgggtgaacagcaccatcatccctgggagcaaagaacagcaagagaatcattctcattggatttccctgccacctccatgctatctccagcctgacatcagtcatggatactgctgccctgggctgtatagggagaaacagtaagtctcttcatcacagactcaatgaaagttgctgacagattctaacttgtggagtcacttgcaaagcagggccagggttgcttgccccattcccaaggggcttatgtctccgtgtcaaaatctgggtaccacagtcaggaagccgccgaagtaaatgacctaataagaaaagctcgccatgctggacttatgaattaagatgcattggctgggtctggagaatgaatgagttataaggattcggtttcggttagtcaagatgagtttagacttggcattaagattagtgagagggttgcatgcttactgcttagggagatagatccacttctgtgattagatgtcattgctgatggccaggatacagttctaggaaatacctgtggttccagagagacagctaacatgtgtcttctcagggcttcatttgtgtgctctcatttctgattttatttactacttatggatctctaaaggtattcattcagttaactataattaaagtgtgcagccagcacactgctggacccatacatagatgcatcaacacacacacacacacacacacacacacgcacacacacaaacccatcaccttcacgttaaagaagtgtggttggcggttgggttagaaggggagatgatgagaatgaagtttccatgccaataacaacagcggaaactgctgttattgaactcttcctatgtggcagccataatccaatttgatgctcacgctagctctactattttttatcttacatctggggaaaattccactccaagaggattagtatcagcccaaggtcatacaactggcaattcacagggccaggatataaacctagacggtccaaggtctgtgccgtcagcccccatacaagagtgagtcatgtcagggaagggtggtccactaggatagtcacagcattttaagaagcagagctagaagtccagtgcaatccacataccacacacatctttcagggactgtcagagcagcagcatccaatgggtcttgcctggattccagagcttgaatctaaatatcttgattccctttctgccttcagccattgtaaacatgtagcagatggtcaccccaaagggatcttattgtctctctgttctggctccccttgcttcctgaattgaatggctttgctgctgctgctgaaagctggaaatatgtggctgagtgagagttctcagcagaggggcatctagaaagcctcacaggggtgctttagactggcttctgtgctcagcctctggccatgctcagtcccgtgtcctgcctgcctttcctccctccttctgctcacaatttctgcttttctttgtcacttctgctgcttctcttgggttaccttttattccttctagctttctgtctgcattcctgggcctcctgtgtctctctgtctctcactttctctccattactgcttttctaacacctcgcctctctggttttgtgtttctcgcatccacactggctctctcctgtgaaccttggcctttctttatctctgaccacaaaggtacatagggcttaacacagaaacgatgaaaggaaacttaagggattagaatgtaacactaacaacatctgctacagcaaggtcacgctgaagtcaccaataactcaaatctttcaacggcttttaacaactatgtttgtttctcactcatgccatgcgcccatcactagccaggaagtagactctgctcattattatactgtagggactggagcagtagaaagctccctttaaacacattcttccatgatctcagatgtggagaaaaagggaatgtgactcaaatgccaacccttaaagctcttgctatgaagtgactctcattacttctacccatatctcactggctgaagaaaatcactcgaccactcctgaattaatggagcaaaaatatgtgatattcccactgggagggtcacctccaggaaggacaacaaatatgagtgaacaattatttgtccattataaacgtctgggtttctgtttgtttgtttgttttacttattctcttcctcatgaattttgggtttagcttatcaaataatgtaagtaatttcagtttcacagtttctgtcactgctgagctacagaatatctgaaacagtcatagcattactattcttggcatgatatagagggaaaggacagtgtgtgaagtgggtgaaatcagagcttcggtctcaggccccaacatgtgatgactgagaaacactgacatttacttaagctctgtgagattctacattgttatctaaaaactgaatataataattctccctcacaggttaactccagaataaatctgtagtcattacatgtgatttttttctcctatgtctctcatattcttctcattcaatcagcaagatatcttttatataatcaatataaatcaataagcaatgtaatgatatacaagtttggattatgtttaggttggtgagacaaaatgacataaaaattaagagcagagtctttgggatcagatctgattcaaattcaaactctaccatgcagtagctggtgttagtagctactatcaatgtttttgtttgtttgttttgtttcttttcttttgagacagggtctacctctgtcacacaggctggagtgcagtggtgcaatcatagctcactgcagaactcccaggcccaagtgatcctcccacttcagcctcctgaatagctggggctacaagcacgcaccaccacacccatctaatttttgtattttttgtagaaatggagtctcactatgttgcccaggctggtctcgaactcctgggctcaagcaatcctcctgcttcagcctcccaaagtggtgggattacagtcatgagccaccatgcagccactattgtcaatatgattaaggattgaaagccattccagccaggtgcaggagacatccctatttgtcatttgtctaccattgcagcccatatcattcacgatttatttgccttgctccaccccttccttactctgaaaaattagaatattaatagaaaacaggttttaggatcagtttttatatcacacaaacatttactaatgctttgagctcagatatgtaggaatatttatgtaaagaaaaacataagttgtataacccttaccaaattttccaagagtcttggattcttttaccaagaaaaacctcacagataaagaaactttttaaaaagtcttgctttttttgttaaaataaatttttctctaatttttgagagctaaatggttaactgaaaaataagcattcattaacagaatgtgttacacaaaaatttatcacacattttaagagacgtattacgatatatgcaaaaatcaagactgtgctgtgtggtttttaagcttagtgacaagtagatcaaataaggtctatgaatcgtatttgtgtttgacatctaagcaaactgtctgggatcagttgtgggagtaaagcaagatgtttttgaggcctcgcgatgtgcatgtgtgatagacagagtaatattttgttgtttttatgtttcagagatgcttgcagcttgggtgatataaaactcccagtggggcaatgtgtctgccttcctcataaatggacaaaaaggaagaaatacagtgtagtatcagaacaagcttgacttcagatactgcagcctcctgttctctgagaaggggagtgaaaagagagtggggtgagttagtgtctttctttccattcaggatcagatatctgacagagtagtctaagccttagaaaaagaaaattttgttgacttatccatgacaggttttttaaagggccacaaattttttggcactcctcccattaagatatggctctggctgggtgcggtggctcacacctgtaatcccagcactttgggaggctgaggcaggcggatcacgaggtcaggagatcgacaccatcccggccaacatggtaaaaccctgtttctactaaaaatacaaaaattacctgggtatgttggtgcatgcctgtaatcccagatattcaggaggctgaggcaggagaatcacttgaacctgggaggcggaggttgcagtgagctgagatcacaccactgcattccagcctggtgacagagtgagactctgtctcaaaaaaaaaaaaaaaaaaaagatatggctctatgcccctgcctcttgaatcttgtgttgcttggactcataaaagtatggcaaaagtgaccatatgtgacatctgtgacaatcttatttgacaagtagatcaaataaagcctatgatttgtatttgttttagacatctaagcaaactgtctgggatcagttgggaggataaagcaagacattttggcacaagtactgtgtatcatctttgtgcataaaatgggtgcccctttccatcaggtagatgcagctccttcagcccccatgtgccccttcagtctctccatcaccacctttgtacagtctacaagccacacaattttactcaggggccctaattcagctcctatctccatccaccaccaggcaagtgccctcttgctagactcttcaattctccaggtgacccacatcaattctcaagaaaactattttctgtctgattccagcctacaggtattatcatgtgagataatttcttcctccaatctgtctgaaaatctagcagttacatatttctgtgcattaatagggagctaccccatcccctgatttgttagtaagtcagaattgagggaggaaactcccactctcaactctgccagcagtgaaaatctgcagagatgtcatagaagacagctggagattggggcagaaaagcccccagtcagaggatatctggctttgggaggcagagcacatcatgaaaacaaaggattcctgtagcatataaagaaaaaattcaggcatctagagtgagccattcaatccttccttacctccttcctttaccatgaacaaaacgagatgagttaaatagttgccaaaaatttgatcataaattttcttctgtccctaccaccaaacatgttcaaacattccatccacccctttctaaacatattgtcctcgtgccactccaagttggctttatgccaaaatgtagagaaaaagagttgctttgtagtagcaatgggccaagattagatatggcacatccaagaaaaagagtacaccagggagtaatctgtgtctcacctaatggccaggcacagctttatgagattgagtctaataatgcaagtcaaaatgtcaacatatcccaggaaacagtagggcagatctgagcagaggtgctgacatttttattgtagtccctggactctcttcctcttctggaaatgcacattcagagatgattacagtgcaatctaacgcccccaggaacatatacagctcctttctcaagctcttccccgacttcaggcattttcttcttcagattttcaaaaacaaaacaataattttattacaaaacaactgaaacaagaagtagctcagattatcagttactgataagcaggttggtttttatgtttgtgtattttgcccacttccaagggcctgagtgtgataattacatatggtttgatgatgaaaataaagatgctttagcttagatatttgttagtattttccagattaccttagaatccatgaggactggcccacctaaaactgatttaggtcagtaaatctgacctgtaagaaggttcagaaagggggtcaacaggaaaataaacaggaaaactaccttgttttattctgctgcccaaatttgcttgggtttcacgtagagaaacaagcagctgtcatagtcaatcaccacacaggtgaaatgggaggcatgagtggagaaggattattttttggccagaggctgaggggatactggagtaggaatcaatctggatcaaagaagcaataacaatggaaatgtccattaatagactgtgtgaaaagatgaagagttgactgaggaagaaatccccgggagactgaagacttcatcaattcaaccatgtaaatgactgcatttcccattaatctcatcaagtgaaagaagaagttaaccaaaaggaaatggggcagttcctcaaagcctgggaagcccaggagacagaattgagtggcactagagtagttcccctcgctgtttcaatcctagctctttctctctgggaaggctagaaaggaaacaagaattaacattgctccacatgcctttaatcccaaaggaaataaggacagatttaggattatgctcctggattatggagcctgatctatgttatgatcatttaaccgagttgacgctacatatttattaaggaatgaacacaattgtgtaaagatgaatggatctggtcaaataagtggttcaccaggcaccaaagctgcatggtagtcattgcgataggcagaggaatgccccctcaacgatgtccaagccctaatccttggaatttgtgaaatgttgctttacataggaaaggggactttgcaggtgtgattgggttgaagaccttgagatgaggggattagcctgggcgatccaggtgggctgaatctaatcttaggggtgatccagatgggctgaatctaatcttagggatttgtaaaagtggagaaacttctcctctgagttcagtcagagggctaagtgatgacagaagacggttctgagagacacatgtgactggctttgaagatggacgagggaacaataagccaaggaatgtgggcagcttctagaaggtggaaaagcaaggagactccagaaaggaaggcagccctgatgacgccttgattttagctcattgaggcctggtcaagttactgacctggagaatttgtcaggtaataaatttgtgttgtttaagctacaaaatttgtggtaattggctacagaagcaatagaaaatgaatagtcatgaaggcccatgtagccccgacctatgctcctgcctttcaattcccaagcccctgcctccagccctgctctgcccaggacctgtcttcctacctgagctccctgctagcaactggctcctttcttcttcctcctccatttctagccttgtgacctacatttttctttactttctttctttttgtttttgtttttgttttgagacgaagtcttgctttgccacccaggccggagtgcagtggcacgatattggctcactgcaacctctgcctcatgggctcaagcaattctcctgcctcagcctcctgggtaaatgggattacaggctaattttttgtatttttagtacagacagggtttcaccatgttagccaggctggtctggaactcctgacctcaagtgatacacccaccttggcctctcagagtgctaggattataggcatgagccaccgttcccagcctcttctttgctttcaatgggtcagctccaaatctcagttccaagctcaagtcctacagaaagattgcctggtcaacccctccagccctggttattcttaacctcagggcccatctgtactaccttcattgcacagcttttccttgaaatctttgagtcattatttctgtctcagtgtgggtggggttgcactgggtatcatgcataaggtttaaatgtctctgagatgaaagactgtgactcagagtttactagggagctggaagcttggagtggcctccccatattccctttacctttgtccccagggtgtgtatcttctcacaggagccagatcccaagatgtgtccaccaagggccctgcctctggaggcagatatctgtttgattcccagacttctccaaatgatactttctttggagaattttaacaagaggctgctatggtccagggcctccattccctgcctccctagatccctaaaccctggatccacttggagattttgtctgcaaatggaaactctggatccagccctggctaggtacccaggctgtcataattttagtccagctgggaaaattcctttgtgttttttccatgatctcatattttttccatggtcctgggaggaggggaagggccaggagacaggcactgccgaggtgctgatcctaagccgtcagctgcttgggtgtatctgggtctttatccatttctttattcagatctttttctcaaatgttacttcctcaaaacagaggacatctcattattctaaggagcaacgtcagtgcctcagaagtccccagagggctccttggcttcctgtcattcccacagaaaacactctgctggagtctaagtttcccatccagcataagctgaactgtaaacatcatcaagacacgaaggacttggagatgtggatgagagaaagagctgaaaacactcatccttgagagagaatggacagaatcagcacctttcccctctggtctcctgagggacttatttcccatctcccagccccacatcaatgctgctgcccctggctttgtagtgacacagggtaggtgctgaattagaaaatcagcataaggactggcagagttttagctcacccagcagtgccacctcttccaagctgtgcacaaagcccctttccaccctttccagccgcaagacacaacccaagggaaagagactgcatctctgatgtcattcatgttatagagtgaggccagtaggcaggtgtctccaggtatgaatgcctaagtgagagcagcttacaaagaagacaacaggcttggaggctaaggtgagggggggaagtctgtatgtcagtcaggttctcatgcaacacaaacataaggactgggtttgaatttagtcagtgctggggtagattttaggattttagacctaccgttaaggcttgccagtggcatgggtgcaaggctttatttatttatttatttatttatttatttatttattttttattgtttttgagatggagtctagctttgtcatccaggctggagtgtattggcatgatctcagctcactgcaatcccacatcccaggttcaagtgattctcctacctcagcctcccaagtagctgggattacaagtgcccgccaccatgcccagctaatttttgtatttttagtagagacggggtttcactgtgttggccaggctggtcttgaactcctgacctcgtgatccgcccacctcagcctgccaaacagctgggattacaagcgtgagctaccgcgcctggccgggtgcaaggctttttaaaattagaatgtcattgctgtgtggccaggacacaaccccaaatgaagcatttatggggctggagaaagggccagagtatatctacacacagcttcactccttccactcctgacagtttgtgttgtaaatactttgtttgtgtttgaaatgttttaaagtacccttttagtgaactgaaattccaagaaacagtgtaaagctgtaaagatcttcacacacacacatgctggcaatgagaagaagtgtagagagatgatgggcaaaaaaaatttgagttctattgacggtctaacaataagaacagtgataacaataacaacaacgatttgttggctagtatgtgctagtcactgcactaagtagtttacttatttaattttataatcaccatagaggctaagtaccagtaataccattattttacagctgaataaacgggctcagagagagtaagtaacaaagaagagcagatttacggcccgtgacaagcaagtctagagccagaattcaaacacaggcaagccaactccatagcttacactttgcaccacggcgggaggggaagtgcaatggagacggcaaagcagcacccttgggtagacagattatgccgttgggaagcctgatgactgtgtgtgtcctgggagagcagccacttggatttccaggctcgctccctgacctgctgcaccctttctgctctccatctttgcaaacacgaagcagaggtctcctctaaaggaagttaatttctggactcaaaactctgactttcactaatttcatgatcatagccggagaaatgtgcacaagcgagggtcctcagagaggcagctcagaaaggtttgcagggaccctttaaaaagggtcttggggcacaacctctgggtgtgacatagacggattagcctacatttgggggcttctgggtcacatgcactaatgctctctctccctctctttttctgtgttcctccccttcctgtatttctctatttgaattttttctgttctttctctggtcctctgttgtttccttcttgttttctccctaaatgtcaatgtctgttgccatgtggtcttccttaatcttttcctctgtttttctttcttccccccctttttttttttcttttttgagatggagtctcactctgtcacccaggctggagtgcagtggcacgatttcggctcactgcaacctccacctcccaggttcaagcgattctcatgcctcagttttgcaggtagctgagattacagttgcctgcacctggcttatttttgtatttttagtagagacagggtttcaccatgttggccaggctggtcttgaactcctgacctcaagtgttccccctgcctcggcctcccaaagtgctgggattacaggcatgaaccaccatccccagccttctctcttcttaataatggctttctatgtctttcacttctctcataccctcactctgtttctccttgactctcccattcctgttttgttatctttctttattgccgtttctttctgcttttctgtttatcactcgctggctacttgcctttctctctctattctctgtctctgtccctgtttcttctgtttcaagttcaatggttctctgtctctatctctctgtttctgcctctccgtctgtcttttgtttctcttgcatgcagggccccatactgtggatcatggcaaatctgagccagccctccgaatttgtcctcttgggcttctcctcctttggtgagctgcaggcccttctgtatggccccttcctcatgctttatcttctcgccttcatgggaaacaccatcatcatagttatggtcatagctgacacccacctacatacacccatgtacttcttcctgggcaatttttccctgctggagatcttggtaaccatgactgcagtgcccaggatgctctcagacctgttggtcccccacaaagtcattaccttcactggctgcatggtccagttctacttccacttttccctggggtccacctccttcctcatcctgacagacatggcccttgatcgctttgtggccatctgccacccactgcgctatggcactctgatgagccgggctatgtgtgtccagctggctggggctgcctgggcagctcctttcctagccatggtacccactgtcctctcccgagctcatcttgattactgccatggcgacgtcatcaaccacttcttctgtgacaatgaacctctcctgcagttgtcatgctctgacactcgcctgttggaattctgggactttctgatggccttgacctttgtcctcagctccttcctggtgaccctcatctcctatggctacatagtgaccactgtgctgcggatcccctctgccagcagctgccagaaggctttctccacttgcgggtctcacctcacactggtcttcatcggctacagtagtaccatctttctgtatgtcaggcctggcaaagctcactctgtgcaagtcaggaaggtcgtggccttggtgacttcagttctcaccccctttctcaatccctttatccttaccttctgcaatcagacagttaaaacagtgctacaggggcagatgcagaggctgaaaggcctttgcaaggcacaatgatgagcccagggcccaggggaacctggcctgcctccattgagcagttctgtggggagggagacctccagcaagtgggaagaacactgctgagtttctttagtttttttccctctgagcaataactacagtgagccctgagtgctgcactgtctggcccaaagctcttatggaccaccatggaagagttccctacatcccctggcagccgtaagaactctgagagtagcccagagctttcagtaaagggaagtgcatgtgctttgcatttaaggaagagcagccaagaagtgctctatgatcaagaggtagtgtccaatcccagtatgtgtgcatgggtgtgtatgtgtgtacatatgtgtgtatgcgtgtgcatgttccgggtgtgcttctctatcacagtatgcactgctgctgagtgtatgcaccataagtgcttgggctacatgggatcaagagaagaagcaaaacttaccaaaaacaaactgattgtttttcaatgtgtgtgtgagtgttgggaggaggactgggtccttgtataattattcatccatttattcattcatttcttcaacattgagtaggctgtgtgtgtcaggcactgtaacaggtagagggtagaaaggtaaaaaaggcataaatggttcttaacctgacaaagctcttggcctaaggaaggaaaaagtgataaatagctgtttccagcacagtggggaacgtgcaacagtggattcacagacggtattatgagcacacaggggagcaacactgagaccaggaggaggctcagcgacggcttcctgacaagatgacacctgagtagcacattgactataaggtggacactgtgagagtgcaattcatcaggtacctttgcatcagagaaagatgaaacagagagaaattaaaacaagataaatctccgctagtgaggaattatgtggtttccagagaggaaatattcagagttttagaaagacaaaataaactttgctcctgtatgattagaaacattcatttgcctaaaggcaagggattgtaataaacctagtaagttcacttattcagtgattatatatcctattttacacacatacatattatattgtacattacataaaatatgaacattatattacattcacatacgtgtgggtataaaattcttgaaaatctattatgtcccatgctgcctttggagttaaacatcagctccactgtcctccctcctccaactatagcctgaaatttttaaaatcttccagttactttgacctcaggatcatggtgttcccttagcttttgcccatgcagaattttctaaagtagccccaatttaagttgttttgacacactgtttctgtaagtacactttaatttaccaaactccatatcccaatttgtgatatataaactacaaccaggagtttattcgtagctacacttacttgaaaacaataaaactactaatttatcacaaatgtcaagcatttaaaaaatccactatgtggaaatgaatgaggtaagctcatttggagcttgagagatgcagcttgcttaccaacccattggttctccttgtgacctcctcttaccccaagctaactccttcctaaacgaggcatccctttctctggctttctgaaagtgtctttctttcttgctgagataccccttagccaagtcggagggtcttttcacattcccagtttcagtttctggaccaaaattttgcttgttctttaattacataacagagcaatgattctgttgtttgcagttgctattgaatgaattgatgtttttttcctctgtttattctctgcttgctacctagaaaagtatttgtagagtaaatgaaagaaggatgagtaaattaagaataattctactaacaatatcttacttttgtatacttttcatactttatgaaccacttttacatatattttccatttggttttaccctcatagtaattcagttaaataaatattcactgatcacccatcatgagcaaaacactccactcagcagtggctgttaaagatgaaagaaatgaggagtctgacctcaaggggttccatgtactgagagaaatttaaaagtgtggttaatttcaataaggtgttttcctatagagtatgagagctcggaaggaaaatttctgattctgaaactgcagcaagcggtgttcccgacccgctttagcgggtaagggaaacatggctgagaggaagaatgagttggtcaaagaaattgcagaaccgacagcaggatctggttcttcaaacctttttttccatctccccatctttggaattttcttcttccatctgaattaaaagttgggttaattcaaagttggaacctccaggatctgaagctgctcagttttgcctcctctagacccttactgagcacatatctatcaagattctacaagtttgtagatttgtaatggcaacaattctagtaaccccttcctcacagtaattgcacatttagtatccatcacttgaaagaaacacatattggcagaaagcaagtatagattcaatgttacttttaaagatttgtgtttcaatatcaaaggcatagaagcaacctagatgcccatcaatggtggactggataaagaaaatgtggtacatatacactatggaatactatgcagccataaaaaagagtgagggcatgtcctttgcagcaactcagatggagctggaagccattttcctaagcaaattaagacagaaacaaaaaaccaaataccacatcttctcttataaatgggagctaaatattgagtatacatggacacaaagaagggtataatagacactggaacctactttaggatggagggagggaggagggtgaggattgaaaaactatcaggtattatgctgattacttgggtgacaaagctatctgtacaccaaacctcagcaacatgcaatttacccaggtaacaaacttgcacatgtaccccttgaacccagaataaaagttggaaagaaggaaaaaaagatttgtattttatttatcaccactgtttccacaaacatttgaaatagagcaaataatacctacacatgtaagatatttttattttgaataaatattttgattctgttcatatacaatgttaattatacagtggattcacagtccctttgctatgacatcattttccctgggaggtgagaacagttgatgtggttgtttgtctatgtaaggttgttggatgtagatgcacagatggcaacagcctttccacttcatagaagtggcttacactggaacctaatttcagggtggtaggagggcaaggttgctttcaatacccagaactaatttaagtgtgggcgaaatcatgacaggatttcgtgaaactaaaatgttttccctggccccaaatatcctcccacacacccttcatttgtctggcatcctagttctaaatggctaacccaagaatccattctcacacatgtatatcccagtgggaagccaaaaaaatggatttatttcttccagttgggaggattagagagcaagaaattgaaggtatgaaagtttttgaagaaggaagacaaaggcatataatcacttttcaaaggaaagtcaggcctgggtcttgcggtggttggtagcaacatcaagaccctgcacagatgggattttaggagtggtgaggtgtaaaaccctctgggtcaaactaagaaaatgtcagtgttgcctacagtggactagattcatatcaatctaattcactaattctttcagcactaggttttctgatgtacatatgttttttcaacaatgcctgacgggtactgaggaatggtggtcgtggctcagtggtctgatagtaaatgtttagccacctctctccatttgctgacttctagcatttgccaacttcctggtgtcaatattttcaccatgtccagttttaagctaccgagatgacatctgaagttggagttacggaaagatgccccaccatgcagccccatatagtatttccaccacactgagacaggtggcctaaataacctcaatctcatggacaaaagtaaaatatagcaaagtaattaggagttttgaatatgaatcacctttgtttttagcataacttatttgattttgagtttctgttatctaattttttttatcatgcctgtatttaattcctgccaatttaacggtcgatttccagacatttccatacgtcctctgaaatctaggcagaggttcccaaagctcaactcttgtcttctgccacatcacgtggaagctgccaatgcttggggtttgcaccctctgaagcaatgaactgagctgtaccttctttccttttagccatgactggagctggagtggctgggatgcagggcaccaagtcctgacgctgtgcagagcagcagggccctgggcctggcccattaactatttttccctcctaggcctctgggctgtgatgaaagaggctgctgtgaaggtctctgacgtgttctgtaaacattttccctattgccttggctactaacatttgggtcctcatctccatctgagaccacctcagcctggacttcattgtccatatcactatcagcattttggtcaaaatcattcaacaagtctctaggaacttccaaactttcccataccttcccatcttcttctgagccctccaaactgttccagcctctgccagttagccagttccaaagtcccttccacattctcaggagtcttgtagcaatgccccagtatgggttctccaggaggctccagaacatcactagcatcctacctctgggtttcccttagatcctgctccccagtcaatgctgcattgctgtcattctccttcccttgagttagacacctgccaagtcctatggaggtaaagctcatggaattgcccttataagggaacttatgaattattttatctgatagacacaggatcctccatatatgaggggacttggcttcttcactagcagctgggcagctcaccactcacacttgtgtttctgccacttccctcactcagtggacaattcacccagaagttcttgggttacccagccctgggggtgagtccaaaggactgtatatgaggcccttgtccttgtcatggaggaagttggctgtgatctaaggagaggggacatcacagatttccttccctctcctccacagacacagaaggcagatcccccattctctgcctcatccccatgcctcccttttgttggaggacccgaccaaaccagccttaaaggggtataacatgtgactaattcagctgctggcagagagggaaatcaagcatttcagaaaagctaagctctctgaacttacttaggtttttgcaaaattaaaggcaatacagtttcagtgctgaagataaatagcacctttggtgactacaatatgattgccctaggcaagcagagatttctacactgatgtacacactgaagtttgttgttatcaaatatgccctgttatttcagtgagtacagcatcttgcagaggacacttacgggtcccctggggggcttgggtctgattagtgatgatacccatggccagtctccagaaatccactcattaatctcgtctctttaggctttggttgtctacacaatataccattttatgcctatgttattttacacactcagttgcctctctcaggaattcacttttcctcttctcagcctataaaactgttctttggacctcaaaaagtcatttcagcttaactttcaacttaatcaaaagaaatggggcattccccaagagctttgccttcaggaactcagaggaagtcacactgaggtttgatataaggatttcttcttaagatttgaaccatgcagtgaagaaaggggcttcctcccacagctgggaatggtccatctctggacttggttcaatgtagttttgtctatgtgtggattctgagctccttatgttaggtgtcgtgccttatagatctttgtttttcctgtacctagaatatagtaggtgttcaataaatgctagctgtcattaatcatgaggtttatgtgaatttggaacatgagttagcacgataacctaaacatggaatgccatcttagttgatggtaagaaatgcagtcaacagagcaagaggaaaggtttcccactgcactacatctcagttagttgtccacactagtacgtcagtcagttccaagatgcacctaacaggaaccaaacaaagcaatgcagaaggcaagagttctagaaacggtttgatgcaacctcctatttgtaaacctgaatattttggaggggaatgcatagatatctttgcttacctgctagtctgcctgcataactgaaaaaggcagaactgggacaatgggtgaaggttagaggacgtcacattgaggtttgacataaggatttcttcttaaaatttagaaccatgcagtgaagaaaggggctgcctcccaccgctgggcatgctccatccctggacttggttcaagcagagtccctaagccagtctgatcagtgtgttgcagtggggatgcctgcactgagacagagggaggcaggcctgcatgacctacaaactcccttgcagttccatgaagctgtggtttacttacatcatgtcttaaacctgaggagccttttataacagctactttgatttggaactggaatcccaagattcctcccagcaagttgcaagatttttaaaaaattattttttcgtttctatctatccaggagtctcatttgccattgtgcacattgacatccctgccacattaagacaaatgtctggaaccaatatatctagacatctctaggtgacatccacatagaattctaacagtgagtcagaggctgggccattgattgaagtcactcaagaagcttaaagtcagactaggatgagagtcttcagggtcttcatcctggttactactgtctccggaaatgggacctgggataaaggtcactaaggaatgatggatccaacaatagcaaatgtgtccccaaattccctcttccaatgcccttcacgttgttgagattggaacaaggcctttcttatacaatttattgtttgaaaactctaccagcaaattgtctagctcagcgttactcagatattaacgtgcataggaatcacccggggatctgcaaaaatgcagattctgatttaggaggtctcaggtggggcctgagattctgcatctccaataagctcccaggagatgccagtgctgtttcaagcatcacactttgaagagcaaagaaccacaggcaaggctgtggggcaggtcaggctgcatgatgctggattccatggggtgattgctatgaaggcccaaagctagtcagaccgtccccaaaactgaccagagaccccacttccaaggaaatcctatgaaaaacaggagatagcccgctataggctattgattatttttagttttttaagagggggaatgtgcagagaagagcgagtagcaggaaggagtccctggggaggacactgagtgactcctgtgctgattattttaggaggagaagctgaggaaaagtatctgcatctcagaaggagataattactttccacttagctcttcagtttttcaggaagtttgcaaggagggcaagtaattagtctcttgggaggtgaaagagacaagttctcaggatgaaaaacttttccctgctggtctttacagcagaatcagaagtatctgcccacttttggcaaggcccacaaatgcaaaaatgtactgtgggggttgaaaaagaaaaagagctatgttagagatcaagctaaatggcagagacagtaagacagtggtgcctccaagctctgtgtcctggaaggcttcccctgaaaccattcttcatagtcttggccctgtggggtggctcccacactgtgacaccacactgcaagttatgagcagggcctctcctctagggatcctgtggacagaaccagcttcagaaatgagaggaagtttgcatctactctttgccccgctttgctaatcctagcccagcccagctgagactcagtctagtaaaagaaaccagacccggatctcttcctgcccctaccatcttcccatgacttctcacgccatccagatttccgaggaatgcctctcttatcagccctcccaccacgttacctacaacaccagtcccactccgtttactccttctcatctgatttctaccacctttgcttctaccatccaggggccctggtaatctggccaggctgctctcaggaaacccagcctcagaaggcctgggcaactggtccttcttctggaacttggatctaagattctgcagtagaagggaagtagtggccccacgggaaggggaaggcagcaagtctgagagtgcagacgcagctcagctttcccccactctcaagtgcatgaaaaaggtaaggtcttcatgactttctataagagggttggaggagtggctcccagagagccatttctgtggaaaggcaagaggctttggggccagatggaagaagtgggcagcctgggtgtgaggggtgcttccatccaggagcggtcaggccgagagaggggagccaacagaagcacatggctcctcctgtgttggggtgccaggcctctctgctcttcttagagcacctcccattttcagaactctatcatagaccttgaagccaggtcctgaaaaggaaacacatccaaaataaaggaaacttaaaagaatgcaagcaaaaccacagagctaagaaagaaaggttttaataggacattttaataatagctacatttactgagctcttacttaatgtgccagaccctgcactaagagccttatttgtttggattatctcttttaattaagaccgtcccattgtactcactctgcattccctatccattccttaactatcccaggtgcacagaaacttgcctttgagacattctaccaatgtgtgtccattagttctctgcagtgcaggagaagaaacttgcatgaagatgagggaccaggagaaaatgagaaaaaagagagtgaggagctccagcttaggcatgtgggtgcccacctgcagcaagtctactcctcgtgacttgtcaggtgctctctagccctgtcaagggctcaccctctcacctacaggctgctgggtctccaaggaagatccttttagtcacatcctcaatgacctccttgaccttctcattccggaaggtgaagatgaaggggttgaggaaaggggttaccattgcagtcaccatggccaccgccttgttgaggtatgtggagtggcccttgcctggcctcacgtagatgaagatggcactgccatagcccagaaccaccactgtgaggtgagaggcacaggtggagaaggccttctggcatccagaggaggaagggatgtgcagcactgcagccacaatgaggatgtaggagaggatgataagcagcatggtggtcagcacaaagagcagggacaggaagaggtccatgcgctcaatgtggcgggtgtcagagcaggcaagcttgagcagcggggcagagtcacagaagtagtggccgatgatgttagggccacagaaccagagtcgtgttttctgcagtgtgggagagacaatggagaggaaaccaaccacccaacaggccaccaccagcttcacacacactggaccattcgtgatggttgggtagcgcagggggtggcagatggccacgtagcgatcaaaggccatgaccatgagtatcaggaagttggcagagcccagggagaagtaaaagaaagactgggttaggcatttggccagggacatggtcttgtgagtggatagcaggtctgccagcatcctatgtaccacagtggaggtgaccaccatctccatgagggagaagttgcagaggaagaagtacatgggtgagtgaaggcgggaatcaaggcaaatgaagctgatgatggccaggttgcccagcagcatcagcacatatatcaacaggatcagagcaaacagcagaacctggaactcatggagataagaaaatccaaggagctcctctgcctaggaaaaccagagacctttgttcacttgtttatctgctgaccttccctccactattgtcctatgaccctgccaaatccccctccacgagaaacacccaagaatgatcaattaaaaaaaaaaaaaaaaaagaaaatcccaggagcacaaactccctgacaatgctgtagttacccattgcacttgatgcccattctatgtgacacctgtgagaggttgagaactgttagcaggagattgccatcaacctctctctcaatcaggtccccatagtgctggcctggctccccatgcacactagcctgtgtgcacagttgaccccaggagacacattcccaaaaggcaggagtttccctggggcgaggaatggattactggctgggatgagcagatttatgacttggccacctctacattatcaccattcttaagctcttcctcttctgtcttctactcattgattatattgtacaacacacttaataagctccaactctgtgcaagacatttggctgggtctgaggatgaaggggtaaacacttcctaactgccaaatgtaatggtctgttgttcaaataatagctgatatttactgttctttccctgtgccagaagatgcgctagataccttacacattatttccttccatcttttttgctgaatcttcatcctcttttcttctctataacattttcttctctataacatttcaggctacaaataacccgtttttgaagtgacttccacccttgactgcaaggaccctgcactcttgaatttctcctaccatcctgggttccctcgtctgtctccttctctagctccctgtctttctgccattttctaaacatggatgaccccacatttcttttcttatctttgtttaaaaaaattctctattttctccttcagaaatctcaccttctttaaccaaagcaatctttaaaatgtaaatgaatttcaaatctggattttgtcctcctctgagtcccggcccacatctctaaccaccagattgaccaccaccacacattcaacacatctaaagatacacacctagtcctcccctcccgcaaaggccatgtttatggctcccaattccccagtcatctgggctggaaactggaagcatctagccctcctttgtttatccatatccaccaccctagttcaaggatctgtttcctcttaaccattgcaacaacactcttaattttttttttattggtagattgctcaatcaccaacctatccaggcaccatgctgctattatattttattttcttaagttattgtgtcaatcaactgtttttaataatctgtaacaaggccgggcatggtggctcacgcctgtaatcccagcactttgggaggctgagggcgggtggatcatctgaggtcgggagttcgagaccatcgtggccaacatggagaaaccccatctctactaaaaatacaaaattagccgagtgtggtggtgtgtgcctgtaatcccagctacccaggaggctgaggcagaagaatcgcttgaatctaggaggtggaggttgcagtgagctgagatcatgccattgcactccagcctgggcaacaagagcaacactctatctcaaaaataaataaataaataaaaataacctgtaacaatgagatttcatttataattactttcaaaatcaatcaaactagctagccatctatcttcatccagaaaaagagtaaaaggatgcattttaaaatattaacaatggctatatctgggtgtgggttataggagtttacttttaaaaatcttgtattgaaattatacatatttaaactgttgtattagtctgttctcacgctgctataaggacacacccaagactgggtaatttataaagaaaagaggtttaattgactgacagtttggcatggctggggaggcttcaggaaacctatgatcatggccgaagggggagcaaacacgtccttcttcacatggcagcagcaaggagaagtgcagagcacaggagtgaaaaagccccttataaaactatcagatctcgtgagaacttactctctatcacgagaacagcatggaggtaaccacccccatgagtcaattacctcccactgggtccctcccacaacatgtggggattatgggaactacaattcaagatgagatttgcgtggggacacagccaaaccatatgaaatgtatatcatgaggtttggatagaaatatacatagtaaacttattacgacagtcaagctaattaatatatccatctcttcatatagttaccatttttcacatgtagtgagatgacctaagatctaccctcttagcaaatgtcaagtatacaatacagtatcattacctgtaatccccatgctgaacattagttcgctagaacttattcttcctgcccaactgaaaccttgtaccctctgttcttctatatgtccacattcatttccaaattctcttcatttaaatttgaattctcttcatatattattttagtgataaaaaaattaacaacaataatctcttcctttttcagtcaaatcaagcacagattctccctggcaactcctgccctacatgactctccccattcaccaccccccatagcttcacccccacctccttgtcacacactttgtgataccactgaactgaacccttgatattctccataagttaattccactttgccttcacacacttccctttttattcctgtgcttagaatactttgttctgccatctttgcctggcaaattcttaatcacccaccagggactatctcaaatgtcccctcctttatgaagcttcatcctcatccagatgtgaagtcatcctgcctggagttcccaatcaggaaagttaacaagatctgccttgcattataattgtgtacagtcagattccaaatcctggattcctagtttctcagtgtcagggctcttttttcatctttataaccttcagaataccaagcaacatgtcttacacagtgtaactactcattacattttggttaaacaggccaggtgcaatgtctcacacctgtaatcccagcactttgggaggcagatgtgggaggactgcctgaggccaggagttcgagacccagactgggcaacatagagagaccctatcactacaaaaaataaaaaagttagcctggtgtggtgccgaatgcctgtagtctgagctacttgggaggctgaagtgggaggatcacttgggcccaggaggtggaggctgcagtaaactgtgattacaacactgcactacagcctgggccacagaggaagatgctctctcaaaataataacaattttggttaaaccaatgagcacacatgttgggttttcatttctagtcctgagaaggaaagttttgccaaatggaaactcacattttctttaatgatgatgtgtatgtgtaatgtggactttaacaaaatgtaatggggcaatcacgaccccacaatttcttatcagaaagctaaaatgagaccaataccagcaaggcagcatcctggaatcaagcacactattatttctgtagcaaagtacacaaatattcacactcaatgaaataaaggcagaaatggcctcatgtttagttcaaaacaagttaagccgtctaagtgctttgactcaacatttaagaaagaactttcagcattcaaagcattttgattatagaattgtggataaagggttgggaatggctagaccccatccactgagggcccaccatgcactggctcccgtgccacaatgatgctgtgaaatcgttaccaacttcatatcatagatgataaaaactgaggcttggaacgtttaaggatcttaatccttatggtcaataaatgttgagttaggtcaataaatgttgagttaggatttgaatctagagttttctaactccaatatctatttgtttgtagtaatcaaaacttcaagtatgtgaaatctgcagtgttgaatcaagcacagtgccatatcaatctctgaacacaggactcaaagcttattgcttatatctatgaataaaaatgcttatatctacaaaaaaactatttaatgcatggcaaatgaatgaatgcattaaagtcccactatcagctatggactatcagtgataggtaggagatggggagggtgtccctttcccagcagaaagatctaacttgagtctcaaatgctattgcaagactggttagcggtgctccaaacagggtcagtcctcagccctccatctcttattgggaatccatgacaatccagaaatccaggaagctgctgttcctccaattaccacttcccagactgtgacctcacccttttcagcccccatattgatgtccttcatattcttcaggtgtcataaattcctaagccagaatgagaaattcaacccatgggcctattttgtgtttcatttgccacctgccactcagaaagcaacatctttctaccaggtttcagagacatcatgttttgaggctctccaatctaaaacatctcaagtcttggaatcagaggtcaaatggggattctaagataaactttgagtcaggagtaccccagttcatgcggcaggcttagcttcataccacatcgctggcatccttttcaaactggcctccaccacagcccccatttttgtgcccttgcccttcacccctcatcccaaaccctcttgcatttatcttcccaacctctgtccagacacttaaacttttaacacttagtttgttttttccctgttcaagatctcacctctcctctcaggtttgatgactgatgctcctttcttcatacaaaattcatgccagtcacttcttcatgaggcttcaagactctgagtcacaatacgccccccgaccccttccaattcagcaagcctgcaactcagggcaagtccctggagtatgtcttaggacttttcgtgcttgttcaataattttacattccaagtttttattttagaaaactgattgttagttacaagtgaagttaacataagcaaagtgtaacttgaatgtcgaatagacttttttctgcatcagagtctttgatagaatatgtttccctcagtgcagcctctctttgctatagaacagatctctctcaggcccaggagtcctgcattcctgagattcaggcaaactcaacttgtccaaccagtagaccatccagtgctcaatcaaaacaggccaagcacagcctgttgacagtggcctagtcaaggctgtgtttagctatttagcatatgctttggacagcatcccacgttaactgtacttgcagcctggactccccagagtgccctcagctcccctcactcattcctgttaaggatccttgctgagaagagatcctgtttatctttctaagtccttcatgctgcaggttttgcagttcacagctctgttaaaatgccaactagcggagagcttccacatccccatataatataataatcctccagagacttggaggatttgaatgttctctcctgatggtgtatctttctccctctccatattaactctctcaatcctcctaactgaattatccttgtgcattttgactcttgaaacaatgtttctgctccagaaaaatgactgtttttcacccaccgggaatgcagagggggtagcagtactgtcaccctggttctttgtggcagtaatttccatcatcagtgtcctgggggcatgctgagctctttactgagggaaagagcagggtgaggaatgagaaagaggagagagcaaggaaagtacctgaacacccctcacttttggcaggtctttgcaaggggcaggtggccaggggaggacatagaggtgaacagcaccctggggctagcaggccagctaacagcaagaattaaaagcaatgaatgatgcaaaagcaccatgcactaagcagagaaaggtctagggaggctcaaatagaaaaagagacaccgcaggactagacctaggctgagctttcccagccccagcctcaggaagggacaaaagaagtgggtgggacagagatccttggcttcttccccagggggaggacaaaatgggaccaatgcagaggatgcagtcctgtcatgatgaaatgtaatgctgcacctgatgtcagcagtagcacagtgaacaggaggaaatagcaactgaatcattcgttcacttactcactcattcattcagaaagtcatggacaataccaaatactgctggtgttctaggaatccagtgctaaaaacagtcctgggttttgccatccaattgcaaaaaaagacagcaagtaagtttaaaacaacaaactgtgataggtgcaatgaaaggggcatgacagaaagggaaggaaggggagggggactcaccagtgccaggtcacatcctgccacccaggtccaaatgcaggacctggagctcagaccctgtggacaacagggccagtgcaacgggttgaatggggcaaagaggttcctctcagactccctgcaggcacagtcccaaatctgggtcctctggggcagcccacaggaaagagcaacaacgcgaccccagaatggagatgctccactctgcctggtgtgctctctttacctctttcctcccgctattcaggaactcccagtgggagacctggaactgaaagggattcagaaagatcgaagtttcccaccctcttcagtgctgatggtgtgccccagcagggtctggaataggaacatgatggttgttcccagtgagcagttgcttctactagggacttggccacatcccaggaccatcctcagtttggggaatgtgagctcctgggagcaggcagcaactgtgagtccacaggggcctcctaggaactgtgactgctctgtctcacactctcctgtctcctgtgggcacaaagctcagtgcagccctggcagccctgggatttgcaagctggagtgaggagaagagggagaagaaacagggagttgggcaccgactgttttagacgcaggcaattcaggaacaaagaaaatgagcaaagaattgttacctctggccacccaggagggaaaaaaaaataggtccactgtcttgttgttttctcataaatgaaaaataagaggaataccaaagtagaaaaacacatctatttttagaaaaacgaaatggccagggcctcagcattaagatactgggtgaaccaaaatgagaaatcagggatctgtttacaattataaaatggaaaatatacatatatatacacacacacacacacacacacatatatgtatatatatgcacatacataaagggaatatgtgtgtgtataaatgacaaaaatatttgttgtcaatttgtaattctgtatatcagctatgaaaaatttttaatatgacattgggacacttcaataaacatagaattttgtatctctctctctctctcttttttttttttttttgagacggagtctcgctctgtcgcccaggctggagcacagtggtgcgatctcggctcactgcaagctctgcctcccgggttcatgccattctcttgcctcagcctcccgagtagctgggactataggcgcccaccaccacgcctggctaattttttgtattttttagtagagacggggtttcaccgtgttggccaggatggtctccatctcctgaactcgtgatctgcccacctctgcctcccaaagtgctgggattacaggtgtgagccaccgtgcctggcccggaatcttgtatctctttgtcaccaagaccagcttccctgacttctccacccacccaaggatgtgcatcacctctagtgccaaggactcaagaaatgacatagtccttttcctttgtcccttgctgtacttcatggcaataacagctatatcacgtgttcctgcagacattgtctcatttgatcttctcaacaaccctgtgaagcagccgttatgggtgtcttcattccaccactgacggtacaaaggaagccttgctccagggcatgcacctagtaagtggtgtctgggtttgaactccaaggagcagagtacaggtgatcttcagcttgggcactttagacttttacacatgaccttgcataccccctacactgacattttctcattcgcctttcacattttcatatatttgctgatcaaggagcatttcaaatatcacatatagcatctcctgccctaatggttcaagtttgtctgttcaattgtctaacaattttaactgaaaacactaacaagtgaaaatgaaaacttgtcttgttgaacttctatttgcataatgcattttcatggggatgttgtcaaaacaataacaaacaaacaagcaaacaaacacagtacatctgtctcaaagattgagcccaggctagagtttcatgatcgtgcacctaagcttcagaagaaggggtctgaggcagaattgaaaggaaatacaacagtcgtgcttctgtgagatatgtctttttttctagacttctcatcctttccccaaatatatgggaaatatgtttgccccgctggagcttcaaatctctgctcgggttcacattaaatttggtggtgggcacaaccatcaccaccttaatgtttaaatggccaaatatagcaacaatggagaggggctttgaacccccaaatcattttaagtagttttgtaacatattttatatgtatctagaagctgtgagtgacccatctgagacaaaaaaaaaaaaaagtggagatagagactgaggtaagatggaggaagcagggtcgtggggattgtttaaagaaagtgagtttaggcagggcacactggctcacgcctataatcccaacacttagggaggccaaggtgggtggatcacaaggtcaggagttcgagaccagtctggccaatatgatgaaaccctgtctgtactaaaaataccaaaaaataaataaataattaattaaaattagcctggtgtggtggcaggaacctgtagttccagctactcaggaggctgaggcaggagaattgcttgaactcggagggtggagttgcagtgaactggcgatgctggctcttttttggttccatatgaactttaaagtagttttttccaattctgtgaagaaagtcattggtagctgatggggatggcattgaatctataaattaccttgggcagtatggccaagaaaaaaacaaacaaccccatcaaaaaatgagtgaaggatatgaacagacacttctcaaaagaagacatttatgcagccaaaagacacatgagaaaatgctcatcatcactggccatcagaaaaatgcaaatcaaaaccacaatgagataccatctcacaccagttagaatggcgatcattaaaaagtcaggaaacaacaggtgctggataggatgtggagaaataggaacacttttacactgttggtggaactgtaaactagttcaaccattgtggaagtcagtgtggcgattcctcagggatctagaactagaaataccatttgacccagcaatcccattactgggtatacacccaaaggattataaatcatgctgctataaagacacatgcacatgtatgtttattgcagcactattcacaatagcaaagacttggaacaaatccaaatgtccaacaatgatagactggattaagaaaatgtggcacatatacaccatggaatactatgcagccataaaaaatgatgagttcgtgtcctttgtagggacatggatgaagctggaaaccatcattctcagaaaactatcgcaaggacaaaaaaccaaacactgcatgttctcactcataggtgggaattgaacaatgagaacacatggacacaggaaggggaacatcacacaccggggactgttgtggggtggggggagtggggagggatagcattaggagacatacctaatgttaaatgacaagttactgggtgcagcacaccaacatggcacatgtatacatatgtaactaacctgcacgttgtgcacatgtaccctaaaacttaaagtataattaaaaaaaaagaaattgacaaagaagtaaacagccaataaacaagaaaaaatacaaacagttagtaatcaatgaaatgcaaatgaaaacagcaatgatatactattatttatctattatattagtttctgtaaaaggtatttgtcaaagttctggaaaacaagcaattttgtgatcttcgttggagccctattatacagtcattcaccacatttcagtcaacaatagactgactgtgatcctatgagattacaatggagctgaaaaattcctattacctagtgatgtcacagtgcaatgaattactctcatgcttgtggtgatgctggtgtaagcaaacctactgcactgccagttgtataaaaatatagcacagacaagtatgtacagtacgcaatacttgataatgataataaacgactgttattggtttaaaaaaaaacagaagaggagaattttgtgataagggtttttagtaaatatgttaaataagaaattactggggaaaattactcaccactttcagatccaattctggaaaggttgtattatgttcattaacccttttctgggtgtatgagaaaacagaaagttcaaaaactcaggtccatttgatctttaagaatgtattcaattaagaaatatctattcagcaattgctatggactgggaactatactaggtactagtaaaaaaaaatataaatgacatataacctctgtcctcaaggagctcaaaatctagtaaagaagacaagtaaacagaaaattacatttaatgtgtaaagaaataaagaaagatatggagcaaaatcctgtgaaagtaaagaatgtgcaaagagtgggttgtcctttgttctggggaagccaggtgggagtgacatgcatactgttcttttaaaaggagtaggtgtttgagtgacagagaggagaataaagtgcatttgaggcaggcttaatgatatgagagaaaacagcatcttcaaggagctttgacttcctcacttatggttctaaatcagagtttccattagagttctgattgaaatgtaatctgggaaaagacttcagaaaggtcaggaatcaaggtgtcttgggactggccgtcttcctctctgtgctcccctactcccacccccatcactcttttgtttctccggctactcttttgtcctcttccctcttttgaccaatctcctctgagtccctattacgtgatacatctgcatagccatagactcatcacgactaccttgtcccaactcattctaaactttcaggtcaaatatccaccaatgcctttgagtttcccttcaaattcctgagggagaaatctaattggtccaccttatagttttcagacatgtccacggaacatcataaagtttcacatggtaaccctaacatatcatatcaacaaaggagacataatgaccattgaaaaagtcactatttcacttttaatatctaggtatctagttgagtattctagattcatattttcagaatgagatgatccacaatttcagtgttttgcaaccctggatgcacattacaaccactcctgggagtttttgaacacccagacaacatgcccagaaattctgatataattaattggtctggggtgagacttcccaggtgactgtaatgtgcagacacatcaagaaccatgaagactatctcttagtgtgtaacctaagaagcgatgatcagcttccctgacaccagtgactaatgaagtccttccagctttggtcaacagcattcgccatatagccagagagtctctgacatcatactcagctgatccccctataccttaggtatattttgccggaaacaaatgggagcttttttgaaggaaaaatgtgtattccctcccttcagaaatgcaggcattccagtttataaaataggggatgaacaaatggagaaggtgggatgctgaatgatgggctaacttctcactggaatctctgaattctattaactggtggtgacagtagctacatggcttatggagtgattctggtgtagctgaccttgacagatagtattctccttcccagtgacccctactgggatttctatctctttggttcagagccagttcattcaatgctcagtgaggggcatcttttcactttattttgttttagctcctaatgtggtcagaagactagaggggcaggtagtcacctcttcatctagatcatctgcctggctggaaaattactaggaatggggggttatgtttcacagtgtgcccccttcaagagtgagggtagcccagtcctgcccaggctattccaggactagcaatcacaaggttaactttctgtcccaaagatccatgtccctgaatcatccaaaaacaacactgtgaaactagcccaatgtcatcagttatttatcccaagatttattggcatggacctgcagccggatatttatcctcggctaggacttctaaggacaaggtatgagaataaagcaaagcagcagacaagcagctctcagaaggctcacattctgagtacccatatctcagaactcccagatccatgtgcagaaagacactatcttatattagaaacaccaatacacagacatatactcatgtatatcagactgtggtcaccattacccagcttacatgtgagttcacacacacttgtatacacacataattccccatccccttcccaatagctcattatcaatactaacacgtatttgtgtcagagcggaaataaattcccactgcctgaatctgtgttcactttcatgatgaacaactagacctttctacttctcctcttctttcattaccttagacatcactctagagatgacacaccagggataaggcacttttgcccatggagaaggaactgtgcttcttttggaggatgagctggccctatggcttttctgtctgcctagtgggaagcgggtgctccccatctgaagtagaagagcccagaggtgaatctgcacagtgaaggcaggaagcagggcacagacattttgacaatgaagaagctttttctcaaattctcatccctgctactatagaaacattagctagcctggagggctgagaatggttagccattccttctcactcttctctttcatattgctctaccttccagaggtcatctcatctcagaggttgtgcctctgcctccaagaactggtggtcaccacagtgatggcatgcacactctcctgttctctcacccctctctaaggccatgtatcatcagtcatatgccaatgcctggaggctacagctggaccatttccaggttaattccaatgtgaggttctgtaggacttgaaaaataacttgaaataaccttctgttttccccagagcctacataagttgtatagtttgggtcaggccatgtctcctattttctgtcttctacaactggttacctatagtttgtccagaggtctcagctagagggagagagaaaacatcccatgctcataaattgggataattaatatcattaaaataaccatattgcccaaagcaatttaaggacctaatgtaatccttatcaaaataccaacatcatttttcacagaattagaaaaaaatcttaaaattcatggaaaaaaatgagcccaaatcaccaaagcaatcctaaacatgaagaacaaagctggaggtatgacatttcctgacctcaaattatatgacaagggagtaaaaaatgttgggtaggaggaaggactaaattgcagctcccacttggatggacaaaacagcatgtggagactcatactgtggacttttgctccaagaactactgtaggaatatatcaggaaggccaagagaatacacagaccctttgaagggaacaaattgatcctgcaggacccaggagacagcccagattctgtgagtgtccaaactgtgaaagtgggaaagggggattgtccaccccaaacacataacctcactggggaacctgaaggtcccaatcatgggagaaggattagaccttacctggatctgagacaatttacagaactgagtgaaatacagggatggatgaaacagcaggaaaagccctgtgggctctctgggtccccagggaagtcatttctgacttgtttcaagtggtccttggggagggctgccagaggaactgggaaaagaccacagggagaaagaaacctccaggtgaactttttaacaattccaactgaatgcaaagtttcctggccagacctcgaggaagggtgtgaatctggtatgcagacttaacaggcagggaggcatgaaagccctacttgctttctcagccaggaggctggtagcttagggcaagttctcagccctactcgcccactgactggaaacaaatttggcactgttgagggggcatggtgggagtgagactggccttttgggttgcatgagagctgggtgaggcctgtaactgccgcctttcccccacttcctgataacctgcatgacacagcagaggcagccataatcctcctggaaacaactccattgacctgggaagcacatcccatcccccacagcagccagagcaagccctgcccaaggtgagtctgagctcagaaacgcctaatgctgctcccacctgatggtccttccctacccatcttattggctgaagacaaagtttatattctcttgggagttctagggccctgcccaccacctgatcctcctctatactaccacagctgatgctctcttgaaagcatcacctcctggcaggaggcacaaaactagtgcattaaataactacaactaaggatccttacagatcctgtccatttcactctcctgccacctccattggagcaggtgctggtatccatggctgagagacctaaagatggttcacaccagagaattctgtgcagacactccccacaccaccaccacccagtattagcctggagactgtcagccctgctgggtggctagatctagaagagaaataacaatcactgcagtttggctctccagaaaccatatccctaggaaaagggagagagtactacatcaagagatcaccccgttgaacaaaataatctgaacagcagccttgacccccagatcttccctctgacatagcctactcaaatgagaagaaaccagaaagacaattctggtaatatgacaaaacaagattctttaacatgcccaaaaaaaatcacactagctcaccagcaatggattcaacccaagaagaaatccctgaattgccagaaaaagaatttagaaggtcaattattaagttaatcaaggaggcaccagagaaaggtgaagtccaactttaggaaattaaaaaaaatgatactagacatgagggagaaatcttcagtgaaacagattgcataaattaaaaacaatcacaacttcaggaaataaaggacacacttagagaaatgcaaaatgtactggaaagtctcagcaatagaatcaaacaagcataagaaagaacctcagagctcagagacaaggtttttgaaataactcaatccaacaaagacaaagaaaaaagaattttaaaaaatacacaaaacctctaagaagtctgggattatgttaaatgacaaaatgaccaaacctaaggataattggcattcctgaggaataagagaagtctaaaagtttggaaaacatatttgggggaataataaaggaaaacttccccagccttgcaagagatctagacatctaaatacaagaagctcaaagaacacctggaaaatttatcacaaaaagatcatcacctaggcacatagtcatcaggttatataaagtcaagacaaaggaaataatcttaaaagctatgaggcaaaagcatcaggtaacctataaaggaaaacctatcaaattaacagcagatttctcagaagaaaccctacaagttaaaagggattagggctctatcttcagcctccttaaacaaaacaatcatcagtcaagaattttgtatccagtgaaactaagcttcattaatgaaggaaagatacagtctttttgagacaaacaaaaagactgagagaatttgcccctaccatgccagcaccacaagaacagctaaaggagctctaaatcttgaaacaactcctggaaacaaatcaaaacggaacccgtttaaagtatgaatctcacatgacctataaaaaataagcaattaaaaaaaaggtattcaggaaacaaatagcaaaatgaatggaatagtacctcacatctcaatactaacattgaatgtaaatggcctaaatgttccacttaaaatatacagaattgcaaaatggataagaattcaacaaccatctgctgccttcaagagactcacctaacacgtaaggtctcacataaacttaaggtaaaaggatggaaaaagacatttcatgcaaatagacaccaaaagtgagcaggagtagctattcttatatcagacaaaacaaattttaaagcaacagcagttaaaaaagataaggagggacattacacaatgataaaaggccttgtccaaccagaaaatatcacaatcctaaatatgtatgtgcctaacactggagctcccatatttataaaacaattactactagacctaagaaattagagaaagcaacacagtaatagtgaggaacttcaatactccactgacagcactagacaagcatcaagacagagagtaaacaaaaaaaaacagtggatttaaaccataccctggaacaaatggacttaacagatatttacagaacattctacccaacaaccacagattgtacattctactcatcagtgcatggaactttctccaagatacaccctatgataggccacaaaacaagtctcaataaatttaagaaaactgaaattatatcaagtcctttctcagactacagtggaaagaaattggaaattaactccaaaaggaaccttcaaaaccatgcaaatacatggaaattaaataacctgctcctggctggccacagtggctcatgcctataatcccagcactttgggaggcctaggtggatggatcacctgaggtctggagttcaagaccagtctggccaacatgccaaaaccccatctctactaaaaatacaaaaatcagccaggcatggtggcacatgcctgtaatcccagctatttgggaggctgaggcaggagaattgcttgaacctgggaggcagaggttgcagtgagccgagatcacaccactgcactccagcatgggtgacagaatgagactcagcctccaaaataaatatgtaaataaatgaataaataaataacctgctcctgaatgaccattggatcaataatcaaatcaagatggaaattaaaacattctttgaactgaatgataatagtgacacaacctatcaaaacctctgagatacagcaaaagtagtgctaagaggaaagttcatagccttaaatgcctacatcaaaaattctgaaggagcacaaatagacaatctaaggtcacacctcaaggaactagagaaacaatgacaaaccaaacccaaacccagcagatgaaatgaaataacaaagatcagagcagaactaaatgaaatggaaacaaacaaacaaacaaacaaaagataaatgaaacaaaaagctggttctttgaaaagataaataaaattaatagatcattagcaagattaaccaaaaaaagaagagagaaaatccaaataatctcattaagacatgaaattacaagtagcaccacagaaatacaaaaaaaaataattaaggctaatatgaacacatttacacacataaactagaaaacctagaggagatggacaaattcctggaaagatacaaccctcctaccttgaatcaggaagaattggaaaccctgaaaagaccaataacaagcaatgagattgaaatggtaataaaaaaaattaccaacaaaaaaatgtcaaggaccagacaaattcacagctgaattctatcacacattcaaagaagaattggtaccaatcctattgacactattccacaagacagagaaagagggaattccccctaaatcatttgatgaagccagtatcatcctaataccagaaccaggaaaggacacaacaaataaagagaactacagaccaatttccctgatgaagatagatgctaaaatccttaacaaaatactagctaactgaatccaatagcatatcaaaaagataattcaccatgatcaagtgggttttataccaggaatgcagggaaggtttaacatatgcaagtcaataaatgtgatacaccacataaacagaattaaaaacaaaaaatcatgtgatcatctcaatagatgcagaaaaagcatttgacaaaatctagcatctcgttgtaattaaaacccttagcaaaattggcatacaagtgacatactgcaatataataaaagctatctatgacaaacccatagccaacataataatactgaacggggaaaagttgaaagcattctctctgagaactggaacaagaaaaggatgcccactctcaccacttctattcaacatggtactagaagtcctagccagagcaatcagacaggggaaagaaataaagagcatccaaatcagtaaagaggaagtcaaactgtcactgtttgctgattatatgattgtatacctagaaaaccctaaacactcttccaaaaagctcctagaattcagcaaggtttcaggatacaaaattaatgtacacaaatcagtagctctgctatacaccagcagtgaccaaactgagaatcaaatcaagaactcaaccccttttacaatacctgaaaaaaaataaagtaaaatacttaggaatatacctaaccaaggaggtgaaagaactctacaatgaaaacttcaaaacactgctgaaagaaatcagagatgacacaaacaaaaggaaacacatcccatgctcatggatggatagaatcagtattgggaaaatgaccatactgccaaaagcgatctacaaattcatgcaatccccatcataataccaccgtcattcttcacagaactagaaaaaacatttttaaaattcatatggaaacaaaaaagagcccacatagccaaagcaagactaagcaaaacgaacaaatctggaggcaccacattacctaacttcaaactataaggccatagtgactgaaacagcatggtactggtacaaaaatgggcatatagaccagtggaacagaatagagaacccagaaataaacccaaatacttacagccaactgatctttgacaaagcaaacaaaaacataaagtgagaaaggacaccttactcaaaaaatggtgctgggataattggctagccacatgtaggagaatgaaactggatcctcttctctcaccttatacaaaaatcaactcaaggtggatcaaggacttaaatctaagactgaaactataaaaattctagaagataacattagaaaaacccttgtagacattggcttaggcaagggtttcatgaccaagaacccaaaagcaaatgcaacataaacagagataaataggtaggacttaattaaactaaagagtttcatgtttatagcagcacaattcgcacaattcgcaattgcaaaagtatggaaccggtccaaatgcctatcaatcaatgagtggataaagaaattgtggtgtatatatatatatatatatatatatatatatgtgtgtgtgtgtgtgtatatataattgtggtatatatatataatatgtatataattgtggtatatatatatatatatatatatatatatatatatatatatataaatactattcagccataaaaggaatgaattaatggcattgcagcaacctggatggaagtgaagactattattctaagtgaagtaatttaggaatggaaaaccaaacatcatatgttctcctaagtgggagctaagctgaggatgcaaaggcttaagaatgatacagtgaataaaatttttatgataatgatgatatagtcgctgactactcttttaattaaaatagtaataatctggagagagatgaagaggacaagtggagcccaagagagtcagatccacagctattataacataaagtgaatagaaaacatctataattgataaatcaattaacagaagtataagctcttcattaagaggtgtggaaataattatgagggaagacaaaagtggtgttctctgtgaaataggaactatatatgtgagacagagaaggatgtgggctactgttttttagtacaggcctttcagtactgtttgctcacggcaacctccacttcccaggttcaagagattctcctgcctcagcctcctgagtagctgggattacaggcgcatgccacctagcccagctaatttttgtatttttagtagagatggggtttcaccatgttggtcagattggtctcaaattcctgacctcaggtgatccgcctgcctcggactcccaaagtgctgggattagaggtgtaagccactgcacccggcctatcaagggcattttaataagcatcagtaactgagctacccatattgaacttgggcaacttatccaatctttagtttctaagcacagagcccgaggtcaaggaaaggcaagtacagtaattatatttgactcctacaaacaatagagcttaaaacaatagtccacagtcaaataaccacatccaaagactgcctgttactcacttagtatattggtctgagaaacctggttttacctcatttcaaacaggaaactgttacagagctcagatggaatgtccagcagcacatcatggtattgattgttgcactgtaagtgatctgggcttgagcccaaattaacttcttacaatatggctccaatttaccctcccaacatttatctcccaacattttcattcagaaatcctttgttctagctaccctatcttttcactatattctatttgcactctcatttctctgttttcacaatgcttgatcacatctttagccattttcccacctagatcttttctgttctctccatttttctgactgctgcccatctttcaatactgaacaaatcagcttcttagtgcatatctgtgatatgcaaaacactgttaggtgcttcaagagttagtcttctaagagctttatgttttattagaacatgacacaagtaggcaaataactataatgcaagataaagtgaaaaagattctataagaaaggtttactcaaaatactgagggttcaaaatgtgtattataacattaattaggaagaattagaaaatagtgcatgtagagagaattatatgaaatgcacctcaaggaaagcatttgcctttgacagctggaaacacgcactgtagaaaggcattatttggggttgaaagtatgaacaaagctctatcagcagagcatctttaagcctcaatgaaaagcccactgtggctaggaggtatagtacataaataggaaagcaataggagatgagtctgtaatttcaagttgtcatggtagaaggccctgaatcccaggttgaggaatttttactcacttcaataggcaggagaagaacataaagattttttttgagggaagtggtccaatcagagtaacactttagaaagattaatttaacagaagtttttaagattatttgaactgaatgaaagaaaaggtacaaactgcagttaggaagctattctagtagtgtcagtgacaagttttgcaggtggccaagaaggaagtgaaagaaaactgaatagggaaggaaggaagactgcaagggacttggtgctgattgatccgtgtctccatctctcttgcactatgcaaagaaaaggactctagtttgcatacctagtagactggggaaatgctggtagcaaaagagaagagattgagtagaatatgttttgaatacactgagttaaagtgttaaagaatggtgctaagagtaaagttcatagccctaaatgcctacaccaaaaagactgaaagagcacaaattgatattctaaggtcacaccttggccaggcatggtggctcatgcctgtaatcccagcactttgggatgccgaggtgggaggatcatgaggtcaggggattgagaccatcctggctaatatggtgaaaccccatctctactaaaaatacaaaaaattagccaggcatggtggcacacgcctgtagtcccagctactcgggaggctaaggcaggagaattgcttgagcccaggaggcagaggttgcagtgagccaagattgattgcactccagcctgggcaacagagcgagactcaatctcaaaaaaaaaaaaaaaaaaaaaaaagataaggtcacatctcaaggaactagagaaagaagaaaaaaccaaacccaaaccctgcagaagaaaggaaataaccaagaacagagaagaagtaaatgaaattgaaacaaaaatacaatacaaaaagtaaatgaaacaaaaagctggttctttgaaaagataaataaaattgatagaccattagcaagattaaccaagaaaagaagaaagaaaatccaaataacctcattcagaaacaaaacaggagatactacaacagacaccattgaaatacaaaagaccaaccaaggctactatgaacacctttatgcacataaactagtaaaccttgaagaaattgatacattcctggaaaaatacaaccctctgagcttaaataaggaagaattagatatgctgaacagaccaataacaagcagtgagattgaaatgctaattttaaaattaccaacaaaaagtctaggaccagatggattcacagcagaattctaccaaacattcaaagaagaattgttaccaatctttttgaagctatttcacaagacagagaacgaagaaaccatccctaattcattctatgaagttagcatcaccctaataccaaaactcatgaaaggacataagcaaaaaagaaaactacagactgatatccttgatgaacatagatgctaaaatccttaacaaaatactagctaactgaatctaacagcatatcaaaaagataatccaccatgatcaagtgggtttcatacctgggatgcagggacagtttaacatatgcaagtcaataaatgtggtacaccacataaacataattaaaaacaaaaatcacatgatcatctcaatagatgaaaaaaaaagcatttgatgaaatccagcatcactttatgattaaaactctcagcaaaatcagcatacaagggacatacttcaatgtaataaaagccacctatgacaaacccacaggcaacataatactgaatagggagaagttgaaagcattccctctgagaactgagacaagacaaggatgcccattctcaccactccttttcaagatagtactggaagtcctagccagagcaattagacaagagaaaaaaagaaagggcatccaaatcggtaaagaggaagtcaaactgtcactgtttgctgacaatataatcgtttaccctgaaaaccttaaagactcttccagaaagctcctagaactgataaaaagaattgagcgaagtttccagatacaagactaatgtgcacaaatcagtagctcttctatacaaaaacagtgacaaagcagagaatcaaatcaagaactcaaccccttttacagtagctgcaaaaaataaaatagttaggaatatacataaccaaggagttgaaagaactctacaaggaaaactactaaacactgctgaaagaaatcacagacaacacaaacaaatggaaacacatctcatgctcatgcatcggtagaatcaatattgtgaaaatgaccatactgccaaaagcaatctacaaattcaatgcaatccccatcaaaataccaccaccattctttacagaattagaaaaaacaattctaaaattcatatagaaccaaaaaagagcccacatagccaagacaagactaagcataaagaacaaatctggaggcatcacactacctgatttcaaactatactataaggccatagtcaccaaaacagtgtggtactggtataaaaataggcaaatagggcaatggaacagaatagacaacccagaaataaacccaaatacttacgcccaactgatctttgacaaaacaaacaaaaatataacatagagaaaggacacccttttcaacaaatggtgctgggataattggctagccatttgtaggagaatgaaaatggatcttcctctctcaccttatacaaaaatcaactcaagatggatcaaggacttaaatctaagagctgaaactataaaaattctagaagataacattggagagaacccttctagacgttggcttaggcaaagatttcatgaccaagaacccaaaagcaaacacaataaaaataaagataaataattgggacttaattaaactaaagagcttttgcactgcaaaaggaacagtcagcagaataaacagacaacccacagaatggaagaaaatattcacaatctatacatctgataaatgactaatatccagaatctacaacaaactcaaacaaatcagtaagaaaaaaccgaacagtcccatccaaatgtgggctaaagacatcaatagactggtctcaaaagaagatatacaaatggccagcaaacatatggaaaaatgctcaacaacattaatgatcagggaaatgcaaatgaaaaccacaatgtaatatgacctcactcccacaagaatggccataatcaaaaaatcaaaaacaggggggagagaagccaagacggccgaataggaacagctctggtctacagctcccagcatgagcgacgcagaagacaggtgatttctgcatttccaactgaggtactgggttcatctcactggggagtgccagacagtaggtgcaggacagtgggtgcagtgcaccgtgcacgagctgaagcagggtgaggcaggcattgcctcacctgggaagcgcaaggggtcagggaattccctttcctagtcaaagaaaggggtgatagaacggcatctggaaaatcgggtcactcccaccctaatactgtgcttttccaatgggcttaaaaaacgacacaccaggagattatatcccgcacatggcttggagggtcctatgccgacggagtcttgctcattgctaacacagcagtccgagatcaaactgcaaggtggcagcgaggctgggggaggggtgcccgccattgccgagttagttatttgataaggtaaacaaagctgccaggaagtttgaactgggtggagcccaccacagctcaaggaggcctgcctgcctctgtaggctccacctctgggggcagggcacagacaaacaaaaagacagcagtaacctctgcagacttaaatgtccctctctgacagctttgaagagagtagtggttctcccagcactcagctggagatctgagatctggcagactgcctcctcaagtgggtccctgacccccgagtagcctttctgggaggcaccccccagtagtggcagactgacacctcacacgtctgggtactcctctgagacaaaacctccagaggaacgatcagacagcagcgtttgcggttcaccaacatccgctcttctgcagccatcacggctgaaacccaggcaaacagggtctggagtggacctctagcaaaatccaacacatctgcagctgagggtcctgtctgttagaaggaaaactaacaaacagaaaggacatccacaccaaaaacccatctgtacatcatcatcatcaaagaccaaaggtagataaaaccacaaagatgggaaaaaacagagcagaaaaactggaaactctaaaaatcagagagcctctcctcctccaaaggaacgcagctcctcaccagcaatggaacaaaactggacggagaatgactttgatgagtcgagagaagaaggcttcagaagatcaaactactccgagctacaggaggaaattcaaaccaatggcaaagaagttaaaagctttgaaaaaaaattagactaatggatcactagaataaccaacgcagagaagtccttaaaggacctgatggagctgaaaacaaaggcacgagagctacgtgatgaatgcagaagcctcagtagccgatgcgatcaactggaagaaagggtatcagtgagggaagatcaaatgaatgaaatgaagcgagaagagaagtttagagaaaaaagaataaaaagaaacgaacaaagccttcaagaaatatgggactatgtgaaaagaccaaatctatgtctgattggtgtacctgaaagtgacggggagaatggaactaagttggaaaacactctgcaggatattatccaggagaacttccccaatctaggaaggtaggccaactttcaaattcaggaaatacagagaacaccacaaagatactcctcaagaagagcaactccaagacacataattgtcagattcaccaaagttgaaatgacggaaaaaatgttaagggcagccagagagaaaggtcgggttacccacaaagggaagcccatcagattaacagctgatctctcggcagaaactctacaagacagaagagagtggggaccaatattcaacattcttaaagaaaagaactttcaacccagaatttcatatccagccaaactgagctttataagtgaaggagaagtaaaatcctttacagacaagcaaatgctgattttgttaccaccaggcctgccctaaaagaactcctgaaggaagcactaaacatgcaaaggaaaaactggtaccagccactgcaaaagcatgccaaactgtaaagaccatcaaggctaggaagaaactgcatcaactaacaggcaaaataaccagctaacatcataatgacaggatcaaattcacacataacaatattaactttaaatgtaaatgggctaaatgctccaatgaaaagacacagactggcaaattggataaagactcaagacccatcagtgtgctgtattcaggaaacccatctcacgtgcagagacacacataggctcaaaataaagagatggaggaagatctaccagcaaatggaaaacaaaaaagggcaggggttgcaatcctagtctctgataaaacagactttaaaccaacaaagatcaaaagagacaaagaaggccattacataatggtaaagggatcaattcaacaagagctaactatcctaaatatgtatgcacccaatacaggagcacccagattcataaagcaagtccttagtgacctacaaagagacttagactcccacacaataataatggcagactgtaacaccccactgtcaacattagacagatcaatcagacagaaagttaacaaggatatccaggaactgaactcagctctgcaccaagcaaacctaatagacatctacagaactctccaccccaaatcaacagaatatactttcttttcagcaccacaccacacctactccaaaattgaccacatacttggaagtaaagcactcctcagcaaatgtaaaagaacagaaattataacaaactgtctctcagaccacagtgcaatctaactagaactcaggattaagaaactcactcaaaaccgctcaactacatggaaactgaacaacctgctcctgaatgactactggggacataatgaaatgaaggcagaaataaagatggtcttcaaaaccaacaagaacaaagacacaaataccagaatctctgggacacattcaaagcagcgtgtagagggaaatttataggactaaatgcccacaagagaaagcaggaaagatctaaaattgacaccctaacatcacaattaaaagaactagagaagcaagagtaaacacattcaaaagctagcagaaggcaagaaataactaagatcagagcagaactgaaggagatagagacacaaaaaacccttcaaaaaattagtgaatccaggagctggtttttagaaaagattaacaaaattgatagaccactagcaagactaataaagaagaaaagagagaagaatcaaatagacacaataaaaaataataaaggggatatcaccaccaatcccacagaaatacaaactaccatcagagaatactataaacacctctacgcaaataaactagaaaatctagaagaaatggataaattccttgacacatacatcctcccaagactaaaccaggaagaagttgaatctctgaatagaccaataaaaggctctgaaattgaggcaataatcaatagcttaccaaccaaaaaaagtccaggaccagatggattcacagccgaattctaccagaggtacaaagaggagctggtaccaatccttatgaaactattccaatcaatagaaaaagagggaatcctccctcactcattttatgaggccagcatcatcctaataccaaagcctggcagagacacaaccaaaacagagaattttagaccaatatccttgatgaacatcaatgcaaaaatcctcaataaaatactggcaaaccaaatccagcagcacatcaaaaagtttatccaccatgatcaagtgggcttcatccctgggatgcaaggctggttcaacatatgcaaaccaataaatgtaatccagcatataaacagaaccaaagagaaaaaccacatgattatctcaatagatgcagaaaaggcctttgacaaaattcaacaacccttcatgctaaaaactctcaataaattaggtattgatgggatggatctcaaaataataagagctatttatgacaaacccacagccaatatcatactgaatgggcaaacactggaagcattccctttgaaaacgggcacaagacagggatgccctctctcaccactcctattcaacatagtgttggaagttctggccagggcaatcaggcaggagaaggaaataaagggtattcaattaggaaaagaggaagtcaaattgtccctgtttgaagatgacatgattgtatatctagaaaaccccatcgtctcagcccaaaatctcctcaagctgataagcaacttcagcaaagtctcaggatacaaaatgaatgtacaaaaatcacaagcattcttatacaccaataacagacaaacagagagccaaatcatgagtgaacgagtgaactcccattcacaattgcttcaaagagaatgaaatacctaggaatccaacttacaagggatgtgaaggacctcttcaaggagaactacaaaccactgctcaatgaaataaaagaggatacaaacaaatggaagaacattccatgctcatggataggaagaatcaatatcgtgaaaatggccatactgcccaaggtaatttatagattcaatgccatccccatcagctaccaatgactctcttcacagaactggaaaaaactactttaaagttcatatggaaccaaaaaagagcccgcatcgccaagtcaatcctaagccaaaagaacaaagctggaggcatcacactacctgacttcaaactattctacaaggctacagtaaccaaaacagcatggtactggtaccaaaacagagatatagaccaatggaacagaacagagccctcagaaataatgccgcacatctacaactatctgatctttgacaaacctgagaaaaacaagaaatggggaaaggattccctacttaataaatggtgctgggaaaattggctagccatatggagaaagcttaaactggattccttccttacaccttatacaaaaattaattcaagatggattaaagacttacatgttagacctaaaatcataaaagccctagaagaaaacctaggcaataccattcaggacataggcatgggcaaggacttcatgtctaaaacaccaaaagcaatggcaacaaaagccaaaaatgacaaatgggatctaattaaactaaagagcttctgcacagcaaaagaaactaccatcagagtgaacaggcaacctacagaatgggaggacatttttgaaacctactcatctgacaaaggactaatatccagaatctacaatgaactcaaacaaatttacaagaaaaaaacaaacaaccccattaaaaagtggttgaaggatatgaatagatacttctcaaaagaggacatttatgcagcaaaaaacacatgaaaaaatgctcatcatcactggccatcagagaaatgcaaatcaaaaccacaatgagataccatctcacaccagttagaatggcgatcattaaaaggtcaggaaacacaggtgctggagaggatgtcaagaaataggaacacctttacactgttggtgggactgtacactagttcaaccattgtggaagtcagtgtggcgattcctcagggatctagaactagaaataccatttgacccagccatcccattactgggtatacaaccaaaggattataaatcatgctgctataaagacacatgcacatgtatgtttatagcggcactattcacaatagcaaagacttggaaccaacctaaatgtccaacaatgatagactggattaagaaaatatggcacatatacaccatggaatactatgcagccataaaaaatgatgagttcgtgtcctttgtagggacatggatgaaactggaaaccatcattctcagaaaactatcgcaaggacaaaacaccaaacaccgcatgttctcactcataggtgggaattgaacaatgagaacacatggacacaggaaggggaacatcacacaccgagacctgttgtggggtggggggaggggggagggatagcattaggagatatacctaatgctaaatgatgagttaatgggtgcagcacaccaacatggtacatgtatacatatgtaacaaacctgcacgttgtgcacatgtaccctaaaacttaaaagtataataataataaaataaaataaaaaagaacattacaacatgctctgcaggggtaaatgctttatcatgtattactacattttaatcacatctttgtaaagccagaagcattttgaaagtcacattacagacattgtttaaacatagtttgtatttaccaaagcataggacgttgtatcatctcatattaattagttagttggctcaaaattagtggtaatgacttagtaattcaataatttctcttagctttaaaaccttctttatttcagaactatttcacctcttggtttttgtttttgctgtgcatcactgcctgccagctgctaatctcttatctcccagtggattacgtgtccagtgaagggactgaatgagatactagtggcaaattatattgatgattcatattttgaataaatagattaagcttgtataaacaaacaaacaaaaaaatcaaaaacaggagatgctggcatggatgtggtgatcaggaaacacttctacactgctggtggggatgtaaactactacagccaccaaggaaaacagtgtggagattctttaaagaactaaaagtagatccaccatttgatccagcaatctcactactgggtatctactcagaggaaaagaagtcattatacaaaaaagatacttgcacacacatgtctatagcagcacaatttacagttgcaaaatcatgagaccaacccaaatgcctatcaatcaacaagtggataaagaaaccgtgatataaacatatgatggaatactactgagccataaaaaggaatgaattaacagcatttgcactgacctgaatgagattggagactattattctaagtgaagtaactcaggaatggaaaaccaaatgtcgtatgttttcactgatatgtggcagctaagctatgaggacacaaaggcataagaattatacaatggactttggggacttatggggaagagtgggagggaagtgagggataaaagacaacatatatggtgcagttgtatactgtgtaggtgatgagtgcaccaaaatctcacaaatcaccactaaagaacttattcatataaccaaataccatgtgtaccccaataacttatggaaaaataaataaataaataaagtgttaaagaaatatcacaatggaacaaggcccctagaaattaacctgagtgctgaagcactttgtgagctagaatccgagacaaaatagtaattgcaatggtctattaccttgatttgtccagagctgaggagtctcccaggatagaagactttcagtgccaaaactcagaaagttctgggcaaaccaggataaggtagtcatcctcaagacggtggaatgcagaaagtgggcagaaatgccaaggtgtgatatcaattatttatctaaattatctcaaaatgtgtccagggctgggaggcagacatttacatgaaaagcgtgggtgagatttctgtgtgtacaatccagacagatgaagttcttggttcacatggggctttctatcaacgaccattcaccaatggaattggagccctgaaaatttacccagggaatgtgtctggggtcactccctagagatactacaagactgaatacagggttggagtgcaagggcagggtacttggatcagggtagtgccaaactggcaaatggagattcagtgacaactatttcacagtatttaagaggttgaaatggcaagcaagtgaagataggtggattaaattgatccctgacacaagcacattattttgcctataaaaccaggaagaacaatctgtctcctgtcctgagggcacattcatgacatttgccattgtgcagctactgttgacttttcctgcagaagaaaaatctgtctaaaaggacatcttgaaaggctaagagggcgtgttgggaccttctgccagctggcctgaagaggctcacaaaccacctcttcctcctggttcctttggaaattccactgggcaatgcagactggttcatcttcttgtacttaactgagctgccaggttggaaatagtcctaaacttttcgcacagagctgtaatcttaaactgtaattttattttattttatttttaaaatttttaaaattttaaatttttttttaaattattatacttttaagttatagggtacatgtgcactaggtgcaagtttgttacatatgtatacatgtgccatgttggtgtgctgcacccattaacttgtcatttacattaggtatatctcctaatgctatccctccccgctccccccaccccacgacaggccccggtgtgtgatgttccccttcctgtgtccaagtgttctcattgttcaactcccactgatgagtgagaacatgtggtggttggttttttgtccttgcgatagttttctgaaaatgatggtttccagcttcatccatgtccctacaaagaaataggaacacttttacactgttggtgggactgtaaactacttcaaccattgtggaagacaatgtggcaattcctcaaggatctacaattaaactgtaattttaaattgagagatgcaacatggtgtaatgagaagtagatggcttttgtaactacagaaacctagtttaacctggccacttacttcctgtataaccttaggtacattaattagtttctatgatccttagttctctctccataacattggtttaataatatgtatctcagggattttgtgatacatagacataaccatatgaacatggaaagcacagtgtacatgaggtataggaagccccccttccccccaccccccacaaagtggtctaattctctatctgtgtgtgtgactgtgtgtgcaaaactgtacatgtgattgtgtgtgtgtgcagagctgttcagataaccccctgccctacagccttacccaagaacagaaactctgtctcatccttcctcaacagctgtgttgtaaactgggtgcatagctttaatttcacagtccactaggctctacttctccatctcccccatcgaactccatgctcaagatcacacttgtggcttctatctcattgtaaaaaaaggaggtggagcatatttctttgcaattcatggaggaacataaagctatctctgcctcttggatggcctgtcccaaatgtctttctctatagggtttgctattaacttccctctcagaactgctttgctgcatcccataagttttggtatattgtatttccatttttgtttgtaagattattaatctccctcttaatttcttctgtgacctcttgattatttcaaggcattttatttaatttccacactttgtagaattttccaagatctctcctgttattgatttctagttttatgccattgtaattggagaagatacttgatatgatttcaattttcttaaatctgttaagacttgttttttgtttgttggtttgtttttggcctaacatatgatctatcttagagaatgtcccatgtccacttgagacaactgtgaattctgttacacttggatacaatgttctgtttgtctggtttatttggtcaaatgtgtaattcaagtccaatgtttccctattgattttctgtttaaatgatttgtctgttcttgaaagtggggcattgtgtttccctaatattatggtattagtgtacatttctccctttagattacttaatagtttcataatacattacatgctccaatttggggtttatatgtatttacagttgttatgtcctctttatgaatttatccctttattattatatatgaccttctttgtctcctttttaaggtttttgacttaaggactattttcttgatatgagcatagctctccctggtcttttttggtttccgtttgtgtaaaatatcttcttccatcccttgaattttactctctttgtgtccttactaataaagagagtcatttataagtagtctatactaagatctttttctgtttgttttaagccattcagccacatttatgtcttttaatttgagaatttaatctatttacatttaatatagtaattgataggtaagaactttctactcccattttgtaatttgttttctgggtattttgtggatattttgcctttttctcacttgctgtctttcactatggtttgatggttttctgtagtgatatgctttgaattctttctttttatattttgtgtaactactatagagttttgctttgtggctaccttgaggcttatgtaaaacattgtatacttaataacaagctattttaagctaataacaacttaactttaatcacatacaaaaactctacatttacagcccctcccaccttttatgacattgatgacaaaattaacatctttttgtaatttttatcccctaacaatttattgtacctgcagttgtttttaataattttgttttttaaccataatactacagataaaatttctgaattcaccacatttatagtattagagtattctgagtatcactatatattaatgtatcatcaagttttgtacttttatacatcttatgtcattccttagcagcctttagtttcagcttaaagaactccctttagcaattcctgtaagacaggcctagtggtaataaaatcccttagcttttatttgtcaggaaaagtttttatttctccctcatgtctgaaagaaagctttgctaggtaaagtatttttggttggcagtccttttttttttgcttttaccattttgaatacatcatcctactctctcctggactgtaaaacttttgctgagaaattttctgacagcagtatagggactcctatactaagcctagtactcaatagttattttttctaatcctctcccttctcccacccttcgcccttaagtaggcctcagtgtctgttgttcccctctttgtgtcatgagtttcattatttagctcccacttataaatgagaatatgccagcatggtgactcacacctgtaatcccaacactttggaaggctgaggtgggtggatcacctgaggtcaggagttcgagaccagcctggccaacatggtgaaacaccatctctactaaaaatacaaaaattagctgggcatggtggtagctcccagctactcgggaggctgaggcaggagaatcacttgaaactgggaggcagaggttgcagtgaaccaagatcatgccattgcactccagcctgggcaacaagagcaaaactctgtcaaaaaaaaaaaaaaggctgagaatatgggatgtttggttttctgttcctgtgttggtctgctaaggacaatggacttcaacttcatctgtgttctcataagacatgatcttgttcttttttatggctgcatagtactccatggtgtataagtaccacattttctttatccaatctgtcattgatgggcatttagcttgattctatgtctttgctatagtgaacagtgccacagtgaacattcacctgcatatgtgtttatggtaaaatgatttctattcgtttgggtatatacccaaaggaatgagattgctgggttgaatggtagttctgtttttagctctttgaggagtcaccacactgctttccacaatggtggaactaatttacactcatatcaacagtatacaagcattccttttcaccacagcatcactagcatctgttattttttgaccttttaataatagccattctgactggtgtgagatgatttgcattctctaatgatcagtgatactgagcttttcttcatatgctacttggtcacatgtctatcttcttttgaaaagtataatacttttttgaaaagtcaaatatttttcagtgcaatcaatttattgagagaaaatttgagcataatgagaatttcatattttcttacaggcagtttcagcagcaagaagcacaaagtgaaatagaaactgtaccaagttaaaccaattcacataagaatacacaaaacacactcatatacctcaaacatctaaaagctatctcggtacactgagtgtattgatctcaagggtttgtttattgtcttgttacatttgaaaactactgtatataagcaaacactctttcaatatcccaaacatgtttaagtgtcctggttcaaaacaccagcagggaaaatggaaaaaaagggcatactatttgtatgtgaagactttaaacagaaattacccaatcctgtagaaatggctcccttcagtgttattaatggctaattcagtggtttcaaacatcactacaatctccaaagccttcggccatcagatgacaccataagttcaaatgagaaagccacaaaagaattttcagcagtgatattaaaattaattgaagaagatagctacacattggttcaaaaatggcaattttgaaaaaacagacacgcattaaaaatctcaaagtacctacaacccaaaggcaagaaaaaaatgcccaagtatttaagaattgcaaaagatcaagagtcaacaaatccagccaaagacaatgaatcctgcccatccacacctggtgttatagccttctgtctgatgtctgataactctccttctactacttcacagtatcccacatgctgctacctcctgacacctatttccacaaggaaatttcatgtattcttcaatataaactctcataattattgtagtatttatgtatgttttaactatcaaatatgtgtaatagtgtactattccttttgtttacctctttatttatcactgacaatgtacttgagtgttataccattaatcccatttttctcataactcagtttttattgtacaattttgcatattgcagtgatttttaggaacatatatggcacattataggagaactgactgtacagacccaaattaaattagcggatatttgtaccaaaagacatgtacaaaaaaatcttaacaggtttattcaaaatagcaaaaactataatgctaaaataaagaatggtacatttagataatatagtactaaacatcagtgaaaaatatttagttactgctaagtgcaacagcctaggtaaatcccataaaaataatgttcacagaaagaagctagaaaccaggaagtaggtatattatgattctatttatatgaagttcaataaaagaaaataatagtctttgatgagagaaattagaatcaccgcttaaccttatggggtattgacacaaagaggtcatcttagtctattcttcctgctcttagaaaataccagatacttggtaatttataaacaatagaaatttatttctcacagctctggagcctgggaagcccaaggccaaggcagtagcatattccgtggctggtgaaggcttactctctgcttccaagatggtatcttgttgctgtgttctcacatggcagaagagtgaaagggtaaaaggagtgaatgctacatgctcacatgacagagagaaaaggaaaaatgttaggcagttttctgaagcctcttttataagggcattaatactatttatgaggatttcaaccttatgatgtaatcacctcccaaaggccctacctcttaatactatcactttagtgattaaatttcaaaatatgaatttgggagacatattaagaccataacagagcacaaggagagcttctagtgtacaataaattatctatattttaatttgcttggtagtttcagagggttactcctttgtaaaaatgtatcaaggtcaacttaaaatctgggtattttatgtatgttatacctcaataaaaatatttaccaacaaattatttaaaaatatgtagggagaattaaaatacatagcagcaataacatacaaagttggagacaaggataaaataaaattatctaaggctttgtattgttcagaaagagttgatataattaatattagactttcatgttacatctgtatgtaggataaaatttctaggataaccacaaaaaatatttatagattgtataacatcaaagctaatgtagaaaagaaactgaataataaaaaagtgttataaattctaaagaaggcaaaaaataaaaggaaaaaaatatggaagagggagaaaaatatgtatactatatagtttgatagtaattaaaacccaaatattgtatatcaagttttatgttaaatgtaaatatatgaaatgtttagattaaaagactaatatgttcagattgtagaaaaattccaaaatccacttatatgcagcttataaaagtcacatccattaagagtattaaaaggtagaaaatgaaagcatgcaagagaattcagcaggcaataactaacgaaatacagctggtgtcactacattaatattagacagaacagactttatggccaaaaatattctatgttttcattgccaaaaggtgagtacaacaggcaaatataacaatcatgaatttatatgcacctaataacacaggctcaaaatgcataaacttttacaaaataaggagaaataggagaaattacaactcttccattgtaaaaaattttaatataccactctctgtatattattttacaaattcagtatgcatatacactacctaatgaaaacaattttaaaccttaatccaataggtatatataaaacatggtactcaaaaatacacattcttttcaagcatacacataaataacttcacagaaactgaaaaaaaatgtttaaatatatctcaaatgatggaaattatgcagtatgtattggtttcctattgttgctgtaacaatttgccataaatgtagtgtccataaacaacacaaatttattatcttacagttctggtgatcagaagtcctaaatcaaggagttggcagggctgtgttccttctggaggctctaggagagaatggattccaatgcctttccagagtctagaggccacctgcattccttggcttacagctcctttgcatcattctgaactctgcatctgtcatcacatcttctctccccttgacactcctgcctgcctctttcctttataggaagttttagtattgcattaggcccacccagataaccctggatagtcttcttaacttaatgacatctggagagccctttttgccatgtaaggttacatacagtctccagagattaggacatagacaattttttttcaagatattttctatgttatcttcattagatttttaattacttaggaaaattatgcttaaagggggttaaagtttttacattcatataaccttctgtattgacttcaaagttttttttatcactttggttaaataaggaactattattttacaataatctatgattctgttttaatcaaatgttttgaaccttttagcatcttcaaaaaacattctcaaaatcaaataatcattgctaattcttcatgttttattttccagagtcaagaaaacctttttctttaaaactatttatagtttacaagcttgagtaaaacaataaagtttatctatgtctctacctgatccagaatttgaaaactattcaaaattcccctaggactagggacaattgcagaagaggtgagtgcctgagattgtaagagcgagttttcagacagaaaattctttcagaccttccaaaccaaagatggatacacaggtgtctaaatagctgatggctcaacacatagaatttatagataagtcaattttttaacactgctttttggctttgggtttttggctcttatgttacttagagggtttcaaggattaatgagtgcctacccacctctattcccatatagcctaaaatgtttagttgtttataagtcttttggctcaaatttccttggccatagggttcctgccaagggacatgagggaccctggacaagttgccacgccaccacagcaactgtatgggacaaaataaaatattggccatcaatgctgcttctggtatatcttgaccaaaaacggggaatgtaaactaaaaaataaaatcttaagccacccatcgtctgaatggaccccacccccattggccaagggaaccccacaaaaatttaaaaacttagttcccctccatgatgggacaggaaggcagacatgtcccattataccccctctcttttatggtgtagacacaacaactgaccagcattgatattaaaatagagatcataagaccgacagaacagactctgtgtggcaataagataccaaattataaaagacctatcttaggtcttaagatacctaagaccatgccaggtaagagttaattcacacacccctatgcttaaaggataaattatgttctaactgccacaaggttttcttttttctagcagctattttaagctgaaaaagaaaaataaggaatcataaaacaattttcagctccaccagatgctgaaaaactgaactcctgttccaccagtcacagctgtaacttttactggataagatactgatttcagtaactttcttctgataaaaatactactaatcacagactagttctggccagtttacagaaattgtgcaattgtgtacctttttgtcctaaaaagacctttgacatacaggacctaattgtaatatatttaaatgttgtctccaccccaaagtaaacatgggtcatatgttacatgtttgttcagtacaaatttgtcaaggccactttcataaatattcatagtgtcaggcctctgagcccaagctaagccatcatatcccctgtgacctgcatgtatacagccagatggcctgaagcaactgaaggtccacaaaagaagggaaaatagccttaactgatgacattccaccattgtgatttgttcctgccccaccctaactgataagatatagtttcccccccgcccttaagaaggtactttgtaacattctcccccacccttaagaatatactttgtacgcctatcccaaacctataagaactaatgataatcccaccaccctttgctgactccttttttggactcagcctgcctgcacccaggtgaaataaacagccttgctgctcacacaaagcctgttggtggtctcttcacacagacgtgcgtgacatttggtgccgaaacacggcacaggaggactccttcaggaggccagcccctgtcctcgccctcactccatgaggagatccacctatgacctcgggtcctcagaccaagcagcccaaggaacatctcaccaatttcaaatcgtgtaagcggtcttttcactcttcttcagcttctctcactactcttcaatcttcctctctcgctacccttcaatctccctgtcctcccaattccagttctttttcctctttagtagagacaaggagacacatattatctgtggacccaaaactccggtgccggtcacagacttgggaagacagtcttcccttggtgtttaatcactttggggacacctgcctgattatttacccacactccattggtgtttgatcactgtggggacacctgccttggtcattcacccacattcccttggtggcaagtcaattgtggggacatctgctttggctgctcacccatattgcagcccagggctgctcaccacccccttctccatctctctacctttctctttaaacttacctccttcactatgggcaaacttctgccctccattcccccttcttctcccttagcctgtgttctcaagaacttaaagcctcttcaactcacacctgacctaaaacctaaatgccttattttcttctgcaataccacttgaccccaataagaactcaataatggttctaaatagccagaaaatggcacttttgatttctccattttacaatatctagataatttttgttgaaaaatgggcaaatggtctgaggtgcctggcgtacaggcagccaggcattcttttacacattggtccctccctagtctctgttcccaatgcgactcgtcccaaatctttcttctttctctcctgtctgttccttcagtctccaccccaagctctgagtcctgtgaatcctccttttctacagacccatctgacctttcccctcctccccaggctgctccttgccaggccaagccaggtcccaactctttttcagcctccgctccctcaccctataacccttctattacctcccctcctcacacccagtctggcttacagcttcattccatgactagccctccccgacctgcccaacaatttcctcttagagagtggctgaagctgaaggcatagccaaggttaatgctcctttttctttatccgacctctcccaaatcagttagcatttaggctctttttcatcaaatatgaaaacccagcccagtccatggcccatttggcaacaagccttagacactttaccaccctagacacagaggggcctgaagtctgtcttattctcaatatgcattttactacccaacccactcccgacattagaaaaagctccaaaaattagattctggccctcaaccccacaacagcacttaattgatctcaccttcaaggggtacaataatagagaagagttgcaattacttgcctccactgtgagagaaacccagccacatctccagcacacaagaacttcaaaatgcctaaaccgcaggggcaaggcattcctccaggaccacctcccccaggatcttgcttcaagtgccggaaatctggccactgggccaaggaatgcctgcagcccaggactcctcctaagctgtgtcccatctgtgcaggaccccactggaaatcagactgtccaactcacccagcagccattcccagagcccctagaactctggcccaaggatctctgattgactccttcccagatctcggcttagtggctgaagactgatgctgcccaatcaccttggaagcctacaggaccatcacagatgctttgggtaactcttacagtggagggtaagtctgtccccttcttaatcaatatggaggctacccactccacattaccttcttttcaagggcatgtttcccttgcctccataactgttgtgagtattgacaagaggctttaaaccttttaaaactccccaactctggtgccaacttggacaatgttcttttatacaatcctttttagttatccctacctgcccagctcccttattaggtcgaaacattttaactaaattatctgcttccctgactattcctaggctacagccacacctcattgccacctttttcctcagttcaaagcctccttcacatcctccccttgtatctccccaccttaatccacaagtataggacacctctactccctccttcgtgactgatcatgcacaccttaccatcccattaaaacgtaatcacccttaccctgctcaatgccaatatcccatcccacagcacactttaaaaagattaaagcctgttatcactctcctgctacagcatgggcttctaaagcctataaactctccttacaattcccccattttacctatccaaaaaccagacaagtcttacaggttagttcaggatctgcgccttatcaaccaaactgtcttgcctatccaccctgtggtgccaaatacatatactctcctatcctcaatacctccctctacaacccattattctgttctagataaacctagctgaccccataaatcctaaatcctttccccactcccctttccattccttaaaaaacagccctaaaagctgctcccacactagctctccttaattcatcccaacccttttcattacacacagccaaagtacagggctgcgcagtcagaattcttacacaagagctgggactgtgccctgtagcctttctgtccaaacaacttgactttactgttttagcctagccctcatgtctgcgtgaagtggctgccgctgctttaatacttttaaagcccctcaaaatcacaagctatactccacttactctctacagttcccataactttcaaaatctattttcctcctcacacttgacacatatactttctgccccccagctccttcagctatactcactcttgttgagtctcctacaattaccattgttcctggcccagagttcaatctggcctcccacattatcccagatgccacacctgatccccatgactgtatctctctgatccacctgacattcactccatttccccatatttccttctttcctgttcctcacactgatcacacttggtttattgatggcaattccaccaggcctaatcgccactcaccagcaaaggcagggtgtgctatagtgtcttccacatctatcactgaggttactgctctgcccctctccactacctctcagcaagttgaactcattgccttaactcaggccttcactcttgcaaagggactacgcatcaatgtttatactgactctaaatatgccttccatatcctgcaccaccatgctgttatatgggcagaaggaaatttcctcactacacaagtgtcctccatcattaatgcctccttaataaaaactcttcttaaagctgctttacttccaaggaagctggagtcattcactgcaagggccatcaaaaaggcatcagatcccatcactcagggcaatgcttatgctgataaggtagctaaagaagcagctagtgttccaacttctgtccctcatagccagtttttctccatctcattggtcatgcctatttactctcttactgaagtttccacctatcaatccctctccactcaaggcagatggttcttagaccaaaaaaaaatctccttccagcctcacaggcccattctattctgtcgtcatttcataacctcttccatgtaggttacaagctgttagcccacctcttaaaacctctcgtttcctttccatcatgaaaatttatccccaacccgccactcttgactgcctcttggagtgcacagacaatctttgctgacaggacacactccaatactttcaccctgatgaagtcctattctttacttttatactcactcttattctcgttcctgttcttatgccaccctctacctctccccagctatctccaccacactatcaatctcactcactctctcctacccgtttctaatccttctttaacaaacaattgctggctttgcatttctctttcctcaaaactcgccaaggccctgacttactcactgctaaaaaaaaagggggactctgtatatttttaaatgaagagtgttgtttttacctaaatcagtctggcctggtaaacagtatcaaaaaactcaaggatagagcccaaaaacttgccaaccaagcaaataattaacactgaacccctctggacactctctaattggatgtcctgggtactcccaattcttaatcctttaatacctacttttctccttcttttattcgtgccttgtgtcttctgtttagtttctcaattcatacaaaactgcatccaggccatcaccaataattctataggacaaacgctccttctaacaaccccacaatatcaccccttaccccaaagcctttcttcagtttaatctctcctactgtaggttcccatgccacccctaatcccgctggaagcagccctgagaaacatcacccattatctctccatactaccccccaaaattttcaccaccccaacacttcaccactattttgttttgttttgttttttattaatataagacaggaatgtcaggcctctgatcccaagctaagccgtcatatcccctgtgacctgcacgtatacatccagatggcctgaagcaactgaagatccacaaaagaagggaaaatagccttaactgatgacattccaccactgtgatttgttcctgccccaccctaactgataagatatagtctccccaacccttaaaaaggtacttcgtaatattctcccccacccttaagaatgtactttgtacgcctatcccaaacctatagaactaatgataatcccaccaccctttgctgactccttttttggactcaggccacctgcacccaggtgaaataaacagccttgttgctcacacaaagcctgttggtggtctcttcacacacatgacacatagcttcttctgtaacctcttaaatatatatgtttagccaacctgtcatcaaatccccaggaactccatgtacaattgacagagaggaacaaactagttgattttttttattaatatggggggttgtatattctgtagtcaacatctgcttatccgttgattcaaaaaagactgcaatgtttacaggggtgccaggaaaaaccaatgacatggataatttagagtactattattttgtctaccacacagagtatgtcctccaaaatcaatgcaaataatctaaaataaatgataaaaattttatgtttggagaataaagcatactcctaaataaacatagatcattgtagtcccacttgtttatttttgcttttgttgtctgagcttttattgtggtatctaaaaaatcattaccaaggccagtatcaaagagcttttaccctaagttttcttctactaactttggaatgccattggctgagagggggtgtccattcagatggttgggccatgcttagaattttatttttggtttacaattccttctgagactcaaagaaagaatcaattttcttgccatttccagctagaacctattctgattccttgacttttggcccctttctctatctccgaagccagcaacattgcattctctctgactcttctgttttcaaatctttccagttaatcaaaatagagaaagactccggttttaaagattcatgtgatatgattgggcccacttgtaaaatccaagataatcttctcatctcaagatttccaacactagacacatctgcaaagtacctttttccaggtaaggtaacagattcacaggctctggaggacttggacttctttggaggagccactattcagcctaccacagctagtaaaaaaaataaaaattctttagtcttacaaagaatatcttcaaccatatacaccaagtactaagtttaatatcgaattatcaacagctttccctttacagccaggaataccataggattttcactatcattttgtgtattaaacattgtcctggagggtgtaaatgataagattgaaactgcctttgcaaaaattacaacaattagaagattatggcagtgaaggggatgtaatctggccaaattccttcttgcctttggtcttcaagttgaccttaattattcctgagcttaggctaagctaacttcggaagacatttagtttatagcttaaatgataatagcccttccctaaaactcaaccactgttgtaaagctaatgagagaccaccaggctaggaggatggagaggcctgaattttgctaggtgtagacataaatgattgccagccattattccagaagtcacaagatatgcaacttccccagttacttctgcagataacatcactattgtagaacctaagattggccttttgagatatattttcaggtttttcgcatgtccgataccaatggcttcagctggacctcccaagctcctgtggtcccacccagaggcgacttagcttgtagaaggaccatcttccacacccctgtgattgcaaccccaatgaatcaacaacaagcactcactgcctagccaccccacccgttccctcaaattaccttggaaaaatcctagcccccaaattctctggtaggctgatttgagcaataataaaacttggtcttccctttcactggctctacatgtataaaactttctctattgcaattcctctgcctcgataaaccagctatatgtggacaccaggcaagaagagtccattgtatggttacacagtaaattaagaaaaaatacaaagtataagggtaagaatttttaaaaactgttatatttgcaagtaatatatttgtgcatagagaagattcaagagcactgtaaaggaaaatttaaaaatctcaatgcatgcctatatcaaagtatctcatgtaccccataaatatatatacttatgatgtacccacaaaaattgaaaataaaaaaaatctcaggaaccccaaactccttacatcaaaaggaaaattaagcctggtgactgagtggcacaacacaaacacatcatccttttcccaaatgaatagcttttacttcataatcttgtgtcaaagcattatccattagccacaacccctgcagaaaggcaaaaagcctcaggtatccctgatgactgtcttcacaaattgttctttgctggccttaagctttcaggaggtatatcctgccataaaaaaaagggcatgtcaattataactttaggtctgcaatataagtctagctcctataactaaagtctgttaaaattcagactgataatgtcaattacaagataatcttcccaagtacagaacaaagacaagctgagattgatcaatcctccacctaccctgagaaatctgcataactgattttcctttactccctctttttttggtaaaacattcaccttatcttatgtaaaatgtagatttacaaggcactaactaaagtctcacaaggatgtaaccattcacctcacaccacctacatgccttccccatttcaaggaaatgtataaatgctaaacctcctgaaaacctctttggagaacacaagaattggcaatctggcactggtggtttcatttcttggtgtaaattacatagcacgcttataaaactacagctgctttttgttgtttgtaatttggacttcagaaaaacattgtgggccaggtatggtggtccacatctgtaatcccagcattttgggaagccaaggcaggcagatccctcgaggccaggagttcaagaccagtaaaacttcatctctactaaaaatacaaaaaatagcccattgatgctaggaagaaactgcatcaacaaacgagcaaaataaccagctaacatcataatgaaaagatcaaattcacacataacaatattaaccttaaatgtaaatgggctaaatgccccaattaagagacacagactggcaaactggataaagagtccagacccgttagtgggctgtatacgggcgacccatctcatgtccaaatgcacatataggctcaaaataaagggatggaggaagatctaccaagcaaatggaaagcaaaaaaaagcaggggttacaatcctagtctctgataaaacagactttaaaccaacaaagatcaaaagagacaaagaagggaattacaaaatggtaaaaggatcaattcaacaagaagagctaactatcctaaatatatatgcacccaatacaggagcacccagattcataaagcaagtccttagagacctacaaagacttagactcccacacaataataatgggagactgtaacaccccactgtcaatattagacagatcaacaagacagaaagttaacaaggatatcccggacttgaactcagctctgcaccaagtggacctaatagacatctacagaactctccaccccaaatcaacagaagatacattcttctcagaaccacatcacacttattcgaaaattgaccacatagttggaagtaaagcactcctcagcaaatgtaaaagagcagaaatcacaacaaattgtctctcagaccacagtgcaatcaaattagaactcaggattaagaaactcactcaaaaccgcacaactgcatgaaaactgaacaacctgctcctaaatgactattgggtaaataacaaaatgaaggcagaaacaaagatgttctttgaaaccaatgagaacaaagacacaaagtatcagaatctctgggacacatttacagcagtgtgtagagggaaatttatagcactgaatgccacaaaagaaagcaggaaagatctaaaattgacaccctaacatcacagttaaaagaactagagaagcaagagcaaacaaattcaaaagctagcagaagacaagaaataaccaagatcagagcagaactgaaggagatagagactaaaaaatccttcaaaaaatcaataaatccaggagctggttttttgaaaagatcaacaaaatagatagaccactagcaagactaataaagaacaaaagagagaagaatcaaaatagatgtaataaaaaatgataaaggggatatcaccacggatcccacagaaatacaaactaccattagagaatactataaacacctctacacaaataaactagaaaatctagaagaaatggatacattcctggacacatacaccatcccaagactaaaccagaaagaaattgaatctctgaatagaccaataacaggctctgaaattgaggcaataattaatagcctgccaaacaaaaaaagtccaggaccagatggatttacagcagaattttacctgaggtacaaagaggagctggtaccattccttctgaaactattccaatcaatagaaaaagagggaatcctccctaactcattttatgaggccagcatcatcctgataccaaagcctggcaaaaacacaacaaagaaagagaattttagacaaatatccgtgatgaacatcgatgtgaaaatcctcaataaaatactggcaaaccgaatccagcagcacatcagaaagcttatcgacacggtcaagtcagcttcattcctggaatgcaaggctggttcaacatacacaaatcaataaatgtaatccatcacagaaacagaaccattgacaaaaagcacatgattatctcaatagaggcagaaaaggccttcaacaaaatacaacaacccttcatgctaaaaactctcaatacactaagtattgatggactgcatctcaaaataataagaggtatttgtgacaaatccacagccaatatcatactaaatgggcaaaaactggaagcattccctttgaaaactggcacaagacagagatgccctctctcacgactcctattcaacatagtgttggaagttctggccagggcagtcaggcaagagaaagaaataaaggtatttaattaggaaaagaggaagtcaaattgtccctgtttgcaaatgacatgattctatatttagaaaaccccattgtctcagcccaaaatctccttaagctgataagcaacttcagcaaagtctcaggatacaaaatcaatgtgcaaaaatctcaagtgttcctatacaccaatgattgacaaacagagagccaattcatgagtgaactcccattcacaattgcttcaaagagaataaaatacctaggaatccaacttacaagggatgtgaaggacctcttcaaggagaactacaaaccactgctcaatgaaataaaaaggacacaaacaaatggaagaacattccatgctcatgcaaaggaagaatcaatatcatcaaaatggccatactgcccaaggtaatttatagattcaatgccatccccatcaagctaccaatgactttcttcacagaactggaaaaaaactactttaaagttcatatggaaccaaaaaagagcccacattgccaagacaatcctaagcaaaaagaacaaagctggaggcatcatgctacctgacttcaaagtatactacaaggctacagtaaccaaaacagcatggtactggtaccaaaacagagatatagaccaatggaacagaacagaggcctcagaaataacaccacacatcatctataaccatctgatctttgccaaacctgacaaaaacaagcaatgaggaaaggattccctatttaataaatggtgctcggaaaacaggctagtcatatgtagaaagctgaaactggatcccttccttacaccttatgcaaaaattaattcaagatggattaaagacttaaatgttagacctaaaaccataaaaaccctagaagaaaacctaggcaataccattcaggacataggcacaggcaaggactgcatgactaaaacaccaaaaccaatggcaacaaaagccaaaataggcagatggaatctaaactaaagagcttctgcacagcaaaagaaactaccatcagagtgaataggaaacccacagaatgtgagaaaatttttgcagtctacccatctgacaaagggctaatatccagaatctacaaagaacttaaacaaatttacaagaaaaaaacaaccacatcaaaaagtgggcaaaggatacgaacagacacttctcaaaagaagacatttatgcagccaacagacacatgaaaaaatgctcatcatcactggtcaccagagaaatgcaaatcaaaaccacaatgggataccatctcatgccagttagaacggtgatcattaaaaagtcaggaaacaacagatgctggagaggatatggagaaatacgaaagcttttacactgttggtgggagtgtaaactagttcaaccattctggaagacagtgtggcgattcctcagggatttagagctagaaataccatttgacccagtgatccccttactgggtatatacccaaaggattgtaaatcatgctactataaagacacatgcacacgtaagtttattgaggcactattcacaatagcaaagacttggaaccaacccaaatgtccatcaatgatagactggattaagaaaatgtggcacatatacactatggaatactatgcagccataaaaaggatgacttcatgtcctttgcagggacatggatgaagctggaaacaatcattctgagcaaactatcacaaggacagaaaaccaaacaccgcatgttctcactcttaggtgggaattgaacaatgagaacacttggtcacagggtggggaacatcacacaccggggcctgtcatggggtgggtgggggagggatagcactgggagaaatacctgatgtaaatgatgagttgatgggtgcagcaggccagcatggcacatgtatacctatgtaacgagtctgcatgttgtgcacatgtaccctagaacttaaagcatattaaaaaaaatttaaaaagtagcaggcaacatggtgttggccaggtagagaacccacctgcataataaaagattagggttggtgggggcagcttcttcacatgctatgcaaacagcacacctagtcctagccagttctttctgtgctatgcaaatggcacacctggcctgaccaatctttcacgccctatgtaaatcagataccgcctcctcaagctcatctaaaaaatttcctacacttcactgcagactggaaaacttgctccggaccccctctctcttcaggagagagcttttctctttcttttgcctgttaagcctctgttcttaacctcactgcttgtgtatccacatccttgatttccttggtgtgaggcaacaaatctcaggtattaccccagatgaacgatgctgcttcactgggactcaaatcatttcatccaaagctcataggttaggagtttttcaaaggcagtttgggggaaggggtcggggtggctaggtttgctgctaattggttgggctggagatgaaatcataggcgttaaagctgtactcctgcaggctggatagcttgtaggtggggccacagcagtgggattggtgggtccaggtggagccatgggtgttagacatgcaaaaaaacctgaaaggatgtctcaaagggtcagtctacaaaagtggtgtcatctgcaggaataattggagaagttgcctatcttataacctcaagaatagtggcaaacaatcattcatgtctgagtcttagccagactcagcctcctctccttccccaagcctcatggcctcccattagctttacaaagcctgttaagttttaggcctgctatcatttaaactatagtctaaatgtcttccaaaagtattagattggttcaaagctaactgcagttttgccattaaaagtaatggcaaaaactgcaattacttttgcaccaaactatagcttagggcgaggcacagtggttcatgcctgtaatcctagcactttgggaggctgaggtgggtggatcacttgaggccgggagtttgagatcagcctggccaacatgggaaaacacctaatctactaaaaataaaaaaattagccaggcattgtggcgcactcctgtaatcccagctacttgggtgactgaggcacgaaaacaacttgaaccctggagacagaggttgcaatgagctgagatagtgccactgcactccaacctgtgtgatggagcaagacattgtctcaaaaaaaaaaaaaagaaaaagaaaaagttagcttagccctatcgcccaggaataaaggaaacagcaagatggggcagtggggtagttagctcaacttactgttatattactcattgatacaatttttgcaaaggtggttttagtatgactctacaccttttgggtcacccatttgtaatccattctactgaaggaagccaaaatattaccctctaaaacacttaggattgttgagctaaacacagctaaaaggcagggagattctctgcccttcttttgtttgcctaaagcgaggacataaatcctcccttactggagacagctgcttattagcccactaatgggccaggggaatctgtgagcagactttacctctataaatttgccttcctatatttgcccaccttttggcactacccctatgggcagattttgtcttcctgcttcattaaatatctctttaaatttttcatctgaactctctgtgtagccagtcaactgagaagctgagaccctagagaatatggccagagtgatatgggttgtacacccatttgtagctagcaaaacttttctctctttgaactttctttggcatgaatctggaatcttgtgagaactgtcctgcatctctttggagaaggctcgttgatcaatgtattgattacatcataacattggttaaagcttattggttttggtgagtcacttgcaaagatacctttggtttaaaagaggggggaaatggtacaaaagcaggaatattgactgttctggctgaaatatgataagagacttgaagttttttttttaagatctctatagtcaaaagtcgatttaattaaaagctgatatttaagatacatatgcatatatactttttaattgggcctctgttctctataaaaacttgtcagttgactaaatttctttcttcttaacccttttgtcaagaaaaacagtaaaatatttgaagagatttattctgagcccaataagaatgaccaatgacccatgacacagctctcaggagatcctgagaacatgtgcccaaagtggttgaactacaacttggttttatatattttagggagacataagacgtcaatcaattaatgtaagatgtatattggtttaatccagaaaaatgggacaataggaagtgggggccccagatcataggcagattctaagattttctgattggcaattggttgaaagagttattgtctaaagacctgaaatcaatacaaagaaatttctgtgttaagataagggattttagagaccaaggttttatcacactgatgaagcctccaggtagcgggcctcagagagaatagattgtaaacgtttcctatcagacttaaagattctattagtattttttttgacagagtctcactctgttgtccaggctagagtgcagtggcgcaatctcagctcactggaacctccacctcctgagttcaagtgattctcctgcctcagcttcctaagtagctgggactacaggcatgggccaccatacccagctaatttttgtatttttagtagagacagggtttcaccatgttggccatgctcctgacttcatgtgatccacctgcctctgccttccaaagtgctgggattacaggagcgagccaccacatccagcctgctctattagtcttaaggtctttgtgttgatgttaacactggtcagctgcgaggcatgtccagtggcaccccacttcccatcatggcctgaactaatttttcagattaactttggaatgtccttggcagaggggagggcccatcagtcagttagggggcttagaattttatttcttttttataccttactaactgtatgcactcccttagtttgcttctgttttgttgacatgatttgtgccaagaatgatgtaaaacttcactggccttttgaaagcttaaactctttctctgtactatgaaacataaatttcctaccttgttttgtaaatcagtaagggcttcagcctgtgagacagataaactttaactcgttccatttacaaagccacagtttgattccaactgtctttttaaactactgagttttgcctgactcatgggtaaaatattaaaatctgtgaaccctaaataactgagacaggtctcagtcaaattagaaagtttgttttgccaaagctaagaaagcacccatgacacagcctcaggacatcctgacaacatgtgcccaaggtggtcagggtacagcttgctttattttagggagatatgaggcatcaatcaaatgtgtaaaatgtacattggttcgttccagtaaggcaggacaactcaaagtgggggtttccatgttagaagtagataaaagacaaaaggctgcattattttaagtacttgatcagtcttccactgaatacacaatttaatctgtctcagtgaatctgcatttttacataaacaataggtcagaggaagtaattagatatgcatctgtctcaggcaagcctcagagggacaattttgagttctgtctgttctttgtccacaaagaatttccttgtgggaaaattgtgagggaggtatgtggcttcttatctctgtagctatcttatttagggataataaaatgggaggcaggtttgccctaagcagtccccggcttgccttttccctttggcttagtgattttgtggtgccaagatttattttcctttcacaaatcaaaactataaaatctttgtctgtatttttatacttgtgtaaatgtttgtgtttgtatatagtatacaagtgacaaaactgacttttaaaaaggcccaaatgaacctttaagtttcttgcctttaggatacttgcctaacatatagtaatataaaaatagttaatagaaaatttaacttgagatgatggccaaatgtgtcctatgtcttataaacttttccaaacataattgttaagagtgaataaattaaatagatgtaaatgggatgagttcataaatgaactattaatacctattaagttttataatatgcttacttaaaaaggttgtgatggttaattctgagtgtcaacttgataggactgaaaaatgcaaattattgatcctgggtgtgtctttgagggtgttgccaaaggagactaacatttgagtcagtgggctgggaaaggcagacccacccttaatctgggtgagcaccatcaaaatcagctgctagaatataaagcagacaggaaaacgtaaaatgacaagactgggaccaggtgcagtggttcacgcctgtaaccccagcactttgggaggtcaaggcaggtggaacacctgaggtcaggagttcgagaccagcctagccaacatggtgaaaccttgtctctactaaaaataccaaaattagccagatgtggtggcaggcacctgtaatcccagctactcaggaggctgaggcaggagaatcacttgaacccgggaggtggagattgctgtgagccgagatcgcaccactgcactccagcctgggtgacaagagtgagactccacctcaaaaaaaaagaaaacaaaacaaaacactgcactggcctagcctcccagcctacatgtttctcccaagctggacccttcctgccctcaaacatcagactccatattcttcagttttgggactcaggctggctttccttgctcctcagcttccagacggcctattgtgggaccttgtgatcctgtgagttaatacttaataaactcatgtatcctattagttctgtccctctagagaaccctgactaatacaaacatttttaaaggtttttaaaatctttttgttaactataccctcaaaatttgctatgctaaattaaaggatggatattcattgaatatctaaattatctctaaataagatacaattctaagacattaatgactatgagttgaagcttaaatacttttgacttcttatttcagagaaacaaaagatatttatatttcttagtaaaaatgtcctgttttacatttttatcgggggaaccagcccccaatatttcaacataggtcctttctattttccctaactgtcggccagtctgagaaataaagagaaagagtacaaaggaggaattttacagctgggcctctgggggtgacctcacatatcggtaggtccatgatgtcccctgagccacaaaaccagcaggtttttattaaggactttaaaaggggagggggtgtatgaacagggagtaggtcacaaagatcacatgctttaaagggcaataaagatcacaaggcaaaggtcaaagcaaagatcacaaggcaaagggcaaaattagaattactgggccgggtgtggtggcacacgcctgtaatcctaccactttgggaggccaaggcaggtgtatcacgaggtcaggagatcaagaccatcctggttaacacagtgaaaccccgtctctactaaaaatacaaaaaaaattagccaggcatggtggtgggcgcctgtagtcccagctactcgggaggctgaggcaggagaatggcgtgaacccgggaggcggagcttgcagtgagccaagatcacaccactgcactccagcctgggtgacagagcgagaccatgtctcaaaaaaaaaaaaaaaaaaagaattactgaggagggtctacgttcggctgtgcacgtattgtcttgataaacatcttaaacaacaaaaaacagggatcaagagcagagaaacagtctgacctcaaatttaccagggcaggatcttttccccaccctaataagcctgagggtactgcaggagaccagggcgtatttcagcccttatcccaaccacataagacagacactcccagagcagccgtttatagacctcccccaggaatgcattccttccccattgtattaattattaatattccttgctgggaaaagaattcagcgatatctctcctactcgcacgtccatttataggctctctgcaagaagaaaaatatggctctattctgcccgaccctgcaggcagtcagatctttggttgtcttcccttgttccctaaaatcactgttatctgttcgttttcaaggtgcactgatttcatattgttcaaacacacatgttttacaatcaatttgtacaacagcggtcctgaggtgacatacattctcagcttatgaagataacaggattaagagattaaagtaaagacaggcataagaaattttaagagtattaattttgggaactgataaatgtccatgaaatcttcacagtttatgttcctctgccgtggctccagccagtccctctgtttggagtccctgacttcccacaacatttttttttttttgagatggagtctagctctgtcgcccaggctggagtacagtggtgcaatctcgactcactgcaagctctgcctcctgggttcatgccattctcctgcctcagcatcccgagtagctgggactacaggtgtccgccacaatgcccggctaattttttgtatttttagtagagacggggtttcaccatgttagccaggagggtcttgatttcctgaactcatgatcatcctgcctcagcctcccaaagtgctgggattacaggcacgagccaccgcgcctggccctgttctacatttttaaagaatgttccattagaaagcctatgtttctaaatattataaaaattcatattcataaaccgttggtatgtgactgacacttaaaaattgcttacttcttaggttttcactatgaattaaggttactaggagttaaaattctaattaatacatggtaactagaattagggataagaaggataacaattctatacacagaatgtacaaaaaacacataagatttttttttggtgaggatggttataagatggatatgaggatatgttttttgttaaaggaaaagcgattttgcctaggttagaggttatttaaaagttgtactaaattgaagaaataaaagaagaacaatgagataaagtgaatggatataggaattcaggaaaagaaagagaatggaaaaaattataagaggtttaaaatgtttatgaaagtcatcttctgtggtcaaaagtgattgagattacaggcataagccatcgtgcctggcccaagtgctcttgaatacaggtttctgataactttggagatcataccattggactaggtaaaaaatacttccagaactctcataaaaacaactgatgtatttatgaagattgctaggccaatatcgagcagaaaaagaattaattccatggaactgaactaaggaaggactgaaataatttttacttctttttgcttaaaacattgtaaaatctttttgttttgttttccaaagtcctaaaaacttttttttcttttgagctcttcatggcttatagcaataggtaaagtaaactttcgtgagcaaattgagacatttacctttctctctacctgatttctccagaatttagaagctattcaagaacattattatttcatggcaatattgttattttcatgagttcaataagaatctgtttttctttgtagcaggacacaattggagacactgcctattcaaggctttcactggaatggcatattttcagatacaacaaggagaatttctgaaactaactttgggagaaacttagtttatagtttaaaacacagacagccctttcccaaagcagaccttcttgctgggggacaagattgcctttgtaggactaacattagccacaagataagaaattatcttgtgagactgatttgagtaataataaaactccagtctcccatacagcctgctctgcatgaattactctttctctattgcaagtcctgtcttgatgaattggcactttgtctaggcagcaggcaaggtgaaccccttgggtgtttacaaggacagcttcaacccatatgatttcacctccaacccaaccaatcatcagcaagcatccattacctggccactgccaccctttccctaaactggctttgaaaaaatcctcttaactatgagcttggaggagattgatttgagtactacttccatgtcccacgtggtgtggccagtctcaggtctattaaactttctttactgcaatgccatggtctttctttgtgcagcaggcagaaagaacctctcaggcagttacaattgaaaaacaagcaaaggcttgaataggcacctcacaaaagagaatatataatatccagatgacatataaaaaggctaaataccactaataatcacaaacattcaaagtaaatcacaacaagctccactacatatccaccagaaaagccaagattaaaagtattgacaatattaaatattgggaaactgttgtgcagtgtataaaatggcaccacaactttggaaaacattttgatatttttgtgaaaatgaataaaatttaaaatctgttagaacactgcaaactccttaaactttgagagagctgctactgtgatctgagtcatgtagcatgttttgcaattctgcttcttagattacagcttaaccgtcttcctcattgttctggttctgtaaatgactaagaaagaccagagaacagacttcctccttccaatcactgatatttattctagattaactgcttcctctattgttctgtacctaactcagaccagattgcatcctcaaaacagaccccctgagggttacatcttcagtgtggaatgttagagatatctttccagaaagaaaaaaaacacctcaactaatcagatcattgtaactatgcattaagccttccatagaaaggtgttgaaattctgctaaacttccctgaactttatctgtataaatgatctgaaacttttatactttggaacactgacttccattctttggaatctgtgcttgctggtgggtacatcctcaagcactgtgcttgaataaactctctttcaactacactctgatgtttttgattattttaggatgacattctctataaaaaacacagatacacataccacatatgtaaaggaacacagcaacttaccaaatctgtttccctttcctcctaagcatacaggtatgctaaatttcccaatctctcctgcagtttgatttggctacaggactaagctgtggcaacggggacaaagaatgaatgacattctatgatttggaagccacttccaaatcttgcccattaaaaaaaaaataaaacactccataattctccattctctctttcacctcttaaaagctgaatactaatacctgaagaaaacaaaactatttcacccaaaaatatactcctttgacatactttgagatggctgttagaggatctgcaaacagaagcagtgctgcaaagctgtcttttgtggggagatttgtgtctctagagaatctgcattgatgcaacaggcttttcctgaggtcctcccttgcagatctaggaaagattaactgagagtctgatacctttaaaggtctgaaagaaacatttacctattctctctgagggctactatctgtgagatttcacctgcatagtgaggactaagctctgtttttgtgtgtgtgtatttgtttgttttaatcttggccaaattcctatctaaggggtctggagaccataaatgctcatcagatgggttttattttaaccctgtatatggtgacttactttccaatctgactctggcataacaaggaagaaaatcaaaatgttttacccccaaatacatttccttgccatgccttgaaattgccctgcaaagtctcttgtgggaaaaatccacattctatagagaatccccttactcctttcttttccttccttcctttccagatccaggagataatcacctatgagccaggcacccttttaagtccgataagaaacattttaccacctgctatctctgaagtctgctatctgagagcttcttctgcacagtaaaacttgatctccacaatcctttatcttaacctgaacattttctttctattgaccccaggtcttcagataaactcaactaattgtcaaacagaaaatgtttaaatttacctatagcctagacccctccccccgcccctgccctttgagttgtcccacctttctgaaccaaaccaatgtctttcttaaatgtatttgatggatgtctcatgcctcacttaaaatatataaaccaagctgtacccccacctccttgggcacatgttctcaggacctcctgagggctgtgtcacaggccatgatcactcatatatggcttagaataaatctcctaaaatattttacagagtttaactcttttggtcgacaatagcaagaccacctttgctagccaggcttcctcttttcccctcccataacctgtagcaccactgtaacctgatttactaccataacctggttttggccatgctccaagacctcattcttttgtaacctcaagatggtacatgagcttctgtactcccactgaggagttggaggtcatcattctctcccatgcacgttaataaacttgtatgccatttctcctattaatctactttttgtcagtttatttctcagtgaaacttcagaaggcagaaaaaaagttttcccttggcccctacatcaccagggtgaccttagaaatgacactaaaggccaggcattgtggctcacgcctgtaatcccagccctttgggaggccaagggggggtggatcacctgaggtcaggagtttgagaccagcctggacaacatggtgaaaccccgtctctactaaaaataaaaataattagctgggtgtggtggcaggcacctgtaatcccagttactcaggaggctgagacaggagaatcacttgaacttaagaggtggaggttgcggtgagccgagattgcgccactgcactccagcctgagtgacaagagtgcaactccaccaaaaaaaaaaaaaaaaaaaaaggaagaaagaaagaaatgacactaaagatgacagagtttctaagaaaagagtcacactccagcttctctcacctctgagagattttgcttggatataacctcctctaagaaacaactcattacatcttacatcttcagtatgcattagatgcccttctacaagtcttgtgccaattatgcttttattaagtaagaggaaatatagagtagtcactctaagtgccaactccggattcacttctatctgggttccaatggtttggcttagtcatatggccaagccaaacttcaatacctttgttatttgttggctctgtgacttgaacaacttattaaaacctctgtgagtttccttttctcaactttaaactgttgctacatcaataaatagactagacaagtgtttaaggacataaactctggtatcagactacttgattttgaacccctaactctgccagttactaactttgcaacttgttctcgccagtaggcagtgcagtggttaaagggtcatgttccagggccagactgccagcgtggaaattctggccccacccaaaggtgtattcgccattaagttaatggcatgaagcctcagggcttcctacttatgggtgcctcctccaagatcctgtacctgtagtttacatttgtaagtttggattctatttcaaaaagaggttctcagatactgtaaatcaaaactcagattccacaaaacctgcttgcaaagttgactctgccatatactggctatatggtctgggttagatatttatctcctgggtctctgtttctcctcttgtaaaatggaataaaaatggcaaccaccttcacagggttgtaataaagattgagctaatatatgttaaaatgtttagagcagtgtaatgcacacagcatatgcttcatgtgtgttggtgtctataactccctctctgtccactccttatcttcttctcatgagccctgtcaggactaagattatctttctctttgtaaacttagcctgtggcaagcctcacctatattctaactctttccctatgggactatacacattctcttctgtaagcttcctgagttgtttacaatctgattttatcaacctttatctgatttcttaaacctagacttgttcattctttatggcataataattatggtttctttttctccctaatcttcttcctcaagggacctcaagcttttctcttaagactttcaactgatccaatgagtctgacccatattatggaggtaatctgttttactcaaattttactgatttaaatgttaatcacatttaaaacaaacaaacaaacaacaacttcacagcaacttctaaactgttgtttttccaaaaagtgggcaccatgcctagctaagctaacaaataaaagtaaccatcacagcagtcatggcctgaataagacttgtcctaggccaggcacagtggctcacacctgtaatcccagcaatttgggaggccgaggcaggtggatcacttgaggtcaggaatgtaagatcagcttggccaacatggtgaaaccccatctctaccaaaaatacaaaaattagccgggtatggtggcacctgcctataatccccactactcgggtggctgaggcatgagaatttcctgaacccgggaggtggaggctgcagtgagctgagatcatgccactgcactccagcctggatgagtgagattctgtctcaaaaaaaaaagattgtcctgtacattgtaggtattgcagtttcctgctagctcacagaagaacagcctcattaccttcaatagatgctcttaacccatcgtcatctgccttcctctggacactgccttttgggagtgctggagttgcatcctcaaggacagggctatgccttcaaagagccaagcaaagaacttttcctgcattttcccacacagacacttcctagattcttctgccttatgcctgccttggtcagtgtagctaggatgtgcttcaaatggaaattatgcaagtgagaaggaccaggtgtaaagacaatttaattgtgggaaaaggcttacaaaggaaggtcattgtgaccctcacaagcagtgttcttgagtggataggacataaacagggaagaaagcatgtgatcatgagaacagctgaagttctgagtgagcaatgacatgaatggtgtccaattcaaagaaaagagaaggtagatccaggagctgaataaacagacagagcaattttgagagatacatccagaaagcagaagcacacacttacactttagctctgaatcctggctaaagcaacatacagaggcggtaactcctagaactctgattttcactctgttgccagagaggctcttcctgggcagctgtgtgccatgcaaatgatagaaacaaatcccatagtattgtaagtcataggttaaggagcagatttaatttcataaggagaaataacacaatgccagtgtcagcaagagcaagtctccccatcatcccaaggagaggaattctacaacctgggtatctactggacataatgtgggctccattctcacagaaggaatcctttccactgtggttcttcctgtgtggcttacgcatgagacaagtgtaagaaagtggccatgtcaataagaaaataagccagctctttggtgccaagaagtctgatttgggggtgccagctatttataggaattgtctagaattaaaatatcaccctgccttggggattgtggggcagctggggatcttggacatctgcagtatattgcaaccacacctgaaattaagaaggactcaatgacaataaacatctttacatcacccagtgtcttgaactcacttccccatcatgtagagcagctcaggtcttctctagctcttccacctcatgatgggtagtgactgctagggaagtcctgatcatcctagccctccaagaaatgttttgaatagcattgcatcttgaactcactataatttgatcaagcaaagatgttctatgtctctggtctgaaacctgccaccacagctgtgttctctgctttcagagaccaggggagcagtgactgaagctaagactacacatagcacttcagacaggcaaattaggagggaaaagaaaactgaatctgtaaactcgggaaaaactggtgtatcttttgaggtcccagccattttgagaaactctgatgctgaaaaaataaggaagaacaatctgactcctctctcaaacgctgacattctagctgagtgttgattttttcttagaaaaacaaactttgggtcaacaaggaaagatcacgagtggggagggtgaatgggtgattcacctcatggatctccctggcagctcttgcacttccttgatcaatctgtatataagaaatgtgctgggcacctgggacaccacttctctgggacacattgccttctgttttctccagcatgcgcttgctccagctcctgttcagggccagccctgccaccctgctcctggttctctgcctgcagttgggggccaacaaagctcaggacaacacgtgagccatgcccttctcctccccacaaaaaaaattgcagggagggctcctctcccagtctggaaattacatatctctttctgagaatttctttcaacttcccagaactctagtcccaggagctcccatggatctcctgccaggttccacttcttgtcctcttaggaagccccaccaactcctctcacatttttgctgggtgtttctgcattgccagtggaaataaagctccaaatgtacctacaggctgtaattagtagttagtcttcatctaacatgctgatccacatcttgttcataatttatacctttgttcagatttctgctcagtaaactttaccttctcacaccttgcctcctagaagagaagcataacaggtctgtgaattccaatggcagcttagggcagctttggcaggactggctaaaggaccagaggccctggccactgccctgtggtctgagattgagctagactggcagcttagacattcttcctaacctgaagtctgaagatgaatatgatgacctcttgctctcacgtatactgggacctgagagcacaggttcagaagtcaacttattgagaacacatgtgtgaaggaagcagaaaaattggagcaagtaaaataaagtagaaaatggagccaagggtctgggagaaagcagcgatacccaatctagggagttttctctatagcagtagggtttataatgctgggtttctgggttgtgatcttggaggtactctctatggcatggtcagatatcctgtcctggaggaaactgttcagggttttgacaagctaatgtaatggaggcaagtgtcccaagaaaccctgcatggggacaggttcagatcccaccccattcccgccagatgacagtccacttagccctgaagggcagcaaggtattcaaataagctatgctaattaggttatcaaccatccatcctgatttgcccagaactttcctggttgtagcactgcaactctgccctcccccgccacctccacaacccattctggaaaagacctcagtcctgggtaaactgagatggttagtcactcgaactaagctggtcatcctatcaatctgaaactcatatacaaatgggagagattttgaagttgcttaggtatttatacccttttcctgtgcactgggcactacagcagttggcaccaaaaaatagaatctctctaagatgctttgccccaagaaaatggggctgtgagacactgtgggctaagaatctcaattcccttctgtcccacacaataacaaaggtccgtagccgggagtttctagggacgagaaaataactctcctggccccgaacccagtcctcattgactgaagaagaacatttgaccattttatttgtctccatttcctttccttttcagattgcagtgtatggtctaaatgtagagtagtatctaaagttcccaaacatggccatatgtccaaatttcctaaggagctaaataaatacaaattcctaaaccctacctggggaccacagaaggaggatcttcaaagatgctcctacaaatacctccagtgcattgagatgtttgctgggtttttaaaattttttattattttattttatttttccataagttactggggtacaagtggtatttggttacatgagtaagttctttagtggtgatgagattttggtgcacccatcacccgagcagtatacactgcaccatatttgtagtcttttagccctcacccctctcccactcttccccgcaagtccccaaagtccattgtatcattcttatgcttttgagtcctcaaagcttagctcccacatatcagtgagaacatacgatgtttggttttccattactgagttacttcacttagaataatagtctccaatctcatacaggtcactgcaaatgctgttaattcattccttattatggctgagtagtagtattccatcatatatatatatatatatatatatatatatatatatatatatatatatataccacagtttctttatccactcgttgattgatgggcatttgggttggttccacagttttataattgtgaattgtgctgctataaacatgtgtgtgcaagtatcttttttgaataatgacttcttttcctctgggtagatacccagtagtgggattgctggatcaaatggtggttctatttttagttctttaaggaatctccacactgttttacatagtggttgtagcagtttacattcccgtcagcagtatagaagtgtcccctgatcactgcatccacgccaacatctactgttttatgattttttgattacggccattcttgcaggagtaaggtggtatcgcattgtggttttgatttgcatttccctgatcaagaggtttgctggtttaatgtgattctgttgctagaaaattttctcctaataatgacttgagccctcctactcagtagacaaccaccagagcctgtaggatgttatcaggaagtggcatgtggtattgtacattttttctttttaaaaacttgtttttggtcaatggaagggaagaagatgctcgttcattgatgggcatttgggttggttccatgattttgcaattgtgaattgtgctactataaacatgcatgtgcaagtatcttttctaaataatgacttcttttcctctgggtagatacccagtagtgggattgctggatcaaatggtagttctacttttagttctttaaggaatcttaaagtgtcctagttgttttattaaacaaaattaaatctgtgtgaagttaccaatccaatcaacacatgaaaattccaggggattccaatgctgaacaattgatccaagccccataatttccctcccttgcccatcctgtgccccttgccctgttcatggctcccccctcactcaaagattggtctctgatcctggtgttctgattctctcttcccacaatcagtcggaagatcataataaagaattttgacattcccaagtcagtacgtccaaatgacgaagtcactgcagtgcttgcagttcaaacagaattgaaagaatgcatggtggtaagtagaggactgggggcgtgacttcaaaagataattcaactccttgattataaacataatttaatctctcactttaataatgtacagtgtacttaatgaaacattctcacttatgttatgctacttgagactcagaacaactgtgggagcttgggacagatgacttctcattttccagatgaagaagttcgaatccagagaagtctaggataaataagaaggaaaggaagaaggaataggaagtgagaaagagggaaaaagaaaaaagtgtaagagctagtagagaagcagttagagtccttccaaggtcctgagcatgtttagtttaggatggagggaggggagttctcagaagagaaagcagcaactccacaccataggttgaggtgggtgggcagaagaggacatgcaggatatgactcctcctctccagtaagcactgagcgactctactgtcctcttgccttcttctgctcctttgctctgggtcaccagaagtggactcttgttccagcctccccaccctgacaaggagctcgtaatcatctcctccttttccccacgttcagaagtccaatctctgaacaaggtcagaggttttcaaatggtaatgtgtctaaaactcactcggggatcttgttaaaattcagagtttcattcagcaggtctggggagagattagaacttctggattttaacagacgcccaaggtacaccaaggctgtgcccaaaggatcacatttttgagcagcttgggattagagcattatccctcctgtctagctgccaagggccagaagtcaaatagacttatgcagttattaatccacagtgactcttccctgggacactggttgtgtgtccttttcctagtcattgatctcagatgtcacaagcatgcaaactgcccccactacctttgttctagggccaagacccatgcatctcccatctcccctactccctccccagacccttcatgaaggacaccttctatcaggcagcacaagtatttccttacaacataagtttcctaattcaaatgagacttaaggacaatgattacatgtaaaacaacattgagaacatgaagattgctattcagtcaactgcattctagaaatatccccacacctgtaaagaaaaattcctggtcaatgagcaaagaatatcacagctgctttgtcaaatttttctattttcagtccaagaatctgagacatgtacactaatttggggtaggagcaaggctgaatcataatttttcaactctgtattttgtttatcacaaacacaggtgagaatgagaataagaacatgtacataatgtgtacataaaatttttgtgaaaatggtggtttctggtggtaatagttaatggtagtggtaggtataataagatatgtttgaatcaataaaattacatgtgacataattttgtgcttttgtgattaataaaagtatgcttttaagaatcatgctagtactctaaaataaagcaatcttttcaaaacccacctaagcacaactaaaagaataagaaatctttagactaactgactttgcaaactagaaataatttacaggaaaggaaattttgttaattctagtcaacaaatttttatttgtggcttcatttttcaaagtataactatttttaaatttttattaaaatatatttatataactataaaattcttaccatctaatcctcattttttatcatttataatgttttctgtaactgaatttttgaaaaagtgaggtttagactcatatttatttattttagaattagaatagaatatacctacaatcgtatatttgaatataaagattgcataatcctttaaagctgaaggaaacttgtggcaaaaacaatgcttaaacatttttgtgctacaggccatttcgttggtttcatgaagtttatgaaacatttatcagaaaattgcttctaaatgtataaagtgcattggattacagagagaaactaccacattgagtaacagtgactaacttgtaaaaaataaatttgtgatgcagtaaggtatgtgtttctttatgcacacattagctgggaaagcaatacatttaaaatatagaagagttgaattttattctatgaacacattatctgtgtgatggatgttgttacttagcttgaagaagtacattaaactgcactggtctttggcaacacgtcccacgtgccatgctaggcatgcaacggattctgatcttttattgtacaagtggtgtaaattctgattcatgacgatatgttgttgctaatgtaacagaaaggtaaacaaggccgggcacagtggcttgtgcctgtaatcccagcactttgggaggccaaagtgggcagatcacctgaggtcaggagttcgagaccagcttggccaacatggtgaaaccctgtctctactaaaaatacaaaaattagccagggctggtagcacgcacctgtaatcccagctactcaggaggctgaggcagaagaatcacttgaacctgggaggcggaggttgcagtgagccacgttcgcaccattgcactccagcctgggcaacagagtgagactctgtctcttagaaaaaaaaaaaaaagggaaacaaggcacaggtagtcttctccaaagaaacgccaggattctccaaggcattctgagtaaaactccaagggtgagaacacctgaatttactgtttaggtctgaacggctacttgatgctgagttgccaggtagctgagcaagctgcaggaggtgggcagaatggcactgggcctcagtcgtgaccatgagccagtctgataactgccatacattcaaggtagtacattcaggctgtatttcggacctctggatccgtgcaatgatatgtacatatctacttttctccttgtgataaaatcacacatactgctaatggcactgtggttccttgatgacattcataacagaaggaatgctgaatttcaattagaggttagtaataaagatgcatatttttcccctgcctgagtccacagactcactgaatgctatccacagatccctctgggtctatggaccccaggataaaactgctgtgttaaacgttaactggacaaaatcctctgactccactgaaatttatatatacaataatctgggatcttgaattgcaaagcactcaagttaaaaagaaatttacattcaagatgttatttgcttatctaacagccaggtttggtagttaattgtttccacctcatacctgaggaaagtgagagtgagaggcctctcatcaccaaaggtcaccaagtcagagaggagcacagatggggcttggtcacagctctgacaacaaggcctgacattggctcctacacgcaagtggccaggctgctgtctcaccaggtctcagagtaaacgtgattgcaggtcgattcctgaaacctctggctggtgactaaggcaagcctgctcctcagctggacagctgccctggatgagctctccttgccctgtggattcacttgcatccctatctcctcctgagcttctccacactgctaaggcaggagtttgagggcattggaagggaaaaccttctgacctagactttggctcctgaaatgatactacaacagtagactcccccttgccctaggcccacctccacccccactcttctcctccggcttttccctctcctatttttccctcccttacccattccccaaaataacaatgaattccccctcccaccttctcctcaccaggttaaaacttacctcattagcagcatccctctacaaggtgcatttaactataagtatactgcctgcctatgtgacgacaatccaaaaaccttctactgggacttttacaccaacagtaagtacagaagttgtccaaggagggaactacccaccagccaccagggaggagaaactataaacagaaacatggctgcgaaccgagcaggaccaggacctcagggcagaaggacagaagggagggagggaagagcatggggagagcagatggggaaagcacccaggttctaagacagaggcattgagtgcaaaaagttgatacaggagacaaatttgcaaaggatttggggaaactgaaccccagggggcagatgcctgatatgagtagaaaagacaggacatggccggggtgtctgagagatgatctccgtccctgtctttttcaggaactgtgcaaattgcagccgtcgttgatgttattcgggaattaggcatctgccctgatgatgctgctgtaatccccatcaaaaacaaccggttttatactattgaaatcctaaaggtagaataatggaagccctgtctgtttgccacacccaggtgatttcctctaaagaaacttggctggaatttctgctgtggtctataaaataaacttcttaacatgcttctccatgttctgttgtatctccaaaatctgctcctgaagaaccccagattacctgaaatttctagaacatttgtctttcaaagaacctttactgaggagattgtacgggttctcactgcccattggtatgaagagggagagaagaagaaactgggaagaggagctatgctcacagagaggaaaagcagtggccctaaagttcacggcacaggagtggcagagccagggcaggcaccaagcctccctgttgcttgacctctctccatcccactgccctccagcaacagctcagatcccagaagacaggagtcctgttgcatgcagcagagtcagggatggagtccatggccccctaaatgagcagtagcattctatgctattctgttgcttgttttcaatggattgtgacactcagggatatcagggtcctgtgcagctctgcctgaggagctcaggcataatagaggagtaaaggggcagagggagccctgaggggcttcatcccagagggccagcccatagaagtggaatatgagcaaggatcaggtgcacgaagtgggcagagggcattctagtagataggacgcaggcaccaagagcccaaagcatgaaatagtggcttgctcagggcaggtaaacactttcatattgggcaggattaagtatacatggaagagttagaagcagatctggcaagaggacaggagcaaaatcaggagaggccgagtgaatctgggcaagaaagtgggaccatatcccctaggccagtgatcctaaatgagaatcaaaatccagggcggaaaatacagtcattggaaaagatcattttttatattaattaggattgtaacattgtgaaacaggagagttacctgacctccctcgcagaacatgcaacaggggtgtcactcatctgttcagctgctcaaaccccttagaggaggaggagcacgcagacggacaggtgcaggagggcaagtgggagtgtgttaaaatgcgctcttttagccttgctgtctacggacagtttaagtgttaaccagctcagtggaccctctgcctttttgcaaaggcagagggctactgtgacagctttctgcatcccaagttcttgtccagcatcccggaagaattgggtcacacatgaactggaaggatggtgaatgcagggttttattgggtggtggaggtggctctcagtgggatggatggggagccggccagggaatggagtaggaagatgatcttcccctggagtttggctgtccagtggctgattctccgtccatccccagccgaactcctccttacattcagacactccttcccttctctccttctctgctgcgctattctgccatttgtctcctcatctgctcatctccttctggagcctggggttcagggtttatatggataccagatgggggcatggcgggccaaaaggcaattttttaggcgcaaaaacaggaatgcctgttctcatttagggccgcaggtttccaggtttgagggtggggcctttgccagggaacagccctcttctacccagtatttctctgtctcctgtccatatcaattgattatatgcttaacaggtaccaaaaatgtgaataattttatttacatgctttatcacatgccctatttaaaacaataacagacattaaatatttattcactcaataaatatttatcaagtacctacatgtgccattacctgctttcagcacttggttttacataagtaaatcaggaattttttatcctgttcttaaaatgcttatattgttcccaggcaatagaaaataaacatgtacatgttattcttacctttatttatgggaaaactgagataagagaaggtaattaatttgcacatagccagcaagtgacagagccaagattcgaaccacacaggtagcctggagagacatgctcctaacttctttttatttttgtttttttttttttttttgagacggagtcttgcactgtcacccagactggagtgcagtggcgcgatctcggctcactgcaagctccgcctcccaggttcacgccattctcctgcctcagcctcccgagtagctgggactacaggcgcctgccactacacctggctaattttttgtatttttagtagagacggggtttcaccgtgttagccaggttggtctcgatctcctgacctcgtgatccatccacctcggcctcccaaagagctgggattacaggcgtgagccaccacacccagcccatgctcctaacttctatactacttgcacatacttcccaacagtctcctttaggcccctgcaaagtgtctaccaaaaagcatttcaaaattgcaaattttatttcctctatgaattatgtgaacacctatatccacctagattttgttttgttttgttttgttttttgagacagtgtctcactctttgacccaggctgcagtgcagtggtgtgataactgctcactgcagccacaacctcctgggctcaagtgatcctcacacctcagcctccagagtagctgagactacaggcaagcaccacctcacctggctaatttttttaaaaactttttgtagagattgggcagggggagcctcactatgttgcctagggtggtctcaaactcctgtcctcaagtgatcctcctgcttctacctcccaaagtgctgggattacaagcgtgagccacccatgcccagcctagaatttttgattacctagagtagactgttcagtagaaatattcattgaaggccgggcccggtggctcacgcctgtaatcccagcactttgggaggccgaggcgggcggatcacgaggtcaggagatcgagaccatcctagctaacacggtgaaaccccgtctctactagaaatacaaaaaattagccgggcgtggtggcgggcgcctgtagtcccagctactcgggaggctgaggcaggagaatggcgtgaacccgggaggcggagcttgcagtgagccgagatcgcgccactgcactccagcctgggcgacagagcaagactccgtctcaaaaaaaaaaaaaaaaaaaagaaatattcattgaaatatattttaagctacatgtgtaattttgatagccacatttaaataaaaagaaaagggaaacaggtgaaattaagttaataacatattttatttagctgaatatatcctaaattcatttataagatctaattaatattttttaaattgttaatgaaatagtttacattcgtttattcttagtaagtctttgaaatctgttgggtgctttatacttacaaaacacctaagtcaggctagcctcatttctgaaactcaatggctacatgtagccagtggctaccatattagatggggaacttatgggatgggtcaataggttcagtgaggggagagaacttagaggacacgtcaataggtgcagcaaagcaccatggcacacgcatacctatgtagcaaacctgcacgttctgcacatgcattctgggtttttttttttagaagaaataaagaaaaataaaaattaaagaaaaaactagtaaaaaaataacaaattcagccaggtatagtggcacacacttgaagttctagctactcaggaggttgtggaaaaacaacaacaacaactttgggcactttgactcttccttgttccaaataagagactatgcctgccatgattgcctggtcgatatgttttcatccttttagaataacatgtaaagccttcaaatgctccgcaaatataacagttgcccaataaatgctttgtttaattatgtgaattaattaaggctgagaaatacatcataatgagttaaattttataaggttgatagtcctgctacagaattggtaacagctagtttcaccctgtattatcatttgcttcctatagctctcagccagacattttccatttcaggggaaagtttactgagtgcgtgtgacagggaatatttatgaaagaaatcaagtttttccaaagtaactcctataataaaatgtgtttacatttgttgggagcaacattaaatagcatctgtatgtggagaggcctggaaagaagaagactgaggagtttcggataaacaaaaaacaatgtcagtgccgggcacggtggctcacacctgtagtcccagctacttgggaggctgaggcaggagaatcgcttgaacccaggaggcggaggttgcagggagccaagctcatgccactgcactccagcctgggctacagagtgatcctctgtcaaaaaaaaaacaaaaacaaacaaacaaaaaaaacccaccaaaatacaggaaaaaggaaaacaaataaaaaacctcaaatataaaacagttactaggagagagaaaaccttaatttttattcatccaagacataaaagtgatagagatgaagcaaagaatattgaatgaatcaatgactactgtagaatcataaggagagataactagtgatgacttgcatttctgggtgaatggtcaatgactcgagaaatagatatatgggaaacttctggaaggatttgtaagaaattaattactgtgatcatctgatagaattaagacatagatggcttctatttttcaagtagtagtcctctatacattatttcattattttattttataaaaaataaagttaacccaaaaattaatgagaaatgctaaaactgaaaaacacaataactgcaattaagaacccaataaacggtttttaatagcaactcagacaaagccaaggagtgaactacacagttaattacaaagaaaagaaagatgaataacacagaaaatagagttagagacatacgggataattggaagggagataaaagacttgcaataagcttctcaaaaggagaggcgacaatgattggaaaagaagtaatattggaagatataatgacttagaattttcctaaactgacaaaagacatcaaaccacaaatatagaaagaacttgaacttgaaccaggataaatgcaaagaaaattacgtttaacacatcatatcacgtgcaccattttattttcaaatggtagcaatacgagtgatagctgacctgaaaaacagaaacaatgtgagccaggaaaaaatacgatgatatcctcaaagggctgaaaaaaaaccctgctgatctggagtttatgtcagtgaaaatacagataaaaatgtctttaaatattaagaaccttcaagaaaattctgtacttaaattatttactttaactcatacaatatgtgaactcagtagttttcacatttttttcttcattccttgcataatttataagaatgtaatttatgagtatttaagactcttaaatcttacagatgttgtgaacatattaaaacaggccaaataattaataatcttatttgaaacaattaaaattgatcacttccatattagtaagctttatttaaagaatattgaaatattgctttgaatcagttatttctgtcttggaacaaatttctaaaaccaacttgagaggacacagccaaaagtctaactgaaagaaaaaaaaaatcacctgagcaaatgagaagatacttgacttcgctcttaatcagaactgtgaaaatctaaactatactgaaatgtttttcacctaattgaaaaaagacacataaaaataataatgctttctgttgctgagactgtgggaaaataggtctttcaaacatttctcataggtgtgaaaaactagtataacactgcaaagaccaatctggtaaaacccatcaaatttgcaagtatatttctccttagtccagcaattctaattctgggaatttatcctacagataaacctacgagcatgcaaaattatgtatgaaaaatgttattcattacagcttatttgcaattgtaaacgtttagaaagagtcagtgtctaccaataaaaaaaactgcttaaattaattctggttcatatacacaaccgaataaatacacatggctttaaaaagattgaaggcactctgatgtactaaattgaaatttcttcaatcacagtgtcaaatgaaactagtgagtcatagaacattatatgataaattttgtgatggaaattaaagaacataatagtatttattgtataactgtacactgatgtaaagaaatactaggtcaggcgtggtggctcacgcctgtaatcccagcactttgggaggctggggcgagtggatcaccaggtccagagtttgagaccagcctggccaagatggtgaaaccccgtctctactaaaaaaacaaatattagccaggcatggtggcaggcacagcagtgcactctagcccaggtgacagagcatgactttgtctcaaaaataataataataatatttttgaataagtaataaatgaatggaaggaagggagggaggaaaggagaagagaaattagtttaatgagtttgaaaaacatagggataaatagcagagtaatccaagtaagagaagacctgctgcatagcacctggtatttgggagctggccctctcaatgcatggtgaatcttgtagaaaattcaaaatgaatggatggaagcagccctccctggtcttgctgtcaccttaaggcatctcaaggaccttgttagtttcagcactctagttctctggaaagactctacaggggtaagagcacagctgtcccaactcatccacccttggacttcacctcgccatctgatatggttctcccacttggatgttaggtgggcaattccatgggttctctagtcgtcttagctttctaagacgttcttaagaccacatgttctcctgcagatgactagagatgatcacagggtccttcaaagatggattctgacaactgccccaacatctgaatttccagcaagaggaagcaggctgagcagtaaccaaagctagaaaaatggagacctgggacaacaggacctttcctaagaagcttcaggattgcagctcccacacatataatttaaacccaagcccccttagaggggccaatacacagaaaggtcttgcttactgacagtatcttaagaaatagataccaaaaatatctggtctaccctcttctcatctgattttttcctatttctgaggcttgaattctcatgaaacatactctatactctatagagggctatcatttcttacagaagactcattgtacctgaagatgcaaaccaggagggctgagtaggaacattagtgtcaagtcattcactcaactagagtaaaatttagagttgaagtaactggcattggtagaaagataagacaccatgtcatctagaggacaaaaagataagaatatacatttcatagatcctacagacccagagcaagtattgggaaatagaagtgaaaaagatgctgtttagaaaagttaaggcagaatccatcctgctgttccaggaacattctaatctgatattggcaaacaagggaaaacaactgaactaattctttcctcattccattccaatgtaaaattccagctgaatgttgacatttctccaagaaaaaaattcatggtggtaattagggaagtttcaaggtctgatgattttggttgagtggcctgcccaaatgtcacaatgttctcttgctgtagttatgaagaataatttgggtgcctgggtgcacagttctctgggcatcaaatttctccagcatgcatgctcttcagattctgttcaagccctgtcttgttgccctgctcctggttctctgcctgaggctggggaccagcatagctcaggaagaattgtaagccaccactttctccttgttgcagaaaatcttccaacggggacacatctcccaacccagaaatcaatatggtgcccctagggattattttaccactccaaaggggacacattctgggtattctcactaaagatgtctcttagtctcactcttttcctattcagatcctattgtgggggttactgcattcatgtcttattactacttgtattttaattcatttttctatcctaagtttatcattggcatcattttctcctaaatgaaaagcatgggcagagatgtgggcttaatcaatacctgtgggatgagctttggataagatgcctgagctgcaagagaggggccatggccctggtctttactggggttacaaggttgtgctgaccactaactcatacaattggtctcattggaaacagtgctctctatctcattaagatctgtgtcatacactggggctgggacctacaagacctgagcaggtttctctaagtaaggaaaaagtagaaacatgctcctggactccaccttttcctggatttgttcctaaatgcaacatgtccttgcataaatgcgacacagctggtctccaggtctatactgatttgccaaaacggaggaaaagaaatgacagattccagttccttaagtggaaaggagaacattgaaacgggactctgtcccttggcaagagcaaagtactaagatccagaatgaagccagcaggtccttaggagacatggacgtgtagcagacagaatgtggagaaaggagtatctagcagatggaaatggagccatggagattttggtgaagaaggggttcttgccaagcctggatgtttctctaaggagaagagaagcaaagaggatgtgggggtggatatatggagtaacacaaaatgtgtgtgtgctgggttttggttgactaaacttctacttagtttcccctctacttagtgagttggacaaagttgaactatgttgatcattatgttaaactttaattcattggtgtgatatgtttatcagactcatagaatttcttatccttctactagttataccagtataagaaaatgaactttcatggatttggggatgattccataagaaaaatcaaaaggagaatctcaggctaaagtagaccatgcaaccaaatcacttcctgcttcaaacaacatggtggagattcaactgagtatccatgatgaaggaaaagcagtccctcagtctggctccctgccctcatcagtccaccaggaatatgacctcttttcctctggcctccatttccccttcctatcagataggggcatcttggctggacacacagagcccacaggcacaagtcatgcacagaggatccttatgagtgacagcattgacttatgtgcttcctcactccctgcacccctctgttcactctgtcctcctgcttccattctccctcctgggacacccctgtcctacactttccctgactttgggtttctccttcttttggcatatacagacagaacataatttttctgagcatgacaatccctgaatctgtaaagccagaggaaatatttttgctaacactcatggttacaaataacaataggtataaatatgtggaggtaactgaagaattggagggaaggttggtgggaaagagaagagaaatatcacaataaagaacattggtcgtcattactgattgtatgtgaaacagtttaacatcttgccaaatgcttcacctacacatgattttgtgtacattagccttgaacctcagaacaactctgttaggaatgtacatgttatcaattccattttgaagttgaagaaattgtgttatgaaaaagatgaatgagtggaggcttttaaccatagggtcaggactctaattcatgaggggagggtagcagtggggagattaggaagaggaaaaaaaagaaatgagaggaaagcaatccaaatgcagatgaaaagaaagatggacagagaaacacaaatcaaaaccacaatgagataccatcttacaccagtaagaatggctactactaaaaagtcaaaaaataacagaagctagtgaagctgcagagaaaagggaatgtttacacacttttcatgggaatgtaaattggttcagccactttgaaaagcagtttgaagatttctcaaagaacttaaaattgagccaccattcaacccagcaatcccattactgggtacataccgaaaggaaaatagaccattacaccaaatggccacttgatatgttcaccaccatgctattcacaatattaaagacatggaatcaactaagcgcccattgatggtggattggataaagaaaatgtggcacatagacaccatggaatactatgcagccataaaaaataaaatcattttctttgctgcagtgtggatggaactggagaccataattctaagcaaattaatgaaagaacagaaaaccaaatattgcctgttctcacttataagtagtagctaaacattgagcacccatggacataaacaagaaaacagacaatgcagactgctagagggagggagggcaaaagggaggaatgggtcaaaaaactacctattgggtactatgctcactacctggatgcaaaatacccatgtaacaaatctgctcatatacccctgtatctaaaatgaaagctaaaaaaaaaaaaaaaaaaaaaaaaaaaaaaaaaaagatggattagactgagtgacaatgctcagagacttctattggaaccatgttcccacccacccctactcgccccaaccagcccatgcagcgatgaggatgaacctaggagacccagctcaacaggctgtggcagatgtaacagaagcttcagggatgtggtcattgtgatctctctcaaaattgagagacttaccatcacacaagaactggctatatatatacatacacatacacacacacacacacacacacacatacacatatatatatatatactttatgttctggggtacatatgcagaatgtgcagttttgttacatagttacacacatgccatggtggtttgctgcacccatcaacctgtcacctacattaggtatttctcctcatgctatctgtcccttagcccccctccccctgacagggcctggtgtgtgatgttcccctccctgtgtccatgtgttctcattgttgaactcccacttatgagtgagaacatgcggtgtttggttttctgttcttctgttagtttgctgagaatgatggtttccagcttcatcgatgttcctgcaaaggacatgaactcatccttttttatggctgcatagtattccatggtgtatgtgtgccacattttctttaaccagtctatcattgatttgcgttggctccaagtctattgtgaatatcattcatttgcattggctccaagtctattgtgaatagacatacgtgtacatgtgtctttatagtagaacgatttatacttctttgggcatataccgagtaatgggattgctgggccaaatggtatttctagttttagatccttgaggaattaccacactgccttccacaatggttgaactaatttacactcccaccaacactgtacaaccattcctatttttccacatcccctccagcatctgttgtttcctgaccttttaatgatcaccattctaactggtgagagatggtatctcattgcggttttgatttgcatttccttaatgaccagtgatgatgagctttttttcatgtttgttggctgcataattgtcttcttttgagaagtgtctgttcatctcctttgcccacttttttatggggtttcttgtttttttcttgtaaagttgtttaagttctttgtagattctggatatcagtcctttgtcagacggatagatggcaaaacttttctcccattctgtaggttgcctaagaactggcttttttgaagtcatgtcctccatttcctttccctgctctcttcactgagcattcagaacccctaaacccttctgctttgccatctttgataccagtccccagttccttcaaggtttctttaggctttttggaaagcagatgcaaacagatgggaaaattgcagagttactaagaaccctaagagaaatacaaatagtacttaacacttatgacatttatcgaaatatggtgacagtagaaatgcctctgagaagccccttctccagaggtcttctttggtactgtctcaggaagacatcggatattttttcttccctagtctggcctcagcagatttcttcttccgtcttcagaaactcagtcagtgtttaactaaaagttttataatttgattggcagaagaaaaataagtgctaaatactactcagtcaaatgctttcagaatccaagtgtgtttatttgcacaataaacatggtactttacattctgaaagctctaacattcgcaaagcactcatgagctcatacgaaggagacaggtgagtatccatgcttccatctcgcaaatgtcatgttacaaagcaggaaagcaggacaggtgagatgataaactctgtttttgtttgtttggtgggttgtttttgtttctgtttattcaccacaccagagtagacaaactaatgtctccaatctccatataacttcctcttggttcagtgagcagttaattaaaataatttcctactaactccaatttggagaacctcagctctaggctggatgaaaggcaactgatgcctaaatgcagtccaacactggtgcccttttactccttcaagtactgaaataaagagtccatttcactaataagctgatgagttaaatgctagctggacccagacaggtgtgtttacccctgcttcttgaaacagaaacaaatgtgacatgtgacttccctaaaccaaacgtttaaatttgagttgtttgccatgccaaagaaaacattgttggctgggtgtggtggctcacacctataatcccagcactttggaaggccgaggcaggaggattgcttgagcccaggaattcaagaccagcctgggcaacatgacaaaactctatctctacaaaagaaaatttaaaaatggctgggtgtaatggcgtgcgcctatagtcccaactacagtgggggccgaggtgggaggattgcttgagccctggaggtcaaggctgcagtaaggagtaatcatgccactgtactctagcctaggtgacagagggagacccaggctcaaaaaaaaaaaaaaaggaaaagattgtttttaacaatgcagttaggccaggcgtggtatcttatgcctgtaatcccagcactttgggaggccaaggcaggaggacccgcctggccaacttggagaaaccctatctttactaaaaaaaaaatacaaaaattaactggacgtggtggtgggcacctgtaatcccagctacttgggaggctgaggcaggagaatcgcttgaaccaggaagtggagcttgcagtgagccgagatcgtgacattgcactccagcctgggcaacaagagtgaaacccatctcaaaaaaaaggaaaaacaaacaaacaaacaaaataaaaaaacaacaatgcagataaagttgagcgtggtatataatgacaattttttttaagttgcctatgatcaagtgtagcagtgaatgtataaagagtataacagctggagaatagtccctgagtgtccccttcacctgggcctaatgcttaacccagggctgcctcagccagatctacactctctctaacccttctccccattcctctcctcagattaaaaccagtattgaggccaatccaagcattagctgctcttacagtcgttttatttacactgtgtgtgtggtagacaaaagttctactgggaactaacaactccgtccagtaagtgaggacacttcctgcctgaacataagtatccagattagggggagtgctaggagaggtcacagtaaaaagggaaaagcaggaggtggcagaaagcaaaggagcagagtattgcaataagagcgagacacaagacaggcaggcagtgtgggcaggggctcaacgtgagagcagggagattgggcaacaactgctgtgccttgtgtataagactaagcagtgggagctgagttccagaggcagtgaaaggggggataaggtgtgcggtgggtggagcttaagtgagaagaccagaagtgaagtggtgtggagcccagtggtctatcactcttctgattcctctccccggaagatataaacaatagaagagatgctgaagttatgtcagatgaagatatgggccatcctaatgaggaactggacaagacaaccggttactacacattcgtggagagcactgtcatcctaaccctgcactggaaagtcggctctgacttcccacccctagaaggtctcctttttaggagaaccatccctgagtttgagggtatctgggtggatggtaacataaacttcctgcaacttctcagcatcccctctatgtcttttccccaaaaacttacttccgtaactgcccagatatcccaagaattcttaaagcactggtcttacaagaaactttcacagatatgatataagacacatgtattccatagtgaacaggagagagagaaggcagcaattattcttaccatttgacatagaagggaaaatggccagagaaagtataatcaactgtctccaggggtacacagaaaattaagggtggaagtgagaaagattccaagtttccctatcctgttagtccaactatatccagctgccccttccagtgacctgaaaggtcaactactcagaagtcctaaaatgattatacctgcttctttttaactggtggcaaaaaaaatagactcactgaacttcagttgtactgggttcctaatcatgacacactcctccctgtgttcacgtccttgtctttcctcatagtaaagcaaaactcagaaaggtagataatgccaagtgtcagcagagaatgaggagataggggaaccattaagcactgctactgggaacatataaataggtgtagccatttggagaacaatctggcatttcttagtcaaattaattatatacagaccctttgacccagcacctccacaattgaaaatgatggtaagagagaccatttccatccatggatttctaggccagtacagtttagctatcaagaacacagaaacatttaataaccattatttcaaaatatgtgtcacatcttgaaagacatcaccataaccctaaagggtgtgacccccaagtggtctcctcagccgcttatttatgagatttttccagcatgctataaggccagtggtttcctggtgatagagttataaaaaaagaaaaacagtagattccttgattatgtgtccattatggcaactgtatcatttaagaaaaaggttctcttggtccataaagatgttacatgggatcccatgtctagaaaccagatattctgtgggccttcagatagcagagctgtccaaaatactgtaggcaggaaagatacatctatagctagaatatatatcattctcagtaaagataaactgctgccccttctaaggtcaaagagattcaatataatcattgttttgtaaaatggttggttcatctccttgagacatagtaccctattgaagtcccagccttaatctctgttgctgaagggtcggcagcagtaatacctaaatcacttttggtgagagggaatccttactattgggtatatgcataatatcaatcactgcctcattagccattaaacaagcattggagaagctaaggacatccattgaaccagtcctcctgtgttcctaattgtttgctctctcctctgtgtcagatactttcttatgagcaccaacatgagacacaaagatccactttgtgttcacatccagaggttcattcagatggccttcttaactggtggcaaaaaaatagacttaaaaaaaatagaatttcaggcagacatccctgtgcaaaatattaatattcttgttcctaccagattcctgaccgggcagagccaagagatctcccaccgctcaagcatccaggtatcctgtttatgaccagttgtgctgcttgtagcactgcctaccaagagtattttcaccaagccatgctcctctaggacactcctgagtaaaattttagtgtggtaatagtccaccattggctcataacaacaaattgagcctatctgtgaatcacatttttgttttgcccctctaaaacctggtcataggaacaccccatgaggctgtaagtacagtctaaaggagcagtgttagttctgcagatgtagttcatatggagtttgaaccactgtcttctgttactgagggcctctggatcaggttgagtccaacctcaactgcaccatttccattgtgtgatggatttgtgctgtacccactaaatttataatttgtgggtctgccagtacaggtcatgatgagcagttctggccccatagccacttgatgtttcatggtcagctattgggtctctacagaatccatggccatgccatgtgctccttttctaaaaaatagttctctcacttttacactgctggtgggaatgtaaactagtacaaccactgtagaaaacagtgtggagattccttaaggaactaaaagtagatctaccatttgatccagcaatcccactaccaggtatctacccagaggaaaagaagtcattatacgaaaaagatacttgcacacgcatgtttacagcagcacaattcataattgcaaaatcatggaaccaacccaaatgcccatcagtcaactagtggataaagaaaatgtggtatatatacatatatatatgtgtgtgtgtgtgtgtgtatatatatgtatatatatgtgtgtatatatgtatatatatgtgtgtgtgtgtatatatatacaccatggaatactactcagccataacaaggaatgaaataacagcattttcagcaacctggatggaattggagaccattattctaagtgaagtaactcaggaatggaaaaccaaacaatatgtgttctcactcataagcaggagctaagctatgaggacgcaaaggcgtaagaatgatacaatggactttggggactcgagagaaagtgtgggaaatggggtgagggataaaagactatgcattgggtacgggtacactgctcgggtgatggaagcattaaaatctcagaaatcaccaataaataacttattaacatcaccaaacaccacctgttccccaaaaacctgttgaataaaaatgtaatcacaattctatgatcacatctttaataatcattcctaaggctgtcaaatatccagtcaatgttcagatttctcagattgttttgtaggggtgtgtgtgtgtgtgtgtttgtgtgtgtgtgtgtgtgtgtgtgtttgacatatgattcaaataaagttgatggtcttctagatctttaaagagccataaataaataaataaataataaagttctctgctatagagggcatggctttgtttcagaagcctactggtctacccagcatctctctccctgggacttactagagacgatgctcagcataattaacctaccatgacctctgtaattccataggacctgccaggtgatatggccaaaataaaggacagcttaaatcaaagtttaaacttgctgcagagcatatttatttattatttatttttgctctagataccactctaaactggtatctgtgagtcagcctataaagcaactgaatatatcgttgtcaagtgaagtaaatgctgcctccaaaatttaagcttctggggtcatgaattttgggcacagttttgcacctcttttttaatgataggttgttcaaggtacaacactgagccttaaaatcttcactgatgtggtaggcccttaaatattttcactgtgcgtgtgtcttgctaggatatctagagtacttgccactttctgctcatcggatccaactaacacaatatcatcaatgtatgaaccagtattctatcctgtggatgtcaggaggatcaagggagccatattataataaagttaatatagtctcaaggtagaactgtgaatgtatgtgactgtccatctaggtgagtgtaaactactcttattttttttctgatgggaattgaaaaaaacagcattcctcagattaatagctgcatgccaaacaccagagactgtgttgactgtttttgtaaagatatcacatcggacacagcagctgtcagtggagcttttttaatagtttacagtagccccccatggtctgttttcatctatttaattttgtgtgagacagactgctgaaataatggagctataaagcagaccaccgcatgtgcatcctttaattgtttaagagtagcacttatctctatcattccagtaggaggaattgtgacttactctcttggctgcaggatgcaatttcacagggttccatttggccttttgaatcataatagtgattgctccataagtcagggaatagatatgaaagttctgcatctgtagattatattcttctcagttatgcattcaggtgtcagagaaatgaccacaggatgagaaaaaaaaatgtactcgctgtgaaatggacttagactgctaccctatttatttatcaactggcttccattaactctaccctaccattgaggccataatggaattttggtgtcagtctcagctgagagccatatctaatatcacgaaaaaagatttgggcatttctcattcccagatactgttattctagtaaatggccataagtctctttggagaaagatcaaagggatcttttcatacactagaaacatgctgtgttattgcatggtccttcttcaaggggacctagtctcccctttaataaataggtcatgtggcagggcacggtggctcacgcctgtaatcccagcactttgggaggctgaagtgggtgcatcacctaaggtcaggagttcgagaccaggctggccaacatggtgaaaccccatctctactaaaaagacaaaagttagacgggtgtggtggcacatgtctgtaatcccagctacttggaaggctgaggcaggagaatcgcttgaacccgggaggtgggggttacagtgagccaagatcatgccactgtactctagtctgggcaacagagtgagactctgtcaaataaataaataaataaataaataaataaataaataaataaaataggtcatgcttctgaaaactaactctggtctgcaaagtaggtgaaaaattgtgactttcctttatatttaccagtattagctttctgcttattcaatattgaactttttgtatatttaagtcatacaattcaatattacctctccatttatatttctcctaagaacatcatggtctattagccattaccaaatatccctgtgggccaaaacctccaggttgtaatttttgcttgtttttgctgctttgtagtttttgtctattttgcgattgcagcctatttttgctctttcggaattgtggtcacggtaactatgtccccttttgcctccaacactgtagtggcaatagtaggcctctactggcccagtatcctataatccccctttgctgcataggaaccctacttcatagaggcattgcctacccaactccaacctagagaggacagttaccaccaaaactgtcagcaattccaggggctctctcaccagtacattccttacttaactactgaagtgtacatattctgagatttctcaggtaataaagccacctgattggttttctggccttatatagtacagccattctgacttgcacatctaattatcttgaatctttccttagtactatgccagaatagtttgagcctctccacataattttccttagcacacaatattcccaaacttcataaagccaatccagaggaaggagctccaggcatcctttgtcaagaacttaaatcctgggcaaagggagagtgcctctgtggtaggcagcttctaagattcccaatgatccctgcctcctggtgttcatgccactctgtaatctccttcttgagattaggctgaaactattaatacgacttgcttccaactgatagaattcagcaaagatgatgaaatgtgcttatgtataagattacataaggtggcgactttcaccttctaatagactctctcccttgctaggttggatgaagcaaactaccattctggaaagacccagatggcaagaaattgaaggtggcctctaaccaacagctagcaaggaactgaggccctcagtccaaaacccacagggaactgaatgctgccaacaaccatgtgggcttggaaacatgcccttccatcattaagccttcagaaagaacgtatccctggcaaacacctggattgtagcctgtgaaaaatgctgaagcagaggacccagttaatctgtgcccaaaattcttgaccccagaaactgaaagataataaatgtgtgtgcatgttttttaaggcactgcatttgtggtaattcattatgcaccaatagataactaatacagcctctgtgtcaataaattctaattcatctttttttaatgtattttttaattatactttaagttctagggtacatgtgcacaacgtgcaggcttgttacatatgtatacatgtgccatgttggtgtgctgcacccattaactggtcatttagcattaggtatatctcctaatgctatccctcccccttctccccaccccacaacaggccccagtgtgtgatgttccccttcctgtgtccaagtgttctcattgtttaattcccacctataagtgagaacatgtggtgtttgattttttgtccttgcgatagtttgctgagaatgatggtttccagcttcatccatgtccctacaaaggacatgaactcatcattttttatagctgcatagtattccatggtgtatatgtgccacattttcttaatccagtctatgattgttggacacttgggttggttccaagtctttgctattgtgagtagtgccacaataaacatacgtatgcacatgtctttatagcagaatgatttatattcctttgggtatatacccagtaatgggatggctgggtcaaatggtatttctagttctagatccctgaggaatcgccacactgtcttccacaatggttgaactagtttacagtcccaccaacagtgtaaaaatgttcctatatctccacatcctctccagcacctgttgtttctggactttttaatgatcaccattctaactcgtgtgagatggtatctcattgtggttttgatttgcatttctctgatggtcagtgatgatgagcattttttcatgtgtctgttggctgcataaatgtcttcttttgagaaatgtctgttcatatcctttgcccactttttgatggggttgtttgtttttttcttgtaaatttgtttgagttctttgtagattctggatattagccctttgtcagatgagtagattgcaaaaatttcctcccattctgtaggttgcctgttcactctgatggtagtttcttttgctgtgcagaagctcttcagtttaattagatcccatttgtcagttttggcttttgtttccattgcttttggtgttttaggcatgaagtccttgcccatgcctatgtcctgaatggtattgcctaggttttcttctagggattttatggttttaggtctaacatttaagtctttaatccatcttgaattaatttttgtataaggtgtaaggaagggatccagtttcagctttctccatatggctagccagttttcccagcaccatttgttaaatagggaatcctttccccatttcttgtttttgtcaagtttgtcaaagatcagatagttgtagatgtgtggtattatctctgagggctctgttctgttccattggtctgtatctctgttttgataccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctataaattaccttgggcagtatggccattttcacgatattgattcttcctatccatgagcatggaatgttcttccatttgtttgtgtcctcttttatttcagtgagcagtggtttgtagttctccttgaagaggtccttcacatcccttgtaagttggattcctgggtattttattctctttgaagcaactgtgaatggcagttcactcatgattttgttctctctttttctgttattggtgtataagaatgcttgtgatttttgtacattcattttgtatcctgagacttttgctgaagttgcttatcagcttaaggagattttgggctgagacgatggggttttctagatatacaatcatgtcatctgcaaacagggacaatttgacttcctctcttcctaaatgaataccatttatttctttctcctgactgattgccctggccagaacttccaacagtatgttgaataggagtggcgagagagggcatccctgtcttgtgccagttttcaaagggaatgcttccagtttttgcccattcagtatgatattggctgtgggtttgtcataaatagctcttattattttgagatatgtcccatcaatacctaatttgttgagagtttttagcatgaagggctattgaattttgtcaaaggccttttccgcatatattgagataatcatgtggtttttgtcttgggttctgtttatatgctggattatgtttattgatttgcatatgttgaaccagccttgcatcccagggatgaagcccacttgatcatggtggataagctttttgacgtgctgctggattcggtttgccagtattttattgaggatttttgcatcgatgttcatcagggagattggtctaaaattctttttttgtttgtctctgccaggctttggtatcaggatgatgctggcctcataaaatgagttagggaggattccctcgttttctattgattggaatagtttcaaaaggaatggtaccagctcctccttgtacctctggtagaattcggctgtaaatccatctggtcctggactatttttggttggtaagctcttaattactgcctcaatttcagagcctgttattgatctattcatagattcaacttcttcctggtttagtcttgggagggtgtatgtgtccaggaatttatccatttcttctagattttctagtttatttgtgtagaggtgtttatagtattctctgatggtagtttgtatttctgtgggatcagtggttatatcccatttatcattttttattgtgtctacttgattcttctctcttttcttctttattagtcctgctagcggtctatcaattttgttgatcttctcaaaaaaccagctcctggattcattgattttttgaagggttttttgtgtctctatctccttcagttctgctctgatcttagttatttcttgccttctgctagcttttgaatgtgtttgctcttgcttctctagttcttttaattgtgatgttagggtgtcaattttagatctttcctgctttctcttgtgggtatttagtgctataaatttccctctacacactgctttaaatgtgtcccagagattctggtatgttgtgtctttgttctcgttggtttcaaagaacatctttatttctgccatcatttcgttatgtacccagtagtcattcaggagcaggttgttcagtttccatgtagttgagcggttttgagtgagtttcttaatcctgagttctagtttgattgcactgtggtctgagagacagtttgttataatttctgttcttttacatttgctgaggagtgctttacttccaactatgtggtcaattttggaataggtgcagtgtggtgctgagaagaatgtatattctgttgatttggggtggagagttctgtagatgtctactaggtccgcttggtgcagaggtgaattcaattcctggatatccttgttaactttctgtctcgttgatctgtctaatgttgacagtggggttttaaagtctcccattattattgtgtgggagtctaagtctctttgtaggtctctaaggacttgctttatgaatctgggtgctcctgtattgggtgcatatatatttagaatagttagctcttcttcttgaactgatccctttaccattatgtaatggccttctttgtctcttttgatctttgttggtttaaagtctgttttgtcagagactaggattgcaaccctgcctttttttgttttccatttgcttggtagattttcctccatccctttattttgagcccatgtgtgtctctgcacatgagacgggtttcctgaatacagcacactgatgggtcttgagtctttatccaatttgccagtctgtgtcttttaattggggcatttagcccatttacatttaaggttaatattgttatgtgtgaatttgatcctgtcattatgatgttagctggttattttgcctgttagttgatgcagtttcttcctagccttgatggtctttacaatttggcatgtttttgcagtggctggtaccagttgttcctttccatgtttagtgcttccttcaggagctcttttagggcaggcctggtggtgacagaatctctcagcatttgcttgtctgtaaaggattttatttctacttcacttatgaagcttagtttggctggatatgaaattctgggttgaaaattcttttctttaagaacgttgaatactggcccccgctgtcttctggcttgtagagtttctgccaagagatcagctgttagtctgatgggcttccctttgtgggtaacctgacctttctctctggctgctcttaacattcttccttcatttcaactttgatgaatctgacaattatgtgtctcggagttgctcttctcagggagtatctttgtagtgttctctgtatttcctgaatttgaatgttggcctgccttgctaggaagttctcctggataatatcctgcacagtgttttccaacttggttccattctccccatcactttcaggtacaccaatcagacatagatttggtcttttcacatagtcccatatttcttggaggctttgttcatttctttttattctttttttctctaaacttctcttcttgcttcatttccttaatttgatcttcaatcagtgataccttttttccagttgatcgaatcaggactgaaggttgtgcatttgtcaggtagttctcgtgccatggttttcagctccatcaggtcctttaaggacttctctgcattggttattctagttagccattcatctaatcttttttcaaagtttttaactcctttgcaatggttttgaacttcttcctttagctcagagaagtttgatcatctgatgccttcttctctccactcgtcaaagtcattctccatccagctttgttccattgctagtgatgagctgtgttcctttggaggaggagaggtgctctgatttttagaattttcaatttttctgttctgtgtcttccccatctttgtggttttatctacctttggtctttgatgatggtgacgtacagatggggttttggtgtggatgtcctttctgtttgttagttttccttctaacagtcaggaccctcagctgcaggtctgttggagtttgctggaggtccactccagaccctgtttgcctgggtatcagcaggggaggctgcagaacagtgaatattgctgaacagcaaatgttgctgtctgatcgttcctctggagttttcgtctcagaggagtacttggccatgtgaggtgtcggtctgcccctactggggggtgcctcccagaaaggctactcaggggtcagggacccacttgaggaggcagtctgtccgttctcagatctcaaactccatgctgggagaaccactactctcttcaaagctgtcagacagggacatttaagtatgcagaggtttctgctgccttttgttcggttgtgccctgcacccagaggtggagtctatagaggcaggcaggcctccttgagctgcggtgggctccacccagttcgagcttcccagctgctttgtttacctactcaagactcagcaatggcgggcacccctcccccagccttgctgccaccttgcagctcaatctcagactgctgtgctagcaatgagcgaggttctgtgggcgtgggaccctccaagccaggtgcgggatataatctcctggtgtgccatttgctaagaccataggaaaagtgtagtattagggtgagagtgacccgattttccaggtgccatctgtcacagctttgctaggctatgaaagggaattccctgaccccttgcacttcccaggtgaggcaatgcctcgccctgcttcacctcacactcagtgtgctgcacccactgtcctgcacccactgtctgaaaagccccagtgagatgaactcggtacctcagttggaaatgcagaaatcacctgtcttctgcgttgctcatgctgggagctgtagactggagctgttcctattcagtcatcttggaaccgcccccctctaattaatcttttattgtgttttctatgattcaaaatagtcaaaatccattcccaggcatcttcacctcattcctgttaataaaatttagccagcactttggtgagtcatcttttcctttccattacagggatagtccttcctttctttggtcacactgatacttggccctagcgattgtctaaaatcaatgggttgaaagacatgggcaaatttcaagaacaaggtaaaacattatctcagatgaggtctatgcatgttctccatgcaaagaaagtttgctcttttctagcaaactttaaagattcagggaacctggagattcaacgttcttatgtgcgtctatccaaatctcctaatcccaatccctagaatacatttagttctcacaaaggtcctaactttatcacaggaatctttgctaaggctgtgaattcaatcctttttaaatatgccaccattactatgaaatcttaggccttagtatcactgattttctgtaggtgtactgaaaattgcaagaggtgagaattttttaaactgccttgaagaccttctgactttgaaactatattttgagttgatcattgacatatctgactctgtcatttcttctgggtttctttttttctttctttcatttttttttttttttttgagacagagtctcactctgttgccaggctggagtgcagtggcatgatcttggctcaccgtaacctccgcctcccaggtttaagcgattctcctgcctcagcctcctgagtagctgggactacaggcatgtgccaccacaccccgctgatttttgtatttttagtagagatggggttttgccatgttggccaggatggtctcaatctcttgatcttgtgatccgcctgcctcagcctcccaaactgctgggattgcaggtgtgagccaccgcacctggccttcttctgggtttctataaccaatcacagcagtcatccagtgccccaacccttataattattcttacttataattatccatgttttaataaaacactacagatacctcattccaacctatccaaagttaaggtttttttagttcaatatatccctgcttgtctatttttgtttttgttgctgtgcttttcttgtcttatctaagaaattgttgttaatgcctatatcaagaagtttcttctctgtgttttcttctaggagttctatagtttcatgtcttatgtttaaatctttaatgtattttaacctactttgagttgatttttgtgtatggtgtaaaataatatttcagttttattcttttgcctatgaacattcaattttctcaacacaatgtgttgaagagactatcctttatccattatgtattcttggtgcccatgtcacagatcagttgaccatacctgagtaggtttatgtctgggttctctatcctgttacattggtctatgtgtatatctttatgccaatatcatgtagttttaattactgaagctttgtaatatattttgaaatcacgaagtatgataccttcagctttgttctttctcaagatcactttggctgtttgggatcttttgtgtttccatataaatttttagatcattttctctatttttattaaaaatgccattggggttgaatggggatagcttgaatccatatattgctttggatagtatggatattttaacaacactaagtcttccaatccatgaacacaggatgtttttccatttatttgtgtcttctttagttttattcatcaatgttttggtgtgtgtgtatgtcctttaccttcttggtttggtttatttctattttattgtctttgatgcttttgtaaacggaattgttttcttaatttccttttcaggtggttcattgttagtatatagaaactcaacaaattttcataggtgaattttgtatcctgtaactttaatgaatttgtttattcattctaagttttttggaagtgtctttgggattttctacacacagtatcatgtcatctatgagcaaagatacttttacttcttcttttctgatttcatttgaatgccttgtgatttgatttacatgctttgtatttctttttcttgcctaattgaccttgttagaacttccagtactgtattaatccattttcacattgctataaagacctatctgagactgggtaatttatgaagaaaataggtttaattgactcactgttctgcagactttacaggaagcatgacttgggggatctcaggaaacttacaatcatggcagaaggtgaaggggaagcaaggaccttcttcacatggtggcaggagagagctaggagagagctacacacttttaagccatcagatctcgtgagaactcactcactatcaggagaacagcaagggggaaatccctacccatggtccattcacctcgcaccaggtccctcctctaattcaacattagattcaggtggggacacaaatccaaaccatatcaagcactatgttgaatggaagtgatgagagggggcatctttatcttgttcccgatcttagaggaaaagctttctgtttttcactgctgcgtataatactagctgcaggtttgtcatacatgacctttattatgttgagaaaaaatcctcctatacccagtttgttgagagtttttatcaaactataaatttctcgatagcaaaggaaatagtcaacagaactgaaaggcgacctgtgggataggagaaaatagttgcaaatcatatgtctgataagggtttaatatccgaaaaatataagaaacccctacaactcaatagcaataagtaagtaaataaataaataaaaattacaaaatgggccaggtgcggtggctcactcctgtaatcccagcactttgggaggccgaggagggtggatcatgaggtcaagagattgagaccatcctggccaatatggtgaaaccctgtctctactgaagaaaaaaaaaaagcaaaaaattagctgggagtggtggcgggcgcctgtagtaccacctactcaggaggctgaggcagaagaatcacttgaacccgggaggcagaggttgcagtgagccgagattgcgccacttcactccagcctggcaacagagcaagactccatctaaaaataaataaataaataaataaaaaatagagaaaagagttgaattgctatttctccagagaagacatacaaatgcctaacaggcatatgaaaaggtgtttaacataactaatcatcagggaaatgcaaatcaaaaccacaatgaaatgtcatttcacacctgttatagtggttatgattttaaaaaaggaagataagtgctggggaggaggaggtgatattggaatgctgtacactgttgttgagaaggtaaaatggtaaagctgctatgaaaaacagcacgatgcttccttaaaataaaaatagaaccactatatgatccagcaatctcatttctgcatatgtatccaaaaaagtgaaatcaaaatcttgaagagataccagcactgcacttccatgttcactgcagcattattcacaataattagttaggatatagaaacaaccaatggacaaatgggtaaagaaattataataaaactctcaacaatttctttatatgtcataaagaaatttatatatatatatatggaatattatggaatgttcatatatattcgtatatatgtaatatcataatgggatattattcagccttgaaaaaaaaaaaggaaatactggccaggcatgttgttcatgcctgtaatcccagcattttggaaagccaagacaggcggatcaactgaggttgggaattcaagtccaggctggccaatatggtgagaccttgtctctactaaaaatacaaaaaattagccaggcgtggtagtgcacacctgtaatcccagctactcgggaggctgaagcaggagaattacttgagctgggaggcggaggttgcagtgagccacgattgcaccactgcactccagcctgggcgacaaagtgagactccatctccagaaaaaaggaaaaaaaaaaaaaacccacgagtgaacctgtaaccaggagaatattttgctaaatgaaataagccaggcatagaagtacaaatactgcaagattccacttacaggaggtaactaaaatagtcaatctcacagaaacaaagagtagaagtatggtcttgcactccaagagattccccaaggttggagttgcaggtgtgtacagtaagaagccttggagcaatcattagtgccttgtccatccctcgaaccctaacctaccatccctgtgccctctgagcaatttcaacctgccatatctgcctctctgtgctagtggactcctaccagagataggaaaggtcattttgcccacacactgcagactaaaggggtaggtggggataaggccactaaaaaccctgaggagcaagcctcaaccagtgacgggaaaattggcatggagaacccatgcttttctgcctgagaggtgtgggaactctgagtcacatgtttcacagcacttgccagagattcctctcaggatgaagcctcagtgttccactgtggtaactggcctaataatgtacctttattttttaaaaaattatattgccctgagcattaaaaaaattaaaaactaaaaaatatttctattcaaatcttggtcttaaagtctgtccctggaggaacacaagctaaaataagtttcaccatgttcaagaatgatagttactaaggaaagacagtggagccccaacagcaactcctacaggaaggaaagaaagaaaaaagaaaactattgcatcaaatcagatatcagtggcaataaatggttacacgacatttgatatgtttcttttggttgtaggcatttcagctaagtatacatttttatggtccttagcaagaaaatcaaaattctgtaaaactcattaaaattttagtcttgtgttagggtcagaaatgtagtgagaggtgggccgggcgcggtggctcacacccgtaatcccagcactttgggaagccgaggtgggctgctcaagaggtcaggagatcgagaccatcctggctaacattgtgaaaccccgtctctgctaaaaatacaaaaaaattagccaggtgtggtggcgggcacctgtagtccaagctactcaggaggctgaggcaggagaatggtgtgaacccaggaggtggagcttgcagtgagccgtgatcatgccaccgcaccccagcctgggcgacagagcgagactccgtctcaaaaaaaaaaaagaaatgtagtgagaggtaagaggaaaagacatcattttgaaggaaaactacatataaccaggagtcaaatatttaccaaaaatgtacacacctgtctgaaagagctgtaactcatagaaacaaagtatctgcaataacaacaatatcagctccaggcaagaatcttggctcttcactgggaaaccacagcaccaggaagaagggactgaaacacagtgaaactgccagacagggagggtgactatggagaaaggagagactccctggttcaagatgaaacaccagacccaaactgtaagacacaacatagaaacctaatgtcaggctaatgtttaactaatggtataatcttaaaagggcagaaatttttttaaaggggcagaaataaaagaaaaagaagtaaacaggaaaagtaagcaattagaaattttgcaaaggaaaaatatattcactgaagtttttaaagacacaaataaaaggaataaactgtgaaatgaacccaataatgaaaatagttgtaaattagaatatgatgttaaagaattttgctagagctacagaaatttcccacaagcatattagtctatgccttttgctccagcgccctctctagatttagcatttgtcccctatttttaatttttagtcttctatgttaaaatatgacaggatgaacttggcactttcattttgtactccaatttctacgaaggtcttctctagtaatatattagctactcccctaaaaaccctatagtttctgtaaatagaaggacgctaatacctctttttcaaaggtgctatccagggaacttgctgcaaaaataaagtgcactcctaagcaagtggctcaggacagccctctctctctccagccatagatggtaatgcgaaagtaaacaatgttgctgccagggccggccccactcaccagctgtgccaaggctcttgctgtaacctgagaattttatgaaaccttcagatcactagttgatgagaacagtggaaaaaggtgagaaattatagcttaactgtacaggaaaagtgagtaggaaatagaggctgagcagtcctgtcatagaacatataaagagaggtctgaatgttcctgcgatgataatttgtcattttttgtaaggcgtaaatctacaactacttattttattatttgacatttttttttcaaccaagcttttggcatagtgagctcaagaaaacaaaatgtatgataatgaaaattaattactgaattttcatttttcaaggaagttgatgatgaacatgtaacttgcacaatatgtttgttgccatttaccatctaccgtaatggctataataacatcactgactacttgaaagccctagaccaaatttgctgtgggagcctcagcattgacttgaaatattagttgctactttaaaaagagtatgcctaaaatgacatcaatgtatatctgcagaagatgcatttgatttatatctttcagtagagtgtgacctttcattttggtccaatactgctatctaaactaagtaagaaataaagagggaagaatcaaataaataaaactggaaatgaaagatgaaacattacaactgatgctacagaaatgaaaaggacatttaggagattcttatgaacattaaacaccaacaaattagataaatgaggagaaataaattcctagagacatgcaacctatcaagaatgaatcataaaaaacagaaaatctgaacagaccaataataagtaaggagattgaattagtaatcagaaacctcccaacctggccaggcgtggtggctcatacctgtaatcccagcactttgggaggccaagatgtgagaatggctcaaggtcaggagttccaaaccagcctagacaacatggtgagatcctgtctctaaaaaatcaaagttaaaagattagctcactgtaaccttgaactcctgggctcaagggatcctcctgcctcagcttcccaagtagcagaaactacagatgtgtgccacaactccaaacaaagaaatctccaaacaaaaaaaattccaggaccagatggcttcactagtaaattctgccaaacacttaaagaattaatgccaatcttttacaaactcttccaaaacaatggaaaaaggaaaacttccaaattattttatgagcccagcatcacctttatatcaaagccagacaaagacactacaaggaaagaaaatgacaggccaatatccctgtgaaaataaatttaaaattctgaacaaaatattataaacagaattaaacagcacattagaataaccaagtcaggtttatccctgagatgcaaggatgattttgcatatgcaaatcagtaaatatgatataccacttaacaggataaaggacaaaaatcacatgagcctcgcaatagatgcagtaaaaaacattcgacaaatttcaacaccttttcatgaaaaaaggctcaacaaactagatatagaaggaatgtcccacaacataataaagtccatatatggcaagcccaaagctaacatcatcctcaagatgaaaaactaaaagctttctctctaagatcaggaacaagacaaagatgaacgctttcaccacttctattaagcatagtattgaaagtcctagccagagcaattaggcaagaaataaaagacttctaaatgggaaagaaagaagtataattcccaagtatacattttcaattccaaagtttttctgtgcgtgtacaaaaaaggaattggaagctattaatatgttgaatccatctatagaagaaaaaattcccaattacatgacatcagttttatatcaattttaccagagtctttcaaatagaaaaatcagttaattcaaataatggttagattgtgttcatccaattcatgaaatgagagtaaagcttttaaaagttatttctgactgggaggtggctcacgcctgtaatcccagcactttgggaggccaaggttggtggatcacctgaggtcaagagttcaagaccagcctcaccaacatggtgaaatcccacctttactaaaaatacaaaaattagctgggcatggtggtgcatgcctgtaatcccagctactcaggaggctgaggcaggagaattgcttgaacctgggaggcggaggttgcattgagcaaagattgtgccactgcactccagcctgggtgacagagtgagactctgtctcaaaaaaaaaaaaagttatttctgttgaagatgaaatatctgaccttttaatatgtgctattgaaactcatttagaaaggtaaaattttatttgttttgcagttaataacataaacaaaaattttagtggagcacagcgtcacagtaaaagcttagggtcttactaaattaaaacatctgtgaaatatgaagacaactgaaattttctgtggtacaaacataattaaaaatattcaagcaatcagagatactttatcaatcaaaacagaagctacgattgataaactttgcaaaattttttatgtgggcagaataactgacctactaaacttgtatgatgaatctcatcttgaacactaaaaatacttcagcatagttctctctttttgttccctctcatcaatcattctttacatacgtttgagtctttgaagaagtactttgtatatgaaccaaaatttcttacaattatattgaatgttttggtaaacaatttctctaaattttgattgcttttgtggaaaattagagggaaatatataatcaaagtattaaacaaatggagcaaaaaaatgcttcagcttctaaagctttgagaaatcacagtgattgaaacacaacttacaaataggaaggcactgagtatcgacatttatccctgcaaaagtaagaaagaaactaaacaaattaagccatgcatgcttaatgatggagaagatataatttcaaaatttaaaaattatgctagaatatctcattttctagaaaggaatattttggtgtagttattattttttgattagataaatagatatcctgtattataataaagtaaaactgaagactagaattttgcatgatttagatttagtaaaacctttaaaagaatcataaatagagaaaatttacttgattatttttgtcataaaatattttaaagaaaggttttccaaatggaagctaaaatatttacataattcagtttaaaaaagttacagttgagaatagactccatgtagcagaacttacttagcacacattagttatctcaacttataaagaactattttctcaatcgtcagagaagagtccattaaagtgtcaataatttcaaatgtgttaaccataaaatgcaacttaaaagaatactgtaggcaatttcataaaaataagagcaatcaaaacaggtatttttaaaaaatatacattattcagaaaaaatatcaatgacatggtatcagaaataaatataactaaaaagctcattaaagtacattaataaaggccaggcatagtggcttattcctgtaatcccagcactttgggaggccaaggcaggaagatcgctcgagcccaggagtttgagaccagcctgggtaacatagtgagacctcattcctacaaaaaatacaaaaattagcccggcatgatggtgcatgcctgtagtgccagctactgggctgaggtgggagggccgcttgagcccaagaggtggtggttgtagtgagccgagatcacaccactgcactccagcttgggcacagagcaaaaccctgtctaaaaaataaaattaaatttaaatttaaatttaaaaatacattaatatataacaaaaaattatctgcttatattatttttaatgttcagttaatacaaagaagtactttttattttgctttagagagcaggatatgtggtttttagaacgatttcatagaatacttttagaatagatctattttatcagactaccaacaaataataaaagtaattttagccaataaatttgtattgtaagtaattatatacttttaattattgttgtaccctttccacacatggtaaattacatagttgtcttcagaatataaaatacagaaacaaaaatattaaaaacttgcaaaaacagttaagaaaaactgagtctaattgtaattccaggtaaagagaatggaagaaaagtctgagaagcagtttgtaaagatacaattgctgggccagacactgtggctcgtgcctgtaatcccaacactttgggaggccaaggcgggtggatggcctgaggtccggagtttgagaccagcctggccaacatggtgaaaccccatctctactaaaaaaatacaaaaattagccaggcatggtggcacgcacctgtaatcccagccactcaggaggctgaggcaggagaatcatttgaacccggaaggcagaggttgcagtgagtcaagatcctgccactgcactccagcctgggtgatagagcaagactctgtctcaaaaaaaaaaaaaaaaaaaagatatagttgttgaaagtttttcaattaaaaaaatatataaaaatatataaaatgttacatctagagccccttctgaataccaagcaagacatattaagtaatagtaataataaagtccaaactgcattcatggtagaaaaactgcagaaaattaaagaaaaacaatcttaaaattaaccaaagttactgctgaaaagaatttgctcaaacatttttccagagactccactcacagcaaaacaactctgaaaagcatgaataaagttggaggattcacactgtccgattccaagtcttgttatacagttacaataattaaacaatgtgttttttacaaaagagtagatagaagatagatagatagatagatagatagatagatagatagatagatgatagatagatagatagatagatagatagatagatagatgacagatagataaaatagaagagacagggaagaaatagacccacacaaatatagtccactgatttttgataagagttgcaagtaatttcaatggagaaaggatgcttttgacaacaaatggtgtggaacaattggatattcatataccaaaaactaaaaacacccaatctggacacactcctcataccttacacaaaaattaattctaagtatgttataagtaaaatgtttatttagaaacagaacacttattcctcggtactataaggaaaaattagtattcagataaaactttttctcagcaaggcaattttactttctgcagaagaggtgctccttgcagatgaaacaatggcaagagcacacctgaacaaaggagggaagcaattattatcccttatgcagcttgtccctgctactgtgtcctgtctccattagctggagccagacctcacaatctaaactgaacccaactggctaataatttaaaactttcctaaataggtaaaggcaatagagaacaaaggaaaagaggaagttgcttatgaaaagacttagaaaactaataacattcccaaataaaaaaggggcataagttgcaagctgggacatgcctgtgagcacgtctagcacagacatcttggttaaagtacaaggacatagaatgtactacatgcctgtaagcatgtctaacagctacagagaatagggcttaacaaagaggtattagcacaaagtaaggagggctgaaggaagttagtctttaaaagaaactattaacacttatgatttattctttaacaagaagggaaactttgaagaggaaactttttactttctacaaagtacatcatcagcataaatatgaaagctaaaattataaaacttctcaaagaaaacacaagagaaaatatgtatagctttgggtctggcgcagttttatgaccaaacaccaaaagtgtaatccacaaaagaaaaattgatcaattgaattttaccaaaatttaaaacttgtattctgtaaaaaccattaagagattgaaaggataagtcatgcactgggggaaaatatttgcaaagcacatagctgataagggacttataattagactatataaggaatataacaactcattttttaataggcaaaattctgaataaacaaagacatattgatggtcagtaagtgtattagtcagggttctctagagggacagaactgacggaatatatatataaaggggagtttattaagtattagcttacaccatcacaaggtcccacaataggccatctgcaggctgacaagcaaggacagccagtccgaattccaaaactgaagaacttggagtccgatgtttgagggcaggaagcatccagcacaggagaaagttggaggctaggccagtctctgcttttcacatttttctgcctgctttatatttgctggcagctgattagatggtgcccaccagattaagggtgggtctgccttacccagcccactgactcaaatattaatctcctttggcaacaccctcacagacacacccagaatcagtatttcgtatccttcaatccaagcaaattgacactcagtactaaccatcacgataagaatatgaacagatcctcaacatcactcgttattagggaaatgcaacttaaaatcacaaagaaatagtgccacatatttttaaatgactaaaattttttaaaaacacttgacaataccaagtgctggcaaagatatgaagcaactggaaaactctcatacattgctggtaatagtataactactctagaaaatagtttggcagtttcttacaaagttaaatacctagatattggtgtgtaaatgccattctccaataaaagaattaagactctttgaataaatgatttatttcagtgttggggtgggaaaaatatgagtttggaacatcccatgatgccacaaagttaggaagttcttaagaaaaaaaaaatggagccatatttaaaagacataagaaccaatctgaaagagttcccaattgccaaagcttgagcaggttgagcaaaaaataacaatagtattgaagtgtgaccgaaatgcaaaatataaaataaaaatccatgagtgcataagaatacaaataaatgtttgattaagtaactaaatgggagaggaggaataattttttcttagagaagaattctaattaataaaggtgaaaggaaagaggaaaacaaaaaattataacaccacagtaatgttaattgctgcaggcagcatgccgtcatgaatactcaaatcagtggacaagagttttaggaaaaacaagatatttgcatagcttcaaaatatctcctacagaatatttctgtgttggtttttaaaataatgtccacaaattctttaagagttctcctctgggaggtaaagtctaattcatctcccttgagtgcgggccagacttagtgacttacttctaattgatagagcacaaaaggaaaaaaaagagtaactttatggccgagagaccagtcagataccaccttaactaagtgatcaagttaacatcgccagtaaaagtcattgacatcatgggtccctgcagtcagaggggcacatcatctctgtggtactcttcccaaaaatccattaacccaggctaataatgagaaaactaagacaaacccaaatcaaagaatacactgcaaaatacctgaccaggactcttcaaaactgtcaaggtcataaaagaaaaggaaagaccaagaatttgttttgaattggaagagatgaaggaaacaatgatgaattacaatgtggtattctggactgggtctcgaaacagaaaaagaggacgttagtggaaaaactggaaaagtccaaatgaagccaaaaattgagctgatagtattgtaacaacgccaatttccttcgttagatcattgtagcatgattatgtaagatgtaagcattagtggaagctgggtgaagggtgtatgagaattgtctgtactatctttataactcatctctatgtcaaaagttatttcacaataataagttaaaaatataaccaaataaactggacttttaaaacctattccctatgtccttaatgggtcagagttttcttcatgagcgttccttaattattaggttgatgtaaaagcaattgtggtttttgcctttttttaaaagtaatggcaaaaaccacaattacttttgcaccaacctaatattagaaatacccactcaaatacatccaagatgtatttaggaaactgaaggtgccatttaggaactggtccaacagtgttactttaagaagatcaagaaaatgtggcacatatacaccatggaatactatgcagccataaaaaaggatgagttcatgtcctttgtagggacatggatgaagttggaaaccatcattctcagcaaactatcgcaagaacaaaaaaccaaacaccgcattttctcactcataggcgggaattcaacaatgagaagacttagacacaggaaggggaacatcacacaccggggcctgttgtggggtgtggggagggggcagggaaagcattaggagatacacctaatgtaaatgacgagttaatgggtccagcaaaccacatggcacatgtatacatatgtaacaaacctgcacgttgtgcacatgtaccctagaacttaaagtataataaataaaaaaaagaaaaagaaaagatcatcttttcacccagaaaggttatttcatcccccctcagatcgcccctggaaatttccatgaacaaaactctttccattgcaggaagcacctctttcataagctgtggcaagcagagcatcttctgaaatgcctttggtgatgtctgtggtcccagctcctgcccacagcctctgcagcaccctacactgtgaagccagaccctgtctgagctctttctcatctggctgctctgtctctgcttccccttcctttgttcccctctgtcacccaccagtgtttcttacacagatgttctctacagtctgctgtgttctcactgaacctcactgtttatgctctgacacttgatttaggcataggacctgcagattttcaaatttgaggagacgtggaactgccattcctcctcatgtctctcataaagagcttctctgagctgaaggtcttcactaaggccatatatcaacccagcaagtatctatgtactgcctcctgggtgtctggcatgggctaggggctcagagtgggatacatggataaacaaatcaaatgaggaaagacgcaacagcctctgaagggaccatgtcctgtttctcctcccactcttggaagcctggatcagcagaagtaggggaaagccagtggcaagaaaaatcctctttaaaaccaaactggaggtcctgagatactccaggcctacttgtgcaaatgggtagaaacaagcagagaggagcagttgtctattacgctgtattcaagggaaatatttgttcaggaatagtgattttcaaatgagatggtaaaattcgtaacaactcatctaaaatcattaatcaagccagaaaacgtttatgagttcttgccttgtttttaaaaggctttaagtaaaaaccaaatgttataaagattttctgagacttctcacccaccaactttctctttattagaattattacttcatcattattttaaagttacatacattcataaaaattaatttaccctgaaatgaaaagtccattttatcattatgtgtcctatgcttgcgttttaaaatcagaaaaaaattccttaagataaaagtgattcttttttcctttctttttgttttaatattccaaaattggatgaattgggacattgcttttattctcaggttcgctagcttaccttgctaggaactagggagttttaccttcaactcttattttcctagttttgcttaaaatgaaaggtgaatatgtgtgtgtgtgtgtgtgtgtgtatgatcttttatgtataattaaatttattacctctcaagtaatctactttgaaaagagagtcctatctcttaaaaatcagtgtcttcttgctttattgatttttctttagagggtggggacataaaaggctaccaggaaaaaaatgtcatagtggaatcaaccctgcatttagtcttgggcacacaaaagaatccacaggtctaggtagcataacatggtggataagaggaggaactctgcgaccaggtgacttgggtttgaatcccagttctatcacgctctagttgtgtgatgttggccaagttatttaacctctgtatgccttagtttcttcatctgcaaaatggaggtaatagaagcacatgctcataaggttgttgtgaggtttaaatgtagtaattataaataaatcatttgaaaatttcttagcacaaaatgagaagtgcgtgtgtgtgtgtgtatgtgtgtagcagtttttattttcaatcattttctgcagtcacaagtgaaagtaagttaaatgatgactcagttaaccaatgttcaaattaactgatgctaccaaagaacacggacctcagtaccatgttagctgcttttaaagagtctactcaagcgcttccctgggcctcattattgaaccactaccaacatgttcaaaaatagagagaggattagaaaccaaatccttccaacatttgcatctctagatgtagagctaagaattctgaaataaacaaatgcagtgaatttggaaatgatacatcaattgcttcctcctatgacatcaatactgggagttatcaagagtctgcccatcaaatgctagggagatgttttcctccagacaccaaagagaagcaacagctcagaatgactaaactctgcgatcctgcagaaagtgaattgtcgccatttctcatcaccttaattttagcagttttacttgctgaatacctcattggtatcattgcaaatggtttcatcatggctatacatgcagctgaatgggttcaaaataaggcagtttccacaagtggcaggatcctggttttcctgagtgtatccagaatagctctccaaagcctcatgatgttagaaattaccatcagctcaacctccctaagtttttattctgaagacgctgtatattatgcattcaaaataagttttatattcttaaatttttgtagcctgtggtttgctgcctggctcagtttcttctactttgtgaagattgccaatttctcctacccccttttcctcaaactgaggtggagaattactggattgataccctggcttctgtggctgtccgtgtttatttccttcagtcacagcatgttctgcatcaacatctgcactgtgtattgtaacaattctttccctatccactcctccaactccactaagaaaacatacttgtctgagatcaatgtggtcggtctggcttttttctttaacctggggattgtgactcctctgatcatgttcatcctgacagccaccctgctgatcctctctctcaagagacacaccctacacatgggaagcaatgccacagggtccaacgaccccagcatggaggctcacatgggggccatcaaagctatcagctactttctcattctctacattttcaatgcagttgctctgtttatctacctgtccaacatgtttgacatcaacagtctgtggaataatttgtgccagatcatcatggctgcctaccctgccagccactcaattctactgattcaagataaccctgggctgagaagagcctggaagcggcttcagcttcgacttcatctttacccaaaagagtggactctgtgaccagcacccaagaagaccacaggacctggccttaccagctctgccattccctcacctagacctctcttttctctcttcttttcttctccaaccctcatctgacccttttcgcctgatgtggctttttatataggaaattgatcatttcttttttgcttcatgggtacaatcttagtggtactgtcatattctttacctgagccctctacctccccttgctctgtttaaagcagtgattctaagcactggctacccattagaatctctaggttgatttttgaaaataccaatgttcaaacccaatctcagatctattaagtcagaatttctagtgttagaactcacacaattttctaagatctccaggtgattctgctgtgcagcagggttgtatagccaccaaaatagaagaatgttctgaaactagttcctgacaactctctttctccctccacatgccttttaaacacatttagataacttgggaagttttctgagcagaagtttgaaatgcattttgtctccatctttcaaagatataaccaaaataatgtggaactatttatcaaaattaataatgcataaaacacctttcatcctaaaaattactaagaattttttctaagcatggttttgtataaataagcaaaaatatgtgcaagaggctcttcacagctgcactgttcatgaatgacgggaattgaatgtctgaaatgaatattatgttaaccttttttaaatgagatagatgcatgcttcctgagatgaaaagatttccaatacacagtgcaaaaagcaaggagatattttatgattccatctgtatttctttttttcataatacttatatatttgtatgtatatatatgtacatgcaaagtttctggacaaatataccaaaaataattcacagagggcttctgagtggtgtcactgggtatctggggaataaatgaaatatttaccgtttattttatgcctttatgcattgtttgaattacttagaacatgtattcactaattttaaaattttaaaagatttatattgatttttattagaaagagaattggtaagtaaaaaagatttgagagaaaggatagtgcacattattttgttgattggctctctcactattgggttttattaaaaatgcaaacaaatcacaaattaaacatcacaggctttcaatccattgacacctctatattctctgtccctctatcaggcctgtcctctcttcctttcatattcaatttggattactggtcaatcattatactcacccttcaaaaatagcttcaatatttacagatgaaatgagctgtatctgtgatttgctttgaattaatccaacataggacaaaggagtagagaacggggtggtttgggttattcttatgctaatgtttttttaaacaaggcttcaggcatgtggagttctttctactattctatttcagaatatgtttgagaatttccctaatatagcttttatataaataaatcatacaatattctaaattcctgacccttctaaatgtgaaataatcccacatttaaatgactatttaacattctgtgtttgcttctaagcagctgagtgttacttgagagtatttcagaactggatgagttcatgttcctacaaattcatgctattcagcctcaaacgagtaacttcattgagcatttccatcccatatttccctagagaagtcactcattaaagtccccacaatgactatctcacatctttttctcagtctccaaaccttcagcctctcttctccctgacccatttcagcccttaaagtctttgtcaggcaacatttgaaggacaatcctctttttcccattagtgaatctactaatccaccaatttctgcctatatccccaatattcaatagaaagggtgccagtcaatgaaaaaaaatcattagacatgttttaactatgttctactccctctatattttttcctcctccaagtttcatttttctatgtgtttcagtttgttttctctcgtgatcgagtctttccttaaacatccgatgatccttgaatgtcagcgctaaaaagtcgactgccaaattttaaaaattcattttaaaatatcttttagaatataaaaactatgttgaaacatctatgtgagtggtcgctcaaaagtagaacatgcaaacttggattcttaattttccccttgaaacacatttccttttcagttttctccaactcattaaatagtgccacattatttccactggtgaagtcagaatgctaggaaccaccatggatgtgtcttctgtcttactcacttcatgcaactcatcagtaagtcccatgtttctgtcctgtgacgtgtataagtagaggatcattcagttattagttgaacaagtattggctgaacaccaactatatggcatattctattccagttgctatgtatacaatgaacagggctcttgtcatcatggatcttctagtctagtgggaaagcattggtaataaaacctagaatgaatagcacatcatggtggtggtgttagatcagcccagtcaggaaaggcctaaatgagtaaataagatataaagaggtaattgttaaaaatataaatctaggccaggcgccgtggctcacgcctgtaatcccagcactttgggaggctgaggcgggtggatcacgaggtcaggggttcgagaccagcctggccaacatggtgaaaccctgtctctactaaaaatacaaaaattagccaggcgtggtggtgggtgcctgtaatcccagctactcaggaggctgaggcaggagaatcgcttgaaaccagaaggcagaggttgcagtgagcgaagatcacaccactacactccagcctaggcaaaagagcaaaactccatctcagaaaaaaaaaaaaaaaaatatatatatatatatatatatatatatatatatatatatatatatatatataaatctagatagaggaataagttctagagtagcactgtagggtgacttatagttaacaataatttactgtgtattttcaaattgctagaagagaggattttgaatgtttccaacacaaagaaatgtttgaagtgatagatatgcagattactcagatttgatcatcccacatggtatacatgtacccaaatatcactgggtcctattaatatgtacaattactacatgttaactaaaaataaaacaaaattataaaaataaaaaattataaatataaaccaaacatttaggataattacgaaataaatctaaggaaatcagaacatattaaatattgatttgataaataaaatataaaaaagttaaaacggatacaaaactggttcattgaaaagaggcagtaaaattggcatcattagcttacataatcaagaaagaaaaaaggcataaatacacaaaataagacatgaaagaaaaataactacaaatcagagaaattgcagtacttttaagaaactattttgtttaactctatgctagagtttgaaaacgtagataagatagatgttcctagaaaaatataatttactaaaattgacttcaagaaaatctaagcagaataatcatcacagttgagctagagaaagttgtgaagagccactcctcaaataatgctggcaccagatgttcacaagggaattctatcaactttttaaaagcaaataatatgaagtctatgtaaattgtttcacagcacaaaagttaaaggaagcttccaaatttgttttgtgaaataaatataatttagatatcaaaacctaacaaaaattgtctcccagaaaactacaaataaacctcacctcacttatcagtgtttatacaaaaatactaaataagatttagtattaaatttaaatctagaatacaggtttatttcataaaagtaaagatggtttaatattagaaaacatatcaatataattaaccatattaataatactaaagagacaaatcatataataatgttaagtgctgaaaaataaaattcaagaaccattcctaattattaaaaaatcttacaataaaaatagatgatttcctaacatgataaaatatatctatctcttaatagctagcaagcatcattcttttttttttttttagacggagtctcactctgttgtccaggctggagtgcagtgcgatggcacagtcttggctcactgcaaacctctgtctcccaggttcaagcaattctcctgcctcagcctcccaagtggctgggattacagacatgaaccaccgtgcctggctaatttaacagctagcatcattcttaatgagaaaacattattatttccattaaattcaggtaaaaagacaaagatgtttaccctcaccctattaactgatgttaaccctagataagtatccagtacaactagaagaagtgaaattaatttaaaggattttaaaaaattggaagtttcctggtggagtatcttatctgcagatggttatataaataaaaaacccaagagaagcaactaaaatattattctaaataacaaaagcatgaaatatggaaggaaaaaaataaacagcaacaaaaaataagatactagagcaataaagttaacaaaaaatgagcacgactgaaacaggaaattttccctgaccccttcataggcctcacaaagggagttgctcgtttattcagcctgcagctctcaaatcctttgtaggaggggaggcatgcaggtgagtgggtgcagggaccaggaggagttctggatgccggcaggagcagaactccttgcggccccacagcagcatccagcggggtacccatgacccctggagccccagagggcatgtgttactgtgctcttatagctttgctatccatgtacggctttagtgtttaacagctcagtgtgatagccctctgtatctcaagctcttgttgggcatccaggaagaatcaggtcgcaggaacaaactgaacatggtaaatgcaggggattttattgctgataaaagtggttctcagtgggatgaagggcttggaagtggatagagcaggaagggggtcttcctctggagttaggccatctcttctccaaggtccagctatcaagccgaccctctgaagtcaagctgcttcttgccaatgttaagctgctttttctcttctctcctctgatgctctgctgctagtggagcctggggtttttatgggcacaggatgtggggggcgggggtggagcaggccagggtaatttggaagaggcaacatttaagcgggaaaacagaaatgcatgttctcactttgggctgtgagtccaggcttgagggtggggcttcaagaaggacccgcccttttctacctaatatttcgctgcctcctgtccatatcacaatctatatgaagactacttttaaatgcttcagatatacacacagaagacttgaacaggagaaaggctaccatgctattgagtggaaaatgtcaatgtcatcagatacaacatttccctaaatgaatctacatttactgtaatttgacacaaatgccaaaaattttttagacagataataaacataatctggaaaaaatgaagcaagaatggccagaaacattctgaaaatgaaaaagtaatgagggaggactaaccccatgaaataacacacatgttatgaagctgaaaaacacaaaatagtgtgacagtggaaatcaatactcaataaaacagagtagacatccagaaaaatgagaatttagtatatggtaaaagtggtattagtaaaggaataatggattattcaataaattatgttagaacaactagctagcaaagtggaaaaaaattttggatgtctctctcacatcttatactaggccaaataaatcaaataattcatgtttttatttaaaaaaggaactattaaatattagaagaaattttggagatttcaaagttaattttagagttgagaagacccttctaaccatgataagtgaaaaaacaagcataaaatgatttatttaatctggttacataaagtaaaaagatactacatggcaaaaactacctaagcaaagtcaaagacaaacaagaaactgggaaataatatttgccactcacattccagataaagattaattttctgaatatattaagagctcatacaaatcaataagaacaattactgaagttaaaaattggcaaaggatatgaactgatagttagagaaaatgaaataaaggtggcttttaagaaattaaaagcttataaaatgtgaaaaggtatttaaaaattaaaattaaaaatcatccattatccttcaacccagagacaacttttaaagcgtgtgtgtctgtgtgtgtgtgtgtgtgtgtgtgtgtgtgtgtgtagtttaacaaaactgggttcatactaaagtttttgtaatcttttgttttcatataacatttagatgatttttccaattcattaagttgctttcagaagtttgtttaaaaaatttaaaggatgctcagcctgatttactacaagagaaatagaaataagaactactctgagatgtactttttcacctatcagattaacaaagatcaaaaagtttgaaaacacactgtgctgatgatcatagggaccaggtgagctcataaatgatggaagtgttaattgctactgcctcaagtacagtttagtaatagctatgaaaatcatggtggtacatacattcactcaagaattttacatgagcgaaacaagaatacatatacttgaacacataaaagataacatatgtacacaggttacatgttacagcattgtttataatagaaaaaataggaaaatcataggatatcatcaatacaaattgatatcaatacaaaggttcagtgtaagaagctatagaaagaaaatattaaaagaggcacaagaaagagaaagatagaaagagaaaggaaccaaatgtatttatgtgtttggaatggcttccaaatgtattattaggcgcaaaaaaaaagcaatgcatttaatatactatcatttgcattcaatactgttgttaaaaataattaaatacatgtgtgcttgcatatacactaattttctctggaagaatacaataagaaattaataatattgttttcttaaaatagagttagaaaatgggaatttttttttctgagacagtcttgctctgttgcccaggctggagtgcagtggcatgatctcagctcactgtaacctcctccacctcctgggttcaagcaattctcctgcctcagcctcccaagtagctgggactacaggcacctgctaccacgcctggctaatttttgtattttcagtagagatggtgtttcaccatgttggccaggctggtctcaaactcctgacctcgtgatctgcccgccttggcctcccaaagtgctgggattacaggcgtgaaccaccgcgcctggcccggaaatatttatttatgttttcttccacagatgtaaattatggactgggagacaagaagcaggaagaagactttttactgtatacattttgtatcttctgaattttcaatgatattaccatataatctattcaagaaatgaatacatagaaaatctgagctgttttgtcataaagacatacccaagactgggtaacttgtaaaggaaagaggtttaattgactcacagttccatatggctgtgaggcctcacaatcatggtggaagagcaagggacatcttacatggcgacaggcaagagagagcctgtgcaggggatctcacctttataaaaccatcagatctcgtgagacttattcactatcacgagaacagcacgggaaagacctatctccatgattcaattacctcccactgggtccctcccatgacacaagggaattgtgggagctacaattcaagatgagatttgggtggcgatacagccaaaccatatcagtgctactaaatcttgagaatttagtcacacctattataatgctaacaacacccactgccatcctgtgtgtttctagaactttgttttgtttcagccacaaacatttttttcgtatctggtcaagaattgtatacactatgcaatggtgagtctcaggcagccaggagtactctcaatgtgtgctaacttgaattaagggaggacatatttctgcggcccaataaatttaagaaatgctctcttgagccccagtaaacaggtttctatataataaacaaaatgttgctaattcaccatcagcattggaatgataaaccctagcaagctgaccctttcatttctattatacgtgtgataacataaaatctcccatatcaccagccatttagcagaaagaatttctcctacttggcactagaccaagagtaacaacctacagttgggttgaaaaggccagatagaggtacctgtaaaaaaaaagactaaagacaaactgaaaacaaaatgctgaggaaacagtaattaagaaagtgctctgagaagaaaattaggttgaatcttagagaaaattgaattaacaacaaaagtagcagcaacaacaaccaaataaccacagagcagaaagtgtctacaagcaaggaatggtaacagtagttaaattcaagttaaagttctaagtctctgccatctactctgtttattcttgagcaaaaaactaacctatgcaaatcttaattctctcatctataaaatgaggaggataataatgctgatctcacaggagggtcctgaacaataattaaaataatatatatatagcaaatggctgatacaagctggccgtacctgttattgaaagcagctgtatcggggtaacaactaatgttgaatcaccagtctccagaacttgacctatgataaattttccaaacaaaacttattttaccctctattcccctctgcaaagtactaggtggaactcttctgaaatagaggcactatttcttttttctcttcaggaaattgcagtgattcttcttaagggtctcattttctgaactttaatgtccatggacttctaagaggagataaataaaagcaaaagagcaaaaggcaagaacaatcctgaaactctcaagtcaagaaacagatgctacagatcgttttaatcaattctgggtaggttctgggcatcaggcttctgacttggagtggaaagggccccagaaggtagaccttcctaaaaggaaaaaggtgaatggaactgcccccatttctaaactaatctctaagacagtctgtaaacatggacacctgttgggggtcctcactggaccagtgacttatctgtgttagccattgttcctcagatccaccatccttaaaagctaacaacaagtaataagacattttgttgacaccctttcacagccttccaggaagaaacatgtctgttccaggtgtgttagacaaacaacattattatctttcatttgatccctagtgaggattttgttgttgtttaaaaaaataaagtatttggtattcaaataatggcatgcttccttgtacattaacaaaatggattttgaataatatactggatgcagaggaaacaggtaagtgtactttgtaaatgctttttcctgtctcatcattctcaggggctgaaaacattaagtcaacaactgtcaaaacattgccacagacagctggaagtagagcattaaagccatcgaaaaccacctgggagaaaatatttatgggaaatgatgagatttcttagcaagcagctcccaatcattttagtaacaggtaatttggtgaaaacatgtcacatgtcacaattgtttgctactactttctcgtaatgttgagaggttttattttcttgtgaaatagcctgatgagtagaaagttaaaattgtcataactcaaattctcatgtaaggcctttttaaaaaatggattgggaagacttacaaaaacataataatattactcatttttaaatcttctccctaaaaaaatacagaagcaaaattggttgtttcaaaatgatgaaactttcaaaattattattatcaaagtaatactggtttctgggggaaaaaattaaacgctaaaaaaggtgttttgtgaaaagcagcagtctcctgtctcaccccaattaacatttccaaaagcaacatttctatcaatttctggcattagtttttgtggtggttactctcacaattccaaatacatacacatatacatgtatgtgtattttttgtccatttgtaaataatattcattgacatatcactataaaaagtgggaatttctttttctggctgggtgctgtggctcacacctgtaatctcaacattttgggaggccgaggcgggaggattctttgaggccaggagtttgatactagcctgggcaacatagcgagatcccacctctatattttctttttaagtgagaatctgaatgtcacttacattactctcaaactattgaccctgtcctcttctaaaattttgagttgtattactattttcagctcttgttttcattgcctttaaattgttaagtgataattttaagttttcatttctattcaagtatttatactcaatgcccataaaatgcactttataaaaagagtatattagctctctacccttccttcaaacaccttcccttttccaccttataacttctgaaagcaatatgttccttctgaattgtcatatgcttttctataactatagttcagtcttctatgctttatttataagttgatttaaatatggaaaaccaataaatagcatttctaatattgtggctaaatattgttcaactcaaatagaaaactgtttcccattaaggtcaatgacacaatccatagacccaaatcaaaggagaatatttccacaataaaagtcaaatgtgttttatagttttctgtgtacaagtccttcaacttcttttataagtttattcctaagtatttcattatttttgatgtgataatttttgacagttttttaaaatttcattatcagataggtcatttttggtgcaaataaacagtactgattttgtatattggctttgtatcttgcaactgtactgaatttgcttgttcgttctaacagatttttgtagtctttagacttttctacatataggattatatcatctgcacacagagatagttttatttcttcctttccaaattggatgccctttatttctttctcttgcctaattgctctaggaaagacttctaatactatgttgaatagcagaggcaagagtgggcaaccttgccttgatcttgacaggaatagctgtcagctttgagctatgagcttatcatgtgatatatggcctttattatgttggggcaaattctttttatacataatttgttgaaagttttcatcatgaaagagtgttgaattttgtcaaatgtttttctgcattggctatgatgatgatataacttttattctacattctgttaatgtaatgtatacatttattgatttgcataggttgagctatcctcgcatcccaacaataaatcccagttgatcatggtgttttcaatgtgctactgacttcattttgcagtattttgttctggatttttgcatgtatgttcatcagggatattggcctgtagttttcttttcttatggtgtctttggttttaatatcaggataatgctgacctcataaaattagtttagtactgtttcttcttctattttttagaagagtttttaaaggattttgtttatcttatcatttttatcttttcaaaaaacaaactcttaatttcattaagttgttttaaaatattttctattttatttattccatctctaatcttattatttctttccttttattaactctagtaaaaacttagtttagggcttagtttgttcttctttttctagttccctgaagggtaaatttaggtttttaatctgagattttttttttaatgtagatgtttatcactgtaaacttctctcctgctgcttttactgcatcccataagttttagtatgctgtctttccattttatttgtctcaaagtagtttttttaattttcctttcgatttattctttgaaacattgatgaaagaaattgaaaaagtcacaaataaatgaaaagacatttcttcatgttcatggactggaataattaatgttgtcaaaatgtccacaatatccaaagtgatctacagattcaatgtaatcccatcaaaattgcaatggcatttttatagaaatagaaaaaaatctaaaatttacgtggaaccataagatgcccctagtagccaaagcagtcttgagcaagaaggaaaaaaacagaaggaatcacactttctgatttcaaaatatattaaaaagctatagaaatcaaaacaatatggcagtggcataaaaacatacatatcaaccagtggaacagaatgaagttcccagaaatgaatccacgcatttacagtaaacttatttttgacaagaagggcaagaatatacaatcaggaaaggatagtatcttcttcagtaaatggtgtcagaaaactagatacccacatacagtaaataaaatttgacctttatcatacaccataccaaaaaaatcaacttaaaataggttaaagatctaaatgtaagacctgaaacaataaaattcaaaaaaaaaaaaaagaaaggcaaaccttcttgacgttagccttgacaatgattttttggatatgacaccaaaagaataggcaacaaaagaaaaatagacaaatgacattatatcaaattaaaaactgcacaaaaaagaaaacaatcagcaaaagggacaaggcaacctattgaatagaagaaaatatttgcaaaagatatagttgataaaagactaatatccaaaacataaggaagtcctacaactcaatagcaaaatagtagcctgattcaaaaatgggcaaaagatttgaatatacatttcttaaaacatccaaatggccaaaaggcatatgaaaaggcgctcaacatcactaatcatcaggaaaatgtaaataacaatgatatatcacgttagaatggctgttatcaaaaaagaaaaagtagcaaatgttggtaggatgtggagaaaatgaaactcttgtagactgttggtgggaatgtaaatttctacagtcactatatggaaaaaaagtatagttggtggaaatgtaaattggtacagacactatggaataagatcccaaaaaattaaaaatagaactaccgtatgatccagcaatcctacttcttgatatatatccaaaagaaatgaaatcactatctctatgaagtatctgcactctcatgttcattgcagcattatccataacagccaatactgaaaacaacctaagtgtcaattgacggataaatggataaagaaaatgcagtatttatccgtgtgtgtatatataatatatatatgtatgtatgtatatatgcataccacacacatacactcacactcagtggaatattattcagccttataatgaaggaaatcctatgacaggcaacaaaatggatgaaacttgaggatattatgctaagtgatgtaagccagacacagaagaacaaatactacatgatcccacttatattagaaatctaaaacagtcaaacccatggaagcagagagtagagtagtggttactaaggactgaaggaaggaagaattgagaaaatttgcgtcaaaaagtacaaagtctcagttatacaagatgagtaagtcttagagatctgctgtgtagcacagtgcatatagttaacaatcctgtattgtatactactttcaaacttgttaaaagggaaagtcttatgttaaatatccttatcacaaaaaaggagggaaaaaacttttagaggtgacagttatgtttatggcattgtttatggtgatggtttacataggtatatacttgtcttcaaactcatcaatatatatacattaaatatatacaccttttagtatgtcagtcacacctccaatttttaaaatcgaatgcattttattttcttattatccatcattgactcagtagcattcaagaggttgggtttgtaataattctactcagttgctttattttacgttgtttggatccctcctccaaaaaatatacacatatgttttactgtctcctcatagtaactcagctttgtaatcacactactaccaagtagatgtaatccactttttttgctccaggagcaccgttttcaaagccctttatcctcttatttcagtctcaacaattgtgccctaatcctgattcacatttggaaattccttcgctgaatgtctgaattatatccattaactattttctagatctcatatcttacccttcatttattttctcactttcttactggaacacatccttaagtaattccctcagaaaagtgacctgagaacgtaaactctctcagtccttgaaagtttataatatttttattttgccctcattcttgattggtagttttgttgagtatataatttaggtctaaaataatctcccttaagaacttaaaatacatttcattatcttctaagattccttgtgtattagtccattctcatgctgctatgaagaaatacctgagactgagtaatttataaagaaaagaagtttagttaactcacagttccacatggctggggagacctctggaaacttataatcacggtggaaagcaccccttcataggtcagcaggagagagaatgagtgcaagcagggaaaatgctagacgcttacaaaatcatcagagctcatgagactcactcactgtcacgggaacagcatgagggaaactacccccatgatctaatcatttcccaccaggtccctcccatgacacatggggattatgtgaactacaattcaagatgagatttcggtggggacacagagccaaaccatatcaccttgttacaaattgttaatctgaaagcaatgtgtctttttcatttgtacattttcacattctttttctctagaagtttttagggtcttctctttatttttggtgattcactagtattgtacaacttcatataacagaaatctagctacagtgaccatataatgactaatatttttaatgtaacatgaagtctagaggctggacaaaatgctccacgcagtcatgaaggacctaggatccctcctgtcctaccactcttttcttgtcgcttactctctcgttcattgtcacagatggcttctccacaatgaggcatcacatttttttttccacacaggctcaccctctgccacccaagttggagtgcagtggcatgatcttggctcactgcagcctccacctcctggctcaagcaattctcctgcctcagcctcccaagtagctgggactacagggatatgccaccacgcccggctaatttttgtatttttagtagagacagggttttgccatgttgcccaggttggtcttaaactcctgggctcaagagatctgcccacctcggcctctcaaatgctgggattacagacataagccactgcacccagccaaggcatcgcatctacatttagaagtgatggttatgtttatggcattgtttatggtgatggtttacataggtatatgcttgtcttcaaactcatcaagatatatacattaaatatatacaccttttagtatgtcagtcatacctccaatttttaaaatcgaatgcattttatgcagacaggcagagctgggtcacatggacacccctgcaaggaactctgtgtgataaatgatttttcattgtgcacacttccacactaaacaaaattgatgtttttttcaggagaaaggggagaatgaacatgtcttagtaaatttgtagtgaatgttccacttgatgaaaattatgtaagaccaactctgggcttaccaattaaaataacatgttttttgtcggcactgaaattttttcttctatttaaaaaaaaaaataatgtttttccctccattgtctctaacttcactacctaaaacttctttcagtcagatcttagacctcctgggttaaacaactgtgtctctcatcttttcctttatctttttcatgattgagttttgctctgaattctgagagattaccttgacttcatcttgtttttactataatcatatattgcctggatgtaattttaaatcatactttaaatatctgaaagcctgttgtgtcttttttactttgtttttaattggcatttaacaattattcatatttatgaggtataatgtgatattttaatacatgtataaattgtgtaatcatcaaatcaggatatttaatatatctatctcctcatataattatcatttctttacagtgagaacattcaaaattttcctattttgatgtttgttttgtttgtttgtctgtttgttggtttgtctattgcacaggctgtagtgcaatggtgaaatcttggctcactgcaacctctgcctcccgggttcaagtaattctcttgcctcagcctcccaggtagctgggattacaggcatgcatcaccacgcctggctaacttttgtatttttttagtagagatggggtttcaccacgttggtcagactggtcttgaactgacctcaggtgatccaccctccttggcctcccaaagtgctgggattacaggcttgagccactgtgccccacctttctaactattttgaaatacacaacattgttaactaacatagtcaccctactgtgcaatagaacaccagaactaattcctcctatctaactgtaactttgtagtcattgacaaatctctccccatttgccccctaatctcactatcttccccagcctctgataaccactatcctactctctacttctatgagatcaactttttaagattccacatattggtaagatcatgcagtatttgtctttttgtgcctggattatttcacttaaaataatgttctctaggtttacccatgttgccacaaatgatagtactacaattttttttttttttgagatagagtctcacactgttgcccaggctggagtgcagtggcacaatctcggctcactgtaacctctacctcctgggttcaagcaattctcctacctcagcctcccaagtagctgggatcacaggcatgcaccactacgccgggctaatttttgtatttttagtagagacagggtttcaccatgttggccaggctggtctcgaactcctgacctcaggcaatctgcccgccttggccgcccaaagtgctgggattacaggtgtgagccactgtgcaggccgtattccagttattttttatgtctaaatagtattccactgtgtatatataaaacacattttctttctctattcacccattggtgaacacataggttgatcccatatcttgactcttgtaaacagtgctgcaataaacattgagagttcagatacctctcagtgatttcctttggacatatactcagtagtggggttgctggatcatatggctagttctatttttaactgttgaggaatttccatactgttttccataatgacttactaatttacattttcaccttctcatttcttaattgtttatttttaatagcatccttctcttattttatggaggcaatatcttctgtgcctcctctaaggacacaagcttaaattttttgtcttctttgatctttatttcttcaggggtaattcactcttggtgtttagcttggtctttctctttcaggctgtggattttgttcctatttctgatcatccttgattagtaattcatgaaggaaaaggaaaggctgttttgggtaagcaggtatcattctccagtagaacggtctcctgaatggaaaggctgattggaagctctcttttgtaactgggccaccttgacaggctggctcctcttttaggtatgtgggtgtggaatctgacattagcctggaaattcaaaatgccataataaaaaaagggtttaatctatgtgcaaatatctgcacttgaagccctagttcttccttggaaatgtattcaatttttctagaaaagaattctcaatatgaaggttttcgatggttctgtatgcagtggcaaggaaggcactggaaagcatcaatgatgcagctatatggcagacagaattttaatgatgcctctggtttttgcacaatgtctcgctcctgctatccaaagctaggaatccgatagccaaggccctccaggcttctagcagcctgatcagccaccacattcccagaggcccatgacatgcatattctgagcatcctttactccacttcatctacaatatgctttttctgattgtccacaaccaagaaataggatgaaatctccagtctgctcttggccatcctcattcccttctctttagtgttatgatatttttttctctatggagtctcagaagaaagggaagtagtgaacacattatttaaaaaatcaaatcaaaaccttatacatactttttttttatcatacaagaacctctgggtctatttcagaagcttaatatttggtgcccaaaatattttatcctggacaatcttatattgcacaaatcttaattcagagtcataaaagtcccccaaactggctttttaagctggtgcataaaccccattgatgatagtcttatcctatttttgtttatgctcatgtgctttctcacctgttaagaaacttgctaattctattatgcgactctctggcaaagcttatcaaagcttcaaattaattaagcagtggcagctcccaatttccttttcttactggcaaaaatttgtttcacagaaaatgtttagaaagcttaagttggtaacagctgattgttgacctggaaataagaggtcttcatcaatatgttaagcggtcaggatacttaaagaaaaacatctatggagacttcttagcatgcactctaggcaaatacttgctgtccttcaccattatttcaggatttttttttcctaaaagcataagaacaaacacataaatgataaaagcagaatttaggccaactctagcttgcctgccaagtaggtaagatgcggtggcagaatactggctacacttgtgcctgtatcaccatggagaccctactctgaccatcaaataatgggattctaatgaggaatgctgctgaacaacaagcatggctgagcacaaagacagagctgctggcattggaacatgggagtgagcaagaaaggggcagcccaagggagaagaaaaggtgacactgaacgtaggtgtcgtgatgagaagaaaataggttgcaggtggtgactgcctggagaccagcccaaatcaccttccacctttacgtggaatccaggctcaaagcaggagggacaaacttgagtgggataaatgtgacatgaaatgagtcagtttgcccagaatatgtttttacctatgaggtggattgcatgggatgggggaggggggcttgtaggcaggaggggctgggtcatggaaattaaatgaattactttcctaatgtgcattgttgtttttttttttttttacacaattggttcacaaaataaaaaattaatccttactttatgtatgagctcatctgggattttgaaatagcctcctgatgcacatctgtacttagaccaattctaaatcctggactagaattttgagtaaaatcatctccaggcaagagccaggaccagtgagagctgagaggctcaagaagtgatgagaatagattagatgaaccctcactgctgatatcagaattagaaatgaattataacaaggctgagtttcaaagagaaatgcccaggatggggtcaggatgcacctttctctctctccatacaagctctccctgaggggtctcctctattctaagtgctcaggtcccctcacaagccaatggcttccaaacttgtgtttatctcatctcttgctcttgatctccaggcctctctacccaccaacaatcccttctcctatatatatatttttgggcccaaatttttgctaagtgaattgttctggctctaactatcctctcctttgcaaatgagaggtctttcattctaagaattatcatgggccggcatttgtagctgacattgaaaataaacctcccccctccccagaactgcctataagatgtgattttctgaaaacctgcaggccttgggaatgcaaatcagagaaagatccaattgtcaccaacacttaccagggaacactgccatttgcatctgcactccagatccccggtggctgcaaatatatcagtggctcattcaaaccagagcccaggcacagattgaaagcttgagtggaggtggatttggaaagaggaatgaaaaggacacagctctggaaactggggggaatgagcccgtgtcactgccaagatggaagggtaggcagtgcattcccacatgtctgaccctaagatttcaaatttcattagtagcatctcctttagctcaacctaactacaaggagaacgagaaatacaaggaagtccctgccatgtttggggagcatttttatctctgccccagcatctcccattttctgctgaactaaaaacctttctctttctcaagatatgtggaaaaggaaaaggagaaataaggaatatctcttactttagtccttcatttttctagcttcccaactctccaactcagactctcgctctgacccccaagtcaaatatggcaggtagcactgccttctttaggggtcttccagattatgctaccaccaccaccaccaccaccactccacttttcagaaacatgtgggtttccacttgtcaaaaataaaacaaccctcttgatcattatagacttggggtcttggctagagaacaaatgaaaacagaattaagaacaaagaggcggggcatggtggctcaagcctgtaatcccagcacttttggaggctgaagcaggtggatcacgaggtcaggagttcgagaccagcctggccaacatggtgaaaccccatctctactgaaaatacaaaaattagccaggcgtggtaatactactactaataataatactaataataacaaagaaaagcaaatagttaagtatttaaacattttgaattccataaatattgatcaaggcccagtatatacctagactctttacatttaatattcactatacccatccaagttccgggcaccttataatgcacacatttgcaagccacagcccagcacaaagggcactccctaaatgagagcaaccacaatccctcctgagaatcgcacgatgtagagatccaccctctctccctttgaaaaaatacgaccatggaacataaggctgatcgcatcaaatataggaacagaggagggaggactcgctgctggagggagataaagcaagtagtcccaatgcagacagtaaatgaaggtggcacagggttctctggcgtttgttgtattgatgcgcccagcgaaaggaaatttggcagctctttagaggtaatctgccttacaagggaccgtgagctgactggcaagcaacagagttgctatgccatcatcatggtcacatttgttaccctcacttgcggaggaagaacagtcacattcctccccaccgcaaacgtccaaagagatctggcaccaaagaagacttcctgctttcctgccacagcccaaagcctcagagtcccccacagatttcacttcctccataacctcagatgccattgcttgtagtaaatccatgtgatagtgcacagaagcacacacacatacagggaggtcttcatttctttcctccctctttccttccctcattccttctcttccttacctccttcctttctttccacttttctctcttccaacttccttccctcaaccaatttatttattggtagcctaacacatggacaggcatatctctttaatttagaagataagactttactacatgcaatttaaaagtaaaatgcacctgtccccaaataaacagggacaaatacatggagagagacagaattcagcttcagttgcatacttctgcccaccacctgagcaaaacatacagctacacaggttctttcctttgtcagataattctagcaactttttggcatgaagatagcatgcacccacagagctaagtatataaatgctgtcttacttccaatatctgcagtgaacctggagtagagctttcacaattcaatcctatttaggacctagagacaggttaattctgtttaactcttatcactcttccctccctcccacccaccatgtcagtctcttatgtggctcttctctctggacctgaagctctgttgaggattgagcccagttctccagctttgcatttccctcaggccctatactaatgtgggaggcacaaaatacctatgtcttattgcattatcttcatgacctgctgcactttatcctgaatattccattccattcaaacagatattccaacatcttgttcccttcatgtaacacacaaccatttttggtgctccataatcttctatctccccaatgccgtcccccccgcaaagaaagaaaaaacaaaaacaagcaaaagacccaaatcactgtatctctttttatggaaaaattacaaccagaatatatttgccactttttaattgatgacctaaacaggtaaactctgtaaaatatttgcagagatttattccgagccaagtatgagtgaccgtggcccatgacacagccctcaggagatcctgagaacatatgcccaaagtggacaggctacaactttgttttatacagttagggaggcaaaagacatcaatcactaaaacttaaagtgtaataaaaaaaaaaaaagaaaaaaaaaagacatcaatcaatataagatgtatattggctcagtccagaaaggtgggacaactggaagggggtgctttcaggtcataggcaaattcaaaaattttctgatggacaataggttgagttattatctacaggcctggaatcaatagaaagaaatgtctaggttacaatatggggttgtggagaccaaggttttatcatgcaggtaagcctccaggtagcaggcttcagagagaatagattgtaaatgtttcctatcagatggagagtctattagtcttaaggtctgtgttgatgttaatactggtcagttgggcctgaattccaaaaggaaggaggatgtaatgaggcatgtccgactccccctttctatcatggcctgaatgcgtttttcaggttaacttcacaatgctcttggccaagagaaggggtccattcagatgttggggggcctggaattttatttttggtttacagaattcttaaaatggtcttcaaaattatatataaatagggccgggcacggtggctcatgcctgaaatcccagcacttggggaggctgagaaaggcagatcacttgagcttaggagtttgagactagcctggacaacatggcaaaaccttgtctctacaaaaattagccgggcatggtggtgcctgtggtcccagctactcgggaggctgaggtgggaggatcacttgagcccaggaggcggaggttgcagcgagctgtgatcacgccactgcactccagcctgggtgagagagctagaacctgtctcaaaaaaaaaaagtatatatatatatatatatatatatatatacacacatatatatttaaaaaaccaaaattatatataaatatattttttaaccatatcacatgtaataaaaagccataagtaattctggttttagattaacaatttccactcaaagttttagtgtttgagtaacctgtcctactatgttcctggatcccagaaaagtgaaggactcaggatgaaggctcacccagcgacgaggggagaaacttgggtttagacgtttgattggtgtcctcaagaaacccaggaaagttccctggttacagctttagcgtttaagcaagccatccatttacaaattggaagcatttttaagtttgattgcagagaggcaagctgtacctctctccctttggtggccgcatgccccagcattttctgccagcacagatttaaaatattatctatgtattcttctctcacaagaaggctggtggctctcagtccaggtctttccacttttctctcacacttctctcttatctccttcctctgctgccttccccaaacatctaggtaacagaaaaacatccggtggtcctaggaaaagaaaaaaaaaccgtgggcttcccaaggcaccacctctcagtctcctggtaccgactggcacaactcccagcaatctcaccctctctaggaagaccttcacagtccatgaggtggcttcatagaattttgaaatcccctcccctaaaatcatctggttccaggtttattcaaagaaccagattctacaaagcaccacgaaggataactttttctctttccatcactgcctttggttttactgtttaacagctttcttctgcgtttaagagcaacctttcaggtctagacatgtcagaaatcaaaacaacattatttttaggtaaaagattaaaaaaaggttcagtcctattacaatcaaaactgttatctcccatctcattttaaggtgctctccctctctccagcaaggcctgggccacagagctttaccccagttccagcaatgagaatggatccgataaaatctcttttcctcaccttcctttccctgcttgctcaactgctgccagtttctggaggcaggaagggagggaagaggaaaaagtttaggtaattacttaactagttccggtgcaatgtggctactcaatgccctctggttgacatatgcccaaatactaatgaagcgggaaaaattcccttattccctttgcagattatgccacaggggtgtggctcgattctttggtgccccgctgctcaaacccctagccggaacatgcagataagcaggtcttggggagcttttttgggctccaaccccacagcagcatctagggctgagtgtttacagttcccaaagaagccccagtgggcgtgtgctacagtttactctttgagctttgccgtctgcaggcagctggtgtcaagcggctcaattagatcccttgacttattgcaaggacagagggctgtctgtatcctgagttcttgtcccagggtactgggaaaatcgaatcacgtgggcttggaggatgggtgcaaggttttattgagtggtggaggttgttctcagtgaggtggatgaggaaccagaaggggatggagtgggaaggtagtcttccttggagtcgggctgcccagcggacagactctcctccgactgcccccaaccgaatgccacgtcgtcctgccctagatggcgtgccggtgtctgctggtgtctgtcagtgtgctcttgtgcccctctgctcctctcaacgtccagccacttgtgtctgtgtccgcttaaggtcttgggcttacacgggtacaggatggggggcgtggtgggccaaaaggcaacttttggggcgcaaaaacagaaatgcttgttctcatttgcgtccgtgggcacaagcccgagggtggagcccttgtcagggaccctgcccttctctactcagcacttccctgcccccactcccctgtcactgatgggcagaataatgctccccaaaatgtccatcttctaatctgtggcacgtgtgaatgttaccttacgtggccaaagggacttagcaggtgtgattaagttcagaaccttgcaatggagagaggatcctggattatccatatgggccctatttatttattttattgagacagagtgtcactctgtcacccaggctagagtgcactgccttgatcttggcttattgcaacctatgcctctggagctcaggtgatcctcccacctcaagtagttgggaccatggggaccagccaccacgtgtggctaatttttttttttttttttatagacagggtttcaccacattgcccaggcgggtctcgaactcctggcctcaagtgatccacccaccttgacctcccaaagtgctgagattacaggcatgggtcaccacacctggccagataggcccagtttaatccaaagggtccttaggcaggagggtgagagtcagagaagtgagtgacaatggaatcagagatcaaagtgatgccattgctggctgggaactgtcagccaaggaatgagggccgtctggaaaagctggaaagggcaaggaaagggattatctggagcacttccagaaggaacacagccctgccagcactttgacggtagcacagtggaatctttgctggacctctgacctccctccagaactgtaaggcaatatacccgtgttgtttcatgctgctaaatgtgtggtaccttatgacagcaaccccaggaaacgaatacactgacttccttatgggacacattgtaggttttccagacctccgtagcaggattcttgacaatgcatctttttctaaagcagtgtttctcaaccaaggacaatgtttgcccccacggcatcattggttaatgtcttgagatatctaagatcatcatgactgagaatatgccaccagtatccagtgagtagagcccagagatgctgctaaacatgttacaatgcacagaaagcctccacaacaacaacaaaaaactatctggtctaaaatgttaatactgtcaaggttggaataccctgatcgcaagcaagcaactctttgacttccaattaaagtgctttcctggccgagcacgatggctcatgcctgtaatcccaacattttgggaggctgaggtgggtggatcacctgaggtcaggagttccagaccagcctggccaacatggtgaagccccatctctactaaaattacaaaaattagctgggcgtggtggcatgtgcctatagtcctagctactcaggaggctgaggcaggaggatcgcttgaacccaggaggcagaggttgcagtgagctgaggtagtgccactgcactctagtctgggcgacagagcgagattccatctcaaaaaaaaaaaaaaaagataaagatatgtacggaattattgggacttagacagctgcttattaactaattctgccaggaagcactgtaggccaacattgtcatcaaagaatgatgacttttatttcctgagagtgacttttacaaaaatttgtagaactggagtagggaaggatacaatctaatgtttatgtatcaaagaaaggctatttacaaacaaaagaagagaaaactgggagcagagcaaagtttatgtgctttctccagtcattatttcaacaaatactccactcagatgttaccttcttactgaaaccttctcttaaaataatcccatcactaccctatgcccactttctctctattccctctccctactttctcattaactttttgaggaactgttttccaaagtgactgaaccattttgtgttcccaccagtggtgtatgagggttccagtttctccatagccttgtcaacacttgtcatcatcttccttatttttgccatcctagtgggtaagaaatggtatctccttgtgtttttgatttgtgtttccctaatgactaatgatgctgagcatttttttcatgtgcttattggccatttgaatatcttctttgaaaagatatctattcaaatcctttgcccattttttttttttgagacagggtctcactgtcacccgggttggagtgcagtagtgcaatcacggctcactgcagccttgacttcccagactcaagtgtgactctcccacctcagcctcttgagtagctgggactacaggcatgtgccactgcacccggctatttttctttttttttcatttctagtagagatggggttttgttatgttggctggtctcgcactcttgggctcaagcaatcttcccgcctcagcctcccacaatactaggaattacaggcgtcagccaccatgcctggccctttgcccattctgcgggggaggggaacattatggtagaagtttattcagaggcagaagaagggaacagtcacttttttaaattataaattcagaggggtccatatgcaggtttggtacataggtatattgcataatgttagggtttaggcttctagtgaactcatcacccaaatagtgaacacacaatagatagtttttcaacccttgcctcccttccccctccctgcttttggagtctcagtgtccattgcttccattatttttcaaatagaagagcataacaaagttattttatcacagctcatgtgacacagccgtcttcagaatgaagactcagagatccaggggaaactgcccatgtttataaacattaacatggttcagcaaagtatggaaacatgattggacaaaaagagtaagatcaaatgctcatagactgaaaggaagaacccagccaggcctgtcagttcagattcttcttggcatctcttagcagcattccctttgcccatttttttaattgagttttcttttactgtttgcttgtaagagttctttatatattctgaatactaggcccttatcagatatatgattttgcaaatattttctcccagaatgtgggttgtctttcagtttcttgatagggccctttgaagcacaaaacttttgaatttttatgaagcccaatttattatatttacttttctttcattgcttgtactttaggtctcatatctgagaaaccatggcctaatccaaggtcacaaagatttacacttatgttctcttatatttacatctttgatccattttgagttactttttgtatatggtgtaagatggaggtctaacttcattcttttgcatgtggatattcagttgtttcactaccattttttaagagttttccttcctccagatagttttggcacccttgtgaaaatcaataccttattgtctttatgacacttatcaccatctgaaattatattatttatttgtttattgtctacccttcccaaactcccttactccctgtattagtctgttttcatgttgctgataaagacatacccaagactgggaagaaaaagaggtttaatggacttaaagttccacatggctggggaggcctcacaatcatggaggaaggcaaggcggagcaagtcacgtcttacatggatggtggcaggcaaagagagagcgctcatgcaggggaactcctctttataaaatgatcagatcttgtgagacttattcactaacaggagaacagcacagggaagacctccccccatgattcgattatctcccaccaggtcccttccacaactcatgggaattcaagatgagatttgggtgaggacacagccaaaccatatatctccccttcctcctaccccctgcaaacacacatacaaattcaaatgtacatcttcttaagacaggaacctgtcttatctactatttatccccagggacatcgtgggcacttaataaatatttgttgaatgaataaaaagggctccagttttgttgaaaattaatggccactgtatgtgtctatacccaagcgcaggtaattacttcatttagggcaaaaagattgttgaacattgcctaaatgagattttatagccatttcctgggttggatgagaagaacctaattaggcaagaaattacctcattggcagaaaaaaaaatccagcagagaattttaatgaaaatccaaatgcaagtgtgaagggactttctgagaccctctgcttgatagtccaataatacctcagtaggtgtatggctttggtcaattcccctcacttctgaaggacttcgtttactcacccctatatggggagctcctgtgctaagccatcttgcaggtcactggcagcagtagcattatatcattctaatgttttggattgtttttgtttttgtttttgagacagggtttccctctgttgcccaggctggagtgcagtggcgtgatcacagctcactgtagcctcaacctcccacctcaagcaatcctcccacctcagtctcacaagtagctgggactatagatattcaccatcatatctggctaatgtttttttttaacagatgaggtctcactatgatgcccagctggtctcaaactcctggcctcaaggaatcctcctgtcttggcctcctctcctgccttgaaattactctggggttccaagagtaagccacttcgcccagcatgttttggattctttagaaatagcatctgtaatcaattaaagttagtctacttaaggactatagttttcatttgcaatttatcttgcaaaaatatactgaccaatctgttaattaaaagtatatgtggttggggagagtggcacatgcctataatctcagctcctcaggaaactgaggccagaggatcacttgaggccaagagttcgatgctgtagtgatgcaccgtgaatgcatctgtgaatagccactgcactccagcttgggccacatagcaagaccctttcactaaaatatatttttttttaaagaggcttgattaagagacaatataaattttctcttgaaaactgtctgaaataactgatcataagtacaaagaatcagagacctccttagaagagaggaggtaaaactctcagtcaattgtctcaaataggttttgaaaggtttccccagaagtttcctatttagaaagagcatgcctgcccactagtgggcgaattaaggaattgctcccttttccgagaggcattcataaggctccatcttgtggtgaaaactgttaataagctttactgctaacacataatccattcctaagtaagacctaggcctggaagagctcattcaaaactccagggtctgcagaagccagagacgtcaaggtgtacgggcgaacatggcagccgtatgacaaaacaaaccaactgtcaggaaaataatcactgtgtttatttttctaaactaagactgcaaccataccagataatgtgtatgtgtatgaatatatatgtgatattgaagattgtatcttaaattcagaattgaaaaaaagataaaatataaatatttcatttctagtattttattttacaatttgctcactttttcttcagtaccaatatgtccttgttaaacctgtgttaagttgtataatgaaaacagaattcagccttgactgggacccattaactagaagtgataattagtcctaattagtttaatactgggagagagctgttcaaaaacgtagatattttaaaatatgagtctttgcacaactgtgaagatatttgtagaagcctggcattccagtgtcactgtacaaaatgtccaatcctatatcacaccatgagtcatttttcacactataagtaggaattgacaaggtgcattgaacaatgggaggttatcttcacaaagtctgaaatcaataagccattttgaggaatcagttttcagtgtatcacaatttttatcacaggtttcaggccatcagttgtatttctagaaactaattccaaccacagaaaagaggacttagtaacgatgccagatatgccttcctaaaacatttttttttctttttttaacacccttggcagcagactctattctacattttataactgctttgtggatgcctttgcggggaaatattcaaagtgtttgtctaccccaaaggtcaattatatgataacaatcttcgctgcttaacataagcaaagcttttttccctccaatgatgtgaataagttcatttctcttaactgttcaacaatgctgctttgctttcagccatgactaagccacccaccctctgtgtcatgagcagactgccatgctacgtgtccaattcatcacacagtgcatccaacactctgtgcctgaagccctacaaggagatccagctcacagtatgaacgctgtgttcgggacatcttcaatttttagcttctcgcagaaagcaattcctgctaaataatgcaagcaagtagatgtaaagcctgtgtctttatataacttgccacctagagtttaagttttattgcaagtctgatataaacactgctcatcccaggaatatcatcctataggcacacaagtcttctgcattaaattgtttgaaagtttcctctatacacacaaaaaaattattttcttaatcatttcctaaggttgtgtctgtcatgagcacactgtccaaaatatttttcagtcatataaaaattcttaacccccatggtggttaatagagctcattactacatctaaatattactaaatatgtatcttcaccaactgcaatagcaaatgccaccatttaaaaattttttcacatgatttttcttttcatttcttagtcacatttccattgcattgagcaacagtatttctagttacatttacatttgcacgtgcttgtatcttttcaggacacacaatttccgctacattcagtagattctcttttacaacttgctatctgtgaagaatttgatgtcccaggcagattttttatttatgacttcttatttcttaaacaaccaagacaaaccttgttgacattacaattctctcttcagctccttaggttttgatcacatgtctcttccatggccctcttctttcttcttccagtggtttgtttcataatggcacctacactgttttcttaaattacatcttttgccaaatatgcacacaggagggttctatgaggaacacaggaggaacatatgaccccctcagtctatcttccttttcctacttttaataaagatatgactacaagaaatatgctacttttctaatactattgggtagatgtgacttcacaccaccaaaaacccagttctgcaaaatgttataattattttcctaattcaatctctgaatttggtctcctaccacctgataaacgatatgtcctcttagtcttcttcaggaagtcattcggtcacttctacaaagatattgagggccacttttcctgttgccccaagtaaccctggagctcatactaaaaaccataagggtaagtccccccaaagggcagtgattctcaaccctgtcctgcttcatataagaatcacagtggggagttttgaaaatgccaatgcttagctgttctccagaacaattattcataatcttcgagggtgggacatatgtataggtgctttgcaaaagcccttccagtcataagggtaattctagaatgtggacagggttgagaaaaacagatctaaagaaagcagccaacaattgaggccaaatatctacctgcaaagcttaataagaggcagcagtacctgcaaatggccaggatcccagcagcagccctccacctgagtctgcacatatagaaagattagggaggaagaaggggggcctatgggagttatgggcagcagagtgaagagttgctgcagagcctcctcaagactcacatgagatcctcacaagacagccaacatatggatatctggcacccggaagtcatggagggccagatggtgttggccaggggagcagcagcagcacaaaagagtgcatttacaacagcagccagggaaataaagagactcttctgcctgtcctctctctcatacactagccaaaaactgaagagggagagacgggtgtctcagggtccaccttgtctcctcccagtcctagcagatggggtgtcagctgaaactgtgcttggggaaaggcagaagataatacttaaaccaaatatgaaattaaactggactgagtattaataaccaaaagaagacgaacatttggaacctgcccaagacattacaattggatgggaagcacagaatggggcactgaaactggagggggagaaacatgttgtgtttatcccttctcctttctccttcttgtcttccatgaaggacacctatgctccttgggagtcactcaaagatttggcatgaaggtgggatgtagagtctatactgtggtcattcctgtccttacgttgatgtcaattcacgtgtccacactttgatctcatgcttgtaaagtctccttgatatggccactagaccccatggaatccgataactcccttagcagatttccaaactccttctgtgaacacaaggaaggttgaacagctctcccaagtgtggacaggctgcaggggactcaggggccctcttgcagcctgtctgcctttgacacccccatgcagccatgagcagtgggccaagatgtgggaccccttcaaaagagatccttaccttctctagctctttcctgcctcctcttctttcattcctctccaactgggaaagcattttctagtctacatggtagtgatggagagagatgtgaaagaaaaatgtttccctggaaacattggaagaataggtgtattcttccaatctgttctatcctatgcctggaccaaagcttttaaacttcgtagccaagaatttgaaacttttgttccttgaagacccccatgagaacttctctaaagcaggccgggtgcagtagctcacgcctgtaatcccagcactacgggagggcaagacaggtggatcacatgaggccaggagttcaaggccagcctgaccaacacggtgaaaccccgtctctactaaaaatacaaaaataagccaggcatggtggcacacacctgtaatcccagctacttgggaggctgagacatgagaatcgcttgaacctgggagggggaagtttcagtgagctgagatcgtgccactgcactgcagcctgggtgacagagcaagaccctgtctccaaaaataaaaataaaaaaagaacttctctaaagtagagatgatgcctccattctagctctccaaatgataaaatatggaataaaaatgaattggccccacatagctataaatgtggcactgtgagtgccttggagttgtcagcccagactgccagcttgcattgagcctcagcaatagtcccacaccccaatggctgatcccctccctgctcctcttgcctgagcctctggggctgcaggcagaccctgcccaagatctccttctgttcccacctcttaaaatcagagaaaaacatgaatgaagaccaatagaaaacagtaccagaacaatggaagtcaacgattgtgtgccagaaatttggggagatatcatttattacaaacttgcatatgttgggacaaaataaaccaaaaagtgagtttgatgctttggaatacgtgaaagctgctgacaaatactactgtcctcaattaagagaactaaccaaagttaatgagtctcttacaggagatgcagaacctgccaacaaatctcgtttccagttctgactattatgaataaagctgctgtgagcatttttgtacaaatctccgtgttgacataagttttaatttccctaaataatgctttcttaattttgaaatatattgctttgcctggtgcttatttctatacaaataataaatctctacttccttatttaattaatttatttatttttgagacacggtctggctctgtcacccaggctggagtgcagtagctccatctcagctcactgagacctccgcctcccaggctcaaggatcctcccacctcagcctctcgagtagttgagaccacaggtgcatgccaccatgcccagataattttttgtatttttggtagagaaggggtttcactatgttgcccagcctgacctcaaacccctgagctcaagcaatcctcctcctcagcctcccaaagtgctaggattgcgggcatgagccactgcgcccagccaacttccttattttaaataaaattaatttggggtggggaaacccatttttatcattcatcaatttatattattaaaaaatataatggaccaaggcccaaaatataatggaccaaggtgtgaaggatggtagctcacacctatagtcccagtattttcggaggctgagatgggaggattgcttgagcccaagaattcaagatcagcctagccaacatggcgaaactctgtctctacaaaaaatacaaaacttagccaggtgtgttggcatgcatctgtagtcccagctactcaggtggctgaagtgtggggatcacctgagctatggaggtcaaggctgcagtgagccatgattacaccactgcactccagcctgggtgatagagtgagacccagtctcaaaaagaaaaataatcaaataaaaataacagggtaagcacactggaaaatgataactggcactcagcttctgtgtcaagaagacactaggaattagtattgtcaacaaactgaaaagtatataccttgtttaaaatgggcagccattactcagcttcagccagttcactatgaagacccaatactgccaaatcttctaatttttcaagagaagatagattttttgtgcatgcatataagtaatctcctaagtttaaatgtttgccaatagaacccctcaaaaagaaaagttacacactggtggattaatgctgtacagcattaaccaatgcaaggtaaaatgactacaggccaaatctgacccaaggctcattggtttccagctaagattttggatctcaatcctgactatgagcaacaagacctttcggcttttttaaaagatagcatgcctgagccctagtccagttctgatttcctagatttggacgagtcctgggcatctacatattcttgtaaagtgccagagttcattctggttcacagccagggttaaaaagtaggaaattaaatttcaagtcatagtaccttatcacatttccaaacttcaacaccatgtccagaacactgaattctccccaggctcattctacctgattctgagctcaaatagtcatgtgggatctcagtaagctgaaattgatgacacatacacaaacaataaaaactgggactatggagacttccttctctccaactcgaatagcatccaattttggcttttctatatactattcgaggacattataatagcaggcctttttggaagaaactcaattctaagtaaaagatgttcatatatgagcttatgggaatttcttattcacaaacatggtaactatcaaaataaaactctctcccaaaataagagagacaagaaaagaagtggggaaaacagattttaaaagctgtatgagcttttacaaataatttagcaggtaacagagatcttgtgagacaagtaaaaaggccttgtattcattgcttatcaggtaaatgtggacttaaagtaaataaggtaagaaggtgttgagctagaaacatgtctcaaattatttccagtgagcttctgaaagcccaagacaaatgtatctttatgaaaaattgagacagacccagtaaccagatcctctcattatttgcatgtgaagcctctaacttgtagtcatgtgataaacaaatggagaaaaattggaaataaccattaatgagggcggcagaaattataacattgagcaagggtcagaagattgcagagcagttacccattcttggcgcagaaacctgaaagtcaggatcaaagagaatggcaacggtgaacacagatgccacagataaagacatatccaagttcaaggtcaccttcactttggtggtctccggaatagagtgcatcactggcatccttgggagtggcttcatcacggccatctatggggctgagtgggccaggggcaaaacactccccactggtgaccgcattatgttgatgctgagcttttccaggctcttgctacagatttggatgatgctggagaacattttcagtctgctattccgaattgtttataaccaaaactcagtgtatatcctcttcaaagtcatcactgtctttctgaaccattccaatctctggtttgctgcctggctcaaagtcttctattgtcttagaattgcaaacttcaatcatcctttgttcttcctgatgaagaggaaaatcatagtgctgatgccttggcttctcaggctgtcagtgttggtttccttaagcttcagctttcctctctcgagagatgtcttcaatgtgtatgtgaatagctccattcctatcccctcctccaactccacggagaagaagtacttctctgagaccaatatggtcaacctggtatttttctataacatggggatcttcgttcctctgatcatgttcatcctggcagccaccctgctgatcctctctctcaagagacacaccctacacatgggaagcaatgccacagggtccagggaccccagcatgaaggctcacataggggccatcaaagccaccagctactttctcatcctctacattttcaatgcaattgctctatttctttccacgtccaacatctttgacacttacagttcctggaatattttgtgcaagatcatcatggctgcctaccctgccggccactcagtacaactgatcttgggcaaccctgggctgagaagagcctggaagcggtttcagcaccaagttcctctttacctaaaagggcagactctgtgactggaactcacggagttctgcgggacctggtccaaccacttctgcctttgcctcaggtagaactctctcctcacccgtctcttctctcccaaacctgctctgacacttctcagataacgtgatccttttataaatatgaagctgaatttttaacttgagattctaaacagaagtaactaagaaacctgaagatggactttgaaagctccttgaactatgttcattcatatcctgccctgagatctctccactttcttctcctcctgagccttaaggagagggtggccagacatatcggtttgccagggacaatctctgtttattgtctgttgtcaattgagcatcctttaattctcaagaatatcatggtctggatgaagaattacatgatcatcctacttaagacacccaactaacacacagttagggctggtgaagcagagcacagcactcagtccacggggtagaagggaaaccagagtggctacagaaaaagaagattcaggaaagaaaggctgctggaaattatcaagtgctgcagagttccgaggaaagtaaagggtgaagaaaaaggctctggatttgactaaaaggatgccatgtgtgccattagtggagtgatagggtgacatcctgatcccaggagttccagaagataatgccaaaagggaggggatgggtaaaaaccaatagtctagagaggatgtttgcagataaagatgagttatagaacggcagatggatatgtgaagggtcagttcaatgctttatttctccaaatgggaggggacaaagtgagcagagaggaaagaaagaatgcagggaaaagagtgaagtgggcaggaagcagaaagagaaaaggaagaggccagagtaagtaagcgtctgttttgctcagctcctgactctgtggcaatgctagcggcacctgtgcctctggttttaccagttctgggttaccttgaagtaaatagtggggcaagagcgggttacttggggcaggctgctggagaagaggaaaaacattattctccattgtcattgttcaggatggttccagcagcattgtctcaaagagctgttcacaaaacattggacaccctctccccagatatcttagagcttgaacgttaggaatctgaagttgtcttttattaggtaagttttaaatcatgattattgaggaaaatgaaaaaagaatgctgtggatcataccaagcttaggtagcccccaaatgaaaatatgaggtcagtagcaaagtctagttctgagctccagcgctctcaagcacacatttcagagagagttccttacatccataaactgcaaaaaccacacacacacacggcatacacacagacacatggcatacacacacacacacacacacacacacacacagattcctttatagctcagacagcttgggacttatttacctgaaaagtaaaatattaataaaacacacatttttgatagttttcttaagctatagttatttatatgactatttcaggcggtatttgttatagtaagacaaattagatattgaagttttattccagtccctagaatagagaaatatacattttcttccaagttatatatattgataaaagggtcatgtacccactaagggttctctgatgcattacagagttagagagaaaattgatttaaagttgccattatattaacatgaaccatgtcaagaccacaaagtggataactccatacttactatgaagaaatatcatctcattgctagcaagagcctaaggcagcacatagctaacaaaagctccaaggatgataacatccttatcgatgcacatgttggcctgccttcaacgagataaaattctctccaattctctttcttctgtatgtaaaacccaagtaagcactcagaaagacccagaatacctagtcttcaagttgtctggctttagacagcaatcagaagtcctaaatgaagacaataatcgactctgctggacaaaagtctgtaaccaaatgcaaagcccggcttgctgtggtctcaatattattacaggttttcaccttgcaaactctacatcatctccctcgccccacagccctgcgggatgttgaaagtgatagagtgaaggattcctttacccacaaagtcactctgaatattcatctagcatgtggagcaggtaaggggactttggttagcaatggattccagtctggcaggcccagcccagaggcagggtatctggcttctttcctcatacctggtcgagtccttgcaaataaaggctagactggcagccatggccagtctaagggctatgactttatgggcaccagattgtcccacaatccagtatcatcttccccttccaactacttcggtgtctgctaaaattccactgtggttctggcttttctttgcttttattctacaggaaatctgttattctctcaggcattctttacttggggcagcagggaagaaacatctatgtaataaaaagaaaagaaactataagtccaaccagtctaaaatgtcttgtgctgggggaggggagcagaaaccaagggctaactaattatgtcttgttggagacagggcaacttgtgcattaggaaagatcatggaaggaaagaaaaaaaagacaccgagagaggaagccttcccatctgtcttacgttttctccctctcctctggagacaaggaatatatatatagttttcttttttttttttttttgagacggagtctcgctctgtcgcccaggctggagtgcagtggtgccatcttggctcactgcaacctccgactccctggtttaagcgattctcctgcctcagcctcctgagtagctgggattacaggcatgtgccaccacacccagctaatttttttatttttagtagagatggggtttcaccatgttggccaagatggtcttgatctcctgaccttgtgatctgcccgcctcagcctcccaaagtgctgggattacaggcataagccaccgcacccagccaagaaaaatctttagaagagaggtaagaggaggaaatttcttatgtactcagaaagatttgtttgggggagaaagaggaggacagaacggctaaaaagccagtctgtaatgtttgaaggctgggggaactctctgtacccttttctaaatgggggaagcgttgcctaaaataggagaggcaaaactttcagggaaatgctcaaatcaagtgtatgctgggaagaggtaacatgttacactgctacaagtttctgttgacaggaggaagatggaagcattttggagcctgtgacatggcccaggaagggcaggcctgggcggaaaatgggagcagacagcagaaaatgggtggtgtgaagggctggggcagtgggaacctaaaggggaagatgtggaggtgttgagtgctgagttaatcttggccactctcagttgggagaagctcttaactgacaattctgcctaggcctgtggggattaccctgtaagcagcaaaacaaagttttccaagagctttgaagaggagcatttctgggttggactcttccctcccagtgtggtattgcaaaggtgctctgtgtctgtggcgctagcccatcaaacaacgtcagtaggaagaatacagatttgtaaaaaattttcctggtttgtctctcatttggtttttcttattttttttagcaaagtgtcttatgaatgttctaccctctttcagttgcatcaagaagaaaataagagaaaagtggttttgaagatagcccaagaaagaaaagtaccagccaccccctaggtttagtatggcagcagtagcaggaggggatccaaggcagggtggagcattaacagaaaaacctgcatcccctcaacttccacacccccgcccgtgcagttcccagagtcgtgagactgggtttgggtcctggctctgccacttactggtgtgcaaatgggcatgttattgcatctctctgaacctcagtgtccacatctgtaaaatgggaacaataatgggaaataccagcctcctagggttatctcatcctaagagaagaatggggtaaagtgtttagcacacagcatctgacccagagtaagccatcaatagatgttagctgttagtattccaaagggaagtggagtgacactgagaggcatctagaatgaggatatttaaagcaggccagatatgaaaaggacagaccagactgggccagatgcacacagaaggcttagcctttatagtcccacaggcttggtggcagaacatggccatggatccagtagttcagtcatccaagtggcaggtgaaaagtgtagggtggccttaagaattggattcctgttcacttcctgacaatgtcagaaatgaaagacatctagtattccacagtttagctgcccgacagttatctgagtgtagatttgaacctaacaggcactaggttaggggtcagcaaactttttctgtaaaggaccagagagtaaatattttaggatttgtgggccacatgcagtcccttccagaagaattcaactcttctgttgcagcacaaaagccaccatggtgattcaaaaaataaataaatggacatgggtgtgctccagcaaaattttgtttatggacactgacatttgaatatcatataattttcacgtgtcatgaaatattattcttcttttaatgttttcaaccattaaaaatgcatttttaataaatgcctcttgcatttttaaatggttaaaaaattaatatttcatgatgtgacattttgttggagcacagccatgtccattctttcccagctgtgcactcttggagggtgaaatttttgcttagttgatctcgtgggccatacaaaacaaaaagaatcagtgggtcagatttgcccccaggctgcagttgcagacccttcactcaggcatgttctcctacccctgaaggcacagcattccccaggacccagtcacacttcattgcaaaaccagggatacttattgtggcaacttttgccatgttattttttctttctttttttttttttattataccttaagttctggaatacatgtgcagaatgtgcaggtttgttacatgggtatacatgtgccatggtggtttgctgcacccatcaacacatcgtctacattaggtatttctccttatgctatccctccaccagccccccaccccgcaacaggccccagtgtgtgatgttctcctccctgtgtccatgtgttctcactgttcaacttccacttatgagtgagaacatgcggtgtttggttttccgttcctgtgttagtttgctgagaatgatggtttccagcttcatccatgtccctgcaaaggacatgaactcatccttttttatgaatttttgccatgttttgaacgtggcaacttccccaatatttttgccactttcaatttctccagcttttctctgtccctgtgcaatctttaaaatagagtccactagctctttgtaaaaaaataaaataaaaaaataaacagaaagctaatgttctagtcccctgtctcccacctgctaaggatagacacggagcccaaattttgtttctccttaaggctttgaaagctattgccctgaagctactcacttgataacaatgagtttgaaatagtcatgcctctacaaaccatctctgttgaggttgaacactaggctttctgagtgctttctccttgtgaatttgatccagcagggcaatgtttgtatttttgtgttcttttagatgactaagcaacaggctggtttattgaataatgatgggaaatgtggtgtatagaaagaatctacattcggtgtcaaagatctagacttcagtctccattctgtgtgatcttgggaaagtcactaaacctttctgagcctcagtctccccatctggaaagcagaaataatcataacatccgctacacatggttgctatgagactcaaataaaatatgtctataataaattgtaaaccacgatatgaagataagtgcattcattcattcaacaaaaatgtatttcttaatgcatttttagtaaataaagatcaactcaacaaaaattttaccctccaagagtacacaggctagaaaagaatactggattaaattataatgtgaaaaattcctgagtagtcatctatgtactgtggagtcaggaatgtaccctaaacctcaaatgtgcacaattaaaacgcctatcctctaaaaacaattttttaatcctgatcttctttccctagttccttcaccgtggggagcagataactcaggacaaaatccttttctctcggtcttactgagccatttaggagaaatcagggctgagagaaaaagaaattttccactgagcttcctcagagattcccatcagagcctgaggatggaaaacagagaagggtcccattacatctagccctcccgagggaaagctgctgtttgcatttcctgcctacagctctcgggactgcaaataaatcagtggtttattcaaaccagtagctggagagtagattatggctggcggccctgagtgcagctgagaccatgagtgatggaaatgcttggcagggagggagtggcaatgtgacctgcggaaaacaccaagaccccataggcccgttcttccctcatctcactgctcagtggaatagcacctgacactcacactctactcataagagttaactaagatttgttaagatttatgtgagatttatcttaacataataaaaattaaatatctccaaatactacaagaaatggtcttaacctctttgttatctaatcaaattgttaagtgattcaaacacctttgcctaatattttatctttcatgagttatttcactaagttttgtgtctatattctaatttacgtttttggcactgatggcattaattgtacccaatggcagaatttttttttgaaggctaaataactaaaaaacatgcctagtaagtcctgatctgaataagttaataatattttaaaaagtcaaacctgtggcctgagtctccattgcctctgatccccttaagggtggggcactgttggccactctctctgttttaaagatcttcacccttgacttccatatctattcagctgcctgagttttcttctatttccttatccaccaagtacccttcaaacatacaactactcacaatttgtaccctttatctattgccaccactaaggtgaccaaccactcagattttataaactgaaagttccacaacccagaaaacctctctgtcctggataacctgggacagttggtcaccctaagctccacccaaatgactgaggctaaattcaggtaacaagtattacctttcaactcagctatgatattcacaccaattccataactttgtgaacaagaaacctatacacattcacttgaaccgcacatacacacacacacactcttatactctttcacacacacctcatgcacacactcacatatactcccattcacacacaccacatacattctcacacaccacatacattcacacacacaccccacacactcacattcacacacaccaacacacacattcacacacaccaacacactcacattcacacacacaccaacacacacattcacacacatcacacactcacattcacacacaccaacacacacattcacacacaccacactcacattcacacacaacacacacattcacacccaccaacacacacattcattcacacacaccaacacacactcacattcacacacaccaacacacacattcacatacacacaccaacacacactcacattcacacacacaccaacacacattcacatacacacaccaacacactcacattcacacacaccatacacacgcaccaacacacattcacacacaccaccacacacattcacacacacaccaacatacactcacattcacacacaccaacacacacattcatacacaccacactcacattcacacacaccaccccacactcacattcacacaaacaccaccacacaccatctcacacgcacaccaccacacacattcacacacaccacacattgacaaacacaacacatattcacacacacaccaccacacacattcacattcacacacacacaccaacacacactcacattcacacacaccacacacattcacacaccacacattcacacaccacacattcacacacaccaacacactcacacacacaccacacacattcacacacacacacacaccaccacacacattcacacacacaccccacctgcttaaaatcctccaaaggcttctcattatgcaaaaaccttctgactggcctgcaaagcccttcacactgcatctcaggactaccttttctggcagctcttgatgcttcattctattcacttcactacgtacaatcactgaaagggcctgatggttaggttctacttacaattttaattttggaaaatttaaaacatatacaaaagcaggtaatggtacatcccctatgtaaccactactcaaccattaacatagtgccagtacacactgttgaaggcttttgatgaggtttattatataattcaaatatttctagtacctttagcctaaaagattttgtgggttcttttcattccagttaaatttttagtacctattaaaattaattgggtttcaagattcatctttgaaatccacactatctgaaatataccaaaatatacatcattcttctggtatgtgtttcctctaattcaacttttttcccttctatttttaattgacatgtaataatagaacatatctaagagtggtatttctatacatgtatacaatgtgtaattatcaaattagggtaattagcatatccatcaactcaaaagtgtatcatttctttatgttggaaacattaaaaggctctcttctagctttcgaaaatatgcagttactgttaactatattcacccaatgctataaagcactagaacttattcctatctagctgtgattcatctgttagccaacctctcctaatcctctcccctaacccttcctagcctctaataaacacaattctactctacttttattaactcaacatttttagctcctacatatgagtgaaaatatgcagtatttcttttcattcctgacttatttcacttaacataatgatctccaagctcattcgtattgctccaaatgacaggatttcattcttttttgtggattcatagtattccattgtgtatatataccaaattttgtttatccacttacctgtcgatgaacatttaggttgattccatatcttgactattgtgaatagtgccgcaataaacaatgaggatgcagatatgtcttcaatatattacttttccttggataaatactcagtagtgggattgctgcatcatataatagctttatttttggctttttgagaaacctccatactgttttccataatggctgtactaattcaaattcccacagtgtattagagctcctgcttctccatgttctcacaagcatttattactttttgtctttttgaaaatagcttgttctaattgggatgagatgatatctcattgtggttttaattggcactaccctgatgattagtgatgttgagcatttcttcatatacttgctggtcatttgtatgtcttttctgagaactgtctattcagattctttgcccactttttgatgagattgttaaggtcttttgctattgagttgtttgggttccttgtagactctggatattagtacactaccaaatgtatagcttgcagatatcttctctcattctataggttgtctgctctcttgattgcttcctttatcatgtagaagctttttagtttagtatggtcctatttgtctatttttggttttgttgtctgtattttagagccgcaggcataaaatttttgcctagaccaatgtcctggagtgtttcccctatgtttttctctagtagttttataattccaggtcttacatttaagtctttaatccatttggagttgatttttgtatatggagagagataggggtctaatttcattccttttcatatgaatgtccagttttcccagcatcatttatcaaacagggtgttatttccccagtgtttgtgcttgacacctttgccaaaaatcagttgactctaaatatttaacacatggatttgtttctgggttctttattctgttccattggtctctgtgttcgtttttataccaataccatgctgatttgattattataactttgtagaataatttaaagtcagatagtgtgatgctttcagttatgttctttttgctcaggattgctttggttattcagggtcttttgtggttccatacaaattttagcattcctttttctatttctgtgaggattgtcattggtattttagtagggattaaaatgaacctgtagatcactttgggtaggatggtcattttaacaatattaattcttctaatccatgagcatggaatatctttctattggtttgtggcccttttcaatttctttcattagtgttttgtggttcttattgtatagatatttcacctccttggaaaaatttattcctatgtactttttttgtagttattgtaaatgagaatgttttccacatttcttttttaatgagctggtgattggcgtatagaaacactactgatttttatatgttgattttgtgtcctgaaactttactgaatttgtttatcagtatttcttctaacagtttttttggtgaagtctttagggttttctgtgtataagatcatgtcatctttaaaaaaagaaaaaaaaagggaggggacaattttacatcctcttttccagtttggacaccttccatatttctttctcttgcccaattctagtactatgttgaagaagagtggtgagagtgggcatccttctcttgttctggttctttgaggaaaagttttcagcatttcctcattcagtaggatgttagctttgggtttgtcatatatggcctttattgtgttgaggtatgttccttctatatataattcaggtatgttccttcaattcctaagctctcaagtccctatgttgagagttttcattatgaatggaggtttaattttatcaaatgctttttctgcatctgttgagatgatcatattgcatttgtctctcattcttttgatgtgatgtatcacatttattaacttgcctctgttgacacattcttgcatccctgggaaagcccacttcatcatggtatactatctttttgatgtgctgttggattcagttccctaatattttgttgagaacttttgcatctatgttcatcaaggatattgcctgttgttttctccttttttgttgtgcctttgtccggctttggtatcgggataatgctggcctattagaatgagttaggaaaaattccctcttcttcaatttttcaaaatagattgagaaaagttgatgtcagttcttctttaaaattttaggaaaattcaccagtaaagccattctgccctgggcttttctttgttgggggactttttattacacaatatgtgactgtattagtccattttcatactgctatgaagaaatacccaagactcgataatttataaagaaaaagaggtttgagccgggcatggtggctcacgcctgtaattccagcactttgggaggctgaggcaggaggatcacctgaggtcaggagttcaagaccagcctggccaacgtggtgaaatcccatctcttctaaaaatacaaaaattagccaggggtggtggcgggtgcctgtaatcccagctactcaagaggctgaggcaggagaatcgcttgaacccaggaggcagaggttgcagggagctcaggtcacacccagcctgagtgacaaagcaagactccatctcaaaaaaaaagaggtttgattaagtcttcttacatattatcaaacaatacatgactgcattagtccattttcatattgctatgaagaaatacctgagactgggtaatttataaagaaaaagaggtttgattaaatctcattactcattattagtctgtccaggtgttctatttcttcctggttcaatctttgtaggttatatgtgtcctggaatttatctattttcttatttcctctaggtttctcagtctgttgatgtattgttgtttataataatttctaatgatcttttttcatttctgtggtatcagttgtaatgtctccttttttgtttctgattttatttcttccctcttttttcttagtccagctagtgattcgttgactttatcttttcaaaaagacaagcttcattttgttaatcttttgtatttttgtctctattttatttagttttattctgacctgtattatttctttccttctactaattttaagtttgggtcattcttgcttctctacttccatgagatacattttgaggttgtttattcaaactctttctacttttttgatgttggcatttactgctataaagttctctcttagtaatatttttgctgtatcccataggttttggtatgttttgtttctattctcattgtttcaaaaaaaatttacttccttcttattgcttcatagatccacgtttgtttgagtggacattgcttactttccatgtatttatacagtttctgaagttcctcttgttgttttagagttttgtttcattgtagccttagaagatactcaatactattttgatttgttaaaatttcttgagatttgttttgtggcataacatacagtatatcccagagaatgtttcatgtgctgatgaaaattattttctgctgctgttggatgaaacattctgtcaatgtctattaggtctatttggtctacagaacagtttaagtccaatgtttcttgttgattttgtctagagaatctgtccaaagctgaaagtggtctgctgaagttcttacctattattgtattgatacctatctctctttctttagctctaacaacatttgctttatatatctgggtgctccagtgtgcagtgcatatatatttacaattgtatgtcctcttgctgaattggttcctttatcattttataatgactttctttgtctcttttatgtttttgactttggtgattttctgtactgataatgtctgattcctttctttctctcattcatgtatctgatctaccagtgagttttatacttttgtgtattttcaagatggtagttattgtcctttcactcccagatgtaggactcctttaaggcaagtctagtggtgataaattctcttggtttttgcttgtcagagaaagactttacttctccttcattagtgaaggatagctttgctgggcatagtatttctgggtagccatttggttttttgttttgttttgttttctttcagcactttgaatatgtcatcccattctctcctggcctgtaaagcttctgctgaaaaaatctgctgttagtctgatggcgattcccttatatgtgacttgacacttttctcttgctgtttttagaattctctctttgtctctgccttttgacagtttaaccaaaatgtgccttggagaggacctttttgggttgaatctatttgggaatgtttgaccttcctttatctggatgtctgtatctctcacatgacttaggaagttttcaactattcttttattaaatacattttctgtgccttttcccatgtcttctgaaactctcaaaatgcaaatatttgttcacttaatggtgtcccatatgtcacgtaggttttcttcattccttttattctttttttgtactttatatctttttgtctgaccgggctatttcaaaatatttgtcttcaagttcagaaattcttctgcttgatctagtctattgctgaagctctcaacagtacttttattttattcattgaattcttcagttttgaaatttctatttggcttttttattatagctattccttttcaaatttctcattcaggtcattaattgtttccttatttctttgtattccctatttgtgttctcttgtatcttgctgagtttcctaaagatcattattttgaattcgtttttggacatttcatagatttccttttctgtggggtctgttattggagaattattgtgttcctttggaggcatcatgtttctttgctttttcatgtttcttgtgtccttatgttgatatctgtgcatctggcacaacagtcacttcttctaatttaattaaatagctttaataaggaaatattttttcctgtggatttatctgtagtctcagttgggtagattgctttggctttatttctgagtgagtgcaatagtgcagtttccatatgatttatttggctgtagtcaacatcactggtgtctaccagttcctcatttacttagactgtagttgtttgtggaggctgtggaaaaattttgctggaaatgaggacattgggcaggccagtctttggttccctggtaggcacatgcaggtatgtggcagccccactacttgaaggggcaggttttctggcagtggtagtggtgggcactgggtgggttgatcctcaggctcttgggcaccatgcataggcactagtggtagcagcagtgggtccaggcattctgattttggggcccctgagtggtgcatgtgggtacacagcacctctactgctggaggggttggggaccaccagtgacagtggcagccccaggtaggtaggcctcagtttctagagagcatatgctttggctccctgtgttttgagacggccttcctggtgtgctagactgcttgatatgcctgttcctaagagtgtaaggtgctgcatgggctggggtggcagggatgcagttgcactgctgggtccaggtggtgttgtgacattgcagccttctgagtgtatgttgggggatattggtggagcccaagggctatggagacgcaagacctattgggtcccaggccaggatgcagtctgacggtaactctgcttccaagatggtgctgtactgtggtagtttgggtctcatgcataaaacccagtgtaaatgccctctctggatgcagtctactggtaactctgcttccaaaatggtgctctgctgtggcagtttcagtctcatgggtaaaacccagtgtaaatgccctctctggaacaatgtagatagatggaccccaggaagctccctacactaggcctggctctcctgtagtcaaaactgcaagtgtctgtgatgagaatataaactactatgcatctcttgcttagcttttcctcaaaatggtgagtccttcttggctctaagccaatcgcagccagctgcttcacttgcctctctatgctgccatgttgagtttctatgcttgagagagtctttgtcacttccttgctgaatttcagtgttctcacttagatgctctattcaacatgtgattatcatctatttattgttttggtccttctttgtggaagaggcaagtgccaggacttctgagcaaccatttgatgacatctctttgcattggctttattaccaagaagaaagaaactaatgttattttaaatatatatatgttttcctgaaatgtacattccaggaatgttctgactcagaggacaacagcagctgctgggtgtttgctgattcctgtgcttatctactctgatttgctttgatgatgtcttaatcatgtatcatttggatgcaagaaataaaaatcaactcaaagaagcaaaagtaaaagagagaattattaaaatgatttaagggctctcatggaaccccattcaggcatttgcaagaaatatgactgagcatcatgaaaactaaaaaaccatgagggagtctccctctctcttctcctctttcatttctcttctctccttccttctctcttctttccatcaattttctcactaaatagctctgacctctgcatctctctgtacatctgttctggactcctctcttcaaaccgccttccactggagggacgctcattagtctatggccccttataattccagtttgccatagccccaacactgaacaatcttgcagctccagtatacaatactacgtttcctgtgtctttaaattctcagagtataatatagcactgcttgagttagggattcatccataaattatatccaggagaccacattataatttgttgcacctattccttcaggaggggctatagaggcatgtccaaaaaaaaagtggggtgggggtgaagaggaccacaagctggaattcctaacatgtcttttttaccacagattatgtgaagaaaaaaacctcagatgtgttcttcttacacatcgtaacataatgtaggttgttagtgaccatacttacatattgtaatatctcttcaagctgttgtttaatgaatgtagtccacaagaataaaggtctcctcccaactgagagagagagagagaatatgtgtgtgtgtgtgtgtgtgtgtgtgtgtgtgtatcactccaagcatttagataaggggaagaagtgaagttgtagcaattttgtgtcatttcccctaaatttcatggccattctcagtgtctgatttgatcccctgcaaattggcatagatgtatttgttctctgaattttagagatcaaatacagaataaataaaacaggacctacttaaaatttcttgaaataggcaatgcaattttgcccatctcaagaaattttaagtaggtcctgttttatttagcttcagttcctctaaaaaaatagttctgcttgttttttctgactcatctgtttctttgccatttttaatatgcactttgcaactgagcctctgtaaccattttgttttctttcctcataaagcagttgagcaactgcatactctttggtaagtctctcttcattttgggaagttctacattagtcataaaatacctatttctgatctagtacaaaatatcagaagaaaagtcttaaggtctctttattttattttttacaaaaaccaggttttcagtactttccaaatctcttttccagctttccaaaaaaaaaaaaaaaaaaaagcttatgagtatgtctcttatttcttagtccttctcaccctgcaaaccagctctctctaggaggtggagcggggagaaaaacaaagcccagatgtgtagaattttctggttttcatagtgtaaatactcccaccatgacagaattgaaactaccagtgtgatgtcactgaatgtggctttggaaagaatgcacaccatccactctctctagctggtaggagacaatcctagcataccgccctctttttcttgcagtcataatagcaaatagtttgagtatattgattctcgagtcacacagtccagatttcaaaacagtattagctctatgactttggcaaactgcttaactcctctaagtttcaatttcatcatctttaaaatgggggggtaataataagctatgtttcacggtgttactgttgtaatgtgtaaaattcttagaatagtgggtagcctatagtaagtaccctaagggtgtcctattactcaggactagagctccagtggtgctatgtagacttagagccactagatggcgggctcctcatttctgcagcacaaaccttttccgctgcgctatttgcaacttaacattcaacaaactgctaattcgattatatgaattcactgacagcattttttctactgccatctcctagtttaagctacatatttgaccttgaaattccactgggaatccagctactggccctcacgtgcagccacttctaaagctctatgcaggagttattctcaatcaggacttgctaatcttagtgagttattgtaagaattaaaaccaaagccacagttgtccctgttacagaagggagtcaattccctggcctttctctccacctctgtcttttctcactcaaaagaagacaagatggcctcaaatctgacttccatcattacataatttattctccttcccagtcactaaagagatcataaattcaacaatagttcagttctataaatatttattgagcatgtgagatactatgctacgaagtaaagatataaaggtaaataaaagtcataaagaagcaaggaatttatctaccaacaaatctactagatctttccagaaataatatattaattttttgatgaaccaagcaagttactgtaaaacttagaggaataagggttcttgaataacgaatatctctatgagatctaaagacatactaagttataggtagactaatacaacaaaaaaatgagcacaaaaacagacttatttgtccaggggaacttgagatatgataaaagtgaaccacaaataagtgggtaaaggatagattatttattagatggtattagatatgaggcttactatttggagaaaagtaaagccgaataccttccttttacttcctacacaggtaaacccaagtggataagaaatctaaatgcagaaggttaaggtataaatctaatggaagaaaacatagaataactttgtgagcaaagggtaaagaatggctaattaaacaaggtcctaaaagctcaaatcataaggcaaaaattgattggacttccattcaacgaaaggcacaggtgagagacagattgacaacatctaaaatctacaagaaacccctagctggactatgcaaggataattggtgcacatacaaacacacaaacatgaatgggcagaggaaacccaaatagtcagcacatagaagaggtgctcatgcttacttgtaaccagaaatatgtaaattaaaagcaacaacagggtaccattttgcaggcattagaatagccacaaattaccaagtgttggagaggatgtgaagaaaggaaaaccctggtgctactggcaggagtgtcaaattgtacgtttgaacgtggagagcaatccttcaacacttggtgaaataaaatattcacatatcctttgactcagagaaccactcttgagtacactcccaagagaaattctagcacaggttcatgaaaggctataaataaagatgtttcttgcatcatttttgtggaggtagcaagttgaaggtgccctcattaaggagaatggaccagtaaagtgtgatgggtggccaggatagaatattatgccgcagtcagaagcagtgaactcgatgtgccaacagcgacatagagggcgtgtctagagtgaaaactatgagaagcagagctgtgtggcccaatgccatttatgtttatgaaaaacatctcacacacaaaatgacactatacgttgtaggaagtgatattcacgtccaaggacctcatcaaccggaacagcgcatgtgtctgaaagagccgtatggtttatggagcctgaccagttgggttcaaatcctggctctcccacacacttactctgtccgtttgagcaagtctcttaacttctctgtaacgtttctttgtctgaaaaaaatgggaaatagaaatagtaagactctatgggggttactgtgaggaataactgagttaatataaagtgcttaaacaatgcctggcagtaaatgttcactgttattcctattattattgtcaataataatgtgaatggggaatcaagagtgaagagaaaaattagatttttttaaaaaaaatgaaggtgggggccgggcctggtggctcatgcctgtaatcccagcactttgggaggctcaggcgggcggatcacctgaggtcaggagttcgagaccagcctggccaacatggtgaaaccctgtctctactaaaaatacaaaaattagctggacatggtggcagatgcctgtaatcccagctactcaggagagtagaaggcaggagaattgcttaaacccgggagacagaggttgcagtgagctgcgatcacgccattgtactccagcctggacgacagagtgagactccatccaaaagcaaaaaaaaaaaaaaaaaacgaaggagggacttcgtgtacaatagtgagctataaattaaagttgatgattaactcaagtctctccgaatccgaggttaaaaacacacacatgcgttttcctccctgcagaaacagagcatggtggaggatactgatgacttcaacgtaatatggtaaggtccatgataagagaaaacacagatggcatgagaatataaaagtggaacacttagcctggaagctcacaaaggaattagggagaataggagtcttggcaggcagtatggtttagggcttaagatttggaagctgggttaagatcgcagttctgccttttactagtttacatgatttttggcaagttacattcccagaataatagcacctagatagaaaatatccaggccctaagaatgtattaccagaactcaaagaccccagaggaatcttgctgtcgccttaagtatgcttgagtctttgctctaggtagttcctatctcttcaagaacaatccttcctgcatatcatcaatcatgtgtatgttaacctaaaagccccacagtgcctctccttactagtttgctccgaacatgttagacagtgggctgcctcattcttttgtaatccttggcaaagtgaagatgcagagagtgttgtgatcacatcaaatcttgagagcagtagtaggtgattgctgtggtgacctttaacatcagaaagaagcaattgccagccagaggtgaagggtcctctgagcaattggctcgggagctcctgacaggcagcccatgcattgtcactgacacgtgctttgtagcctaccagctgctgtattaaaaagaaatccaccagccacacagactaagtcagtagctagaatgttattttgaaggtagttattggtccaggaaagaggactttgtcactggagagtttaaaaatctcattttcaaaacactccctaggtttgttcatgtttctcacagaaaggacgtgaaaatgaaaatacttgagtggcctgagatttgcctagggaatcatcttagaagcaaagaaggaaaagaacatcacggaaattcccgcaggcataattccatggacagaactagacaacgtattctctagcagttttgaaaccaagatcaggtaagggaaagaaggcaagctttatttatttattatctttttttgaaactgatgacagtttaaacaaaggaagtagccatcaaagtttagtgttaaggtcacagaggttcgtggtgaatggcataagttcaattcctactgccaccattcacaggctttatgacactgtagaagtttcaccttcaataaaagggaaatgatgatgatagtatctacctaaatagccactttgaagaacagtttgtccatttcttaaaaagttaaacatagacttaccattagacctagtaattccactcctaggtatctatccaaaagaacacacatgtctatgccaagacttgaatgcaaatatttacagcagcactattcataatggacaacaacctgaaacaatccaaatgaccatcaacaatgtgttacatccatacaatggaatactattcagcaataaaatgtttaaaactataaatacatgctacagcatagatgaacttcaagaacattatgctaagtagaaaaaagtcagatgcaaaaaaaaaaactacgtattgcatgattccatttatatgaaatttccagaaaggacaaatctataaagacaaaaagaagatccgtggtttcttagggggtgggagtgggattgagtgcaggttctcaaccaggattgactacaaagtagcaagcaccaaagaaaaaaagaaaagactttgagatgatgaaaacattctaaggctgaattgtagtgatggttgcacaactgtataaatatactaaaaactattgaatggtacacttacaatgggtgatctttatggcaaatatatcaagttgctaaaaaatggtacttaccttgtagggttgttaaaaggattaaattagttaatatttataaagtacttagaagagtgactgatgtagtaagctacatgtgtgtttgccaaacaataaaaataaatgtggctgtgtgattcatcgcaagagtaaattactaacagttcctgtatgtttttctacaccaacaggaagcaattctgagtacttaggcaatgaaattacttcttttctataaaatacgtttttaagatcacactaagcttgaggttattccaggagagattgtaaatcttgtcacatgactttgccttgcctctacctgccgtagctccagcctcatctctcaccattgccctccttcaaatccttcagctaaagagaatttctctcagttcctcaagactccagacaatgggcttttccataatgttgctggctctgtatggaatatctatctgctcttcctctctgctattggctgaatgtgtgtgtccccacaaaactcataggttagaatcctaacccccaaggtgatggtattaggaagtgggggctttggaaaatgattaggtcatgagggtggagccctcataaatcgggtgggtggccttatgaaagggacccagagagttccctgtcctttctaccacatgaggacacagggaggagatggccatttgtgagccagaaagtgagccctcatcagacaccatatctgccagctccttgatcttggacttcccagcctccagacctaccagaaataaatgtctgctgtttataagctatgcagtctattgtattctataattgcaaccctgactacagtgctatccacggtctacttacttcctacctacagttcaagtcttcatttagggttacttcctctgagaagcattccctgattctttctcaacatccttaacactccttccctcaacacacacacacacacgcacacacaaaacacactttgtattgaatttgccaattgatgttttgccttttgactcccacatcagatggagtgcttataaccccaagcactcagaacagtgcatgaggcagaggagacactcaatagacaccagtgcaggtttgcaaccagggtgattttgatgccaccaggaaacacttggcaattttgtcaccttaaaagttccctcatgccaatgttcagtcaatccccactctcactgccagccttaggagaaaccactgatttgcttcctgtctattctgaaaatgttatgcaaatgaaattgtataacacatagtactttgcatccatcttctttcatttagcataatatttggtggtcacacctgggcacctagtggcatccagtgggtagaggccagaaatgttacaaaaacatttttacaataaacacaacagcccccacaaccaataattatccattccaatgtgtcaatatgctgaggttaagaaatcctgcactagtgaaatgaataaacgtgtgaattaatgaacaaatgaatcctcttttctgacatgaatttaaggattgttctcactatcctttcaaattcttttaaaaaaagaagagtctctgaaaatatttccatatcccttcccttcccacatttcaactttgtttctctaacaactgtgttttcaaagaacggctcagaatgggagaaataccaggattattgcactggggacaccgatgttctgcacaggctcccttagacataaacccaagcaggtgaggtgctgccagcagccttcagctgtcagccctgagctgaagagtcacctcagccaaggtcagggccccttcccagggcagcgcataacctgagactagctcataaggggatgtaaagtcccagccaactcaccggaactcagtacaatctcagaattccttgtagaactgacagggtcctttgctgagacagcatcacagcaccacagccaacctttccctctgcctgactctctcattttcttcccttctcttcccatcccatcacttcctctccacaggtgttgatcataaaatcaatccctgataaagctcctccactgtaatcttcaggaggctgcctcccaaatgtgacaatgtgaaacaatgactctggcttctcaagtttatattggagcacaaaaacttttaatgtacaaaaatatatatttataagataatctatcatgacagacaccagatcagtggggatggagggcagggagaaatggaggaagggattgcaaagggtcgtaagaaaatttggaaggagggtgacataaatgttcattatcttgattgtgatggcaagttaacagggatatacacatgtcaaaacttaccaaggcatatactttaaatatgtgcagtttattatgtgtcagttaaacttcaataaagctgaagaaagaaagaaggaaggaaagaaggaaggaaagaaagaaaaagaaagaaagaaagaaaaagaaagaaagaaagaaagaaagaaaaagaaagagagagaaaagaagaaggaggaaggagggagggagagggagggaggaagagggagggaggaaggaaggaaggaaggaaggaaaagacattagagtctgagaaattaggagaaattacacgatatgtaatgcagctatttttattttttcattttcttttgtttttgtccatctgaatacatattttataaggatataattacagtatatattagttgttctcagcttcaatattgtcacactgatatgtcccgatgaatcatgagatgttctacctaaacttattaatcatatttaaagtaccccagtttgctaaggtttatctcttttaatatagcatagcacacccaagattagaattataataatgtcaatttcactctcttacatttggtatgttttcctaagtgagaaagctagcacacagagtttcatataaccattgataaatccttaggaaaatgtcaagtgctgagaaccagtaatataaatactcagtactcagtggtatcttggcaaatattgtatcttaacactctgtcacagatgttgccatatggccttcataattgacattttccttaaatccaggtaaaatatacaaatggtaaaagaaaatcacataaataataacagcctccttctaattccctcccacttctgccagtataatttcctaagggcaactttcttcctttcttcattgctttttttccctccttcctcccttcatctttccctacacccattcctccctccttctttccttcgtatctgtgcttctttctgggtagataatttacttacatgggtcaaaaatttaatgagttttaaatgtcatatacaacaaaaactctccctcataccctggtactcacttacctatgtttcctcctcaaaagcaacaattttgtcagttctttgtcactccattaagcaatatcaggaagtatatacatgcatgtgtatttcacacatttacagaatatttccaacttttaagataataatatgcatcattttacatcttgcttttttcacttattaatatatggaatatcattaaatagtaatagaaaagagcttccaaattctttttaaagatgcaagatattctaaatattgatgtattgaattactcccataacaatgaacattaggtgctttccaatctgttgctattacaaaaagtgttgtaatttataacttcataggaagggaagttcatgcccccacatatttgcagagcagagcatttggctgcacccaactcttgtggtcaagcaatgacccttccctgcttcacagcccaacctgaggttcttccaggcctggggagggaggaaagcttgaaactgtgcatatctgtagagcatagcctctggctttgcccatcccaagtgggcaagcagtgacctcagagactcatccagccctaaggctaaggcccagcctgtagccctgtccagccagattccaaacagcataccactaacctatgaaaaagagcctgcaaatctgctcaatcagacatgattgcagagcctagccacaagttctacctaaacacaaagcccagccagtgctcttactagagtacagagtacagccagcagctccagctgacctttgagcttaggcagcagctcagcccaactaaagaacccaagagcaaggtctgcctgcatagggtcactaccagctgacccgttcagaaacacaggccaggctaaatagcgaagctccatccccagtgcagaacaccagcaaaaaccagacaaggtaggtgattcctcaaatgtgcagacactgacacaaagacacagaattacaaaaaaacagagaaatatgacaccaccaaagaaattaataatgctccaataatggaccctaaaaaaatgaagaactataaaatttcaaatagcagtaccactcatttaggaaacagaccctagatgactgataaaaacttcagaaaaaaatcctcttcaagaagctcagggaactacaagaaaacatgaatagaaaattaaataaaatttaaaatacaatgcacaaacaaaacaaaaagtttggcaaagaaataaaaacaataaaaatagaaattttagagaaaaagaatataataaatgagctgaaaaattcaataaaactcttcaatggcagactcaatcaagcagaagaaggaatcagtgaggttgaagatggtacatttgaaattactcagggaagaaagaaaagagaataaaatgaagacagaaagcctatgggaattataggatatcatcaagataactaaatttacataataaaagtggcactgggaggatcgcttgaggcaaggagttcaaaaccagcctgggcaacacagcaagatctccatctctacaaaaataaaattagccaggcatggtggcacacatctgtagtcccagctattccagaagctgagcttgagccaaggtgttcgaggttatggtgagctacgatcatgtcactgcactccagcctggataacagagagagatcttgcctcaaataaataaataagtaaaaatagaagtggcagaaagtggagaaagagagaaagtgccagaaagcactttttaaaaaatggttgaaaacttcccaaatctagggaaagatgtcaatacccaggtacagggagctcagaggtctccaacaaaattcaactcaaagaggtgttcaacaagacatatcataatcaaactgtcaaaattaaagacagaaagaactctgaaagcagaaagagataaggaaatatcacatcttaaggaatctcaatgtgactagcagtggatgtctcagcaaaaaccctgcagataaggacagagtgggataatatactcaaagtgctgaaggaaaacagtgccaaacaagaatatatccagaagaagtccctctgaaataaggaagaataaaaacttcaccagacaaacaaaatttaagggtgttcatcattactagtcctgcctagtaatcatgcaggaattgctaaaaaagagttctttaagctgaaataaaaggtatttaattaataacaaagcatatgaaaatataaaactcaatgggcatattcaggataatctactactctaatggtggtgtataaagcaattttatctctactatgagggttaaaagataaaagtattaaaaacaactatagctgcaataaatcgttaagggatacaaattacagaaagacgtaaaattttatatcaatattataagaggtggttggggtaaaagtgtagaatttttgtatgtgaatagagttaagttgttatctgtttaaaatagcctattataagtataagatgtttcatgtaagcctcatggtaactacaaagcaaaaacaaaaacctatagtagttgcacaaaacataaaaagaaataatttgaagcatatcactacaggaaaccaccaaaccacaaaaaaaaatagcaaggcatgaaaaaagaaaaatgacaaaagaaaacaagttacaacatagcagtaggaagtccacacctattaaataattaccttaaataaaaatgaattaaattatccaatcaaaagaaagtaactgagtggatttaaaaaaaaatgtagcctacaagaggctcacattattagtaaaaacacacaaagactgaaagcaaagggatgaaaaaagatattccatgcaaatggaagccaaaagagagcagtagtagctatactgatagcagacctaatagactaagtcaaaaactgtaaaaaaaaaaaaaaaaaaaaaaagacaaagaaggtcattatacaataatagggggttcaattcatgaagaggacaaaacaagtgtaaatacatatgctcccaacattagaacatctaaatataaaaagcaactattaaatgatctgaatgcaggctgggtgtggtggctcacgtctataattccaacactttgggaggctgaggcaggaggattccttgagcccaggagtttgaaactagcctggacaacatagtgagacctcatctctacaaaacataaacaaaattagccaggcatggcagtgcacatctgtaggcccagctactcaggaggtgggaagatcatttgagcccagaaggtcgaggctgcagtgagccaagatcacaccattgcactccagcctgggtgacaaaacaagacgctatctcaaataaataaataaataatctgaagggaaagatagactgcaatataataatagtaggaaacttcaacactccattttgaacaatggacagatcatctagacagaaaatcagtaagataacattggctttgaattacaagttaggctaaatggaactaatgcacatatacaaaacatttcatccaacagcaacaaaatatacattcttctcaagtgcacacagaacattatctaagatggctctaaatgttaggccactgatatggtttgggtctgtgtccctgcccaaatctcatgtcaaattgtaataatccccagtgtcggaggtggggtctggtgggaggtgattggatcacggtggtggatttccccctggagctgttcttgtggtagtgagttatcatgagatctggttgtttagaagtgtttagtacctcccccttctctcttcctcctgctctagccacataagatgtgcctgcttccccttcaccttctgccatgattttaagtttcctgccatgcttcctatacagcctgtggaactgggagccaattaaacctcttttctttataaattacccagtcttaggtatttctttatagcagtgtgagaactgacttatatagccacaaaatgaggcttaacaaattcaagaggattaaaatcataacaagtatattttatgattacagtagtatgatactagaaatcagtaacaggagaaatcttcaaaaattcacacatatatgaaaactaaagagcacactctgaacaatcattagatcaaagaagaaatcaaaaggaaattgaaaaatattctgagacaaataaaattgaagcacaacatatcaaaactcatgggatgtggcaaaagcagttctaagaggaaactttatagcaataaacacctatatcaaaaaggaagaaagagctcaaatgagcgatctaatattatacctaacaaactagaaaaggaacaaactaagcccaaagtaagcagaaaaaaggaaataacaaacagcagagtggaaataaataaaatagtaattagaaaaacaatagataaaatcaacaaaattggccaggcatggtggctcacacctgtaaccccagcactttgggaggccgaggcaggaagattgcctgagtgcaggagtctgagaccaacctgggcaacatggcaaaactccaactctaccaaaaaaaaaaaaaaaaaaatacaaaaattagccaggcatggccataagtgcctacagccctaacaacttgggaggctgaggcgggaggatcacttgggcccaggaggtcgagactgcagttatctaagattgtaccattgcactccagcctgagtgacagagcaagaccctgtctctaaaaaataaaataagttaagataaaataaaataaacaaaacagttgggtctttttgaaaatataaacaaaagtgaaaaaaaccttagccagactagggaaaaaagagactactcaaataaaatcagaaatgaaagaggaaacataacaaatagtacagaatacaaaggatcataagaaactactaagaacaattatattctaacaaataggataacagaaaaaaatggattaattctagacatatgcaacctactaagactgaatcatgaataaatagaaaatctcagtatactaagaacgagtaagatgtttgagttggtaatagaaagtctttcatcaaaaaaagcccaggaccagatggcttcacagctgaattctagcaaacatataaaaaactaatactgtattagtccattcatgttgctattaaggaatacctaagactgggtaatttatgaagaaaagtggtttatttggctcacagttctacagtctgtacagaaagcacaatgtcagcatctgtttctggtagggtctcaggaagcttacaatcatggtagaaggcaaaggggagtcagcacgtcacatggcgagagagggagcaagcaagatgccaggtccttttaaacaatctgctcttgtgtggactcacacagcaagaattcactcatcaccaaggagatagcactaagccaccctattcatgagacatctgccttcatgaaccaacatctcccactgggcaccacctccaacaccagggatcacattttaaggtgagattttggaggagacaaacatccaaaccatatcaaataacaattctttttaaactcttccaaaaaaaattgaagtaaagggaacacttccatacccattttacaagccagcattaccctcatactaaagccagacaaggacagtacaagaaaagaaaattgtaggccaatatccctgataaacataggtgtaaaaaccctcaacaaaaaactataaacttaattcaacagcacactaaaaagatcatttaccgtaagcaagtgtgatttatcccagggatgcaaggatggttcaacatatgcaaatcagtaaacataatacaccacattaacaaaatgaaggacaaaaaccatatgatcatctcaatagaagtagaaatcatttgacaaaattcaatattcttcacgataaaaactctcaacaggtatggaaggaatataccacaacacaataaaggccatatatgacaagctcacagctaacatcatactcaaggtgaaaagttgaaagcttttcctctgacatcaggaataagaccataatgcccactctcaccactttttttcaacatagtactggaagtcctagccagagcaattagccaagagacagaaataaaggggatcctaacatgaaagggagaagtaaaattgtctctgtggatgatataatcttatatatagaaaactctatagagattccaccaaaaaaattgttagaactgataagcaatatcaataaagttgcaggatacaaaattaatatacgaaaatcactagcattcttgtacaccaacagtgaaccatctgaaaaagaaattaagaaaacaatcccatttatagtagcaacaacaaaaacaaacaaaaaaaacttaggtgtaaatttttaaaaattggttaaatgaggtaaaacatctgtgtactgaaaactgtaaaacactaataaaagaaattgaaaatgacacaaataaatggaaagttgtcccatgaaagaattaatgtcgttaaaatgtccatactacctaaagcgatttacaaattcaatgcaatctctatcaaaattccagtgtcatttttcacagaaatagaaaaaaaaatccctaaatttgtatggaaccattaaaacatacccagatagtaaaacaatcttgagcaaaaagaacaaaactggaggtatcacacttcttgacatcaaaatatactagaaagctatagtaatcaaaagagcataatataaaaacagacacatggaccaacacagcaagattcagagctcagaaataaacacacacatttatagacaattgctttttaaaaaaatttaagaacagggtcttactacattgcctaggctggcctcgaactcctgggctcaagagatcctctcgccttgcctcccatgtagctgagactacagtcatgagccaccatgtgtggctaacttcctttttgcttaaggtgcctagaacaaacaagggagaaaagataagctcttcaaaagatggtgttggaacactggatattcacaagcagaaaaataaaattggattattatcttacaccatatacaaaaatcaatacaaaatatattaaagacttaaatatagggcctgaaactgtaaaactactagaagaaaacatagagaaaaaacctccacaacatcagtctgggcaatgattttttggatatgaccccaaaagcacaggcaacacaagcaaaaatagataaatgggattgcatcaaactaaatagctttcgaacagcaaagaaaacaattaacagagagaagagacaactcacagcgtgggaggaaatacttgcaaaccacacatctgataaggggttaatattcaggctatataaggaactcacacaactcaaaagcaggaaaacaaataacatgatttaaaactgggcaaagaacctgagtagatatttctcaaaagaagacacacaaatggccaacagatatgtataaaataaatatggtcgggtgtggtggctcacacctgtaatcccagcactttgggaggccgaggcgggcggatcacgggatcaagagatagaggccatcctggccaggatggtgaaaccccatctctactaaaaatatgaaaattagctgggcatggtggcatgtgcctgcagtcccagctactcaggaggctgaggcaggagaattgcttgaatccaggaggcggaggttgcagtgagctgagatcgcaccactgcactccagcctggcgaaagagcaagactctgtctcaaagaaataaaaataacaataaaaataaataaataaatgctcaacatcattgattattagagaaatgcaaattaaaaccacaatgagacagtacctcacattgttagaatagctattatcaaaaagatgaaaaacaagtgttggcgcggatgtggagaagaggggacccttgtacactattggtgggaatgtcaattagtacagctgttatagaaaacagcatggaggtgttttgagagccccagccaaactggggttccaataccagagtggctagcaacactgcccctaacaggaaataaaggggaactggatagggatgtttaccatgtcctttcacaggatactttttttaaccagggggtggactaatgcctagttttcagcctggattcaggggatccgtcacacagaacactcttttatactgacagacactcttgtgacccttgtctgacccatgcccagtttatgcctgcctggctatcactctggtgctgggtgcctgaccttgtgttctcctcagcatctcagggaaaacccagcttggggcatctcctagtccttcagaggggaggcacaaattcaatgcaccaccaaaataggagacaagttcagcaatttttgcttacagatattgggcaaggagatgtaatgaatgaagagggcaatcctccatccctgggtcatgacaggcaggaaggaagagttaggcagagagagagaagcccatggcaactagctgtatatatgaggactaggattgggggtactttaaattctctggaaaatacctgaatggcccatttaaaaggaagcagtgggaaaggagagagcccagtcttctaggccggagagatgtctctgaattcttatctctggccaccggcttgagccatttggatgtgacgtagaactagaaaccctgtcaagggtgactgagttctgcttctgttgtgagaaagttaaacttgtattcaaaatcgatgccaaggcaacataaaatagaactcactgcaggaggggaaatgagaagatactgtagaaagagtacaaggtttctattagaaaaaaaaaagggatatgtttttgatatctattgctcagcatggtgactatagttaataataatgtatatttcaaaattgctcagagtaattttcaaatgtctcatcacaaaaaataataagtgaggtggtggatatgttaattagcttgacttatacatttatacctacatcaaaacatcaccttgtaccccataaatttacataattataatttgtcaattaaaaataataattcataacttcacagtatatcatgtcgcaggtggcaaccatgtttatatctaaattcttaaaactgctggatcaaagggtacatctgtaaaacagaagacatcattaaactgccctctgcagacgctgtaccaatttacactcccaccggttaaataaaagaatggttttccatgactccgtaccaacactgagtcatcaaactttatgagttttgtcaactcgatagacaaaagcatatcacagggtagttttaactgacaattatcataagtatacaaagtgtcttcaaatgtttagtatttgcaagccatctatatgtccattttcatgtatgttctcttcatcttcccattttttccactgggcttctgttttttttaatgtattgatttttagctctttctacagtagaataattaaaattagctttttgactatgaaataagcacagatatttttcccagttatgtttttgactcattggattttgccaagcagatttttaaaaatttgatataattaaatgcatcgatcttttaaggtttctgcattggtattacagttagcaaggctatttctattctcagctgttttaaaagtttctccataagttcttgaggcactttattggcttcctctttataacatttagatatttgatccatttagaggtgttccatgtgtaagttgtgaggtatggatctaaatacatttttgggccaggcgcagtggctcacacctgtaatcccagcattttgggggtccaaggcaggcggagcaagaggtcaggagttcgagaccaacctgactaccatggtgaaaccctgtctttactaaaaaatacaaaaattagctgggcatggtggcacacgcctgtaatcccagctactcaggaggctaaggcaggagcatcgcttgaacccaggaggtggaggttgcagtgagccgagatcgtgccactgcactccagactgggtgacagagcgagactcctcacaaaaaaacaaaaacaaacaaacaaacaaaaacaaaaaaaaaaacctctcagttgtcccaatatcatttattgaatagtcaattttttatttatttgaaaaggcaacttaaagcatttccagtatcaattatttaattccaaatgacatgattaaagcgctatttactgagctttcaaatgtagataataccattggctcatctacgaaagatgagaatttggatcgcatacaccacctctcctctgcctcctccaatgtttgataattatatcatgttttgttcctctacttagtgcttttcccacttcaaataacttacttataccactatttcttgtttcaatagctctaatcagtatctagagtaaaattaagtaagcaggaggctattgacctgagacagtctccatgctttgaattcctatgaaacaaaatgcaacctaacttagtatgtaaacaaactgaaacttaacttaggagtttcatttttataacagataaccaggtctttgccaatcacaagcagccaagcttcagctaagtgcaagcagccaacggactggctcatgtctaaatcaagcaaaacacttagctgcaacaaatcaaactatttatgtactttaccttcctgttctgcttataaatactcattgcttacagttgcagagctctcggaacctcttctggttctgagtactgcctgattcaagaatcattctttactcaaataaactccattaaatttaaattgtctgaggtttttcttttaacactaaatacccctctcagcaataggaagatgatagcccatagaagtgaatatatttttctttttgttgtctctactccattttatccacaacagggcccaacctaaaaataataataataacaacagtaatagtatgtggagatagactgtaaggactcagatcaatgttttattattctgtgattcttaaagtaaatatacatgagtccatactgatataaataactgactgaataaataaataaatagaaagaagggacaactctcctgtcaaaagaattccaattaataaatgaaaaaaactaaggaaatagagaatcaccattagaacaccacagtaacaactgctgcaggcaagatccactgatgaataataaaactgatgggtgacagtttagggagcaactggatatttgcatagcctcaaagtatctcccccaaatatttattagttaccatggtagtgttaacgtatatccacaacttctttaatattcttccctccagtggatggacttaatctactcaaccctcactcccaggatgggctgcacttactgactcccttccaaaaactagggtttggatagggaaaaatggtgactttacagtgcagaaattttccagttgctccgccttaaccaggtgaccaaggtaaacaccaccagtgatgagtcatgttgatatccctgtacctcatgacatgattcaagaagggcaccttacctctgtggtaatcttcccaaaagtccacaaccttagtcttactctgaggaaatatcagacaaacccaaatgaagggacatgccacaaaatagctgatcaatactcttcacaagtgtcaaagtcatgaaacactagaaaaggccaagaaactctcatagatatgggaagaataaagagacatgacaacaaaattctgtatgtatgctggactggatcctggaacagaaaaagaacactaatgaaaaaactggtgaaatctgagcaaaacctgcagttcagttaatagtaacgtaccaggctgggcacagtggctcatgccagcactttgggaggctgaggcagggggatcacgagatcaggagttggaaaccagcctgtccaatatggtgaaaccccgtctctactaaaaaatacaaaaaattagctgagcgtggtggcacacgcctgtagtcccagctacttgggagactgaggcagaagaatcgcttgaacctgggagccggaggtcgcagtgagccaagattgcgccactgcactccggcctgggtaacagagtgagactccagctcaaaaaaaaaaaaaaaagtaatgtaccaatgttaatgtattggtttttatcattatcatacttatgtaagattttcacattaggtaaagctggatgaggggtattcagaaaccttgtactatctttacaagtcttctataaatctaaaacatttccaaatataaaaagctttttaaaataagtgattgatctacctttgaaatgaaaccttaaattaccacgctgaattagctcttggacactttaaaattatgattactggagaaaaacaaaaatgtagctgggcatggtggctcatgcctgtaatcccagcagtttgggaggccgaggtgggaggatcacttgagcccaggaattcaagaccagactgggaagcatggtgaaaccccacctcgacaaaaaacaaaaattagctgggtgtggtgacatacacctgtagtccctgctactcaggaggccaaggtgggagaattgcttgagcttggggggcagaggttgcagtgagccaaaattgaaccactgcacttcagtctgagcgagagtgagatcatgtctcaaaaaaaacaaggtgggctgtggtggctcacatttgtaatcccagcactttggaaggccaaaatgggtggatcacctgaggtcaggagttcaagaccaggctggccaacatagtgaaagcccatctctaccaaaaacacacaaaaaattagctgggcgtggtggtgggcacctgtaatcccagctacttgggaggctgaggcagagagaattgcttgaacccaggaggcagaggttgcagtgagctgcaattgtgctactgcactccagcctgggcaacagaacaagactccatctcaaaaaaaaaaaaagtttagtttcagtggttgttgaacaattagtttactctgcaagtaggtaatgataacatcatttttcattccattttgcatgctcttctccatgtaggggtttacctcgtatctctgtattctgatagcctggagttgttttccttattgatacaaatgaaaagtggaatctttatatgttttccaatttattaaattagtaatgttaaaaataattttaacaaagttaaatggaattattttaaaattctgtttctttgcagtaaatgtaatcccaatataagacaatatgactcacatatttgtgaaaacgaatagggccaatcgtttccattatcaccaaaattatctatagtgaggcctctccatcttctaccagtccctcttttttttcactcactcaaaatatatgtatcgatggtcaaatgtgtcccagacattgtgcaaatctctgacaaaggtaacacaagaaaatgtgtactctgagaacttcttattctgccccagtttaggagattcatgcaactgccaagcaacaataataagagctagcagttattggagtacctcattcctcacaactcgtcataaggcaggtgttatcattagatattccccatgtgtatgcaggatgaggaaataggttcagagaggtcaagtggctcacccaaggggcacagctaagtgaaaggcactgcaggcatctcaaactacccccttcccacaagactccactgcagagcaggacagtcaccctgacaccagcccaatgggttcatcttgcccattacccagatggggctaatttatcaagacaagggaattgcaatagagaaagagtttaatacacatagagccagctaaacaggagaccagagttttattattactcaaattagcctcccaaaattcggaggcagaggctaggggactttgtgggtttttttgtttttgtttttgtttttcttttgagagggagtcttgctatgtcacccaggctggagtgcagtggcatgatctcggctcactgcaacctctgcctcccggattcaagcaattctcctgactcagccccccgagtaactgggattacaggcacatgccaccatgcccggctaatttttgcatttttagtagagacagggtttcaccatgtgggccagagtggtcttgaactcctgacctcaagtgatccacccacctcagcctcccaaagtgctgggattacaggcgtgagccaccatgcccgccggctagagttttttaatgatagtttgatgggcaaggggctagagaatgggtgctgctaattggttggggatgcaatcacaggggtgtggaaaaccgtcctcagtgcaccgagttgcatttggatgcgggccacagaggagtcactggtccaggtggagtcatcctgtcattagaaatggaaaagtctgagaaggtatcttcaaaggccagtcttaggttctacaaaagtggttatttacaggaataattggggaagttgcagagcttgtgacctctggaacaatgtctggtaattgttaatgcctacatcttagcagaattcaggcccctctcataatcctaaacttgtggacttttattagttttataaaactggtttagtttggggaagggctattatcatttaaactataaactaaatttctccctatattagctcgtcccatgctcaggaatgaccaagggcagtttggaggttaaaggcacgatggagttggtgagttcagatctgtttcaccttcgtaattttctcactgttaaaatttttgcaaaggcgattgcagcgccccttgtccacacctgcgcgctccccaaggggtccctacccaccccgcccctggctgggggccgtaggctggccctgccccgctgcgccggaggtggacctctaccagggcagtttctctctgaggctgcgcgctaaggcggtgggcggtcccaggcaggcccagaagctgggcagcctctgccgggttccgggaaaaggagctcctgctgccactgctcttccggagcctgcagcatggggcccctgccgcgcaccgtggagctcttctatgacgtgctgtccccctactcctggctgggcttcgaggtgacgctgggaggggtcgcctcggcagtgtctggggagtgagggcggagggaagagtgagcgcagggctccgggacagaggtctcgtgtaactcctggcgccgcccaaggggttaaggcaagcagggagagctccggggctgaaggtcactttgtgcttttaaacggaatagagtcgctggctccaacccgagcctttatatcccgactgcagtttcccacggtggtggaaagaggggcggctccaaacattcagggagaaatgcagaacacggccacctcttagcccaacgatggcagttttggggaaaactggccacaggagcgaagatcctggaatagatttctagtagtgaggagagttttgccaatttcaaaccaaacaatgtagggtgtccgcataacccctgctctgcacttagcgcctcccttccctttccctcggctctttcacttttccatcttgcacactggcaatcgttcttgacctctgcccgcagatcctgtgccggtatcagaatatctggaacatcaacctgcagttgcggcccagcctcataacagggatcatgaaagacagtggtaggaagggagggtcggggcaggggtgatctcagtggcccaagagagccgaccccagcgggtccttatattggcactggcagccagaaagctgccctctgccccgtctctactaaaaatacaaaattagccgggcgtggtagtgcatgcctgtataccacagctactcgggaggctgaggcgggagaatcgcttgaacccaggaggcggaggttgcggtgagctgagatcgcaccattgcactccagcctgggcaacaagagcgaaacaacaagagaaaaaaaaggaagctgccctctgcccaaaacccacgtcgaggtccccaaacctgggacccttaggtcttttctcacttagcgtgcccaaccttctcctggcaggaaacaagcctccaggtctgcttccccgcaaaggactatacatggcaaatgacttaaagctcctgagacaccatctccagattcccatccacttccccaaggatttcttgtctgtgatgcttgaaaaaggtgaagagagtgggatgtagacagggtatccagtgaaaaacacagaagtcggagattgagggattgataggatggaggggctgcgggagactaaagcaagtgaagcctgccttgggaaacctcaggatcagccttgagcgagctgaaggttgccgggcatgaaagggaagaagagcaggcaaataggtcatgggaaccttgggtgagaggctgagggcggaggagctctgggggatgtcagaagcaaggaagagctagtcctccaccaggaaagcagcaagaggagccctgcctctgggtgcctctgccccacaggaagtttgtctgccatgcgtttcctcaccgccgtgaacttggagcatccagagatgctggagaaagcgtcccgggagctgtggatgcgcgtctggtcaagggtgagtgtggggctctgggaatcctctgggaggaccttggatgactttctgaccttccccaggcacgttttcagggtcatgatcctgcccccgcccgggggatctactgtcctcccagtcacacccctctccccgcaccgccttcctgctgtcttctcttcttcccagaatgaagacatcaccgagccgcagagcatcctggcggtgagtgtcctggctccaccccaactgcactcatagagaatctgagaacagttggcgtttgggggtaaagaagacaataggtctcttattgcatggaaaaggttataattactggggaagaaaggatgtctgtgattcagggcacaaactactgaaaagttggaactaaggatcctcaaaaggatatctcaaggttgaaaggggaagtgcaaaagggacaatatatgggaagaatttatttgctgaaagatgtcagtgagagaaagatgctcagtgttggaacccctggatggggagggatatagtattcacaagtctccacaaactccaacacaaacctcaccaacacatccagagtggaaggcaggagacttgttccaagaggctttaaaaagacgaaaagagataactaatgccagggttatataggagcctgagtgagaacaaatggaaatagctcaaaacattgaccagtgagccatggatgggggtataaaagtaagtttgtcttcaggattaaattaggaaattcaaaacagtattattcctctggtttacaaaaaaaaatagttgagacctattcaaatttaatatataaagtggcaaatcacacaaaagttaaacgtataaggaatggcaaatatatcttctacagtctatactcctgcaaagtacatgtgtaatttttagcttgcttttttacttcatatttaatcattttccatgctttttttttttttttttttttttttgagacacggtctggctctgtcgcccaggctggagtgcagtggtgtgacctcgacccactgtaccctttgcctcctggactcaagcaatcttcccacctcagtctcctgagtagctgggactacaggcacacactaccatgtctggctaacttttttattttttgtagagaaggggtttcactgtgttgcccaggctggtctcaaactcctgtgctcaagagatctgtctgcctccacctcccaaagtgctgtgtttacaggaatgagccactgtgcccagcctccatggaattcttaactctgaaagtatagttctttgtttctatagaggttccactgagtggacttatttttgttttgcttaaccatttttctgtggttaaacattttgtgtaggacataattctctaatttaaccaagtcaaagatagtgtctcattaggacaggctacatgaattcctgggtcccacttctgatctaggaagtcaagttgcagtggttgtcaatcttggctgtgaattaaaatcacctggagcaccttggcgctaaccctttcccctggaattgtgatgtaattgttcttgttcttttttttctttctttcttttttttttttttttttttttttttgagacagtgtcttgctttgtcacccaggctggggtgcagtggcatgatcatggctcactgcagactcaacctcttgggctcaagtgatctcgcatctcagccttacgagtagctgggacttcaagcatgtgccaccatgcctaattttttaaaaattttttgtagagatgggggtttcactttgctgcccaggctggtctcgaactcctgggctgaagcaatctcctgcctcagtctcccaaagtgctagaattacaggcatgagccacagtgcttggatctagttctaagggatgacctcacgtggagattttttaaagctcctcaggagtttcagatgggcagccaaagttaagaaccatctatcccaaactataccaacaaaccacaaactgaagcctttatctttgtcttgaagccaggtaggtggctgcagccatgtgccttgttacaaagttctcaggaagttccactggaattacagcctagctcttgattcaaaaaaagcatgagatacttaggaactgtgagaggtaggaaggaaagagccctggacttgaattctagagacctggattctagtgttggctctgctaccaacatgctctgtaactctgagcaagtaatgtatcacctctggattcaggctcttcatttgtgaaataaagaggtctatctagctgctctctaagatgtccgctggtgttaatttctgtgattgactctgtgccatctaccttttctccttttccacccatctcaagatttgggataaaggaaatagttcctcttggcaaggacagatctccacttgtgggtgggtaagggcattgccagcaaaacttgggggcagaaaataaaaagaccagagttttcctctgagatccccatccaatatcatgcagacacagttgtattccctactatattcccttaggctgcagagaaggctggtatgtctgcagaacaagcccagggacttctggaaaagatcgcaacgccaaaggtgaagaaccagctcaaggagaccactgaggcagcctgcagatacggagtgagcagctctttatgtgtgttcccagcacccatcctgaagatggagacttgagaatctctaagtttgagtccttatgctcctgtacaaaagccccctttccaagtgttctcctcagtgctcttaaacaaccctcatcttcttccttcttttccttgggctcagggaaaggaagggaaggagatgcacagtgagagaaaagagagcatcttagaaacaggaaggcacctggggccacagagcctcttagacctctttgcttctgtgaactcagaaaagtactgactcaaaggtttcaacccctgcctaatacctgctcctttgccttcctccttgcattgtaactgctttctccaggcctttgggctgcccatcaccgtggcccatgtggatggccaaacccacatgttatttggctctgaccggatggagctgctggcgcacctgctgggtaagtaagttaaagaatcaaccctgagccaggtgcagtggctcacgcctgtaatcccagcactttggtaggctgaggcgagcagagcacgagttcaggagattaagaccatcctggccaacatggtgaaaccccgtctctactaaaaatataaaaattagctgggactacagctgcctcagtgggaggctgaggcaggagaatcacttgaacctgggaggcggaggttgcagtgagccgagatcgcgccactgcactccagcctgggtgacaaagcaagactccgtctcaaaaaataaaaagattcaaccctgagctgcctttgaccccagctccacacccactatatcagttgaccagaaggaggggctcagagcaaaaaaatattcttggcacttccagtaacaaagcgttatgcagtcagtgctgttcaaggttgagtgggcaggggctgtcttcaaccccataaaagaaaaggaagccttctataccttgaagccaagcaaaagtctttctagaaaacccctgggaccttgtgggaccaactcctgctgccagaacacctgagaacagtgtgcagagtctgttgttttcttcatccaggagagaagtggatgggccctatacctccagccgtgaatgccagactttaagattgcccggaggaagcaaactcttcgtataaaaaaagcaggccatctgcttaacccttggctccaccataaggcactgggactcggatttctctatctgatagaggtattttctgtggccctgggagctgtctgtctttcccctacccccaaggatgccaggaagacgtccaccattagccatgtggcaacctttacttctatgcctcacaagtgcctttcagagagccccaattctgctttcccacaaaataaacctaatgccatcaggcaaaacatttctgtgtctgtatctgccctggtatattctcattcctggggtcacatcctgcctactctaggggtaggtgaaggagagctgtttcagtatttccagccagaccagccatgcagcccaccttgagcagcttgtgcggtggaagaagtgagaatagtcccccgttctctcacacagaaactcccctggtctctctatcagcaacagaaaaccaagccagatggactttgcaactaatcaagtttgggatttactgtcttctgaccaaccacagtgactgagatggggctgggaccagaagcccagtgggagtgaacagccgagggaaccagagtctggctgagcttgtggccagatatttaaactgggtccagccacacctgcaaaaccagggcaaggcagtaccgggaaactggctggagttgctgcggtttggggaagttgcacaccctttcatagatacctcccttaaccctcagtgcagattctgagaaaactccaaggcttctctgcctaacctagtataacccctgttccctactacatacatataacttttccattcccccagtaattgacccaaagtccctgcctctagctgtgcccattgtgcaatgatcagaatcccttgtttcaatagtattttgacttctttaagaatactctgtatttggaagctgaaacctcacttggatccattgttgggaaccaagtacggagccttacatagcccggaggagtttcaggagcaatgccactttcccttccatccctccctctgggtctggctcttcccatagtccattttccccttttatctcccattaatttctgtcttcctctctcaccttttccatgtctctagcatcctccaggatttaaaatcatctttacccaacttatctgtgaagtaatggcaaaagaacatctccaaattaagtactccttttcttcaaaggagtttcatgggatgtacagctagtataaaataaaaatatgggaagatgtccaatcttaaaaaccataagggcaaattaagacaaaactaagctgcccagagcagggtgagtggaaccagttttatgaataaagatgcttgtctcagcactatatgtggatatcaaaaattgtgaacaacttgaacacctatcaggaggagaatactttaatcaattatggcacattcaggagataatgttttacagtcatcaaaaattgtatatgagggccagcacggtggctcacacctgtaatcccagcactttgggaggccaaggcaggcggatcacctgaggtcaggagttcgagaccagactggctaacatggtaaaaccctgtttctactaaaaatacaaaaaagtaaccgggtgtggtggcacgtgcctgtaatcccagctactcgggaggctgaggcaggagaatcgcttgaacccgggaggcagaggttgtggtgagctgagattgcactattgcactccagcttgggcaacaagagcgaaactctgtctcaaaaaaaaattgtatttctgaagaattgttaagaacattggaaattcttgagatataatattgattggaaaaagatgaaactatatggtatgatctcaatatgtcctgatgaataaaaacataatacagaggacattattctgagataaaatacatcaaaatctttccattttatttgtatacttttacaatttttgattttttaaaatgtattctgatacacaaaataataaaaatgaaaaataaaaaatttggccgggcgcagtggctcatgcctgtaatcccagcactttgggagactgaggcaggtggatcacttgaggtcagcagtttgagaccagcctgaccatcatggtgaaaccccatctctactaaaaatacaaaaattaagctgtgtgtgatggtgcacacctgcaatcccaggtactcaggaggcttatgcgggagaatcgcttgaacctgggaggcggaggttgcagtgagccgagatcgggtcactgcactccagcctgggcgacagagtgagattccatctcaaaaaaaaaaaattgtagattcacattgcagtacaactgtgcatcttgcccattgatttctaaatgtattaactacttaaattaatcctgaatcttttcccaggcttaagtgggataatgttttattgtagatgcatatttcctggctctacccagtctttctttgaagactttatcatcctattttctgaatccagtggctgactttaatcttctctggaggaactagataatttctagactaatgcttacactcatgatccagattgtaatttctgaactccttcttccaaatagaatcaaaacaagaaaggggaaagcctctcaaagcaactgtgcgttaataatgaaacactctttttttctaatccaaggagggtttcatactttttcttagtttcttgccctcttcccttctgatcaataattgtaataggaaatttgcaattgtgccaatactcagattcaatactgaactactttcttgcattgtaattcaaattccaaggttaacaactagctgtatgtttccaaaacaatcttattgtatatgtattttcttaggtgaagtttccagaaatgattttttttttttgcagagccaaacacacatggtaatttaaaaaaataatgcacgtatgtggtaaaaacagtaaaagcaaggtatcaagtaaaaagtgaagagtcctccctttctcattcccattcctactctctaattttttatatatccattttgtaagctataatacagagattccatatactcttcacatactttccccagtggtaacctcttgcataactataggacaataacacactataggacaaaaatcaagaaattgacattgatacaatccatcaaccttattcagagttcaccagtttaacacatgcttattgtgtgtctgtatttagttctatataattttatcacatgtatgctgatgaccaccaccacagccaagatacaaaacattttcagtgtaaagatttctcatgctacccttttatagccacagctacctccctccctccctgtacttccctaacccttggcagtcactaatctgatctttatgtcttgtcatttcaaaaatgctacataaatggaatcagatttgattgttttcattcagcacaatccctttgagatctatccaaggttttgacatgtatcgagagtttattcctttttattgctgaatagtattaatattctatagtatggatgtaacatagtgtgtttaaacattcgcctgttgaaggacacttgggttgtttccagtttcaggttcttacaaataaagctactctgtgtgttcatgtacaggtttttattttcatttctctgggtaaatgcttaggaacacaaccactgggtcccatggtaagtccatgcttagttttagaagaaactgtcaaggctgggtgcatgatggctcccatctgtaatcccagcactttgggagaacaaggcagaaggatgacttgagcccaggaattcaagaccagccagggcaacatggcgaaaccccatctccaaaaaaagaaaaaagaaaaagccagacatggtgatgtgtgcctgcagtcccagctaattgggaggctacagtgggaggatcccttgagcctgtgaggcggaggttgaagtcagctatgatcacgccactgcactccagcttgggcaacagagccagaccctgtctcaaaaaaacaaaaacaaacaaaaaaaaggaaagaagaaggaaggaagggaaaggaaagagagagggagggaaggaaggaagggagggagggagggaggaagggaaaagaaaagaaaaaaagagaagaaaagaaactgccatactgttttccagagtagctggtttcacttttccaccagcaacgcatgagtgatccagtttgtccacagcctcaccagcatttagtgttactactgtttcttactttaatcattctgataggtgggtagtgatagctcactgtgatttttaatttgcatctccccaatgactaatgaacatcttttcatgtgctacttgccatctgtacatggtcgtcagtaaaatgtctgttcatgtcttttgcctactttctaactagactcctttgaaaatttctcatattgtttttaacaatagattttaaaagaatttacagagtaagaatacatttttgagacaatggggaaaatgatacggagtgaaaggtgatattaaagaattaatgttaatttcattatgtgataatagctgagtggctgtgcacaaaaaaaaaaaaaacttttcattggttgtaattcattttgaaatatttaggatagggccaggcacgctagctcacacctgtaatcccagcactctgggaggccgacgtagacagatcacgaggtcaagagattgagaccatcctggccaacatggtgaaacctcatttctactaaaaatacaaaagttagctgggcatggtggcacgcacctgtagtcccagctacttgggaggctgaggcaggagaatcgcttgaacccgggaggcggaggttgcagtgagccaagatcgcagcattgcatgcactccagcctggcaacagagcaagactccgtctcaaaaaaaaaaaaaaaaaaaaaaattaggatagaaatcacatgatgctttttaaaatgtggcaggtcagaaggaatagatgaaacaagagtgacaagatgttaattatcgttaaagccgagtgatggatacatggggagttatttatactatattatgtgtattgagatatttccataataaaaatgtttttaacaaagaatgtaaacccacggattgggagaaaatatttttaaaccatacatctgataagaggttaatatccaaaatataaaagaaactcaatagcaagaaaacaaatcacccaactgaaaaatgattacaggacgtgaacagacatttctcaaatgaagacatacaagtggccaacaggtttatgagaaatgttcaacaactaatcatcagggaaatgcaaatcaaaattacaatgagatagcacctcacatcttgttataatgactattattaaaaagctgaacgataactgttagtgacgacgtggagaaaagggttggcaggaataggaattagtacagccattgtgggcaatagtatggaggttcctctaaaagctaaaaagggatctaccatatgatccagcaatcccacttctgagtatatatccaaaagaaatgaaatcagcgtatcaaagagatatcttgctcttattcacgatagccaaaatatgaagtcaacctaagtgtccatcaacaaatgaatggttaggctgggcatggtggctcaggcctgtaaccccaacactttgggaagcctaggtgggtggattgcttgagcccaggagttcgagaccaacctgggcaacatgtcaaaaccccatctctattttattttaattaaattttaaataaataacccaaaatgaatggttaaaaaatgtgatatgtataatacacagtcatgcattgcttaatgatggggatatgttctgagagatgcattattagttaattttgtaattgtgtgaacatcatggagtatacagaacatacacaaacctagaaggtatagcctaccacacaaataggctatgtggtattgcctattgctcctgggctataaacctgtacagcctgttactgcactgagtactgcaggcaattgtaacacaaatcactaggcaatgcgaatttttcagctccattataatcttaagggaccaccatcctatatgtagtctggtggaaatattgttatgtggcgcatgactgtatacacagaaacacacacacacacacacacacacacacacacacacaatggaatattatttagtctttaaaaaggaagaaattctgtcatttgctactacatagaggaatctgaaataaaataagccaggcatggaaagacaaataccgcatgatctcacttacatgtgaaatctaaaaaagttgaacttaacagaagtagagagtagaacagtgattaccagaggctgggggtgcggggtgggcaatggggagatgttgaccaaagagtacaaagtttctattaggaggaatcaattcttaatatatattgtacagtatggtgaccatgattaataatcatgtatcgtatatttcaaaattgctacaagaatagatgttaaatgttctcactatataaaaatgaccagtaaatgaggagatatgttaattagcttgatgtaatattccacaatgtgtgtatatatatatataaaacatcacaccatatcctatacacatatacaattattgtcaatttaaaataaaattttaaatttaaaaaagtattacatcaatgctgtaaaacaagagagacagagaatgtattgagataataattctgtgatattccatgtttcatcctatccccacagttctaaggacacaaagctggtttcatggtcttgaaacctatgcattcacacagggcctcaaaatggtttaatgttctgctgtcattgtcttgaaattcttaataatttctgaatacacagccctgcatattggtttttcataaattatgtggctatagctgaccctgtaagcatacaatatatgctgattaaatgcctctaaaataaaggagcaactcagagatattgtgggtttggttccagaccattacaataaggtgaatatcgctataaagtgagtcacacaactttttggtgcatataaaagttatatttacacaatactaatgtttattaagtgtgcaacagtatgtctaaaaaaagtacatttcttagtttaaaaatatttagttgctaaaaaatgctgatgatcatctgagccttcagtgaatcataatctctttgctagtggagggtcttgcctcagtgtggatggctgctgactgatcagtgtggtggatgctgaaggatgaaatagctgtggcaatttgttcacagggtctcactctgtcacccaggtgggagtgcagtggcctgaacacagctcactgtggcctcgacctcttgggctcaagcaattttcccacttcagcctcccaagtagctgggactacaggtgcttaccaccatgcccagctgatttttgtatttcttgtagagacagagctttacgatgttgcccatgctggtctccaactcttgggctcaagtgatcctcccaccttggcctccgaaagtgctgggactacaggcatgagccaccatgcctggcacaaatgtcttaatggcatctagaaaagtgaatccttttgggaaggttttcaatttactgtgcccagatccatcagaggaatcaccatctatggcagctatagctttacaatatactttaggccaggtgcagtggctcacgcatgtaatcccagcagtttgggaggttgaggcaggtagatcacttgaggtcaggagtttgagaccagcctggccatcatgatgaaaccccgtctctactaaaactacaaaaattagccaggtgttgtggcacgtgcctgtaatcccagctacttaggaggctgaggcagaagaatcacttgaacccaggaggcagaggttgcatgagccgagatcgcaccactgcactccagcctgggcgatagagtgagactctgtctcaaaatatatatatatatatatttatattatatatatatatatatatatatatatagatcatacatattatagatacataaatatatatatactttaaaaaatataggccagttgcagcggctcacacctgtaatcctagcactttgggaggttaaggcaggcagatagatgaagtcaggagtttgagaccagcctggccaacgcggcaaaagctcatctctactaaaaatacaaaaattagaaaattagctgggtgtggtggcaagcacctgtaatcccagctacttgggaggccgaggcatgagaatcgcttgaacccaggaggtggaggttgcagtgggccaaggttgcaccactgcactccagcctgggagacacagtgagactccatctcaaaaaatatatataatagatgggaaaaaaatattcttgcctataggattgactgggaagatatatgagggaactttctgggtgatagtaatgttttgtatcctgataggagtttgaattacacaaatgtatgtatataccaaaactcacggaatgacctacctaaaaatctgtgtttttcactgtaggcaaattttacttcaagggaaaaaaattaactataagcaaatattgaactcattacttctaaaataagttgcaaaataaaatcagaagagtattgacgtctgcaacttactttaaaatgaatcaaaaaataagatgcattgatggatggataaagggatgagtagatagaaaactagtataatgttaatgctaaaatctaggtggtgagtacacaggtgttcactgtaaaattcttatatatatgtgtatatatgtgcgtatagttatatgtatatacatatatacacatatatatacacacatatatacatatatatatatatatttttttttttttttgagacagggtcttactctgtcactcaggctggtgtgcagtggcccagtcttggctcactgcaacctctgctacctgagctcaagcgattctccagccttggcctcccatgtagctgggactataggcgtgagccaccaacacctggctaatttttgtattttttctagagacggggttccaccatgttgcccaggctggtctcgaactcctgagctcaaagcgatctgcccaccttagtctcccaaagtgctgggattacaggcatgagccaccatgcctggccccttttctgtatgcttttagtaattcataacaaaacggtctacacatattgatctacatatgttgataaggcacaatctccaacatatattgttaggtggaaaaagcaaaatataaagcattatctatggtatgctcccaaatgtataaagaaagagagcctgtatatattatgtttgcatatttatggtctctctctggggagggggtacccagaaatagttgggaaagagattgcctcatgggaacgggactgagagactgaggtttggggatataaaaaagacttactctttattataattttttccctgttgaattttatactaaaagtgtagatcattttttaattaactaaaataactatattttagtaatccatatatttaatttttatgtttgtttgtttgttttttgacgaagtctcgctctgttgcccaggctggagtacagtggcacgatctcagctcaatgcaacctctgcctcccgggttcaagtgattctcctgcctcagcctcccaagtagctgggactacaggtgcgtgccaccatgcccagctaatttttgtatttttagtagagacagggtttcactatgttggccaggctggtctcgaactcctgacctcatgatccacctgccttggcctcccaaaatgctgggattacaggcgtgagccaccatgcccggcacatacattaatactttttcagatactgtcttcttcttcttttttttaaagacaggatcttgccttgtcacccaggctggggtgtagtggcacagtcgtagttttctgcaacctcgaactcttgggctcagacaatcctcccccatcagcctcccaaagagctaggattacaggcaggcaacactgcacctggctaattttttaatgtttttttgtgtgtagagacagggtctcactatgttgcccaggctgtcagatactgtctttaattgttatttaattatttcatatgcatctcttatctctctacccatatcagaaaatcctggagaccacagtcaaatatgttacctctcctggatagatgcccttagaagttagcacagggctatgtacaatgtagttacaaacaaatgctccatggtgaaatcaggtcccagtgacaggatggtacccctcgctggtcccacacacagttgtgcacattacagtcagacccagactcactttggctgtagttccccaagctggaggagcagtgtgggaaaggggtgatatacgtgggtttattttcaccaatttacagattagtaaccgaagctcagaaaggttaagtaacttgcccaaggtcacactgctagtaagtggtagaaatgagatttgaaaaccagggttggccaaaacacatgtgcttaaactgcacggcctcctgtttgctagtatttacaggcatatccatgtgggactctgctgtcactatctgtagacatttctaacaaacacaatgctctttttgttgttgttgcttagcaacaactacactcaatttctcaaattccagaaggtttttgtggcttaatgccgagtatctgagctagactgactgcctcaaccccattgttcactcagttcttgtttagcgagctttgtacaatattaaaactagttgatggggtaagtgcatgtatttatccttacatactggaggatttattattttttgaaagcatttccatctagaaaatatcaatgttgctcacctatgtcatgataaaccatttatccaccttccttacacattttggagaagctgtgactaaggcaatttctgaaggggaaaacacacccagctgaattaaaaggtcaaggttctgagtttccttctaactaaagaaatcgtgtactttctctgagcttgtttcctctgtaaaatgaaagtgataatcaggcagcccaaatgattgttaataaggatcaaatgagatcgtgtatgtgggtccaatcaattgattctacacaaaggtatgtatctattgtcactgatatctttttagaagtcaccagcagtgtgttgtatgcttattcagtttaaactgatctattttttagttgtcttaatcagatgataaaaggtaagccttccaatacagagcttgcaatcttcatttccttatcctgccttatatgtcaataaccttaatttaccttctgatcatctccttggctgcccgtgctgtctgaaaatcagccttttcttaaaatggcaaatagtggggaaaagtagcatctaaccactcctccagagaagggcagaataatgattcagaatgcctctagtgttttgttaaattatcatttgagagcagcccaagagagcatttagagtgggatggtgtagtgcttaagagccaggattctgggttcagaccatgggttcaaatcctgaccccacccttaattagctacccacatacctcaagtttcttacctcatctataaaatggacataatcacagtaactacctcttagtatagcatacgtattttaaatcacttaatttgtgtaaagtatttaacacagtgaggagtatgcacaaaacattctacacatgttgatactataaagcactcccagattcagaaacacaaaaatcacagaaatacaaagccacagagacaagcacacagtgggaggcaataagcttgacttctcccttgttctccttgcccttccacttcccttcaccgtcaaccacccaaatgagctgggaagagtgggcaaggagaagtcattccatctccagtagggtttgtcaaaggcaggcaagtagaaagtggatgacaattgaattaagtgatgcattcctgttttgctaaggatattaagttgacgaagaaataaaggaaagcaaaacctttgggaagcaatttggccatatgcattcgggacaataaaaactttcctattgcttgtctcttgataatgacatttcttaaaattcatcctgaggaaataatccaaaacaaaaggaaaactatacataagatgtttattgcattagtttttaaacagttttcttaaggtgtgaaaggaaaataaatcttgggatcccaaacttactaagccagagggaaaagtcaagctgggaactgggtcatgcaaacctgcctcccattttggtttctttggttttttgttgtgttttgtttttgtttttgtttttgtgttttgagaccaagtctcactctgtcacccaggctggagtgcagtggcacaatctcggctcactgcaacctctgtctcccgggttcaagcaattctcctgcctcagcctcccgagtagctgggattacaggcacgcgccactacaccggctaatttttataattttagtagagatggggtttcatcacattagccaggctggtctcaaactcctgacctcgtgatcctgatctgcccacctcggcctcccaaagtgctgggattacaggcatgagccactgcacccagccccattttggtttccgaataagatggctacaaagatgaaaagctacacacctccctcacactttgcctacaaggaaattctttatggtaaccaagatctttaccctaaagcatttcagctaaggttcaccatggcaatgtaaattgatagcttatcttcacaggtgggggaacacaggacagaaatgaaagtcatccctctgcccactgagacaaatgcatatctgattgtttcctctgccctattatctacattatcttatgtaaaaatgcagattcactgagccagacaaaggcattaaatattgaagccaccaaaatcatctttaaaaaaaggcatagacttgtctcccgggtgcccttccttaactttggcaaatctcctaaaataattgagacttgcctcagtcattttccttgattgacaaaggtataattcatccttttaaagtgtacaatgcagtggggttttttaaagaattattcagagttgtgcaagcatcaccattatataattttagaaattttcaccaccccaatatgaaactcatttgcagttactctccatttcttcctctgcctccccacccctagcaaattctaatctactttctgtctcttgtattattattattattattattattattattatattaatttttgagacagggtctggaatgcagacaggctggaatgcaatggcatgatcacggctcactgaagcctcgacctccatgactcaagcaatccacccacctcagcctcctgtgtacctggaactataggcgtgtgccgccacctccagctaatttttgtatttttttgtggcatgatcacagctcactgcagcctcaacctccagggctcaagcggtcctcccacttcagcctcctgagtagctggaactataggcgtgcgccaccatacccagctaatttttgtatttttttttttttggagagacatggtttcgtcatgttgcccaggctggtctcaaactcctgtgctcaagcaatccgcccacctcagcctcccaaagtgttgggattacaggcatgagccactgcgcccagcctgcattattattattattattttttaattattttattttttgagacagagtttcactcttgttgcccaggctggagtgcaatggcgcaacctcggttcaccacaaccttcgcctcccgggtcccagttcaagcaattctcctgcctcagccgcccgagtagctgggattacaggcacacacctccatgcccagctcctttttgtatttttagtagagatggggtttcatcatgttggccaggctggtctcgaactcctgacctcgcgatagtccgcctcggcctcccaaagtactgggattacaggcgtgagccaccgcgcccggcaacctgcattattttaatggccaaaaatattgagtgaaataggctcagtgttattgagcaacgtatcatgagggtatattaatcaaattatggcatatcgattcaatgaaatattacatggctgtttgaaattactacaataaggtctttatcagggtgaaatatatacaatataaagtataaaactttttaaagatacaaagtggttagtatattctggtttgcatgtggacagtctggaagaaatatataaacgttttaaatggccgtgttaggataatgagaagatagacaatttttttttctttagcttttaaatattgtcatgttttttcttttaacaaatgcaatttttaaaaattgattttacattactggaattgagaatgtatgaacgggcacagccagccaccagtctagcctctccagttgggatccagttcttgtctatcgtactctccttccggcaaccaagagacttaagctacaaaggtccgcctctcccagactctccccttacacctcaggcccataccttttggccccgtgcctcttagcctacaccttcccattcccacaactcactccttaacaaaccccctttcctatcacacacaccaatgacccttggccaatttccttctattcatatgttaactgtagactgcagtcctgattccagctgtactttccccttatgagcagaacagtgaggaaattggctgaaacagaacaacaatcagcccccctcactcctgtgcctactttgcatagagacacacctcatttagactcccacagccttcctgttaatgtctccttcctctctctgctatcgatctggggctctgggacagagaatcttcaatatcccaccagtgcccacacttattaccactacagacacagttattctcattcccatactctctctctctctctctcacacacacacacacacacacaccctctcctatgcttccccaccccagctgtccctggggagcctggattggatttgtgcccacggtctgcagcttccctcggtctgtctgctggtcaccctctgaaggaacggggcccagttttgttcaccctctggctcaaggaccaagtatgcttctactcactctctacctccaagcacctaccctactccgacttaactgcctgacccacaactaaaaagaacagctctttgatcttcacaggtgtggtgaggcctggtgagaggggagccttctagttagtgacctaccacgtttcaggaaccatgttagtttccaggattcagagatgattaaaactaatcacgcaccttgagaaactcacagtggaaggaaaatcagtaagcagaaaaatgctacataaccaggtaaatgctgggacaaatttaggaaggaacgatgtggatacactggagcaggctccaaagcagcatcacctcggaggaggatcttgaagactcaagagttaactgggtcaagaaatatacacactaacacttctgacaggtctgcagaatacagggagtccataaaaatagcacttgggtaatggaagcaggacacaccattccatgcccacagcattactttctgtgtgcagtgcactgtgtgatgatctacagagattaaataagccgaggtctccgcttccagtcacttgggagagacgcacaaggtaaattacccaaatagaaggcaaactgcccagggctgtaattaacatacaatatgcgccgagagggaaaggttaatgctaactccggtcctaagtacaaagatcattgggagtcaggggtgcactctcattagggtacagcatgggtgggtggagagagtaaaaaccagaacaaatcaaggttcagcagttggaagtcagccttagggagaaaaggggcggagactgactgggccagaacagggattgggacagaaaaagagggtggggccagtgggctccacctacccgctccggcccttcccaccaccccccaccccatctactttctacagtctgtggagacaggtgagcgacgaacttctgagacaggtgtgggtgcgagggtcgggagggtcatgggattgggaccgaggtgtgaggagggaatctgcaattccttgctacacagagcgctggcaacttctgacaggctgtttctggggtatgggctgcctcgggttgttgctgttacaaggaaagaaaagagttcccctgcccaccgcctcccagccactgggctacctcctggcaggaaatttgcaaactgagtttaacaagttaggatcagcagagggtagaggagggccctggcagatgtggggtctagaagaggacaggagttatcagggcctccggccattgtgctgggcctttgcctgtacaattgtttctcaagcagttgtgtccctgtggctttggtgcgcctgtgtgcactttctccctccacctggagcatgggctaacaccggaggaaaggaaaagacagagtcagacagggtaagtggggctccctcccctcttctctctaacggggctggattgagggcctctggctggggaggtgggggtggagatccagtaggagcaataacagaggaagggcagggcctgccccatcacctgaattccagagatgccagtgtgcactgaagccccaggcagggcgtgcccaggaccggatcctggatggtggtaagggacaaagctggaagggagactacagggaaggagaaaggaaagaaggcagagccatgacacagtcaacttacagaatggctgggagtcaaagctcctgggctggtttcctggctattccacacactccaagacatagagagaatttcggaactggaggggactctacagatgatttatttgagattgaagaacctagaaaccaaacaaagaaatatcatatggttactttggtatctgacacagccatgacaccaattgctagtgtagacacaatagctgtgtgtctttttgcaggagcctggggaggggccatggtgccaatgcacttactggggagactggagaagccgcttctcctcctgtgctgcgcctccttcctactggggctggctttgctgggcataaagacggacatcacccccgttgcttatttctttctcacattgggtggcttcttcttgtttgcctatctcctggtccggtttctggaatgggggcttcggtcccagctccaatcaatgcagactgagagcccagggccctcaggcaatgcacggtgagttaagggtgggcatcgtaagaggaatacaccttgggcccatcctccctctctccctgtagtctctgaggcagagagtctctggtttcctgtcattggcatcagcgggaggaggggtcagaggccaacagaggatcttttgcccacagcagacaaaaaaaagggaaaaagggcttctttcatggaagccaccaatggccttatttctcttccctcagggacaatgaagcctttgaagtgccagtctatgaagaggccgtggtgggactagaatcccagtgccgcccccaagagttggaccaaccacccccctacagcactgttgtgatacccccagcacctgaggaggaacaacctagccatccagaggggtccaggagagccaaactggaacagaggcgaatggcctcagaggggtccatggcccaggaaggaagccctggaagagctccaatcaaccttcggcttcggggaccacgggctgtgtccactgctcctgatctgcagagcttggcggcagtccccacattagagcctctgactccaccccctgcctatgatgtctgctttggtcaccctgatgatgatagtgttttttatgaggacaactgggcacccccttaaatgactctcccaagatttctcttctctccacaccagacctcgttcatttgactaacattttccagcgcctactatgtgtcagaaacaagtgtttctgcctggacatcataaatggggacttggaccctgaggagagtcaggccacggtaagcccttcccagctgagatatgggtggcataatttgagtcttctggcaacatttggtgacctaccccatatccaatatttccagcgttagattgaggatgaggtagggaggtgatccagagaaggcggagaaggaagaagtaacctctgagtggcggctattgcttctgttccaggtgctgttcgagctgttagaacccttaggcttgacagctttgtgagttattattgaaaaatgaggattccaagagtcagaggagtttgataatgtgcacgagggcacactgctagtaaataacattaaaataactggaatgaactcctgatcccaaagcctattgtgttttcaacacaaggtaataggaagccaagcaacttgcatgtctcccaatccctgtctagggacagctgctggtgcaggatggaagacttcctataaacagaatgggcgaccaattgtgtctacagagggggtgggctgagcatgggcacgcatgtccccagcctcctggacgagcaaagtcagtcaaagcgctggtgatccctgctccgcgtgcgtagcagtgtctgtgcctctcctgcccaggggctagagagcagtctccagtgcagggtccccatcctatctgaaaacagtggagtcagtgaccccaggtggagggacttccagttttaacaatgggttggtatgaaggccagaaggagtgaaacatgtgaactttctggcgaggagactccctcttgaatcatccatatgtagccccggggtcacttgcgaagagtctctaacagcttctgcctcactcctaagctctgaccgctaggctttcaccccagccgccggtcctgattcctgagatcccaatattgagcaccaggtttcctggaattgtgtgctgcggctgtgatgtaggtttcggtcgctggaagctgctaaaccatagctgacgccccctcctaagccagccttccttccccgcgcgggcatctgtccagggccttgtcgcgctctcagtctccttcgcagcctggccccaaccgttcaacttcaataaagcaaaactccagccacgcccgtctccgtgaagttatcgccataggccggccagggggcgcgagaggcaccggggtgatttccgcgggaatcgataaccaatcggattcccaggccgaacggagcacacccgcccgccctcgctctttccccgccctttgccccgccccgctccttcccctccttttgtctgtccgccgagcaccccacttcaccccattggaccgcgcggccgccgctagagctctgcgcctgcgcacgcaccgggccggggactgggtggcctggtgtgtgggcgcggcagggcgcaggcgcaggcgcagtgtgcgtccgcgtctgaggggagggatgtgggggaagcgacggcccccggtttgtttgggctgtgggcggtgcgcagcggagagcccgggaaaagcgggaaatggcggcgccgagcgcggggtcttggtccaccttccagcacaaggagctgatggccgctgacaggggacgcaggtaagtagggaacggtcttagggctccttaggggagcccagggaaggggagcgtggcccccaggcgtgcggccctgcagccccctcccctcggagccccggaaagcagccgtgtccgcgcttcctgccaagggtgggacgcccgcccgagccgctccgagcctgactccgcgcaagggcccgcgggcggacctcttggccttgtctctcgtgggaaaagactgccccagcctccctttgttcaacccacgagggttctaaaggggaggtctttgcagtcctgcccgctcttgggttctcttgaagattcttcatcctttcctctggctcccttatgagggaaactataaaaagaccatactctgtctccttaaaaatcgacgagaccttctgcagacctcggtgctctgcctgatgtgcatttgatttgtatcgattgtatcatgatctgcatggctttgcatagaatgaccagattttcaaagaagtcaatacagggtttggaaattgagtacttttggcagaacaagggggttcctgtggctccgagtgtccatgcctctgccccggtcattccatttcatggcagtcatcacccaggagaacattgtaatgcctcctgctcgagactgaagattaaggtcttcgcaaagggaacctgcagaaggacacagaattaagacgtaggaactccgtggtgcccttcgcccctcctccccttccagttgtgtcctgaaattctaaatgattggaaacttttataatgttcacgtttaagactctcatactacagagtagaggaaggagcgggtgtgcagagggggtgatgcttcagattaaaactaaagagttgattgaaaattcaagtctggaactcgagagagttaagaactataagtcagtaagttgcaagtatgggtgagattgtctagggaaaggctctttgaaggggcgtccctaatggaatatcaatattaagggcaggccaaaggccctctaaagaaaacaggaactgggtaggcagagagaagactcccaaagaatgctgtcatggaaaccagaggaagagaacgatttaaggagcgaatactactggtaaactaatggaagaaatctgctgcaccactggttagtatcccagctgcagtgttatatgtgatcgttattactgctttgacgtattcgaaagtgattcattcttaaataggtttttttatttgtatagctctttttcttgtagccagtttttcctgaaagtcttgggtaatggaaatattacagtaaaaagaagaaaaaatggagtttcagactcatttttccaaacctcagattcattggctgcttccaacccacttcatctgttttaggatcccacctgctatcttagttctcccagttcttccaggacccagctcttccctcttctaactataaatctctcacccaatagcatctgcaagccaagtgcatccattccatagatgtgtggtatttcactgactctaagatacacattttttccctccctttttttttttttttttttttttggacggagtctttgctgtgtcacccaggctggagtgcagtggaatgatctcagctcactgcaacctccatctccaaggttcaagcgattctcctgtctcagcctcccgagtagctaggactacaggcatgcagcaccacactcggctaattttttgtatttttagtagagacagggtttcaccatgttggccaggctggtcttgaactcctgacctcaggtgatctgcccaccttagcctcccaaagtgcagggattacaggcatgagccaccgtgcccggcctcccctcatgttttaacaccttagaaatcagaatgcattttagagtaggtttttaagttataaatggaagttattgtattttcactgctatcaggtgccacccttcctgctgttacatatgtggaaaatgtgacggggcaggctagagaactctggatttatgtaaactaggcatgtagatgacatattggcaataggattattttagtttataagcagaagctgatctctttgcaagcctgtagcaaaattagctggaggtgacagcacatgcctgtagtcccaactacttgggaggctgaggcaggtggatcgcttgagtccaggagttctgggctatagtgtgctatgccagtcacgtgtccacattaagttcagcatcagtgtggtgatgtcctgggagtcagggtccaccaggttgcctaaggaagggtgaacccgcccaggtcaaaaatggagcaagtcaaaactcctgtgctgctctgtaatgggatcatacctgtgaatagccactgcactccagcctgggtggcacagtgagactcttttaaagtaaatagataaatacctatccactgtgactttctgtcatactttctgcttatccacatcttaacaggattcgccattttgtcactggaacttaaaagttttaaaaaacatgtaattatatgtttatatcactagtgaaagagagttagtgtctgcctcatttattttctgttaaagccattggcttgagtttttaccatagtgttttaaccctcatctaagatcattataaacttacatcactttcaccagcttagataatgtgagatgttttctgaaataattctctttattaaaattggtctatcagagaagtattccttctcataaatatgtgtacttgggggtattgttttgcttaagacagatatttccctcctctagtcagaccattcatctcagatgatctcagctgaacataaaccataaggaattagacattattttcttatgatcaatgtgttcctgcttagtacatctttgctttaaccagatttaagaaatatgcataatcttggttattgtaagtcttattctttttgttcttcctattcatgcctcttccactccactcttctgtgtcaaattgtgacttgacagcctttccttctaccgtttatctgtaggatattgggagtgtgtggcatgcatcctcatcatcaggaaactctaaaaaagaaccgagtggtgctagccaaacagctgttgttgagcgaattgttagaacatcttctggagaaggacatcatcaccttggaaatgagggagctcatccaggtatctggaggcaaaagagagaagataaattgatcatggggtgggaatagagcatgacaaaatatggaaagggtgtcgtatctttcttccttttttttttttttttttttgagacagagtctctgtctcccaggctggagtacaatggcgcgatcttggctcactgcagcctctgcctcccaggttcaagtgattctcctgcctcagcctcccaagtagctgggactacaggcaggtgccaccatgcctggctaattttttggatttttagtagagacagggtttcactgtgttagccaggagggtgtcgatctcctgacctcatgatccacctgcctcggcctcccaaagtgctgggattacaggtgtgagccaccacacccagctggatgttgtacctttctaaagaaatggaaatgcccttctaccgtagagcatttgagagaaatgatatataactcaagaataacagaaaggacttcacccatacatacacttttcctgtaaaaagaattcttggatgaggacactactaggaagctcatgtggagaaatagaattatagctagagaagtaaatatgatttcatgttttattcttgtgtcttaggccaaagtgggcagtttcagccagaatgtggaactcctcaacttgctgcctaagaggggtccccaagcttttgatgccttctgtgaagcactgagggagaccaagcaaggccacctggaggatatgttgctcaccaccctttctgggcttcagcatgtactcccaccggtatgaagctttagtaatatggggtgttgggaagggttagtttgactggaaaggaatttgtaagtcagagtgagggagactagattttgttgtatttggaccggaccacttccctaaggtctgtcatcatgagttttgatttcttacagttgagctgtgactacgacttgagtctcccttttccggtgtgtgagtcctgtcccctttacaagaagctccgcctgtcgacaggtgagaattgatggactaaaaggggtcccaggccaggtgccacggcttacgcctataatcccagcactttgcggggccaaggcgggtggatcacctgaggtcaggagttcgagaccagcctggccaacatggtgaaaccccgtctctactaaaaatataaaaactagctgggcatggtggtgggtgcctgtaatcccagctactcgggaagctggggcaggagaattgctagaacccaggagacggaggttgcagtgagccaacacggtgccaccgcactccagccttgccaacagagtgagactcagtctcaaaaaataaaataaaataaaataaaaaggaggggggtgtcccagattgacttcccctttcttgtctggtatctggctttgtcctaacatgagcccttttttttgtttttttttttttttgttgtgttttttttcagaaatagggtcttgttctgtcacccaggctggaatgcagtgacaccaccatagctcactgcagcgttgaactcctgggttgaagggctcctcctgcctcagcctcccaagtacctgggattacaggtgcatgccaccacacctagctcatttttaaattttttgtagagaaggagtctcactttgttacccaggctggtgtcaaacttctggcctcaaatgatccttccgccttggcctcccaaagtgctgggattataggcgtaagccaccatgcccagctgagacatagtttatattgggaacagttgtcagtaaatttgttaagggctagtaggacagtttatgcaggagtttgtggttttttgttttttttttttcttgtgatggagtcttgctctgtcgtccaggctgtagtgcaatggtgcagtctcggctcactgcaaactctgcctcctgggttcaagtgattctcctgcctcagcctcctgagtagctaggattacaggtgcgtgccaccatacccagctaattttttgtgtttttagtaagagatggggtttcaccatctcctgacctcgtgatctgcctgcctcggcctcccaaagtgttgggattacaggcatgagtcactgcgcccggcccaggcaaggtgttattaatagttggtccatttcccttccaccccagataacagtttttgtgataattgggcctttgagtagcatgtatgggcaggaagttcatgctcaattggcctctaaaaagctgaataagaaaagactacatttggggccaccagcctgctgatggagcatcctagtgattggaacgaggcttttatcagctagcccattcggtcattcagccagttgagcatatgcttcatgcaggctatgtgcagagaatcctttagtgagctaaaactaagagtctctgccctcatgaagcttacaggtttgggtagtgagtgagaccaatatttatcacaacccagttgcaagagatgtctgaagttacaatgacatattaagattgatggttaagttatatactagttttttggttttctgtctataccacagatactgtggaacactccctagacaataaagatggtcctgtctgccttcaggtgaagccttgcactcctgaattttatcaaacacacttccagctggtgagtttttgcataatgacaagaggaagagagttgggaaattagacacccttcctgggaacctgaacttagtttgcatgtacatttcctttctgccttattagtcagaaagttgttactggttaaatgccttctgtgagcatttgtctatttttacctgctggaggttaagaagaaaaatacgatgtctttgttttcttgaaatgtctaatctagccgaggaatcatctgttatcaagacgctcatggtctaactggcctctcctccacaggcatataggttgcagtctcggcctcgtggcctagcactggtgttgagcaatgtgcacttcactggagagaaagaactggaatttcgctctggaggggatgtggaccacagtactctagtcaccctcttcaagcttttgggctatgacgtccatgttctatgtgaccagactgcacaggtacctgaggtgggaaaaattgacatgtaaattagaggactgaacaacactttgggaccagagacatcgtttgttcctgtgcctgctgggatatgtcttaaaagttggtttattctacttacatttttactcactctgttctgcctctcaccttgcattctagtaagaaagaattagggccggccagccattttagtgttgacatctcaggttgtggtttcataaagtaataatagtccacagttggtgtctcacttttttttttttttttaaagacagagtttagctctgtcacccaggctggagtgcaatggcacgatctcggctcactgcaacctctgcctaccaggttcaagcgattctcctgcctcagcttcctgagtagctggaactgcaggcgcatgcaaccatacctggcttattgttgtatttttagtagagacggggttttgccatgttggccaggctggtctcaaactcctgacctcaggtgatccgtccccctcggcctcccaaagtgctgggattataggcatgagctacggcacctggctgggaaagtattcttaacatttgtgtaatcacaagtcatagggtagattgtttgtggaccagatttctagaaattgtaaacattttcattatgggctgttcgtcattaacctcagttactgtactgcacaactgactttgtgacctttagggtttctattttgcaatcaataatggcctatttgtagattcatattcactctttattttgattccagaatagtagaactttcttcaacttgctttgaggttgtcagtggtgaaattaaaattgctaggagattcactttgatctgttgggatagaggatctttgttttccattcagcattgtctgtagtcttcatttctctttcttagctgccctccttctgtgagagtaattatgtatttactatatttttggcaaggccagtttcatccacaggtacctgggtgttgtcctttacatgctatttttgccagcttcccccttgtagcatatgcaatgtagttaaatccacccttgcttcaaagccatggcagcaacagctgcttcagtcatcaagtattcaggtagtttatatgctttcctgagaagtctgctgggcataaaggggcaaagggcagggtaccagccataattcctacagaaggtcacttaacaaaatgtgcagtgtgtgtgttttcttagaggttttggtctagccatgtcttttactagaaatctattatgtcatggtttttcaagttgtatgcagctgataaaggatcttacatgtctaatagttaaagataaaatactgagtcactaagtcaactatatatactgctgttttctcagagactgtcagatttggtgagtttatgagctcacttcataaatagcatttccatttatggtaagcctgatgcatattcagtgacctattggattctaattctttggttgaattgctctgtaactggaattgcagtagagttgaacttcaagcaccttataatgggggactatgtgagctgccacagattttaaagatcagatgagggagttttgacatcagcataaaaggaagtgtgtcctcttatattcctaacgaccaaacaagattagagaaaaaatcttctgtcatagctaagaagaagaagcgcctaggtagatatgatcagaaggataagtggaggaggcagaacttaagctggccttgaaggatagaagttactgaagcagagaggagtggtgaagccaccctaggcagggagaacagtatgtggacaagaaatgtgtgtgttataaaccaggtagttgcaatgggtgtcataatttggtacactgggcatctgcacagaatgctctcttcctggtgggatctccctagagagtcaactcgtttatcatatagctatttggcaagcaaagaaacagaaccaaaaaaaaaaaaaagatccttttttctttccctatcaaatctttcttacttaagagaggaattccatttaaaaacaggaaatagtataattagtcttagagactcctcttcccctgatagtgctgcagtgaacatgggtattctcactgcccagatgttttcacttttctctttgttattaagtttttattgcatctacttcatgaggttactagttctagaattatgatttaccctatgttaggaaacgtactcttcaaagtggaaatttccttttaccatgtggtattgtttttttagcttgcatttgggtcacaaactgctttgaaaatgtaaggacaagctatgggttatccctggaaaatgcagctgcccatataatttagcatataatttcagagggttcacaagttactctcttcacatgtcccccaacccctagccaaaaatacacttaggagttaagaaccctgctatttatagaagtactgtaattttatcaaaaacaaatctgcagatcctattttaagctatgctacttgtagaaaaattcctccaaatgtctaatccccatttattgaatggtttagtcttactaagtttggttacaaagtgcgtgtattctttttttggacattgttttctattt

SEQ ID NO: 1346 - DNA, 146944 bp, Homo sapiens
cagtcttttggcttccctgggccacattggaagaattgtcttgggccacacataaacaccaacactaatgatagctgatgagctaaaaataaaataatctcataatatcttaagaacgtttacaaatttgtgttgggccgcattcacagccatcctgggctgtgggttggacaagcttcatgtagaatgaggctctaattaaacatgaaattcactgtctcttgcttagaaggaactcttaaaaaaaaaaaagtatgaatggcacattgatctatggaggtttgtagttgtaaggagaccccacagatgttgcaaattctactccaggatcaagtcttcagaaagctcaggagtgaccaacaatagaacctcagtactggaagaggcctggtacccctctcgtccagtagttcccaatcctggctacagatagaatcctctggggagacttcacggcatatatatacactcatacataatattttatctgagttactctgcatttactgcttctatttctgagtcattttatatagtctgacctgaactagtatactgtctgtcagaattttgggccttatcaccttggaaaaagtagaaaactaaagttacaaacagtttaaaccagtaaaatctccttacttagaaaaatagcctaatgtaatcactttggcttgtatagaaagagcttttattgttaaattattactgttaaactaaatttggcctcagctgccctccatatggtaagtctctacaaaatcaactgcaacctagcttgctaagtgaccaaactgaaaatttaggggtatacttccgtaacaaatagctgagtggcagccagcttcagccaatggcaggctgccatctattcagaccatgcccaaataaagcaaattcggtgctgaaactaggaaagctgttcctgtacctcagttcattttccccaggatacatatgcctgcccagttgcagagcagagctctctgaacctcttctggttctgagggctgcccaatttgcaaacagttgtttgctcaattcaactctgttaaaactttagataaattgaacacctctggatatcatgtgacttgcctgtatgtttcagtgactgtgcatgtgctattgctgtgctaccgcttgccagtaagggtgaaatgtaaaaagtataataggactatagtgatgagtctgtaatcttaggatgttttaatgaaatgctttatttggaacactgttctcccagaccccataatctgtgtcacacataattttgctctttattactgataccagtatgaattattgactgcttatgattaacttcaagattatcctcaagattattttagtggcactaaaatacttaatccattacatttatataatgaatgttttataccctgcaaaatgactttatataccttatcttcattgaccttaacaaaacttgaggtggtattatccacgtagagaagatgaggttaaggttagagatgctcagacttgcctgagcttgaatggctgaaatggatacttggaccaagtactttttcttcagtgatctttctggggaccataattgctcctttatatgtgatgaaaagttagtggtctaggttatttctctggtctagactttgtccctgacaagtagtccttccctttctatcagtgtgtcatggaatgcgttccatggatctacctccatcagaatctcctggagtctctttaaagtgttgggtatctgggcccaattccagacccactaaatgagagcatctcagatgggccctggaaatacctgttttaagcaattgctatgggcaatttgattctcaggattgaccttttccttcttgtctctggattggaaatagaactacgtgcaaactgtctggtagctcttgttaaagaatgacaaataggccgggcacggtggctcatgcctgtaatcccagcactttgagaggccaaggcaggtggatcacgaggtcacaagattgagaccagcctgaccaacatggtgaaaccccgtctctactaaaaatagaaaaattaactgggcgtggtggcacgcgcctgtagtcccagctactcgggaggctgaggcaggagaattgcttgaacctgggaagcggagttgcagtgagccgagatcacgccactgcactccagcctggtgacggagcgagactgtctcagaaaaaaaaaaaaaaaaagacaaatagtagttgcagatatattttcagttcattggataattgaaaatacaatagtatgttgggtcagattaaaatgatagcctgagggactatttaagttagtgacagataaatccctctgccttacgtttaggaatattaacttctgtgattactagagactgttggccgcattaaattgtagttaactattgaatgttttcctagctaagaagcattttataattctttaaatttctattgaaaagctatctccaaagtgttagcactgtggagtgctattgaaaaatttgatcaaaaatttatcctaaattgtccatttgtttatctcaaatggacaaaattaaaaatatgacaccagtttgttctaaataattatggtaagttctctctctactcaggccttaaggtaagtagatatgaggtgataacgtgtgtgttagttcctgactcattccaagccaaatcttccatttttattctgtgcaggtaacattgtgttctaaatgttatagtagagtcttggcaattggactagtattgggaaaaggcaaaaatataccaaatgatcaacatggcaacttttaatgttttgaacagatttttgatatttcctgggatccatatcagccaaacagagtggttagctgtggagtaaaacacataaaggtaaagctttttgttttttaattttggtaccttgagtgcaaataattttaggtgtttgtatagataatttgatgttgagagactgctagactttacattttttttcttcaatatagagccctcttacctgtttctctgctcctgaagcaaactaacatcagctgatggggctctctcttagaaatgcaaagtaatgacaatcaagtgaagtgctccgcaggcagctgaaaaggaaattttatgttaattaaatatcgaactgaagactcataatacttgtgggattgcatgttttaaaacagtgcttattttaatgttgtgaagtaagtttttccattataatgaatatttacatatttgcatgtcaacactttgacatgttatgttcccttaaaagaaaggtgtcaagttgtgctctacatggaaatagaggaattcacagtacaaacctatctggaccattggtttttaaacgccccaatcttcctctagactacactctcatctgggtagacctacatttgcttcttactattttgttcacaagtaacaaaattaactgcatcaacatgctttgctctgacatagcaaaaatttctcctgacccctgggatatagcccaggatcttctttctctataggatcgtaaataatgtaagttaaagtccataaacaagagtataaggattactttcttgaatagagcatgcatggattctgtacaaaaatggtacatttctgtatgaatgaagattttcctctaaccaacccctcctattttgcagttcttttagtctagtttttcacgatccttcccattagtcttacttggttagaaggggacagaggataaaatactcaaataagtataagaaatatggaagacttacctaaagaatgttacaaaactctgcagaagaatgtaaaacaatacttgaacaaatggagtgacaatgttgattctggacacgtctaaaatttacaaatgtatcatttatctccaaatttatatttggtagaaatgcagttaaaatccctattacttttgtttttacctgacagaatttccctttaaattatcctaaattaatccggaagcattaaataatgacaataactatgaactttgggataaagaatcatgaagaggatatatgtaccactatttactaaagcataatagaatttaatttaaatgatacaagacttggatacaaagaaataaaaaaagctgaaaaatagaccttaatatgtatgacaacttagagtataatagcatctctaactggcaggcacaaatttatcaattttttagaaaaagtcaatacttcatactatacactaaaacaaagtctatatgaattaaagaggtaagtttcaaaaactataaaataactagaggaatatataggcaaatatttaactgctcaaattggagaaagatttttttaaaatgtaaaagcaaagaaatcgtaaggaataatactgatgcaactgtagaaatattaaaatattctgtataattccttttttccacaaaaagagggaaaccgcaaactagcaaaagtataagcaacacacaaaatagatactgggttgttctcaaaatgcaaagatctcttgcaaatccgtagaatggacaaagaacatagaaaactgacaaatagaaacactgttggccaatagacttatgaaaatgttaaaatctaattaaggaacacaaattttaaaataacagcattttaaatctatcaaatttatgattgaaagtaccgtatcttggcaaggattcagtgaatgaccactctcaaaccttgctggtagagaggggtaagctgataatggtctttcagccaagaaatttggaaatatttatccttagaaatgtcaattctctttgatccagtaatttcatatcttagaatctatcccaagcaaattgttagaagtatgaaccaagagctgactcattgctgagtaacttatcaatagcaaataaccaaatagaagatctgaaataaaccaaacagaagatctgaaaccacttaagtgtctctaggaagttgaataaaatgttacatccatatgatgaaacactgtacaatcataagttatgttttaaatgatgatattgggaaatattcaaaatctattatatggggaagtttacagtttactttgggggttgggttatggtgggattagatttgtggcttttttttctttaaaaacatttttatgtgggaaatacattagaaggacttctccaaatgttaagcagttatctctgggtaatgggttgatggataattttatcccttgtatacttcattgtaaaattattttacaacaatatatattccaaaataagaaaaaatttaaaaatggagaacaaaaattttagaggttccactactcaaaagtgtaacatattccatcaacactttagggcttcataaacatttaataatcctgtaccaagccctgatgtgtatatttttaatctaggaaaacatcagctgaaatctaggtagtttgctttattagcagcagctggaggctccttctgtgcttggtacagcatacctgaaagaccaaaaactcattcagtttaatatttgagtttgtactaggtgaaagaagaaaaacagacgccactttcaatttgcttgaagtttagccattaaaacattaagacagaatgttttggaagaaaggtaaaaatcaaagccctctatcgataaagatgacatcccagctggctagaagcatgttgtcaggatggagatgctgcttaggctgagcctcagtgggtgggtgagtttggtaggaagggtcgggaggcagaactaggcgaggggttgcacttctgtcaggagttaagagaggcattggtcacccatggaagtgtgagactggggagctgggtgggtccttggctcatgatatgttccaagattaccaatgttttcatcaccaaagaacctattccatagttttttttagggaacaaatattttgaaagatggcggccacaaaataaactagccaataaatcacgggttccttagcaatgttttattagtcaaagatgttatctgccaacgtgagtttctgatcagactaaaatatgaaaattgtttcagccatgagtaaaaaaaacatgtgagttcataatgatcctgatttctgttaggctgtggtgggtttctggaaatctgggaccctatcctgggagccatcatccatcctgtactcagtggtgaagaaacccaggaccctagggggttaggtgggaatctgactttgatttgtgattgtttccctctgcttgactctgggcaaccatttaatctccctgaggctgaattaatattcattcattcattctctctctctctctctctctctctctttctgtctctctctctctctctcagagagagatcactacctcctaaattaaagataattacattaaagagtatggaacccagtaggggcacaataatgttaatttcgttccccatttcctagggtcacaaaaatgatggcacaggtgagatttaagctcagcctctgactcctatagagctctttacactgagaaatttctttagtgaactaccttgccttaactttttattgggttctaactagatttgctgcttaattgatagaattctcctgattccttcctatctctttctgtccttggttaactctaacttttaaatcggtaaattctaaaagcagaaaagcagagacaaaattctgaaactttatttgaaacaagagctacttatcctgtttaaatttaattgtcttagcagacttggacattttttctaagcaaatacaagcatttttacctcaaagaatctggaatgtctacccagcaatactttattaattttgcttagaaatataatacatttaagcggacttcaaaaaattatttttgctgtctgtattctctatatccaattaccaggatttctccacttttttttccccagaaaacctaccttaacattgaatgattccagtcataaattgagtgcaaaatctttgtactcaaagaaaatactttcatctgaaatttgtatagctagggtgaaatcctttttggctttgtaaatcccctatgttttggcaaataggaaaattgcaattatctgaaacgaatgcttgaaaaacagtaacagttgagcatcggctgcttcactggttttatagcaaatgagcctaccgggtttgtggatactgttgagccgtctctagtcagagacagaagggacttcagggactacctagggctagatgaactcaaggtacctgccagctctaacaaaatttgcattacagtctgtgggtagagactgcagaagataaacaaggtctcctcatttgatgtgaatttaatgatgtgttgctaccctaaactgccactgttttccaagtaggaaatgcttctcaaaaagagataatatttcaggtatttgccattttctgcagaaaataacatacattttagggaatcatttgactctttggaatgttttcatgtgggccttataccatctgacctggtgacttgtcaataaacttttatgtagatcaagtctgaagataatgggttctattttttgtgactgtctgtctggaaatattcagataactcagacggggggtgtatatccaaagttaaaggacaaaataattattttaatcttcatgcatgaggaggtgtaaagagaaagggaactgtctgccttaagcattgctatgaacagcaagttctttggcatgttggtgcaaccagtaatcatttatgtctaatagtttgttcaggttcatagtaacagcttaaatgttttccaaagcttatacctaactagctttttcctagatctctttattctttattaaaaaaaactttattacaggtgtgtgctaccactccaggctaattatttttgtagagatggggttttgccatgttgcccaggatggtctctaactcctgggctcaagtgatctctctgccttggcttcccaaagtgctggtattacaggcatgagccactgcacctggctgctttattatttcaacatatacttcaacaccttttcattaataatacccaaagaaatgagttaccagagctgatacctttttctgagaagagaatccgatttggtccttcattgtgtatctgcccttcattcttgccaaggcatccctctattccttaaccccctgccacgcacacacataggacagccccccacccccagctgcctgaatcctggccaccttgggggtatagccatcccagaactgtttcctctagtacccaactactctgagaggaccatggtttttcctctcctacaggtgtaaaatagtacaatgttactgatttactcccacatgcctgccatgtggcttcatctcatcctgcttctctgaatccagatgcagtttcttcctcactgctgatccaagtcctactcttgttcattctgtttaattcaacttagttctctacctttgaatttcctgccacccgggcacagtctgaatatgctaccttaaaattatctcattgtttcatttgcctctgcattgattcagagttgtcaaagcaaagacaaagatttcagtattttttctaaccccattgaacccttatcttcagtgagctacttctgtttgctttccctcccctccagatggagatgaccatcctgtctaccttagcctattaaaggttttgataggatcaaataacttagcatatgcaaatagcccttataacctgagggggggctatatcaagggcagtgaggttattctagttgatacatgaaaactatgttaaggttttgagaggccaagtggggcagatcacctgaggtcaggagtttaagaccagcctggccaacatggtgaaaccccatctctactaaaaatacacaaaactagctgggtgcggaggcacatgcctgtagtcccagctactcaggaggctgaggcaggagaatcgcttgaacccaggaggcagaggttgcagtgagccaagatcgggccactgcactccaccctgggcagcagagtgagactctgtccccacctgcccccccaaaaaaactatgtcaatacaaaatattttgtgtctgtttaaccataggagtgtccttactgccttgtataaaattgctgaagctttgtgtatggtcttctacacaatggacacattttatgcaactaaaactgaaaagccgagtcaattatttgggtatatggaaatataactcatatttatgaaacgtttctaagtaacatttctacaatgaagatttataacacttaaagttagaaattatttccaaatatatgtacactaaaaatacctagatatagccgagtgcagtggctcacacctgtaattctagcactttgggaggccgaggagggcagattacttgaggccaggagttcgagaccagcctggccaacatggagaaaccctgtctctactacaaatacaaaaattagctgagcttggtggtgcactcctataatctcagctactcaggaggctgatacacaagaatcacttgaccctgggaggtagaggttgcagtgagctgagatggcgccattgcattccagaagttacagactatcacaattttcctttttatacttatctgtgtttctaaacctttctacaataaacctatactacttttataacttgataaaaaactaagcaaaacatgatttgtccacttgattccaactctgagaacattatcttctattaaatcaccattaaacaatgagcaaagctttgaaattttggaactttgaaagttttaaaagtgttgttataggcttttcttatgttcctggtagttagctaaaatgcttttgtgttacatgttgttatgttacagcaaagcaaattaacttatttgtgcctagcttggatagagcacattatgtgaaatgcactgaagtataaataaacaccaatgcaatacatccgaatactctatcttggagatctattttatcacttacattgtagttttggacactgtgtggaaatgccctgactgcaaaaagagggatatttggcaaaacaggggatcttcagaccatcctttgccttgcatgtgccaaagaagacatcacctactctggtgctttaaatggtgacatctatgtctggaaagggctcaatttagtccgcaccattcaaggagcacatagtgtaagtattaccttgtggaaatctgtgggtgacctaccaaataaggtaagaccacgaatccctccctgtatgtttcccttcttgctttagaatcagagaaccctgctgaacactccctactcatgataatttcccatattacatttgctcacctaaaggaaaatatatttcaaaagcatacaatgtaattagccctcaccttaactattaattgcttgatttatgtcatccacagtagtttgacagaacactagaactagctcatcagattcatcttataggcacttctcaaactttaatgtgcccatgagtttctggggaatcatgttaaaatgcagattctggctccataggtctgcgatgaagtcgccacagctcatcagtgacccatagtttgaacaggaaaggtgtagataacgattgctcttgtattggttggtaagatagattttcctcattctttatgttgaggtgccagggtgtcacctccacaccagtgtcatgagctcttaaggtacaatcagaaaccattgataactacatatcttctgatggtctgctcagtaagaacaaggagaaacttcttaccactctgctctcttttttgacacacatgaaaatgactacattgttgtatctacaaatgataaaattgtccctataaatgggaagatgatgtaaaaggcaaagcctatcatagtgaatggaaattgggtaaagatgttattggaaatggtaagcctttagcttattgcctccaaattgattccctatacccttaatatgaagaaaagtttaagcaactcttagagctatgacatttcagatctttcactatatgttgcaggtgaattttcttggcttcactaattatgaaacagctcttaaaataataggtcagtatttgtcctcattcacaaaagcagctgtcttagtaacctaatttctttttatactggatcttatgtcaacattatattcttgcagcacttttgaacaaaccaaataaagtattttcctgtggaggagcatcttgaaattcctaaaactatttcccatgtgaaaatcttcaaacgatgcttaacaagcgaacacaagtgctatttacattttcatttaggttcaagtgatacctttgtgagctcactgaggtacattttgggcacttttgtgcctatgaaactgttcatgttcctagcctcttatctctacttaattattttaggcagcaacttccatgaaacacctccatagttgtcttttctctctaagggccacttatcacataaaataatttgattcccatatctgcattaattatatttttgaatttttttaaactgtaatctttttagtagtggtaaaagagcacttgaactagtttgcttttattattatgattttttaaatgtagctgagatgaacagtgttataaatggctacttggtctattgtcagcatttcaatagagaacaaaggggttttatttttgtttttgacttgctatgtttttaaatcaacattcaactgtatctattcattatacttaggatggttgcaccattgagtattacctgttttaatcaacaggctggaatctttagcatgtatgcttgtgaagaaggctttgccactggtgggcgagatgggtgtatacgactgtgggacactgatttcaaaccaataaccaaaattgatctcagggagacagaacaaggatacaaaggtaatatatgtgttaagcttacctgtaactctggatgtgaaatataatgtgaagttctgtattcatatttgtttctctgtaccccattttaaaaaggcagtttatataaatatattgaatacaagcaaaagtatgttaaaagtaaatggatgtcctttttcctaattcgcacaaatgcatctgcatgaaccagcaatgctgcagccaaaataagcattctgatgaagttgctgaggtttcttaggagatgggattgtcagtgacaaaactgagacgttctagacaagttggttaccattaaagtgaatgtacccagcctctgaaaacaaacaaatgagaggagaaatgagacaaattttgttttaaatagctttaaagtagtagataattatagtagtagggattaagagcatgggctcagtcatgtggggtgggttcaaactctttttacctatgagagagttaagaaattgaacggcagtctcaaatttcggggcatctgtttcctcatctataaaatggagataatactagcaccagcctcccatagttgtatgaggattaaatatacttagaaaatgctcaggatgaggactaaatatacttgcaaagcgcacttagcactcaaactgttagctattctcaccatatatagagtgtatatatcagaatacaatacatcttttaaaattctcatggtaggcctgttaccttttggcagacaaagaatttacagccgagaaagattaaagtggaaaatgtaaataggtaagacaagaggaagtcatagcactgttaatacgctaagcacaggttgggaggttctgttcactccccacaggtgggccacagaccctgcgccaagggaggggtacatggtactgtgagccatgggggtccacaggatgaaaacttacccatcgttgttgtgaaggggaatctttttcagtgccgagatgagggagaaatttcctgagcatcttttagagaagaccctgtgacatagggctcaaagtcctcaacaggcctgaaacgagttgtttctcctgggctgttcctcatgaagcccccgctgtgtgacctgatggcgatgctgccacagaggttgttccataggccagatcatgtggcagtgcgcggtgctctctgccggccttaggtagatttcaaaggactgggagaaaacagcctagacggcatatccttcaggccatccttaaatagtgttgtttgcagcaaaactttgccaacagttgagcaacagggaaatgagctggatattgtacttcctgtttatacctggatgccagctgctttatgtatctgtgaaatacaaaaatgtgcatctaagtcaactaatccaggattggactcttgtcttctcacggaggctcaggatgctggtgtgcatacgtttctgaatactaggcacagagtttggcataggaagttgtggaatttggtgtctacctcaatgtagggacaaggagatcgaaggccttaagttctctgccatagagtgtgggccagggaaacttgatccggaaaaaacatgccaaacagatataagcttgcaagtacccgtaagagcaattttttttaagtacagtagccaaaaatgtttggtcctgaaccatgaaacttcttggtatatctttcaaggtaaaccagaaaccaaaacatgtacttagagagcagagtcaacttgccagatgggattagtgaccataaactgcctaaacgttggggagtaccaaccaggattcatgactctttttggcagttactccatttaactaatccaaaaattgtatcacataattaaggcataaattttaaagcatggggatcagctaagaagccattggtttacgctgctatacttttctgcccaatactgagtccttgagcctggctctcctgggagagttcagggaccagttctgaatgaggatctgtgtaaccaggtgtggtactgatcacatcagccccacagccaactcccatctacagagttaggacagtcagcgacgccctccgttatacatcagtctcagattcccgccccatccttaccaagatcaaagcacatctggctggtacacggtggacactgggaacccgaaacaagcctgcacctcataggatgtgcctgccctgtggtgcctgggcttggcgttgaccagggattggtgtgcatcttagatggcttactgataaggcggtagcctgcattttgtagggagaaacagattgtgcttttaaaggatggtatagatcatgttccagtttgagtcccagggagtcggagagggcacaggggctgggatggagctcctgggagagtggagatggcactgcttagcatgcagccccacagtgtggatgctgtggatgatgttaattttagaattgctgctgacgaccagtactcttaattgcttagtattttactttaaactgattaatatatctttttaaaactttgctttaaactaatatttgtgacatgagtttaatatgctggggtttaatttttgcccttggagcacccacctaaaattatcctctccccctggcttgggcaacattgtcacaaaaggccactgtgtatcatcaagcatcaaaagagatgccttcattccagtcctcagtgaaaaaacaatgtacatgtagcatcaaaagaagaaaggctcctggtttgaattactggtaacaactaaagtctggcccacccattgcttccaacttagggagttcttgagcctgcatggacagggtcatgtggggaaacttgctctgaatccctctctaaggtgctctgttgcgctcagccaggccttggtgccattattgcactgaagcaaggaaggaggatgttgagttccagagccaccttccatagctccgaacagggagagactctcagaaccggccctcctgtggtcttggaggctggctgcctgggccatcctgtgatggggcagcctctccaaggcaagtggaggtgtgccccaaatccaaagtgaggtagaagacccaacacaagtgtaggaattaaaatacataggatttgaggagataaaagtaatcaagatgtaaatagctttctggcgtagctcccccttcagccaggcaataccatacccttggttgtttcaacattagcaaagagctgagcaaataaaagggaaggaaagagggtgggaaaagagcaaaagaaagcagagtggacagaagatggtcaggtgtcctgtcctccccacccccccgccaacccctcatcccttccctcaaagaaggcttggccttctgctccacctctctttgcctcaaacaaaccaagtatattcgaaaggaacagattcaggcagagcagtgttagacttccttgccctcagtttggacatgaagcttccttgttctcagtttggacatgacagttttatttttataagaactatcttgatataaatgagctttcttctgtatttttgctatttgtgaaacagcgacactcgaattcatttcaatggaaatgtagcgatttctcatcttactcaaacagccaaatagttttctaaacaaatttagcaagagaattaatcatggccacggcccagttcccatgacatggtatgggtacttttctatgttctataaatttaaaagtattagcaaaaattaagaaattgctgcttactagtgtttaggaatctgagggtatttataaagatcacacttagtgtgccacctgtaaagacttctgttgctcctcctgtagacatctataagatttacaaaatgaatctgacaatttccaagttgtttaatggaaatctttgcaagattggcatacatttgcatcttctaataactattaactgttagccatcaagaaagaagttttaaaatgaactaagatggatactaagctcagaaaaaaatgatatggctttgtaataaagtgacattattaattcttttacatctttgtagtagcttgagctaattaggacacttgacttacagtaaaaacaattaaccccactttaggttaagcgtgaatgattggagatgggtcacattcacatcaagaattggttagtgtcagatctgattctcagggctccctcccttctccccaagggttagtcaaagaaaatgtcactcacatgatgaggagggccatccctcagtgaaagggaattgtagagttttatttgcaccggtgacttgtgcatcttttgtgagttattgcatttttgctgactgggtgttcaaacaagtttctgtagcaacaacaacacaagatgatataaaccaacaacctaattcacccaggatccttcatctgcaattctcaaagccaaaaggttcagaataccagaagattttctaaataactaattcggcagcaaaacttgacctgatatgaggctactgggtgtctttatatattttgttatagaaatatttaatttcaagatgctgcctcagtttctgctggatatattacaagtccaaaatccacatttttctgaattccaaaatgcatctggcaccaaaggatttcagctgtatggggtggttgtcctccaatatacatcttagtgaatataaaattctggaattttcaggctgggagacaccctggatgtaaggcggcggtggcggggcatggggagaactccctcacttcatggatggtacaatgaggcccagggtcattagcatcaagctaattgtaaactgaagtcactcactcatacctcacaccaaacttcacaacagtgcatgctgagtctgatcacttttaaaacacatttatgatctgggtaaaataatgaagcttgagtaacttatagtggtggcaagaaaagccaaaattcttaaagtccatcaaccaaaatgaattacttctaggataataaaacactttgggttaatggttataaatgattctgtctaaaggaatacagtaattattcacacagtataagatgtattatttacttatttgtccactcagtaaacatttattaaacatccaagtgccagatacgtgcctaggaactgaataggaagtcctgaaaagtatacttcagtcaagattatattttaggtgtgagtggaggtcgggggagttctgtgggttttaactaccaacacatatttattgagttgttgctgtgtctaatggactataaactccgcatccagaaagaacctgcattaggtgaatcactgagcaagaattagaggccaaagttccaggacatgagatgccctgcttagacttgtcactatctccactgaaccttctctggtcaggccaccaccatcttttacatagaatattgcagttgctttgtaagttgcattcctgcttcgaccaccatcctctgcacagcagctagagggattatttgaactttatgtgagccagatcacataattgctttcctcaaaaccctgcaatgattcatcttacccacagtcaaagtccttatggcagccaccaccctccgcattgcgctgcttcgccctggctgctccttcccctcgctgcttctccctctgcctgtgacactcttgcctagaatctgcatgactacttccctcctctccttcaaacctttgctcaaataaagcctatgctgatgatctcttctagaattgcaactcattctgcctctaccactccaagtattccaaatccccttctcccgggtttacctttcaccttgtaacatacagtataatttctgtgttatgttcttggctattgtctgtttccacaaaggtagggatctttgttcactgatgcctcccacccacttaggacgtgcctagtgtgtgctggagtcctggaagtagctgtcaggtgaatgaaaagtgtcataggactggagggtggagccttgtggaggagcgcaagtgatgaggatgcagaaggaggaacagataacttggtttctttgtgtcaacctgtgacatgcaagcttgcactccaagggccaactacaggaggtcttagaggtttaggcaggcatgtggcataatcggatctccacttagttctcctgccccagagcagagagcagactggggtaggataggatcagaggtaggagcccaggtggttgttccagagtgttcatgcttattactgtttttactcctctgagtactgcgatggtcagatagtctagcagctctcaaccaggagtgattttttggacatttggcagtgtctggagacatttttgattgtcgcaactgcagagttgcgactggcatctatggatagaggccagggaagctgctaaaagtattacagtggacaggagagccaccacaacaaagaattacccagccccaaatgttgatagtgttgttgttaagatcccttgcagagaacgtccaaaagaccaactctcaaacctgagaacacccttgtttacgatagaagcaaaataagcacatcctattctccagtcccgcgggcggctccattacttacctcttgactccttgcctctgtcaccgctctccctgtgtgcccaccatttttctctgggcttgcccttcagcctcactgttctgctgagaaggtagaagaacactgcagaggcccgagcctcaggagctggagacagatttgcagccaggagatgtggtgtcactgtgtgcgcaagttccgtgtgtgacatggtgtcagagggctgctggcctggcttgtagtaattcctctgtaaataactctccttagccagccttatgtaaaagctagcctgggtgggtttcctccctgggtgggaggccatgggcttggctatgtgttctcatcttctgatatctcactaggctttgtgtatctttcacagttcccgtggctgtagaattttggatcctgcggagtgggttttgaaatgagcagagattttgtaaaaagaaatctttcctatgaattctgctggagattctcaggcagggagcctttgtgaacaggagcagcaggtcataggcagtccacgcttaggatgacctgcagccccagccctgcgactctcccagctcagggtcagtgctgaatgcccactctgtggtggcctttgtggtacacactctacacacaggatcccatttaatcctcaaactcccctgggggtcccctggcagggaggcttctcaggctgaggtctgggcagtcacacagggcctggtactcaggagggccctgcggttggttgcatgctttgctgtcacttgcttggaattcctaatcgttttttagcaaggggccccacacttctgttttgcactgggctccaaaatcattggtgtttatgaatccctggggagatgcatgtctttcctccttcatttctttcacatttccaaactctgtcttcagcattacccttagaacatcagaagtccctgcaaggcccagagctcctgtgcccaggatccaggctccctaggtggcctcagccaccccttcctgaggggctgcaagggcggggggttttgaagatctctgctgtcttttccacaccctctaccaatactccctcttaagtttgggtgaaattactcttcctctctctcttgttcttattaccttttaacctcttgcactcaaggcattccctggttttgcatccttaataaggttaggtttacaggagacagccacaaccttgtcttgtttcaccttcagtaccatgtcctgggcatacattcacagatacaggaaataactttgtggggaagggtattaactccacacttgaactgcctgaatcctcattttttttccccctattgctagcttgctctgtgacttgaggcaagtaatacaaactttctatgctgttatttcctcatcggttcagcacgtatttactagccccgttgagggcctggcgctgtccatggggttaatgataatgccacctcctaagcactcacgggcactcacgggcacacggcttggttaagttggtgagaatccttactgcccacctgcagggcttgcttgtttatctcaaagtcgacttctcacaggtgctactgtcttttttgtcatttgctcatcatctttgggctttccgatccagtggggtagagtttgccagcatgtgactgaagaaccactgcattagaatcagctggtgacctgctgggcactctgaattttcaacaatctgacatgcaagaacacactaggtggagaatggcttgagcaggcagtggttctcagccctggggagctaaaagtaatgaagtcttgctctggtccagaccaactgggaggaatatctgggaggggcgcaagcatctgtgtcttttaaatgctctctctgtagattctggtgtacattgagggttgggaacaaccatgcctggccctttaccatatcaggccttggaacatgggttttaagaacactattaaatacgagcctctgcctgctttcagttttcccctcttggaccaaataattgggagaaaaggccattttcttccccaaatggtttgttctctttgtgtgctggaacatagccttttcctctgtgagtttgcagtgccagcagatcaaaattataatagcaaatgacaaaagctaagttgtaagataaggcagagtaactaagactctaggaaaggcccatagggcacttcatagttcctggcactgccaccttacagggctcggatgtgaccacacatacagcaagttgttctgtgctgagatgtgaacttaatagaaagatcctgacctagcacaaaacccgcgggttaaaataatagcataatgtattgattcattcctcagtgccagacactgggtcatgtgttgttgtgttgaattctcacaatgctatgaagtgtgagtgctaataatctccactttacagatggaggaactaacgatatgaatgactaaataccttaccatgtcacacagctggcaacggctggtatataaatccagttcatatatttaactgttcaaaataaactagtggtagaaaataagcaatgtcccttagtaatgaggtctgatttgatattcacagactagatctccccatggccaggcttcaggactgtagcagagggaattggaaggttgctgtttctcttctctggtctgagtataaaatcagggccacggactggtgaggatttggtcttggcataagaggatttttttggtttagatgggtgatttgctctctaccgccatctgctggctctctgtaccaagcataggcccaagctccacgtttctcatcacaagtggcacagggtatggtgtccaaatgtggacacctcatctgtgtggtgaaacgccttcagttcacagtgtcaaaagtaacaatgatgtgtatttctccaggaaagagaacttctgtggttttaaataatgaggatggtttctcctgtttctcttaactactgatggatttgtaaccatattccaaatactagcttatatttctctgactcccagagcagaatagaaagcagtataagacagcttcgttgccttctaatgctgcagctgccttggtcagcccagctgggacatcatgattacatttctgttctctgggtttgtgtcagaagtagaaactaagcctggatagacaggagaagggaattaatgtcagaactttgtcagggatctgccattcaccaaggtctcaccagaaggttcccagaagagactgtgtggttctctttaccactcttgcatgcagaagaacaattaggttaaaaaaggatggcaatgggatgttattaggaaacatgaatacagcttttgacacactgatgtcttcctttttaaaatggttatctaaggaatgagagtgacctggtattgtatctattgcctggtggacagacgccatgagattgacttgtctgatgtgacaaaagacaattgatgtgttgaaagaactgagtacttagggagagacgcagttgctctctgagagaaaatgttcacagctcattaagttgatattgcaagcaatgaaaatgtagcaactccttctcttgttctcttcccttccacccatgtgtagccagaaataatccttgctaagctccgcctttacgttggttagttcagtggaaccctttttcaaatgaaatcggagatggtgaggtgtcaagggaaatgcagcagtgggatcctcaaactcccgcctcttgctgtcctatttcctggccctctccttgccaggaacctggcactcttctgaggaatgcaagagctccctggatatggtctgaaaaacactgagtgccatgtgacttgactggttcattagtctgggctgagttggaaggttttggtctttgttcctgagcctcttaaaattttttaaaagagaggatatatagatatatatttaatgtcgatatttaattccaggttgtgggttattataatcttttttccttgctgaatttattcccccaaataaggttaaaaatagcaggacaataaatacagtaaaaaagtagattatttagtttttgctgatgttggaaaatcattaactctttgcttcctgataatgctgaagagtacagcattaaatcctttctgtaataaagcataaatagatacttgaccaaatacagctccaggcccttgggacaaattcaagtcatttggccttgagaggccagacatgctgttggaggccttgggagaactggtgtgttcatgcttacagtgaagccatggattccagacctgcctggaaaagggccgtgtctttaaaacaatcaatggcattataaaaggactatgatctgaatattcaataacagttaaaatatataacgtatcactaagatgtaatgtatatgtctatatctgtatacaatgtatgtgtatataggtacacatatacatttgcatcactttagtttttgatgcatggatatctgcttacatatgtctggcccctttttcaaatgtaatcttcattacggtaggggcctatcttgttcactgttaagctccactgtcaggcacagagtagtgctgaataaaaatttctgaaataaaggaatgaatatatcccatctttgaatgttcttactgagtaacaagggtggtatcttttatttcttggcatctccaaggactcaaatatttgattttgatgttttatttcatttgctcagtaatctttattgagcatctaccacgtgacagtcactgtgccaggtattgaggatatagcagtaaataaaactgataaaactctcttcacagacctttctattctactgagaggaagcagacaataaatacagtaaaagtagattatttgttttttgctgatgttgaaatatcactgactcttcttccttcctgatgatgctgaagagcaaagcattaaaccctttgtgtaataaaagtagatgatgcaaagcctgctagggagacaactaattcagcccctcctcccaagcccctgcaggagctgagaaaaacaccagggagaaaacgggaatatgttgactcctgagtggtaatgaaaccccgaaaagggtaggcaaagagatcaggacaaggagggggggctgtggcaacaggatcatgggcgcaaggccgtgtggttctctgcagctgagctgcatgccctgtcagcttgcaatgacatcctgactgctttcaccatacatctgtccttcccatccttgaaagcccatcctgatgtttgcagtggaggattttgattaattgaccctgaactactgttgccagggtgtctctactcctcctggcgggaataatacatcggcctgtgtgctttttcccaccatttcaagacctgtagcaatgaattcagaggaaggagtaaagacagttatctcatgtatttgtttaaagccttatgccttgaaaaactactttctcttaataaatgcatttatctcattggatcctctcgggaccacagtgaagtgattaagatcaagattatagttaggatgtccgcgtaccccaaattaccccttctgttgtcccagcatcccagctggtttagtatttgtcttggcttttttttttttttttttcttttgagacaatcttgctctgtcgcccaggctggagtacaatggcacaatctcagctcactgcaagtccctccgcctcccaggctcatgccattctcgtgcctcagccacccgggtagctgggaatacaggtgcgtgctaccatgtccagctaatttttctatttttagtagagacgggatttcaccatgttggccaagctggtctcaagctcctggcctcaagcgatctgcctgcctcagcctcccaaagtgttgggattacaggcatgagccaccgtgccttgccattttttttttaatagactttattttttaggacagtttaggttcagaacaaaattgagaatgtagagagacttaccatataccccttcccacccacaacacacatacatagcttccctcactatcaatgtgccccaccagagtggtacatttgttccagtgggtgaagctaccttgacgtgtcattatcacccagatgccgtagttcatgttagagttcactcttggtggcgtatattctgtgggttttgacaaatgtgtaatgacatgtctccaccattatagtatcctacaggatagtttcactgccctaaaaatcctccatactctgcctgttcatcactctgcctatttatctctctgccccagatttttaattttgcagtaaacagtttttagaatgttataattgaaaatactttgatagaactatttagtaggtctttcaacataagaaagctgcttccttagtcaaatacttcaaagtattatgtaaatttagttttagagcctcttaaaggcgttctaattggaatgacagattacttggtcaccataattacagtctatatcttaaggggagaaaaattggtccccagcaaggaaagaatactcctatgtctagccagctggacctagagcaggagtagaggccaagtcctcgaacgtctgatactttctatcccagagacacagtgcctgctggggaggcaaattggagcccatcacatcctggccttgttttaaagtatttaggaaattgatattgcttctgtatttctaattcggattcaaaaactcactgcctaaacaaataacaaacccagtaaggaacagaacagactgcaaaaaatccaagatactgagactcaggcaagtgaggacctgcctagggaggatgaaatagtactactgagagggacgtgtggactttaaaggagtactatgcttttggagaagaggcttgtggagaagattccataaattaagtcggtgaagaatagtattttcactgataaatgtttgatggtattttgagattgaaattggagtttcatttgcatatttctgagacatggtgcatctgtttattccgtaggatatatctagattctgatcaaatatgtattaaacttgtttaatatgatcatcagctgttctgtagtgtcacccacgtataattttaacacaatgttattcctaaaggttgaactgattcttctctgatagcaaatctgaaggaaattattctgaaggttaggttttcatgaagaccaatttatcatcttatatttacttgatgatatagtatttaaaatacattctactgtttaagaccagcctgggcaccacatagcaagaccttgtctctagaaagaaaaaaaactagtctaggcatggtgttgcacacctgtagtcccagttacttgggagggtgaagcaggaggattactttgagccccggaagtcgaggcttcagtgagctacagtgctaccacactccagcctgggcaacagagtgagaccttgtctctaaaaaataaaaacaaacaatcctgctgtagaaacacatagttatcctaagtcaaggaaaagcagccactcttttgcaaactagattacaaggggtggaggaaacatccagcgcttgtaagaaaataacacagaatgggctgggcgtggtggctcatgcctgtaaacccagcactttgggagtccgaggcgggcggatcacgaggtcaggagatcgagaccatcctggctaacacggtgaaaccccgtctccactaaaaatacaaaaattagccgggtgtggtggtgggcatctgtagtcccagctacttgggaggctgaggcaggagaatggcgtgaacccgggaggcggaggctgcagtgagctgagatcgggccactgcactctatagtctgggtgacagagcaagactccatctcaaaaaaaaaaaaaaaaaaagcacaaagaatggtggcagagttgattctctgcctccaagagtctttaagatgtgtcacatttgatggtatcctggttaaagggcatttactttagggttttgtgtgtgtgtgtgtgtgtgtgtgtgtgtgtgtgtgtgtgaatagtgtgaagatttgcttttgttttacttatttttgtcaggcctctctatccggagcgtgtgctggaaagcagaccgccttctagcagggacccaggacagtgagatatttgaagtgattgtgcgagagcgagacaagccgatgttgatcctacagggccactgcgagggtgagctctgggctctggccctgcaccccaagaagcctctggctgtgacaggcagcgatgaccgctctgtcaggtgaggccctaccgccgtcacctctctgacttctttgagatggatttatttgcccaaatttgcttattaatagaaggataaagtgcagaacagaaccacacagtttccaaatgaaacgttaagacatttagctcatcaagtgggtttttggcattttgctcctgctgttgtctttcttggctgcatcttaaatcatggaaatgttttttagaagtgaaaaatgcttcaatactggtgatgctggcttccagatctttctaattggagatttatgagctaagcacactcatctatgatgaaaccatattgtcccctcgtgcccttggtcttctgcagggggctgcatggagattttacaattttgttaaaggctctctcattcatcatcattagaacttaaattctgattctcaaaattgtctttagcacatgaataagctattatttctttttaaagtctcagatgaaattttgaacagcatcatcagatgaaagaatcatggggcctgagaaagtagtttactcggagcctccagctttcttgctgtggatcatttttattcttttgagagcccaactgggtaaaatgagcacaatgacttatgattccagtatttttgtacctattaaaggaatgaacatatgacttaaaggtttgggatgaagaatgttaccccaatttcagtattttattacttagtgctgagctttagatatgctcaatgacaaacaggccagaaagagggagagtgtgagaggaacagactgatcaatcgattgaatggctactgcctctgggttttgatagctaatatagaacaatgcaaactggactaaagctcactagttcccacctcccttattttgtgtgtttatgagtcgcatcaaaatacaattagtgtagtcattaattctgttttttccatctctaccaagcacgaaaacctcattgatctaaaaatcagtgagaaaaactaaaacaactgttgttctctccttgtgtgacataaatggttatttggtttatacttcactttactcacttctccttttttgtttttgtctttctgttactcttgaattttcccgcttattcagacacgtgtgaaactcatacccatccagaaagaagtgatttcaaggaagtccttcgcttttatgtttcaacaattgttaagtctcagaattgcaaacatccttgaggagccctgactgccagaatcttattccctttaaccattaatttgactagaatctttaatacatttttacactaagtattaaaatttaggaaggctaaaagtcataatttcttgagaaagatgagcatagtgacttcagagggatagtaccatttactgaggagtgatggtttctttactagtaaagcaagggttacattgcttaaaatagtacaaggttgaaacagcatgagatcatgcatgatggatgaggtattgagaacatactcagcttgaggctgcacagtacaggctgcctaagggaccggtaagctatttactgtgcagctcagcatggaagggatgtgccccatcccttctgatggcagaatgctttgagagaaaccgtgctgcatgtgacttattcttgtctgtctgttgcagagctctaggttctcagtctcccagacactagtttgtgttatcagaagactatattttaaaaagtactaattgatggaagtcagataccacaattgcacccaacatgtaaagccttatttctatcttcagatgtttcattcaggctcactcagtttggggtgcctggatttaggtgttgtggggatgggaatgtttgctgaaagctttgtttgagctgcaattgcccctcgtttgccacttctccagcagtgactgtgcttactggccaggagtcctgtgaggtgtccacccccacaaaagtggacccatcacttgggcgcccagggaagcttgtgaggagcaacagagggggatatcatttgctcttcttcatcttggacacattttcttcctaggaaggccaacaaatgtaacatatatttcaatctgtgtgtgctgaaataactattactggaagcacttttatatatttacatacatatataattatattgattatgtatactgatatgtagatatatagatatatatttatattgatctatatattgagagatatatatttgtgttgatatatatttatattgagaaagagatatattgatacataatttttttttttttttttgagacagggccttgctctgtttcccaggctggagtgtagtagtatgaacatagctaactgcaaccttgaactcctaggctcaagctatcctcctacctcagcctcccaagtagctgggattacaggcatgccccaccacacccagctatttttaaaatcttttttagagatggagtctcaccatgttgctcaggctggtcttgaactcctgggctcaagcaatcttcctgccttggcctcccaaagtgctgggattataggcatgagccactgtgtctggcgcatactttttaaaaagctaataataatggcatcttatcctgtaagtactttttaacatgtatgtgtgatgaacaacccttggtatacataaaggaccacttaatttccaaagtgaaagtaatattttgtatgaagtagtatttttttttttttggagacagggccttgcactgacacccaggctggagtgcggtggcaggatcagccttgaactcctgggcttaagtgatcctcctgcctgtgccccccaagtagctggggctacaggcacacactaccacatccagctaatttttgtattttttgtagagtctgtgtctcattatattgcccaggctattctcgaactcctgggctcaagtgttcctcctgccatggcctcccaaagtgctgggatgacaggcgttgagccatcatgcccagccttaaattttttttttgttctgtgaatctcaaaatctttggaaatgttacctcatttgataattcttgctggtttccttcaaatcatgaaaatgacccaaagatgcactaaaacacctttccacactcgctgacaggccatgataaagggctctggtgtgaagttcctatgtcttttcttgttactgttggtgtggtgagcagcccttcttgccttgggctggccgatgaccatgggaagttggttttgttttgttttgacttcgttcttgtgcctaggctgtggagcctggctgatcatgccttgatcgcccgctgtaacatggaagaggcggttcgcagtgtagctttcagccccgacggatctcagctggccctgggcatgaaggacggctctttcattgttctccgagtcaggcacgtactgatgttgaaaatggtatttagaaatgctctcgtgttaaatgttacaattttcctggtcataatacatgctaggaccttaggaaaaatccatttagccattcaaataggaatactatagatctacgatcccctatctgtaattctgaagtcctaacactctgaaaatacaaaattatttgataatttggcagcacagtctaacccaacagactgatgtgaggctgtttataatctagtaatctcttagtagaaataatcatgtgtcatgtgacttgctgcaaaattattgtgtttaatacagattgctgccccagcccccactggggatgttacatgatacattgtgtatgaacctttctaaaatctaatgaataatgaattcccaagcacatctaattccaagggttttggataaaagattgtgggctttgtagtaagccaagaaaagaggaagaaagaataaagcagcacccaacagcaccagatgtttagaggtgagctttagtaaaagatttcttctacccataattgatactaaaatggaatatttcctatttactgacatcctatatactttttactgaaaaaaattatgacccactcttgtaattcctctgaatgcatttgtcgttctctcgactcacatgttttgtaattatagaaaataaatgcagctataaagtaaatatttcccgctttgcacagagaattctccatagctttgattggagaatggtcttagcacagtttattacactacattctcactaccaaccacacataactcattactgaactagtgggcaacattttctttctctgcttagtgacgtgtgaaaagatggctgagtaccagatttctttttcgatggacttctcaagcttccacactacacacacacacacacacacacacacataaatttccagacacctattttatgacattctagtacaccataatgctattaataaatgatagcaggtatgagcgactgttatgtagaacgattatttgctattctttatgtattcagtttatttggagttgatgaagccatctttactggctcaggggacctgctagttgtcataatcctgtctcacaattgtagggaaaaaacaaccccagtgagctttccagtgtgagcagaaattcttaaaagaatctggtcagaaacaaaacaaaatattccagtgactcactgtattcatgacagtgaaatgttgaatgattacatcacaatttaacatttaaaaaggtaattttcttcagctgcttttttgacttgctctttttgcgacaataggtatcaagcttaacagtcactcgtttcttaaagtataaaaaagatgatttatttatgttaatcttgatacagtctccctttctccatggcgtatttttaaaacaatttgacaaaccccaacttttgaaacaaaaattttagggaaaaataatatatagttaaacatgaaagcaaatgtgcatttctttttaaaattttaaaaatcgatacataatagatacacatattttcagggtacatgtaattgaatacattcatataattcgtgaagatcaaatcagtgtaattgggctatccatcaccttaaatattttttctttatgctagagacatttgaattattttctcccatttggaaatatctgatagattattataacctatagttactccactgatctatcaaacgctggatcttatttcttctatcacactgcagtttgtgcccattaatctacttctcttcatcacaaatatgcacttaattaaattttttgtttttactttggaagcccaaaatatcatttaaacagtttgttattctcctaaaatgccataaattttaagacggagtcttgctctgtcgcccaagctggagtgcagtggtgccatcttgactcactgcaaactctacctcccaggttcacgccattctcctgcctcagcctcccgattagctgggactacaggcgcctgccaccacggccggctaattttttgtatttttcatagagatagggtttcaccttgttatccaggatggtctcaatctcctgacctcgtgatccgtctgcctcggcctcccaaagtgctgggattacaggcgtaagccaccgcgcccggccaatgccataaattttaaataataacattttatatatttactcaaaagttaatcctttaattcctgcaggtttggttctctttcaacacacttctttttctgacacatatattttaaaacttggattttctatttgtagaattgctgcttatcgttttgctttttattcttacagagatatgacagaagtagttcacatcaaagatcgaaaagaagtcattcatgaaatgaaattttctccagatggttcttaccttgcagtgggatccaatgatggcccagtagatgtctatgctgttgcccagaggtataagaaaattggagaatgcagcaagtcccttagtttcatcacgcatattgactggtccttggatagtaaatacttacaaactaatgacggtgcaggagaacgattgttctacagaatgccatgtaagtcatgtggaggccttggatgtttctggaaagcaaaattttgaaccaggtgaaggaaatacaggacaagtgtcatggctcttttagaatttgtacagcaggttttctggtttttgccggaaagcacccccacctcagggcaaggaatgttttctgtcgcaagatcctaaataacagacattcaaaggaaaggtatgagttggaacatgttaaactaaaagttgctgcacaacaagggagatcgtgaatgaaatgtaaagacaaggcatagactaggcataaattcttgccattgttataatggacaaaagatatatatctagaatatataaagaatgcctaaggataagagcaaggaaaaaaaaacattagaaaaatgggcaaatctcacatgaccaataaaagactaggaatcagggaaatgatcattaaaacaacagtaaagtaccattttacactatttagactggcaaaagtctgatggcgagaagaggggaaatggaaaccacatatactgctggtgagaacatgcactaaggcatgtgcgcacaaggatgtttgtgacacaatgcctaaatgtttatcagcatgaggagagttgagttaaatgtggtgtagtcatataatggaatactttaaagaacttgaataaattaaactagagctacttgcatcagtagggatacatctcaaaaatatgctgagcaaacaaaagaaagttgtggaatgatatatacagtgtatggtcatttatataaacttttagcacatgaaaaaattctgtattatttatgaccatatacacatgtagtaaatgttttaacaatgcatgggaatgatacctcattcaggatgttggttaccgctgagaagcagagatgatcttggaaagaataacccaatgaggccaggcatggtggctcatgcctgtaatcctagcacttttggagactgaggcgggtggatcacttgaggtcaggagttcgaaatcaacctggccaacatggtgaagtcccatctctgctaaagatacaaaaaaaaatcagccaggcgcggtggcgggcacctgtatttccagctacttgggaggctaaggcggcagaattgcttgaacccaggaggtggaggttgcagcgagctgagatcgcaccactgcactccagcctgggtgacagagtgagactccatctcaaaataaataaataataaataaatttagaaaaaaagcccaatggattttaactctgaaacattttctttaaaattctgtgataaagacataatgttaggatttgttgaaactgtggtgcaacacttgtacactatagtagtctgtataattttctgtatgctcgaagtatttcatagttttttaaagtagagaaaatctgaaacaattgtagaaccaactttcaggtatttggatgttcatgacctgtttagttcattatccaagtcttttgctttatctgttatttcttctttattcctgatctttgcccatttcattgttcattaatgtgtacctaaaaagttgactaaatggtgataatgcaaaatagtcataatgcttctgtcagtgccttgcacacacaattctgcagcagggttagaaatgaatgaaaatgaactggaggtatcatccgtgggtttcagcttgttgggcaataatactcccatcgtaacacagatatccagggatagtcggctacattatcattaggaaaactggttcctgccagaatagaaaagaatagtctattgaaattttagaaaaaatggccctgggagtattagaaactctgagatcagcttagaactccaacacaacatttcaagatttaagtcttcaaagatttgaggatcatagtccttatttacttggattgttttagtcccagatctttgttcttcataattggaatctcttactggttatttggtgaaatgtgcccattgggattttttaaatgctatttttgtgaccccaccataacttttataagagattcatctgacttacataatactcatttattaacatttagtttgtgtgatgctaaaataaatgtcacaaataagactctgccttatcaaattcttcagtgtaccattgcagaaatatgtatttctttgttttctttgcttgacgttacttcatatattttttctatgtgaaaaaatattaaacacatgtttatcatttgcaataataaaataccatcctgttcaggggtggcatcataatttacttcatcactgtcttattattgggtatttgagcttatttctagtatctttgttggtccagctgttggaattccaaatgcccctgtactggtggaattttctctcctgagttacttcctaggactgtattctccaaggcaagaacactaggtgaaagactgtgttccaactacagacgtttttattttgttgtctctttaatgaagttttacgtaatgctgttacagtctagaattttaaggtgccaatttgataatgcaccagtattatataagggcatttattctcaccagttctttattttgaaaatacttattctgagagagaagttaggtaatatgcttaaatgtcttgattttgaattttaaaattgtgtgtggttaaacactttcccaaatgtatgtatgtttgcttctttgtgtgctctctggggaacatccctgacctgctgtggtgggaactgggtagtgggccatccccatttgggaatatacacagcacaacggtcgggattattttcccgcgtgaattacattttatttcatcataatcttgtagattttcagtgcctagtacttataaatttaaataatattcactaattttttttcattaatctactgagcctgaattttaaagacatcacttctgagcatccttaaattatgaaaaatagaagttcaggatgaacttagccaaagtttttaaaacctggcaaagcgttggtgactaaacatgatgatacatgataaaagtcatttcattaataatacaaagcataataccatctgtatcaaggtaattaagtaattgttagtagcttgagacattacatttagtatgataattttcttaagttttttgatacattcatgtgtttattgggtacatgtgaaattctgtgacattcatagaatgtgtagtgatcaagtcaggatatttagggatgcatcacctgaatatttcatcattttctttttaatgtctgagttttgagtgtgggctttctttaagccacgcaaaaaaagaaaaaatcgcaaatgggataaagagattaaaatatgtagttttctgtatttacaaaagttttcttaaagtttcagatctttataaaaaataaattagaataaactttttatttaaatgtaatgttaatattgattattttcagctgggaagcctttaacaagtaaagaagaaattaaagggattccttgggcctcctggacatgcgtgaaaggccctgaagtgagtggaatttggcccaaatacactgaggttactgacatcaactcagtggatgcgaattacaacagctcagtgctggtgtctggagatgattttggactggttaaattgtttaaatttccttgtctcaagagaggtaaggccaaaagagatgtttcattgcataaagatttactctaaactgtatacagtacaattaaggctgatcttcctgctgtctattccaatgcactgtttattttatcttgtatattcttatttacttttcaacaattttaaatagaatgtgttgatgtcttctacttttgacatcttaagatatgtggttttgcaaatttaagaaagaatttgctaatagagttattaccatattgtgatttgtaagccttgtttcacatttcgaacaagtcatatttatgtaaatattcatagtttatatatagtccgttaaaatgttgtaactaaaattcttttatgattcagagctattgtgcttatacatggaaaagcaaaggaaatcctttcagacataattaaaatctgatcatggttgtggtgataatagtttatggacctctcgtcatagcagtaattttgcaaactagatttacataactggtgaaatttttgagagaagtttgattcaaagcaaccctctttgccctcatgttttgttgttttgttttgttaaaattgtttgacttcagttatgtggcacactcaagcgttgtagaaggtgatgaattaaccatgtaatgacctcttcttcctttgcaagtttaggcaaagcccatattcaggctcttctgagactcctcaactgtgcctgaaaatccgatcttagaaaagtaatcaacagggacatgctactgcctgaaaactctttcacttgaacaatttttagactaagcaaggaaagggattgaaaaatgcaatcagaaagtcattttcagctaactggcagttttgaagcagtgacagttatggtacaaatggaacataaaatgcataacaagacaccatcactgaaacatcacaaaatgaccatccgtttaaaatgtgcaaggcacagaattatctcaacatgcccaattcatactcttctttttccccacaagagccctttgagtaatagggcatatcttgttagattgagtagtatacttgcagggggtaagttaggcctccaagaaagtacctgggaattcagaattgagaagaaacaacattggggtcagtggcaacactactggtctctagtgtcagaacttgggaataaacataactcgatgataattgatatcctatacatcccaagtcttttaaggtgtgcttgggtctggaaaatagcaatggaaatgtggatctattagaaaagaaagcatgtgttagtctattcttacattgctgtaaagaagtacctgagacttggtaatttataaagaatagaggtttaattggctcacggttttgtaggctacacaggaagtatgatgctagcatttgcttggcgtctgggcgaggggtgctcaggaaacttacaatcatggcagaaggtgagggggagaaggtacgtcacaaagccagagcaggagcaagacagagctagagcagggttcctacacttgtgagcaagcagatctcatgaaaatttgttcacttttaggacagcaccaagaggatgatgctaacctattcatgagaaattcacccccataatccagttaccttctaccatgccccccccccgccctctaattctggagattacaattcaacatgaggtttgagcagggacacatgtccaaactatattacagagggtgagtagtgctgtcaaaatgagtcaccgttacataaaaaacagctctttggataatggcacacagagggcatctgcatgaatgaggagagatggacagccagatgacagtatggtgagaagtagcaaaacccacctcagcaacccacagacatatccatgtcctcatagcaaatggacttgtgttctacttttcatgacacatggcttataaatcttgtaatttgcctctgagacattcaggcttttgtgtcctttttgtgccaaaactactggtggggaagtgaataaaagagtgggaattgttgatgggaatactagcagttggtggaatgtgtctgtctgtaatttaggtgacaaggtacaagtattccctgtacattttgaacctgtaaacagccagatatgggcaggtgctgatgaccatgagcagttgtgggaaatgagcaaacattattgttttccattgtgatttttaaaaactcacaaccaagttaatttgacatgtttgcaattatatgtgtataacaatcagttgcacagtaattagacgtaagtgttctgcagttaatgaaaatgactgctactgtactatgtttacgtagccaaaccaatttgtttttctcattttgacagttttcacatcttaaaataattaggatcaatactgacagctttccctgataccacttagactatatcctgtttgaccatcgccacacagacactgaaacgaggtaaaatccaaggccttgctcaatgacaattttccatgtcctaatagccttggtacgcacccctactccaatgggagactcagaggctctccatgttccacctggtgcacccgttccattcctcctttgcattacacctcagcaacccacaaaagtatccatgtcctgatagcaaatggacttgtgttgtacattttatgacacatggcctatggacagcttgaacagccacctcccatgatgagtgtcctgaatgttaagacttgagttgcagaaatcttggatcttagatcttggaggggctggtgctggccttccatatgtcatggataagcttgatgcagtgcagaagcaggaaggccagtgtggctagaacttagtgcatgaggggaagagttgcgtaccgtgacattggagagggtgacagggctgtgtcgtaaagggccccctggccactactagaaatcagagtcgtcttctaagtgcaatgaaaaactatggatggttttacatggagtgatgtgaccaatccaagcttttaagactgttttgatattttgtggaatggttaggaaaagggaggtttcaagtagagaagttattgcaggagtccaggtaagagatggtgtggcttggacaaagatactaggaagagatacagaaaggttggtcgggcttaggaaacagtttcaaggcagagctgagggtcttacagatggactggatatgagaatagaggaaaagaaagtaatcaaggatgacttctaagtttgggacttgagcagtgggttgaatagtggcagcatttacagagctgggaaaatgagaaaaaagatatttgtctctgggagtgcacataaggggaagaggaatgtctcggtctgttttccttgttgtaagttaggggcccgtactgggcatccgggtggacgtggcacagagctgtcagtgctccagggagatgtcagggctggagatgtgcacttggcagtcacgttgacagcactttaaagccatgggggaggaggttgatagagaagacatgagggctgaggcctgagccctcctgtggtgcagaggacaaagggaggtctggtggagtcattcagtgtcccagggaaagccttatgagagacaggtgtggccttcatttattcaagaagtgttcgttaaatgctgtcctacgggatggagataggccagtgatgaaaacaagcacaaatccctgccctcgtggagcttttgttctactgaaggtccacagttaatatacaagaaaatataaacatctgattgtgagaagtgctgtgaagaaaaataaagcaaacagtgggagcagagaatgctggaattgggcagtgcagtgttctaaatgagttggtcaaagaggggcttgctgttgtggtttcatttgacttagaacctgaaggagaatgaaggatccagctgttcagatatctagggagagagcacttcagacagaggaaacagcaaaggcctagaagcagagaaaatgcctagcatgtttagggaatagcaaagagaccaatgtacccagagcagagtgagtgagcggggagagagggcagaaagaaaagatgagagagataaggcctaagtattaatgacattaatgcttttgcaggttctagttccagcttacaaaggctatattaattatctattgctgcataacaaattattctccaaacttaaaagtgtaaatgcacaaacatttattatatcatggtttctgggagtcaaggagtcccaagaagcttagctgggtgattctagttcagggtctctcatgaggttgcagtcatgtgaaggctagactgaggccagaggattcgcttcttccaagatggctcactcatgtggctcttggcaggaggcctcagttcctgctgtgtgagcctctccatagattgctccagtgtgcttatgacgtggcatatagagatccaagaaagacagcaaggcagaatctgcagtaccttttataacctcctcttagatgtcagcttcacttttgccatattctgttcattttgtatcagagaatttgtggacatatttttaaacctctgcaaagagataggctaattgatctgtgaggaaggtataaaggtcaaggaagcaaagaagaggccaacactttaagatctaaagagagttgggaagagcataccctgctccccaattactcaatcatgagccagcatttccagctgaccttagttggagccagtttgactttattacgaaactgatttaggtaactctttgaagtaggcaagtttgcttttgagacccaatgcttcctttcccttctgcagcagaattcccctaatttttctcagagcccctgatataatgaggcttatctggtcagagcatgctctcaaaaaatgtatgagcatgacatgtagcagtaattttcaccttcttacaaatcattgcctctccagtggacatttgaaatttaaacatgtgatagttgaacagatggcctcccccaaccctaataaaagggatttcatttagagaaactgtgagaaatagaaatgtttttgaagagaggttggggtatttgacctcctgaaatctaccatggactttggggttctaggcctccatgtaagatggaccctgcttattactcgagtgccttgatgccgctgtgtactgagcatatgctgatatgctgaaggctttactactgtagttcaaccacaaatatcacttcaagtagctttttctattgcactcactacctggggttagtgttcactgagtaaagcaaccagtttaaggaggaaaaaatgattctccaaactctatgtctacgtgactccaaacaataattttatttccatagaattattttctgtttccctgttaaacaggattgcctgtcttatctttcatttaaataagaatgtgtaagatgttcattctctgtcatttattttcagaatcagtgaagcagtaggcattatttggaacaggttcagatgtgtctttagccacagggcttaaattttacgacctatttttagcttactgcatattggaataattgagatatattttgaagcatttggttatttgttacaatatgtaagacggaacatcgttttcagatatatttaaagattttactcttcaacatgaacagaaggggggttgttttaaactaatgaactcttcttttttcataactaatcctctcaaaaaatattctttcaggagccaaatttagaaagtatgtgggccattctgcacatgtcacaaatgtccgctggtcccatgactttcagtgggtgttgagcacaggaggggctgatcactcagttttccagtggaggtttattccagaaggtgtcagcaacggcatgctggaaactgcaccccaaggtaaacccagcaataatttcttaacatcattttatttttcaataggcatttcaaagaatggtctaacatgtattctataggtaaaggatttaagcaattttggaaaattgattcctgtaatcttaaaattttaagataagaagaaactttaaagattaacatgggtcagttggataattttcttcaaaggaagttgctataccaaatgcaagttgagcaggacgtcagcaacgtgacatctgcaatgtcagaataggaagctcctgacactccctccactcatggacaccaaatacacattgattcgcaggtccattctctctgagagaaagtcatacaagttgagaaactcctacccaccaggcaactgagaaaacatccacattgggtaggtaggaaaagctgaggcacactctggcaggaaccctaccctgcgcactgcttcctgaaatcaggacaggaatccccaccacccaacctctccctgtggagagaatggtttggacctcacacatagtgccctaactctaggttacccgtggactggctcttaattcaccaactctgggagtagagggagttagacatttgggagtctctagaccatgggaaagaagcctcggtttgatacaagtgctcaagccttccagggacttcatcccctggagcagttctgagaaggagcttaaaaaatgcagcccagtttctacctagaaggggtttatgacacatttccggaggctacttggcggcctggcttctaaccaatatgcaacagggatttagaggggcagacacacattaacccagctggcagcctaagaaacagacctctgagcctcctcccatgactcatcccatcagtaactccagatctaataatatactctggaaggagtttgtccacacattgagctccccaacttttatagcttccactcaaggaaatgcatcctaaacctcccacttcggggagcagagggggcaaagtatatgaatgtctgtctagaccatagagaaaggtggcagttttatatggacttgtaggcacttgcagcggcttcttctcttaggagtggtgacgagaaggtgctataagaatgcagctcctcatttctccccagatggggtttatgccatgtgttgaatgcccaacttttacagctacctcccagaggactccatcctaaacctctttgctctgggagcagaagggactaggaatattctagtcttcctatatcacagaacagagatgtggtcttaaatgggtttacaaacacttacaggagtgacatccccttggagcagtgcagaaaaaggttgggaatgtgcagctcccattttttttctccagaaggggcttacagcatacacttccaatgctacttgatggcctgccatcaaatgatttccatcaaggagctaacagggcaaacatataatagccttccagcagccagagctcagcacttcatgagcctttgctctggctcgccccagtgataaatctaagcctacccatacttactggaaaaagtttggtcatacaccaagtgccacaccttctatagctcccacctgtctccttaatgaactagctctggaaattgatggggcttcgcattcctgagtggacttaaaccacagaaaatgaagaggtagaggtacaatgggcccacttcaggagttatctccccaggatcagagggtacagcctaaatgtgagtacaggcatttgtcacagattctctacctggcttagtgcagaaaaagtgagcggtaaatgactgtgctcagcttcactgtgaagatagaaggaattgaaacacatagtccaccctccaacccttctagctacatcaaaagtgtcttgatgtcttcccccctttacagtcttgcggtaccaacaggacatggcacatcttaagctctaggggccaccaaaacagacaatagtctggacaaacacagatttgagaggcaccttaaaaccattggccagtcagattggtgagatccttctcctatacaaggccagtctgacgagatagggagaggttttttgttttttttttttttttaatctaatgcacagaaaccaacacacagtgtcagtgacaatgaagaaatgaaattccagataaacgagcaagacatctccagaaagcaaccccagttaagtagagatatgtgatttacccaacagggaattcaaaataatagtcataaagaccctcactgaggtcaagagagcaatataagaacaaattgagaactttagagatagaaggtgttttttaaaactactcaatgagttttggtacttttgaaatactttctctgaggattggctgagcacgttgactcatgactgtaatcccagcactttgggaggctaaggcgggtggatcacttgaggttaggagtttgaacaccagcctggccaacatggtgaaacaccctgtctctactaaaaatacaaaaattagccaggcaaggtggagcacatctgtaatcccagctacaggggaggctgaggcaggagaattgcttgaaccgggaggtgaaggttgcagtgagccacgattgtgccaccgcactccagcctgggtgacataacatgactccatctctaaaaaaaaaaaaaaaaaaaaaaaaaaactttctctgaagagtactgccactgaactgaaaaattcaatagagaggttcaacagcagactagattaagcagaagaaaggaacagtgaacttggaaagacagattactgggaaccatccaatctgagaaacaaaaagaaaaagagtaaagatagcttagagacttagggtggtccaacaacttacgtgttaccaacatgccaaaaagagaagagagagaaatgggcagaaaacatgttcaaggaaataatggcagaaaaattcccaagcctaggaaagaaaataaagccaaatctaggaagcgcaaaggacacgagtaagatgaatccaaaaagatgtaccccaagaaacatcttaaatgatcaaaagttaaaggcagagcattataagtagtcagggaaaagagaatcatcacacataaggaaacctctataaaaccatcagcagatttcccaaatgcaagttgaaggtctaaggtttacgtgaagaattaacccttgggggataacaggagaggatacatttcagcttccttaggacaattgtaacaggcagtgggtctgttcagtcaggctgcaggggaacagggtaacctttgaaatgtaagtggccttcagaatggggctcaagcagtggttcacggttggggcctatgtgttccaattcagtggacatgtatgtagtcttttcatttatctctgatgtcagcaggcatgagcaggtgataaaatgaaaaattatttgaataaatgttgacaagagttctgtggtggtttgggccatgacaattaccaacacttgggtgggcatggttaaaaggctaaagaggatctgtattgaagtaaatggttgggtttatttttgccctagcctttcactttttaaaacctgcccattttacaaaacaaagcttaaaacccaggtatctgctatctaatagaaatgtgtaaatgaccaacctaggcaatgtggtgaaaccctgtccctacaaataaaatttaaaaattaactgggcatggtggtacgcatctctgtagtcccagctgccaggaggctgaggtgggaggattgcttgagccccggaggaggaggttgtagtgagctgagattgtgccactgcgttccagcctaggagacagaccctgtctcaaaaaaagtataaatgagtttagtctgcctggtgggtggtgtggggaaggaagttggcctagtctgttaatgttcctgaaaggagtgaagggtgggctgaactaaaccaaaaggtgaaagaaagatgttttaacaatttatattaaatgaaaactatggtatagtttttatttactttgctaggataaaaggaaaaatattttagataatttcagttgctcagagtctcagaatttttgcttgtttcttgtgggttgtatctctgcagaaggtggagctgattcctacagtgaagaatctgattcagatttatctgatgtgcccgaactggactctgatattgagcaagaagctcaaatcaattatgatcgccaggtcggtaagcagggagcaatgaaaatttgtaaccccagaaggggatctcattcctggatttggacatagcactaaaaatgactggcacttagacaaagagaattgaggcaaaaacaagaaaaatagtctactttgtgcctttaagtgcaggttaaaaccgacgtgtttacccaatcataccattaaaatttatttcagcagaaagtaattgcaaagtttgaaaactgaacccctggtatttgggctttttgcctccctagcacctaaaactttaaaatatattttgaagaaaaatgtgcaagtaagccataggtcttttttcactttcttagcagattatgaaagcatgtgtttcctttacaaggatggatacccttgaggcatggtggtttgcatgtgagcttgttagcccggtttttctattaacttactgcaaccattatccatttaatcaaagtaattatctacttaaagtaaaagctcaaataaaatgtgtattaatctctccagtcagaaattacctctagtaggaaagctgatcagctgacttcagtttttttggaagttgacatatcattttagcactaaacagtgttaaagcaatccctcagcggaatctgaacacataccaccttgttacagcaataaccatgggggttctctttttctttcttgtcacttaacaaagatatgtgaagcagattctgtacatgaatgtggaatgaataagacttcaaatttcagatacatgaactgtaagtgtcgccaatagagatttaagatataggcctatggcagctaccatgtgttgaaagaagtaaagtaacttgcccatgtccacgttgcttgtcgtattaggataacaatgcttacctaggcttatctccaaagtgcacattctatgcactacttggtttgcctctatataagcattaaattggaatatttttcagcccataatcatcagtcattgattcagagtttgaaaaattgtgttcgtaccaagacagtttaatggtttgggtcagccccatgacgaaatcatcttgactgtgcattgacacattgtattatgcaatatgactactaaaaaggacttgaaaagagattattgtctgtggccatacaaccctgaacgtagtcaatcttgcctgaaaggaaattattaatgtggaaatattatgcaaacactaaacaatattatactctggtatcaggagacaataaaatttaaacacaatacagaatttaggaaaagaaatctttaattgggaagtgtttgtttaataaaatggtgctagtagaagaatgaaaagggaccaggcacagtggctcattcctgtaataccgatgctttgggaggacaaagtgggagcatcacttgagaccaggagcttgagaccagcctagttaacacagtctctgtatctacaaaaaaaaaaaaaaactgctgggcatttgcctgtagtcccagctactcaggaagctgaggtgggaggattgcctgagcccaggagattgagggctacaagccactgtactccagtctgggcaacagagcaagaccctgtctctaagaaaaataaataaaagaatgaaaaggtagacttaaaattcatgcctacgacttaaacagtttgaatatccttaatgtgaaaatctgaattctccaaaatccaaaacttcgtaagtactggtttgatgctcaaaggaaatgtgcattggagcattttgtgttttggttttggatttggaatgctcaaccagtaagtataatgcaaatattccaagatctgaaaaaaatctgaaatccaaaacatttctgatcccaaacatttcagataaggaatactcaacctgtatattctccctgacatgtcactttccaatgctttcaccgatatttgatttacattcacaatattcctgagttattccttaacagggattttttaactcaattttacagatgagaatttgaagcccacagaggttatgagacccatttaaacaatagaaatatcaagactagaattcattgctctaaagtaaatagttggtgagctgatgaaagcatcatgaattaagttgaataataatctttagattctagaagcttggttaattgcatctgtagtagacaaaacagtagtgagagttcttctgaccttttacaaatgatttttgatcaaatcctaaacaggggccttatattttatgatttttaaaagagtttgattaaataaaaacttgatgaagatgagaaattattactagattggatttgattctccacctgttaaatggacatttcttggtagtaaagtataaatacacagtaaacaacagatgggtttttatatgcgtttaaatggtacaatcagcagcacgttttaggtcccaagttagaccaagattgatctttgctctgtatctcagatctgttaagatgcatgaagctatgaagtgaatgtgattccaaagagggatttcaggagaaaattgtcatgactcatgaggtccacatttttcaactgtcagaatcagtaagagatttctggccttagaagaaataaaacaaactattttatttatattttactgatacttaatttcctttaaaatttactgatatattttctagacattaagaaaacagtaacaaatcaagaaagattattttaaaatcccaattatttaaaaaatagttcatattagttttattcattaggaaaaagtaatattcattctcatgtcttaagttttcaaagacattttattgaagcaattaaagattttacaagaatgtcaagatgctgatatttttggaacctgatgaaaggcatctcacccagatgtttctgttgtactttaaggtttacaaagaagatctacctcagctaaagcaacaaagtaaagagaaaaaccacgcagtgcccttcctcaaacgagaaaaggctcctgaggacagcttgaaactccagttcatacacgggtgggtggcctgtcatgggcgcccgtatgtgttcctctgtctctgcctggctgtcaccaaccttagcaccaggcttaagggatcccctcccctcagtgtcgtcctcctcctggctagctcttctctgcaatgtgcacttgtacctgtggttgctattttaagtgtgactctctatccacttccctcgttgatgttctgtggccatcacagtgtgattgtctctagatttctcagacttcatataattccatgacttaaagggtgctgctgctcattgctgctgcacttctttctcatcaccatcttcacttcctctttctcctttcccctaatcccctgctgtgttttgctggctccaccataggacagtattttcttcaaatattttctgcacatgtgcccaacataattttgaattttgtaaaattatatgcacccttgcatattttaagtagacaactaaaactttttaatgtcggtttaaatggctgagaagatactatctgtattatgaatacatcagtcctttaaatggatgcaaaggaacctaaatgccataaatgtttgattctcactatgatcaacttaaaaaatatgtgagaccagacacagtggctcacacctgtaatcccagccctttgggaggctgaggcaggtggattgcttgagcccaggagttcgagacatggtgaaatctcatctctacaaaaaactagccagatgtggtggcgtgtacctctagtcccagctacccaggagggaagttgaggttggggaatcacctgagttggggaggtctaggctgcagtgagctgtgatcttgccagtgcactccagcctggttaacagtgaggccctgtcccaaaaggggaaaaaaaatacctgaagaagtccttctaaaacaggaagctattttacatcattcatatttctacctaagttcacatttccattctaattttcccataaaattttaccctaacataatctttttatgcttgagagtcctttgtcaccatgtcataccctctgcaagaaaaaaaatttttctgtggtcctaagactctaactcagcccaatacaatatccactagccacacacagtcactgagcacttaaaatacggctattctgaaaaaagatgttctgcatgtgtaaaatgcacaccaattttgaagacttactatgaaaagaggaatgtaagatatctcataagtttttatattgattacatgttgatatagtaatatcttagatgtgttttgggtttaaaatgttactgaaataaatttttttttctaatatggcaacaaatttttaattaggaggatcatgttatttttctgttagtgttgctccattaacagtttatttgaattatagttattagtaaagtcgactaaatcaacatgaatatattactaattgtgacatataattattaagcacagaaaaattttgttggaaattattttaatatgatggattggttttcagttgcaagatctgtgcatttatattacttactgttagaatgtaacaaagtttaatattgagtctattctcagttctcatttttgtatagatgtaagcagtgagaaagtttattctcttaaataattaggtaagaatggaggccattttatagcaatgttattcaattcttcagactcctgtgataggccaaaaaagtcatatttgattttgatatatcacaaaaaataatctttcagctggtaattccattaagtctctgtacaattttgttgaaagcaaagaattggaaatcacttgatttgcaggattccttagccagtcattagagttgttttctttcaacatgcatacttgtattttgaattgttcctttgttttggtgcccctggaagggtctgtgtcccggagtaatacagtgtaataggattccagatggaggagaggaatggctttctgcagtgggcggaaggcatttatgagaggggagatgggaaaggaatacctgtgcctcatcacagatgtgttctcagatgatcgtttttaagaaaaagcgcacacaacagctgaggatctgctaacagattctgttacaatgttcagtgcccatgtgcctttttgagagtcatctcatgccctcagacggccacatatcctcatttaaacattgctgtcctatgtgacacctggggttccacttgtacatgttcacgtcaatatgttagccttgcctctgacacctcctgctccatgcatttgctgtttgttcaaccactatgcatttcttggacctgtgcttcagttatagaggctacgactgtagaaacaatctgttctacacacaagctggagaagtagtctaccacattgctgcagttgctgtcgtgtataatcggcagcagcactcccagaggctgtacctggggcacgatgacgacattctcagcctgaccatccatccagtgaaggactatgtggctactgggcaggtatctatctcctgtaaactagggcctagccaaaaagagaatttaatttttgaattcagtttacatattagaaattcaagaaatgcttggtagaaataaacatgagatgggaaggtgaagattgaatgatcattggatccttccaagatcatgggagaatcaagcaaagcattttagcattattgggagacctctgaggagttcttttcctggaatgatgagatctatgaatgggaccagctaaaactaaaatggtgaaagttttgtcaaggagcagctttatatacttcctcgctgtatgcccaggatttagtatatcctaggtactcaataaatatttattgaatgaaccatttaaaaatactataacatctagagtataattatatttgtaagactgaaaaccataagacttttgactaatttgtattttagccttataaaaacaccttgaattttatctgaacttttttttgaaatgccttaaccttagattgagtctgtaattgaaaaagctgctaaaacagggaccctctacaatcatttgggagtgtaaagagaaaaataatcattaacttattaaagactttattaaacacagatgtattaccttgctggcaaaagagtaatattgtcaaaagtatttttagttttatcttttcctcaaatgtatagattatacttttgttcagtttttataatgagtgtttaattgcagataatacttcaactggtattaactaagtggcaaattctaagaaaacattcttggtataatgtcaaaggttaacatgagacaagcccttttcctgagactcgacctgcaggtggtaaagcctttggacagagttcataacctggggttcatgaaatctatgaatgaaaatgagaacatgaggggagtcaaccccttaaaaagttgtatttgggggaaaaaggatccatagcttttaaatttttttttaaaagggttgcagtcctccaaagggtaagggctgaccattggtttatacatgaatttgctggccctccaactgaaaaggtatatttgggggaaaaaggatccacagcttttaaattgttttttaaaagggttacagtcctccaaagggtaagggctgaccgttggtttatacatgaatttgctgtccctccaactgaaaattagagacctactgtgttagctgatgttataaggttttacaagtaattgatcattgctttgctttttcacttgcccttattttttgtctgtcttataaacagatggtgcttgattcacgtgtatttaatagcctctttttttaagtaaaagccagaggtgttttttttttacataaatccccaaggagttactgcactcaatactgtatttgatggaaggtaaaccagtggcaaacagtattccagcagccacctgcaggagactgggcctccacagacctctgtaggagtggcctggattctgctcatttatgcctatggctttatctcccatttttccttttaaagtcatcacacccaacaggtttccccaccccccactacatattacaagtgagaaaaaccactctactattataattttctttgttgttggggattagtgtgatagaagcttgtatccctgcaaagataatccaccttactgaaagatagttatgccatgaaaatgttatttcccagggggagaagcggggccaggccttcttctggtgggtagcgtaactgagaatgggtaaaataactctggatagcgtcatgacaatgtacaagtgacttccctgactgagaagcagaatcttgtgtcgagctgggaaggcaggagagggaatggtagaagtaactgacaaaaacaaggcacagtggacatttgaattagccttaaaggcccaggcatcaggttaggctctgttggaactctacctgattgccaggacaagcctcttagagatacagtgcctcagtttcctcatctcaaaaataactgaattgtagcagatgatttcctagggtccttctattctccaaatgggtttatcttggtttctgagcagtgttggactctaaggaacaaaatcattgttagtataacgtgttagtagttaataacagtcattctgttatttaaggttggaagagatgctgctattcatgtgtgggacacacaaactctaaaatgtttgtcgctgttgaaaggacaacatcagagaggagtgtgtgcacttgatttttcaggtaaggtccagagtgattgacacatggttctacgttgagagagagagagacacagagagagtatgccccgcgcatgcgcgcacgcgtgtgtgtgtatttaaacatgctcccacttagtcgttctgtttgtattgaagtacaagctctttgtatgccagctacccgctcttatactgagaatcatacataggaatacctcaccaaaaaatgtggcctttagattacacaccgcttcccatcttcctcattttctgtctcctaagtcactacccagagctcacactgtgttctgtatttgcttgagcaatttgaaatccagagcagctgttgctgttgacttagtcgcaaatgtctggcagtgactcagaacatcaatttcatctctccaaataagtgggagcacatcacttctgattgaaaatacaaagtactagagagaaggctgcaaattatctgcagagggccagtttacaacattggtattttggaaataacttttatatcgaaaaaatagaactgaagttttcatctccttaatttaaaatttgaacacagtatcataaaaaataactgatgaaagttaagttcctttagagtgagtgttctttaagttggcatttgagaatgagggcctatcacaaaaagtatttctacctagaaatttttaataattgcaactgtagaaattagatcaatagaaaaagaattctaaactttgtacagaatgctgattttataatttttttctaaattttattcaaatgcttaataagtataacgtgtaatattattaaattccatgactccacaagcctgattgttctcccctgtcccttcctctccccgttcaagccctcactctttcatctatgctatggtagtcatgctggtctctaattctatcccctcttcctcagtccatcccaccctcttctggagtctcccaaaagcatagttaccattgccaccacatggattccccttggttggctgactcattgtggagcccttgggacatccatggccttccatgatctggccttaaccttccttagcagcatttttaacccaccagcccattagtgctccttcacatctgtctaactgtggaggctacatgcactcttgcccttcttttggctgtgttctttgctcatgctgttctcatgtgtcttttcaagtcctcccgccctttaaggtcaagctggaagttttctcttccaactttacagggagaaataacctgtccttttttgtgcatcccttagccctttgttgtcattgctcttatggcacccattgctcttgtggcactccatgtggcacacagttacttgtgtcagcgtctcccaggcatttcacacacagtaaactacttggcagtagagcccatctgtctggtccccactgcacatgtcatattgctgtgcaaatagaagctactaaaaaaagtgaatgactaaatgaacaaatgaggttctgcttaatgcactttgtcttgcctttccctattactactagaattttacattataaaccacgtttgggtgaaaactaccttcattgcctgaccaatgcaacatggggcagtttttagtttttctaacaggcatgttctcacatactgtaaattactctacaaatctgagctgctgtatcattattagaagttattcagtgccttcagtgattatcaaattggtaaaaatcaaggttaaacagtttatactctacactggtgacatgtgaggtaggagaaggcataagtgtcaagggagagagaactccgcataccacctgccagctgaataacacagtcagtaattcactcaataaacagtgaatacaaagtccaaactcccggaagtgtgatggacatgcagttttaaaataggtgtgctgtgtgtcactgataaagcagtgaaacctaaaagaagctgtaattttagttcaaatacgattgtatttcaaagatgtggatgaattccttctgctttttgttctccatagttccactcctcagtggccaaactgcctttttcctaaaattaattttgctagcagacaaatatatgtatacttaatataagtaattaatatgctttagaagagtggtgaaatgcccgttaaagtagcaaaaataaataacaacagctaaatgtttacaacattattgggaatccaatatattcattcttttggcagcactgaaaattgactcaattctagcaaacaatctggcaatgtataacaaagctgtgattcaaaatgacaagtatgaagattgtattttatgcacatttcaatgtatcaagataaaagaaaaaattgaactcaaaataccatctatcactgactgcaaatgagaatgtgcatatgtgtattagcatataaataaagtggcaagaaatttagagtaatataaatagaatttaatcatttggttatttcctctatagagttgattaattttctattttttgaaatcgaaataattagctcgtgttattttaaatacctttggaagaagagattagcagatcaaagacattaactatgagatgagttggtagcaataagctggtacccagtaatgtggcctcttcatttcagatagctaacatttcttctgggcttattagttttatagaagaaagaacaagaaattaagtgagcttagaaacctttttcccataaggcagcccttcagatcagtgcctgggtagagaaatcagatactctggaggaggtgaggagcccgattctgtaactgcttctgattcccatcttgggcacataaattcccaaatatgaaatgttttgtgcataagaagggtatttcagtattttaacaatacagtctccattccccagataacaatcactgggaaagagcccatttttcagcaaatgtgttgtttttgcttatggaaattcacctttttgtcttacaggttaagtagtatgtcaatatataaatggtagaaaggaatctgatagttttagaaagtactaatactaaggactattgtggaaaaactttgactgatacgtgattcattaccataaatggttacatacagatgaattgtagtcattgactgggggttggggtgagggtgtggggacctgtggtgactcctgaaagtgtgagctgaggcctgtttggtttaatttctattgatagtctatgttttaataatatagtttgagtcttaaatccttgcaaccactttataggctgagaatggacatcctgaagtttggtggggtggcctgggtaaaagtgaacagtggccgatccaaaggcagaacccaggtccattgtgagagccaccaggcctgggtttgtcagcaggcaggaggcatgccaggagttctcctaggtgtcaggcctcctccagccgcttccctttgccgatgctagtgtgtacacttggcaagagtgtcatacctgggacactcagtgtgcaggctcactttctgctacctgtgccctccagtaagcttgtccatctgcccttcccaccctccactgtaactgtggagtggacatggtagtgcatagaggcccccatgtggaacagccccaagtgaagagagatcccgttctaaaacagcccagaaacacacacttacctgaagtatgaacaagggcaactaatgctaccatcctttggaaactgatagaaaagtgagtagctcaagtagaaatgttgaaagaggagactacgtagacctccttgtttaacggtgtaaacagggcactgacgtgacactcaacagttacgatttagctagtgctccatctgtgtgcctcaggactcctgtcgctgcccatctcttaggagttagctcttttggggggttttatggacacctactgatagcgtgcttgtctcttactagagaataaattgtcctggaaatataaagcaggcaaacaatgtgaaaactagataacaaataagcacagttatgtgtgaggatttagattgttcttgccacttttcgaaagcaaacaaaagacatttttagtcaaaaacatttcttgggcaaaatctgtaactgggctacaaggacaagaaggaatgaatttatattatctcagttgagaacctcttttaactcagtatttattactgtctaggggaaggggaaccatttttgttttgtgcttgccgtgaggaaagtgcttccatatgaatagaaaaccagattagaaatagaaaaggtcaaccacagaagtattttctagcctaaatatcaaccatataatttttttaaaagcttcgtagaataatactgatttccataagggcacatctaagacttgatttcattgtgttcagtagaaaacctacgcattttttatgagtcctgaatagagagaccaactcataattgtctgaataaaactttgtctaattcaccctttactactgacattaaatgccttcatattatttctggactatgtcacagacatccataattaatgcatgctgtgactgcaaagatgggaaaggacattacctaagagactaaaaacatggctaaaaataaaaaacttcaactaactggtcagagagtagatttccaaagctaagaccacggcttacagggaaagtgagaactgggaaagagtaaaaaggtagccaattttatttccaaactgtgtagtatatacacagaaatagcccacacccgcagaactcggggaagtcaccatcccaaaaaagaggtatggctgttgaggcacctctgggtttgcactgctgcttccattgctacccacaatcagaatacctttttttggtttagaaaggtggtataacagtgaggataagctgacagggccttgcagaaattctcctaaaataaaagctcacctcttaccccggcaaaatcagcttatccttaggccttcttcagatgacataaaactttattattttaaatgtatttgtgcttgcattccaagaagaacataactacacagatttcaaaagaaaacatgaaatatagtcaatgaatgcaacaagacattgaatatttgtacagtgtttttgaaatggacaatttctttaaaaatctgtttataattaacacataattgcaaatgtttacagggtagaatgtgacatttcagtacatgtatatattgtgtaaggatcaaatcagagtagctatcacatccatcacctcaaacatttatcatttctttgtggtgataacattcaagatcttcttttctagctattttgaaatatacactacattattagctatagtcaccttaatatgtaatataacaccagaacttactcttcctaactgtagctttgtactcactcttgactcatcatccaaaaaaaaatttttttttttttttgagacaaggtctcactgtgtcacccaggctggagtgcagtggcatgatcatggctcactgcagcctggacctcctgagctcaatcgatcctcccaactcagcctcccaagtatctgggactacagatgcacactaccatgcttagctaatttttttgtatttttgtagagagtgggtttcctcatgttgcccaggctgatcaccaactcctgggctcaagggattcacctgcctcagcctcccaaagtgttgggattacagatgtgggccactgcacctggccaaaatctttatagctatataacgtagtacattctatttcaatttataccatccacaggcatattctgtctttatcttcttcctcatcatcagtgtcaccagtatcatcaacattcattgaaaacttgattagtgtgatacttacaaaggaaatgtgataagattattaaaagtcttaaaaaaaagcttatgatattaaaaaaggagagagaaaacaccaataaaaataaaatcaagtgcagaggcatgccaacatagaaacaaccagaccatatcaagagatgtggaaaaagtaatgttggtaatgaataggaagtcattaccaattccttctcctaaatgctaaagagggaccttgcccaatttaaagcctggtaacatttaagcataaggggatatcattagttgtttttgaaagacgtagtttataataatcacctggtgatgatttagcccttaaggaaagtgttaacgtcttcatctaatactacagcctagtagcttgaaagggtcaggtaactttcaaatccttgcctcatacttcgtagtgatggagggttggagaggatttggtttgttaaaccagactttttctttctctgactctccttcatccagaaaaggaggagactaccatttccagttggttggaggagggtctcttgcataagcaagggccctcaaagcatgggcattggttagcaattgagatggggttgccagattaagccaacaaaattttaggaagctcaattaaatttgagtttcaggtaaataatttttgtcataagtgtattccatgcaaaataaggataaatatgtaatatacatataaatattgcatgggacatacttgtactaagaaattagttactgcttacctgaaatgccagtttaacaaggttttctatattttatctggcaaccctaatttggggtatactgcaggtctgcctttgaaaataccggttgggacctccgagtggactggcagaactggaagaggcaatttatcacagacctgtgttgctttatttaccctcatggctggcccttggtagtcagagaagagccctgatatactgatgcaggatgagcttgatcactcgtctcctagcaaccgcacagctagtggaagggagactgctgacccagagatggttctgtgttgaatctagccttgcaggaaggcagcaaaggaaaggctttttgactatacctcttcttttgtcttgaagggaaaaagcaaattaagtgtttttatttgaaatttaattgtgcattcagtatatttttaaaacaatttttgggaaaataacctaaatgtccaaattatagtaatcatggataattattattctcttagagaaataaattgtcctggaaatgtaaagcagacaagcgatgtgaaaactagacaataagcagttatacatagggatttacagtaatctattcttgccacttttctaaacaattataagtaatatttaatactaaaggaaaatgttcatgatataatagatgaagaaagataagataacctgttcattattattctggtattgttttttctaagcacatttgtgtaaagattggtaggatatatatcaaatgttagcctagaaattgggaagatttaaaaattttctgtatccatattttctaaatttcctataacaagtacactacatttgaaatagggaacataaaatttttaaattgtaaaatcatcttttgaaagaattttttaagttaaatttagtttctataatgttcctaatttggagaattaactgaacccagtttttagagctgaaaatggtctcaggatcacaaagccaagtggtacctcaagttaaatgtcatgagatttgtttgtcacaaaatagacatagtttttgtagcttacctgagagtctccctctagctctgtgtctcagaatgtcaggtcggcagtttacttcggcagcccgttatgcattaggaagctcggctatctctagtcatgcatttcattcagcgaggtccatttagtatatgataccccttatgtattaaaatataattgtacatgtttatagagtatagtgtgatgtttcagtacatgtatacattgtataatcaagtcagggcagctatcacatccatcacctcaaatatttatcagttcttaagatcagttacttattcctctttacagtgtatgaaatgttttgttttttcatggaagaaattttgacatttgtgttgttttcatacagccgatggaaaatgtctggtgtcggttggtttagacgattttcacagtattgtattttgggactggaaaaagggagaaaagatagccacaacaaggtaagaagctgccgggatcttacggtatcctgctgataccacggttcagtaaaggtcaatagttttcattttctggtaagatttcatcttcaaactcaggtgaaattgacgtagaaggcttagcacctaagtgaaaaaatactgcagtatttcatggtgccaaacctgacttagagcaggtcatgtttgttgcggtgaatcagaaaattccgaaatcctctgcagagagtcattcaccgcttcattttgagtggtctgtgtaatctgtatcaaagcacttcagcaatagaaaagcagcttttctcaggctggtgccttgccccttgtttttcttctgtcctagcatctggtgaaggattgtcaatgtcaccagaatcagaagcaccgtttgtcatgaggctgcagcatgctggaaaggaggccccaccgtgtgcatctgccacttgctttcaaagcaggcaaattgtttccctaatcttccgtcttataaatagattttttgagaccgactgctgtttatagaccacctgtcctcccttaccccagccttcctgcctgctgaatcagcactaagtctgaacacgactttccactcctacttacattgagctcagctgtttgcccaaccctgatcaggggtcaaaatagttggcagccaaggcccagcaatacaatttgttgccgaggcgtgttgtcagtgtacctccctgctcgttcttctctgcattaatgatgtcctttctgtcttgcgatataaaatcattttgaagttaatagccttgaaccccaatattcactttttaaagtaatattttcctctacaatattaaataggaaaaaagttttgtggggatttaatgaatgaagatttataaattgctagagacctggaggagcagcagatggaggcatgaggactccaactgaccatcttcggagaaaaagggaagcttttctgatgactgctgttgagattgaattcttggcaacaaatgacagctcataaatctgcctgcccaagtggtttttcttctggtctttgtttctagtattcctcactgtcattccactcccttctagtagtactcagattcagcttctcatcagaactctgttccccccagactaaaatacagaatttaagtttaatatttctgataatataccatctgcctttacagataatttcagggaaagcacatttctggatttcaaaagcaacagaaatgcaattttcctgctagaaaaccctctgcagctatgggtggctcaccagttttatgcccgaaacattaatagaaatggaagaaagaaatatttcttaatattaaaatagtatatattttatatacttgttggatagtgttactgcctctatttaacacaaagttgacttaacaccattatgttaataacacaattcatatttggaattgctcccaagccttatgacacattcccaaaacaggatacctgcagaattgcccaggagaacattttggattgacattagccagtgctgtttccaagcaggaatatcaaggattaaagttctttggaagaacagtagattttacagtaaaaagtaaataaaagttacttaaatatctatttgcataatattaacaatgatacatatttacataaatacataagaaatttagacaaataaataaagcttatatgtatggccttagagtgcttaagtagatagaaacttttaaaaacaggaggccgggcatggtggctcacgtctgtaatcccagcactttgtgaggctgaggtgggcggatctcctaaggtcaggagttcgagaccagcctggccaacatggtgaaaccccgtctttactaaaaatataaaaattagccaggcgtggtggcgggcgcctgtaatcctagctactcaggaggcaggaaaatcgcttgaacctgggaggcagaggttgcagtgagccacaatttagccactgcactccagcctgggtgacagagtgagactccgtcccaaaaaaaaaaaaaaaaaaaaaatttaaacaggggcatgatagaagcgacaacgaagtaatccttaacggaatgataccttgcttccagggtcatctaagctcccaagagggcctaattcacagagaagctgattcagtcctacccctcactttacacttctgtgtctcgatcactgccagcctcatttatagagcaaggctgaacaattaacctgcttctggctggctgtgctgttttggcaagggtgattgttctgtaccactcatcgcccaggaagtgagatttctccacagaggaggagcatggttggtagctgtggtggcatcgtcagctgtgctgctggtggctgtgctgacgtgtgccagctgtgcaaccaggcactcagaagttgctcctcccctgattggtgagaatattttaaatgaacctactctttagcagctcacagaaactagagaaattcagaattggaccatagagatcttatttacaagatactcaagattttattttcaagatctctgtgagacgatccgatctgtttaaacaatttccccgcatgcaatctttgctaatttttatgagtgatttcggttacctccattacaaatgaattttttagtcttttttttttttttttccctaaagatcattccaattttagtctagtatacaagtatcccatttaagaaccaaggctgatctcttatagaagtagttacagggtgtaacatcactgtcaatcagggcagaataatgcaatgattaatcaggtacatctgtgctcctttatttgtgcttgtgttactctggtagtgtgactaggggaacaatgaataggagggatcttggacaaaaaagaattatcaacaagaacacttcccaggctaatctgaaagttttgctgctagaaagcttagggacaaaggccgggcgcggtagctcacgcccgtaatcccagcactttgggagaccaaggcgtgcggatcacgaggtcaggagatggagaccatcctggctaacagggtgaaaccccgtctctactaaaaatacaaaaaattagccaggcctggtggcgggcgcctgtagtcccagctacttgggaggctgaggcaggagaacggcgtgaacccgggaggcggagcttgcagtgagccgagatcacggcactgcactccagcctaggcggcagagccagactccgtctcaaaaaaaaaaaaaaaaagaaagcttagggacacactaagcttatgcatatggcaggcgtatcgaacttccaagtaagcacttctgtattagcttcatcgcttgatctattttaggtccctacctttacatgcatttaatgactatgatagagtctcccgcataccatatgggccccttttctttttcactttgttttttaaaataacacttattctttcctctgtttttcaaataatatatgatcattatagaaaaattagcagggaaaagcacttaataaaaggaaaatcatctataattccactacccagatgtagccatggttaacattttagcatatatcttttagtgtgtatttttctagtatttgtattcatttttatttacatgtggagtattgtacatatgctctataactggtttttttcactcactaatacatcatctcactgtgttctaatttgttacctgtcttgttctatattattctatattttcagccaatttaaattttttttggagttagtatatgtatcaaacattcatcagtcttcctgttaaaggctactgccacagaaagggagaacaaaattacacacaggactgggcctctatgcaaacagagttctgaatggacagtatggaaaccaagtcacccagtgtgcagttgcccttggcctctggaagaggctccttccttcgtgcttgctggtgggtttatatggccctatgcggtgaattccttgtgatggggcgtgaggaatcatccagtgttaggacagcagcacagtgtgtaagttcttattctcgccatctaagatctgacaaactctttgtattttgttttgcttacacatacacacatgcacatgtgtgcacaaacacacctacacttgcaggcaacttccctacaagtttaacaagtgtgtataagaaaaatgacaggtatgcagtgtgttctttatttatatattgacattagctaaacatttacatgccatcattagccactttataactagccacaacagaaataaccttggtgtttttatgacatagagtaggacaacaaaagctctcacccaaactcaaagtgctttttccgttttctcactcaacaacaatctgcacagagacttctgtgaccaaacttgtggggatttctccccaccagcaagcaaacaattctgtttgctgagtattctctagttccgttctattctgacactgtctacctggaggtagcctcagatgccacaggttgagggctcagtttctgagaccgttcccctcatcccaccttgggttcgattaatttgctggagttgctcagagaactcggacatacttacttcatttgccaggttattacaaaggttatggttgggaagctatatagggcaaggcacgtaggaaggggcacagagcttccatggcctccctgggtgcacctccctccagggatctccttgtgttcagctctctagaagttctccaaaccctgtgctttggagtttttactggaggcttcattacataggcatgattggtttaccaactggcgatgggtgagcaacttatcttttgatccctctcccttccctgaaggtcaggaatggggctgcaagtcccaatcctctactactgctttggtctttctggtgacccatcctgaagctacctctgggctggcggccatcaagtcaatcatgagcatacaagaagacctccatggagatcctaaggattgtaggagtagtaggtcaggaaatggagggggagaattgaagaccacatatgtattttgtaatatcacaatggcactaagaaatcagatgtaaactaaaaagttctcacaaaaaagatttttgtaaatgtttggcattgtataaatacaaggaaacaatcttttatctctaggaaatataattttctgtacttgttattttcattttggttttctctagtctctctaaagtatatattaatgattttgtatctagggagattttcctccaatcaagaaatcattgggctgggcatgggggctcatgcctataatcccagcactctgggaggctgaggcaggtggatcacttgaggtcaggagttgcagatcagcccggcccccgtctctactaaaaatacaaaaaattacccgggcatgatggtgctgtagtcccagctgcttgggaggctgaggcatgagactcatctgagcccgggaggcagaggttgcagtgagcccagattgcgccactgcactccagcctgagtgacagagtgagatgctgtctcaaaaaaaacctggcacggtggctcacgcctgtaatcccagcactttgggaggttgaggcgggcggatcacctcaggtcaggagtttgagaccagcctgaccaacatggtaaaaccaccatctctactaaaaatataaaaaattagccaggcatggtggcacatgcctgtaatcccacctactcaggaggctgagacaggagaatcacttgaacccgggaggcggaggttgtagtgagccgagatcatgccactgcattccagcctgggcaacaagaacgaaactctgtctcaaaaaaaaaaaaattttttttggatgcttaatgtttttatggttatctggttgatttcttctcttggtgttaaacacatttcgtctttagatctttttctcccctaattgttaacgatatgtccagtaatgtatcctagctccaatatccatattcactttttgattttctttttttcttttttgatggagtcttgctctttctcccaggccagagtgcagtggcgctatctcggctcactgcaagctccacctcccaggttcacgccattctcttgcctcagcctcctgagtagctgggactacaggcgccagccaccgcgcccggctaattttttgtatttttagtagagatggggtttcaccgtgttagccaggatggtctcgatctcctgacctcgtgatccccctgcctcggcctcccaaagtgctgagattacaggcgtgagccaccacgtccagcccactttttgattttcaaagagtcagagccccaaaattccatctcttccttgcctctcatcgtagggttcacattcatgtagccataatggatcaagagacattctattctttttattgtggaaaatttcaaagttatgccaaagtagagggaatagcataatgaaccttctgtacccatcacccaactgtgacaatgatcagcatactacacattgcacaaatgtttccttttttttttttttaaccttcttttttttttttttttttttcttgagatggtgtcttgctgtgtcacccaggctggagtgcagtggcgtgatcttggcccactgcaacctctgcctcctgggttcaagtgattctcctgtctcagcctcctgagtagctgggattacaggtgcctgccaccacgcctggctaattttttgtatttttagtagagatggggtttcacaatgttggccaggctggtctctaactcctgacctcctcaggtgatccgcccacctcagccccccagagtgttgggattacaggtgtgcgccaccgcgtctggcctctttctttcttctattattcagcttcatcttttacatttagatctggtgagaatggaaaatggtgcagcaacttggaaaacattagtgcctcaaaatgttaaacacaggcctccaacttctccacattctggccaacacttgttattgtctgtcatttttattatagccacctcatcagtgtgaagtggtatctcattatggttttcctaatagctaatgatgttgagcatgttttcctgtgctgactgggtatattttctttgtagaatagagtgatttgtctttttattattgagttttaagagttttaatatattttgaatataggtcccttatcagatatatgatttgcaaataatttcacccatgttcaagtttttaggcaagaatgctttataggtacttcctgtcacatcagaaaagataaaatcggtggtataccagagagtagggaggcagtaggcatggtccttcccagatgcaagcaataggggtatattatctgtagagaatttgaaaataactaaaagccatactgctttttattattcccattatctggcaattctaaacaatgttagtgatggaattccttccctccaggatggaccacttcccctgcaccacccttttgtacactactgcccagaacatctaatttttctgctgtcagtaatactcagctcagttggtgggttctgggagcattgacctgatcctttcattatacagctccccatcaccacattttctaatggttgtagcatcagctgacaaccttgggctaaattggttacttagttcagggttcaaagtggcaattttctaattttatcattcattcttcacgttagctagaattattttataaacaattttccctcgtgaaccatttggtttctctgaaatataattctcacagaaagtgattctttaaatgttagggttatttgagttttgtctataacttgctgatttttttcccagtttgtcattcatcctttgaatttgctgtggtgtttttcatcaagcaaaaggtttatatttttatgtggttaaatttattaatcttttattgctttaagatttttgtatttagaaaaatactgcccattctcacattaaaaagaaatcacctattcttctaatgttctatggcttcatcttttatatttaagtctctaaatagtttagaatctatcctagtatctgaggaacaggtccagctttctgttttttccatatggctaccaaggtgttccattttttccctttttaaatagattttatattttagagtggttttagattgacagcaaaattgagcagaaagtagagagagttcccattacctcctgcctcctcatatgcacagcctcccctactatcaccctcctgcactagacggtacatttgttacaattcatgaacctaccttgacatatcattatcacccgaagtccgcagtttatattagcattcacttgttttgtacattctgcgagttttgacaaatgtatattgacacatatttttcatgtagcgttaccaagctagcaatgggcttgctgcccaaaaagcatagacgccaatactatgccaccagcttttgtgaaaagaaagactttattgcagtttgacgggcaaggagacaggaggcagtgctcaaatatctctctcgagctgggggctggggcaggattcatagcagagggtaatgaggcatgatctgattggatcttataatgcagtgtggccgggagacatgataggactggatcatgccatgaggtgtgtagttcttaatttggtccctgttccttgggccaagcactaaggttccacccatggttgcatgcttggttcatctgggcatgatcaggtgatgtaacttgcaacctgggttacatgataactgaaaaacaactcaccattgtattatataaagttgaaccagattgggctgattctgcagttacaacagtatattcaggagagtttcactgccctaaaagttctttgtgttctgcctatttatcctttcatccctcctccctcctctgtatactgtggcaaccactaattttttacccatgttagtagtttttaccttttccagaatgtcatataattggaactatatagtatgtagtcttttctgattggcttcttttacttaatgatatatatttacatttcttccatgtgttttcatgatgtggtagttcatttctttttggtgctgaataatatccattgtctggatgtaccacagtttgtttacccattcacctgctgaaggacatctatgttgctgccacattttgacaattatgaagctgctataaatatccatgtgcaggtttctgtgtggacataagttttcagcttatttaggcaaatatcaaggaatgtaattgctggtcgtatggtaagaatatgcttagttttgtgagaaattgccaaactgtctttcaaaatagctgtatcattttgcattcccaccagcaattaacaagagttcttagcactccacagactagccagcatttggcatcaaacaccatttattttaaaagttcatctttctcttgctatttatgtaaaaccttgtctttgttatacactacatttttatattcatttgtgtctgtttcaagattttctgttttgccatttgtcagtcaactcatacacaggtactatactgttttaattatggagcctttatagattgttttaatacctaggagagctactctctgcactctgcttttctgtttccgttttcctggtcattcctgctggcttattcttccatgagagctttaaaatcaaattgtctaactccagattaaacacacacacaccccgtggtctttttattggaactaagttgaatttataaactaagggataactgctatctttaggattgagttttcctttccaagaacatgggatatagttctgttttttaaagtctgcctttttaatcttacttatcaggtctttttttctctcttcacttttatgttacatgtatctcgttgagtttatgccttgttatttttattgtttataaatagagtcctctcctccattatatttttcaaccagtcactgtatatacaaaggttattgatttggtattcaattttatatactgtacctttactaaaatgtcttatttgtagtcattttaaaatttcctttttaattttttagacatatatcctttgcaaatatgaatagttttagctcttccattccagctcttgtgccttttaaaatctcctctagttgcattagtttatatgttcaatacgatgttaaatggtagtggtaattatcctgactctattgggaatgccattaagtaacagtccttggagtgtgcacacacaaatatgacgaataagctattccagtgtgttctatctttaaagaaaagataatgacacatagcatgtttggagagccagcctatatgtagttagcttgaataaatctgggtttctcaatgacaaagtacagggaaatacaaatgtctaaatgacaagtctgaagcatcctttaatttctactgtattgggtgttgagtggtttattttttaaatcatgggtgactgttaggtttttgtcaaataccttttcagcatctgaaaatgataatatgatttttctctttacatctattaatatgatcaattgtattacttgattccttaatattgagccacccttgtgtttggtcctaatgtattgtttttaatatgctttcagattctgtttgctaatatttatgatgtttgtctctatattcgtaaggcagatcggtcagtcatgttcttctttttaattgctttttttacattattaaaattatgtcctaatatatcaaagaccatcaaatagtccctctcatgctgtgagatgccaagtctacagcccaggtctacaatggaactttgcacttatgtttgtccttctgccccttaggttataaacctacctctctgtgcagcattccaaagtgcctcgaatcaatagaagacatcctttctctttccatagctgtgggtccagggcttcaacttctaaacaatatgtttccagctgaaaacccatttaacccagagcaatgctttccacagcaagagtgattcatgtgaagcttttcgttaatactctctttcctcctgcacaagaggaggaaaagagaagtcaatactatctctttccttctgcacatccccacaattacttgcaaccccacagtggtggcattaattttatcttatggagacattacaatatgttttaaatatttcattactttgcttaaagtataagtaaataaactttggcagcaatattaggataagaagaaagggttcaaacatgcaaagaaaagccaaagctcgttattttaatgtagatgcccgtgtggattttaaaccattttctaatttaatggtcctgttagatgtgcttaaaattagaccaaatgcatgcttttaataaaactgttactgcttccatccaaactagaatcttatttcctatttgtctcttacagaggacataaagataagatatttgtggtaaagtgtaacccacaccatgttgacaaactggttacagttgggataaaacacatcaaattctggcaacaagcaggtactgtcgtttgggtttatcatttatgtgattgagagctttaccctagctggaaagaaaaacaaaacaaactgttgctactacctcgcttgtctctgcaatctaaaataaaaatgtgcctaaaaaaattatctcccaagttcgcttagaacgcttgaagcttagaacactctatatgacgctatgcatattcatcaatacctagaaagctttggaaaatgttctgctgtgaaaataatcatttttatatttagtcatctgttctgaaagcagtaattatgttagactactgcacaggaaataaaataatcattttggttgagtgaataaaattttatctatttggatggttcctttatttatctattactgaatttaaacctgaattaaaccctgagtctgcccacaaataggtggtccaataaatattggtggatttaatgttgataataatgatgagtaaataagcatgagaaaacatagaggatatctcattcttctcactaataagtcagacttaatacaattgaatctgaattcttagtatcagctttggtgccaagccctaacttattatgcacaaaatgtgaataaggttctgttccagtgcattttgcttttaaaagaaggtaatgccacccagtatgtctggagagccagcctgtgtgtagctgtcttgaataaagctgggtttctcagtgacagggagtgtggggaaatgtgaatgtgtaagggacaaatctaatggcttgtcccgtatactaccttttcctacaaaacaattcttttttctcaccccaaaatagctgttataaataagcagagcatatataacatgcttatattttacatttacagtcagtactatttttatcgtttttggtcagcattcatgaagactttgcttgctccttcaggcacttagtcactctttctcttggctgacacagaacttgtgctgagcctcagttagacgcatgtcttggactgagatgcatattgattgctctctccagccagactctgagttccttgaatacaggaaccctcttttcatcttcatatcccaacagtgagcgctgcacttaccacatgtagggattcagtaaacactgagttaatgaataaatgagaaatattcttagaatatttttgttcatgatgttctctgtcacttttagacatctttacataaatacctaatgagagacaccaggtttctcatggaagtagtccttctacatgcttataggaagtgccagattttataaagtaataactgttcttggtccactctaggtgggggcttcacttctaaaagaggaacttttggaagcgttggaaaattggaaacaatgatgtgtgtttcttacggacgaatggaagatctagtgttctcaggagcagctactggagatatttttatttggaaagacattctactactgaagacagtgaaagctcatgatgggcctgtgtttgctatgtatgcactggataaggtatggcctgtgtatcagcattcattttcctcatcagccttctaaaattataaggtagtcttaggatggcccaagaggatgcctgtatctaaaacaggcctgtctgaattaggaagtagttgtcataaagctcagtcaagagacaatagggaggaaagcaaagatatttttataatttcgtttacagttgtttctttatatgcaacttctctgcactttttccacacatgctcttcctggcgcccactcatgagagtcccttaagaagtgccaggataaatgtggacacttagcagcagaagagtcctgagaaatacttcagcattgtcttcctccttggtgacacaatgggcagagacctgaaagtaccaaatggttacattattgttccagacgtccatttgctacgataaatttgcatccataaccaacttgctcctgtgtagaaaggctcagctttaacaagagtgttagagtgaaggctgttcattggccatattacaattcaagctcatcataattgccctggtctgtctacttgccttgcagtgtccctctacaaagattacacttaccttctctcagtctgtttttgctgctgtaacagaatttctgagactaggtactttataatgaacagaagtttattggctcacagttctggaggctgggaagtccaagagtaaggggctgcaacagggaagggccttcttgctgtgttacccaatggctgaagggccaataagagtgggagggtccgaaatcatcctttagtaatgaacccactcctacaataatggcattaatccattcatgagggcagacccctcatggtctagtcaactctgaaagttcccacatcttagtactgttacagaggcagttaaatttcaacatgagttttggagggggctaatatttaaaccatagcaccttcagtgttttaaaacactttattcaatcaacttgccagcaaatatcaacttcttttcagttatttccaggttgctggtagtaccacttcatctgtgccctctgacctccagttgaagccacctactactcctaacccatgtctcaattttcttttacctgtccttaggcaaatgtgttgattctactacaaaagtaggttcttgttaggtatgcaactgtaacggttgttttgctggcaaaggtgttgttttgttttgttttgtttttttattggtacatatgtttttggttaaactgcaagtattagaaaagattaaagaagaagaaagaatttctgtaggcccagaagtagatatggtgtaacttgtttaagctcttgttgtttggtaaattaagctgcaaaatcatgagaaaagacaaggatatcacaatataatatattgcattttaatttaatttggggattgaattttcctgggtacaaattctatataagaataaggatatttagtgttatacacttggaaatattatttctttgtaaacttcataaaaatgcattaaattaaaagttgctaagaaagcagtgaattactcagcttttttcttagaaaaaaaaaaaaacctctaagaacagttggtatatataataaattaccagaaaggaaaactagtacagccaaaaaattataagcttagaacaggaataaagatcactgttcagtaaaaaatatccaatatgttaagctttttactttccaggtttttgtaaaaattaatctggattttaattatggaaattgtgtctattgaatgaaataggatcgtttcattatataaagtacctaagctactcttaataaataatgatgttttcttctggacatgacttttatttttaaatgtttaacaataattttaaactgtgatgttaacttcaatccatttggtcagagtatgtgagataccagaaactctgctaggttttgaggctggttccattctgtaggaaccacattctggttgggagactgggcacaagcagagccatccttgatcagtgggccagctgccaaccattgttctgaggagagtgcagtggacacatgctgagaacgtgcttaatcttgcttagggaagtatgggagaaatgctcccaaaaaatattattcgaacattgttatcaccagagttttccatctcatatatttaggaaggtagcatccacaaagcttccttacctgcggggaatcctcctggggccaagtgggtaattggtcattttgatgtgtatataatacctctcatgtgtgccttcacagggctttgtaacaggtggaaaggacggcatcgtggagctctgggatgatatgtttgaaagatgtttgaagacttatgccattaaaagatcagcattgtcgactagctcaaaaggtgccactcccaaacatgtaatagagatctttgtattcatagggatggagaagattgtactaaagtttttagaaaactattagcaaatcaattttctccctcttccatgtttagaactctcttcctctggtagaaatgtcaaggctgactgcctagtacctagttctttggagctataaaaattgaatttatactaataagcagttgtttttgttattgtgttaaatataccatccccttccccaggcttgcttttggaagataacccttcaattcgtgccatcactttgggacatggacatatcctggtgggaacaaaaaatggagagattctggaaattgataagagtggcccaatgacactgcttgttcaggtactgtttgtatgtattctaaactgcagttcacatcaaggctgggactagagtgaggcaaagttgatgcttaggttgcaaaacttaaggaggcactcactctcagggttgcacaagagttgaactagttacctattgctgtgtaacaaattgccacaagcttagcagcttaaaacaacacacatttattttctcacagtgtctgtggatcaggaatctgagcacagcttaactggatcttctgcttagtgttttataaggttgcaataaaggccagggttatggtctcatctgaggctaaactggggaagatttttccaagctcactcatgttgttggcagaattaagttgcttgtaagtgtaggactaaaggcttttttttttcttgctggctgttggccagaggccattttcagctcccagaggctgcccacagttccttgccacatagggtttcccaacattgctgctttctcaaagccaaaaacagaggggaaaaaaatagatactacaattttatgttacataattatgtcatcacatatgtggaatcataacattccattgcctttgccatatgctgttggttagaaacaagtcacaggtcataccacactcaaagggaggtgattatgcaagagtgtgaaaacacaagaggagtatgagggtcaccgtcactggccaccctctggccaccagttattcatgtccctaccacatacagaatcctttacctccacctccaaggtccccaagagccttatcacattacaggatctgctcaaagtccagaatctcattatctaaattgggtccaggtgtggaagaagtgccttagatgtaagtcctgtcaatctgtccgtccataaaatgaacaagacaaattacctgctccccacatgccagatgcacctgtgcccctttggaatgtgggcctcactatagtctcagccttggtccacataagcaaattgcatcctccttagtccctgtcttccctcaaaagtcatatttaggtaaaattgaactaaaataaatgtaacagaaccttttaggagccaagaaatgataaaatctcacctcaaggatggggatgtggtaggatgtggaggtgcgttaggtagtcctgcccagtttggtgatggataagaccatatttaggtggaagaggcatggtgaggggtgaaggatgtgtgttcagaagttggagagaaaagaaaatgcactgatcatatgagcagtcagaacttccaagattccagtgcaggagcttcccctccttgccttgatctctgagtgattgatgcctgcaggcttgctgtattacgagtgaatccccaaatcccactgagagggtccctctgacttactgtatcatggaaacacatgtgcatatacactatggctcaggacactgcaaggctttaaaaacacaggtgcccaaatcccaccctggatatcctgaacaagtctgtgtttttaaaagaaaaaatctatgttaaaaacaaacctcgaaagctctgcagctggtcgtgccttgcagccaggctagagaactaggctggagatgcatccttgaggcaatgaggtctttgttctccagctgttcttgcttttgttgttttcttccaaactaaatctttttttttctggccataacttctaatttaattttactgaaaagtatttatttactttttaatctccaaatgtttgagaatgtaaattgtttccatgtatgctatattgctagatattttagaagatttatgccccaatatgatttaaataatactgtaagatctaaactttgttttctctcttattttgttacacttgaggtagtttggtttaaatatgttttatgcttgaccaaggcttttcacttcttaattctctacaattctattctttcctatgtttgtttctattgctctaataagaaaaataaccacagcaatcatatattgagcacctactctgtgtcaggcaataccgttgtacgacatttgtctcatctccacaacagattggctctgttacattgttttatagatgagggacctaaagcccagaaaattacccacagtcacatgctaagaactgcagagctgggattccaaccaaggtttgccagagcccttgttcacctcaccaggctgttccccacatctcttagcttggacacttcaggaaagcccctgagctatggggtggctggttgagctgctggaagcttcagaccagatgttagttaccatctttgccacctacatgtgtaccattctctcccttttttttttttcagcatctttttttcgtcttctgctctctcatttgctatttcctcttaggtggatctcattatttcagttcagtcaatgtttgttgggctcctgcccaggtctgctctgtgctgtgtatatgtgcagtggaataagggcttcctgcttgcccaggaccgtgtcacagtcctgttctgagagatgatagagacagcaagggaaagtgaaggaactgtagaggcagtgtgagtgagacgatgggctgtcctgccggaagaagattttagatccactttgccggttttggtggcacggcaatccaatcacagttggaatagactgcttattttttaagagaaaataaggttgggggaggggagaatggcaggtgatgggttgtggcatttcccgtcatgtgtgctttgaagcagtcagctcgcagttgtacagctgtttatgatcagctttgtgggtgatcagcagcaaagcaggatcctaagcccatttccttgagccattcaaggtccttcaagcctgcctcgcttactgtccgatcctgtgttacacggggattaaaataaacagattaaggaaatacaattttgatgtcaatataaggcagtggtttaaaaggatctctgggtcccacaatcttgttcttaactaaaatacacaaaggggctcagtctatagaagagcttcaagcagagtcagtctgggaagatgtgaggttgacccctgagctgtaccctgactgtgactctggggctgggaggcttccaaagagaaggctagaaaaccggggatgtagggtgtcctcaaatccaataaattcaaaaacaatgtctgtatccttcagccctcattttctcatatttgaatgtcagttgtatttggaactttacatcttctgccaaattactgttttgctcaaatagcttctcagttaaattggaatcatccaatttctctttggaaagccacctgttccccaaagcattccagctacaaacacctttcagatgcctgtgtgtgggcttcctttttgctttactaagcaaagcctttttgtaattagccattaaaaagccaaaattcagtaaacagttaatctggtctgttttattgctctgtagcactaatctttacacactgcattatagagtgaaaaattatgagaatcaaattcattttctccctgttaagtgttcgttataaaaaaatactgctttctcttagttattattctaagccagccaagtgtgtttgtgataagatacagatacatggaattggtccagtgcttattaagcacctttcagtttttgatgttcattgttggcacatggacagaccaatttgtgaacagacgcagaacctgggctacaccgaggacgcttgaaatgaaaatttagcttcctttacttctgctctgccgaatgctacacattcaaaggactaaaattgcataaataattagaatattgctcttcaatttcactgacatgaatgggtcgtacctgcatcttttagaatatgatttaactgaaggaagtggtttgtgtccttgtgattaagctgctttactaggagggtacatatatactatgtttatttagtatgaaacaacagaaaagcaggcatttcaccatttacctggatgtttctaaatggaaagatgtttggcatcatataaacaaaaccaataagcaatgagttcatgttttgctttgcaaatgaatgatttagcatcgtgtaggtctagctgtagattcaagtttaaatgaaaaaattatttcgggtgatgattttggttcaaggaagctcaaagtgtgtttattcctatttgtgcttttttgtggtactcttggactgaatatgtagcaccaggctaaagaagggctagccaaacagcataagtagagtttatgttgccccttttcctctcccacaggggcacatggaaggagaagtgtgggggttggcagctcaccctctcctgcccatctgtgcaacagtgagcgatgataaaacacttcgcatctgggaactatctgcccagcaccgtatgctggcagtacggaaactcaaaaaaggtacataacaccaccttacacatctgtcagagtatttacaagtaacagaatgtgtcatatttattcactcagttaatatttactgagggcacgtgttatatgcccataaatatgctgggcaatgagaattttatattggttgctacagtcataactaagcacatgtagaattatgccagaaggctggcctaatccagctccatttttcacttcattttccttgcactgcacagatatttgccacctgggggcaatatgtccttcctcttctcattgagagctgtgggagtcaattgaaattcatcagcttttaaagaatgctatttattttgtaacagtctccagaacttattttatgacttgaaaacaaacatcaattatatagaaatataatacttaagaaatgagtaaatatgtcttgaacacctaaatgcactagaactatgaggtgtactgagaggtacaaattcagcaaacatttattaagtagcttctgtgtggcaggcacaggggatcccatgatgaatggtcccatctctagtgtcagagatagacaggacttgaacagagtctcagcaacatatccattcaaattgggtaattcgaggagagtctttaaaatgggactatttatataaagggatggggaaggtatgaggaaatgaccagggatagtgcagcactatgcagctagtaatggcggctgctctcactggccctgggcttgaagggacaggaggagaggacaattgctgcaaccttgaatatgagagccacatgagatggcagcctgagagaagccacgactgatagcaggggactctgccagcatgcagtgaccctgcgggaggcagccagggaaataaatggcccggcctccctattcttcctccatctctctaatttcccaccagtgctccccgttggccaaagtcaacctgaaaccagaggacaagggagcccattgatgctctccatgcagaccagcttcaggcacagagcagggtggacaagggcaaaaaggggatgtgaaaggacaaactaaagatatttggcacaaagtaccctggagcctcagaggacatctactgcttggaaatgcttcatcagagaggtgacgagctgaggcttgaaggatctgtaaaagttcttaagagggaaggatgaaattgaggtctgaccctaaaatatttgtactgagtaattttataagcagacatgaggattgtattctagggtaataaaatgaagaaaggtgtcaaaacagtagtaacaatagtgatggtggctaatatggctgagccaacaactatgccagctctttccatgtagtctttgtaggaaccccatgagtaaggctattattattgccacttacaaatcagaaaactgaggcacaggaagcttaattagtttgcacatttagtaggtaatggaaccaaattcaaacccatgcagtgtgactgtgagaacacacctgtggccactgcttaacactatttccctctgccgtgttgcctgtctttacactaggctcctggggattggtaaatggtggaggcaggatttcccaaatctaagtccaaagcccatgctcgtaatcactacaggctagaatcattttggctactagtttatatcgggggaatgataggccaagtcctcactgtgaaggacttgaatgtcagtgaatggactttattctctaagttaaaaattagttgaacaactattgacccatcttagataggataaccattcaacccagtttacccctgttgttctggtataattattaatagctttccttttcactctcaaacgtgtcttggtctgtacgatagattgtgattaacctaatcttgatgatgctcttcaagggcaggcttgtattttcattgtctcagtactggcacgtcagttttgagcatgaacacagctttcagcataccatgaacagaggagttggtaaagaggctcggtattaaatgccctggcacaaggccacctggctgtcctatccctggggtgtgcttacaacgctcgacaataagaatggtggcagagggtaggcatgttcttgaatcagtttccttttagacatacctttgcaaagtccatgctcctgattcagaaatgtctttgtgaccctacaaaggagtagagaacatggttcatggagcaccatcaccctagtgccaattagttttccagaaaccccttgggagaatgttcagattccattcttcgcgtgacagaagaggcaagaacaacatctttcacctctagagttatacattacaatccgtggatcagagaattggagcaactaaaagaatgaggtcctctaaagcaagttgtatgtaaggcttaatatttaaaaaaaatggtttctggaaattttattatagaactcctattcttaaatattacctcttttcttcgaagcaaagatactggtcctattaaccctatactccttttctccatttaccccacttattttttggaaaccccaggtatttaaatactcataaatgaatgaataaacctcatggaagttgaaaatgtatttttgatattatgatctttttccttggacttggggagaagagatacttaattttattttcttgagacagggtctccctctgtcatccagtctggagtgccatggcatgatcactgctcactgcaccctccacctccaaagctcaagtgatccttccaccttgcctcctgagtagttggaattacaggcatgtgccactattcctggctaatttttgtattttttgtagagatgggattttgctgcgttgcccaggctggtcttgaactccagggctcaagcaatccacctgccttggcctcccaaggtgctgggattacaggcataagccactgcacctagcttatttctttactttttgtacagggtgggtttcgcctctacaaaaaataacttttcaactaatttttaacctacggaatgtggcccagactggtctcgaactcctgggctcaagagttccacctgcctcgaccttccaaagtgctgggattacaggcatgagctgctgcgcccagacaagaggtgtcttaaattaggaagttttagttctcacaagtgtagtgtcaatttaaaggcagtcacgtgtccatacataatgcacatcatcagatttcttcatcttttcatgtggtttgcttgacagtgaagttttggataataagtgttttttgtggattcttctgtaggtggaagatgctgtgccttttcccctgatgggaaagccttagcggttggcttgaacgatgggagtttcctggtggtaaatgctgacactgttgaagacatggtctctttccatcacagaaaagaaatgatctctgatattaagttttcaaaaggtgaagatgacagcagatactttttaaaatagcacagtcttgggacaaaaaattacaagaatgaactatttcaaatgtttctttgaccattttcccacttttaaaatactaagttcctggaagtaaattcctatataaaatgcttcgatgttaaccccacatttttcttaacagatacgggaaaataccttgccgtggcatcccatgataactttgtggatatttacaacgtacttacaagcaaaagggttggcatctgtaaaggtgcttctagttatattacacacattgactgggactctagaggtaaagtatgttgtggcttttaaaatagaatttctgtgtttaaaaaatgtccatttatgcattgtttctagagagaatggcagttgagtgttagaaatgggaaaggggaatcccacaacaatataaacgactgtaattttacaacccagaggcagctgctgctaacattttgaatactttttccatctttttacgcttaggatgattattgtcactattgattcaagccattgagttttaagacagttaaagatacatgatgccttttgttatcatagcaagccaccacctcacctttagttgggagtgctttctccttgtcttgggtcccctcatcctcctcctggctggtttcccttttccacccaaagctccacctcttggagaaccgcccaaaaaggctcaagcaaatttcctcctccagcagaggtagaaatctacattcagcctgcctaaaatttctctgctctataaaactcccaacctactcctacctcctccaagtcatgcccacaaatgccatgaggatttgtctatttaataactctagcttttatggtgttgcatagtcttaagctagcaaatgtggaggctctggaagtgagtaagacatggtttctgctccctgtggagtttataattgagtgagggagatacttatccataaataatacaagagcacaaaatgggtaccgtgtgagtaagcagtggtgagtcacaagggaagtggtgagcagggactccgaatgggccacggcagcattcagtacccagggtggaacattgcactatagggtgagtcactcgtaaatcctatcctcaagactcggctgatgttgagagtctggagcgggtacttgggaatggacagcattcccaccttcagagacgttgtagtccactgtggtagagaagcaccaagcccaatgtatgctctgagggaaagctccttggaggtaatccatggagcctctgtagaagggagtgacctttgaggttgatcttgagagataaggagaaatccaccagatagcgctatcaaggaagagccattccaggcaaaaggaatatggcatatgaagagtgaaggtgggaagaaccagggggtgatgaagaaatagaagtgctcagtggctgagggtgtgaagggaggggaatgtggagacacaggctgggatagagcagaactttcatgctgaactgtgtacttgtaggcactatgtaactctgagggatctagcgtggggcattccctcccatcttggggagaagaagtgagcctggagttggagcaatcaaattaatcaggagaacgatgatgaaggcctctgccaaaaaggttatttcagagtatttcttggagtagtggccatagaccaggacttggaaacccttctgcctggcaggtatttagttgtaactatacttgccacactggaatttggactttatttcagctttacaacattcaggagttttatacggtgcagtagatagagaaaaaagcatgtgatgcattgcatttataaaaggtacaagtcccaacaagggcaaagggagatcagataagtctgtttcgctttcatgtcagggcagtgctggccagacaaagtgccgagggctttgaccggcatttatgaccaggcagggcactgtgactttatctaggaactggtgaggccgatgaaagcagctgcttctcagacccttctttgatattctctgcttttttttttaaagcagtgatttctccctatttattatcttgctattctcttgccaggtagaatagggtctgattaactttatttagaatccgacacacacacacacacacacacacacacacacacacacacacacacacacacacacaaaatacctgatacaatacgtgaaatcccaccactcaatgactattagggattaaaacccattattgtttctattacggagtgaagagtccagagaaaagagggtatatatagagtaaattttgactgggaagatttcttaattattttgaattgtgaagtacacataacaaaaatgtaccattttaatcattttttaagtgtacagttcaaggacgttaaaaacattgacactgttgtgcaaccatcactgcccccatctcagaattcttttcatcttgtaatactgatgacattcccattaaatgataacttttcatttccccaacacctggcatctaccattttactttctgtctctatgaatgtaaccactctaggtacctcgtataagtggaagcatacagtatttgtctttctataatgggcttattccacttagcataatgttctcaagattcctccatgttgtagcatgtgtcagaatttccttactttaaagactgaatgtttaattttatgtatagactgtattttgcttatctatttgttgaggggcacctgtgtggctgccacatttcagccactgtgagtgatgctgctatgaacatggatgtacaaatatatcttcaaaaccctgctttcaagtatttgaggtatatgcccaagggtgtaattgctgaatcatatggtagttctatttttaactttttgaggaattactatactgttttccatagcagctctaccattttatattcccaccagttgtacacaagggttcaaatctctccacatctttgccaaagcttattttatgtgtttattttgataatagctgtcctaatggatatgaagtgtatctcattttgggtttcatttgcgtttagggagtttgtttgttcttaattctgcaaatgtataggccctgtgtcagatggtggggatataaagagaagtaagtcccagatagaaagcacaagatctcggccaggatcagggggatgctgctgtggaggggcctgggggaaggtctgtgtaaagtccctcgatatggagccatcacttggtggaaagagaagcaaacctccctatttccataatcttgcccaaggccagcctcttagagctcaggatgctgagggaggctcctgggaatgagcaggagaggagtggagtcaaaggtctttgaaaagccaccatgcttctcattgtaagggtccctgcaggcaggtgagggggtcagaccaagtgctttctgtggattgagagtagtagagacacttctgatttttagggaggaattacaccatctggagaataagagcaagaatacctgtgaatcttccttgatctaactccactagccatgagacatgtgtcatcctgatattcctgcattcccaacacctcagtccccaaaatgcctgatctcgagaatgtgccatgctgcctcaagaccagcctagctttcacagcaggggcctccagagtctggcaaggttgagagcagaatttagaagcagggttctgtttcatgcctttgatcctgtcgaaaatagtgaaagcatttgccagagccagctggcttctcagggtgggggatggcacagccgccagcctcagcagcctcttgtgcccatggcaactacaggtccttggaaaaccaaaaagtgcactgggcttttgcaggaacatcagctacccctgaatgaaagctccagcatggaatgcttgagaaagaaaaaatgtatggagggagagaaaacatagaaagggtattttctaaatgctacaagttcatttctagaaatatcaggctataacatcctttacaaattaacaatttgaaggctgggtgcggtggctcacacctgtattctcagcactttgggaggctgaggtgggtgacctgaggtgaggagtttgaggccagcctggccaaaatggtgaaaccctatctctactaaaattacaaaaatcagccaggtgtggtggcgggcgcctgtaatcccagctacttgggaggctgaggccaggagaatcgcttgaaccgggaggcagaggttgcagggagctgagatggcaccactgaactccagcctgggtaacagagcgagactatgtctcaaaaagtaataataaaaatgacaatttgagccataataggacatttcattcccatttttgttgcagatggcctgatacttggtatatttagtaccagttgttagaattattctaacttgtaaattatatagcagctgggatgatgtatgtggatcactttgtgggctgcaaagctctatggtacccgcaagatgtgtgatgtaaggacatgggtgtctttcagtttttaatctgtgtgagcagatatttccagtgaataaaaatgtgattctgaaaggattactgttattcaagagcaattataaatgcaaacagagtttttgttcttgcttctgctcctcatcctcagaatatgtcagtggtgagacagatagattagatagattagatagattagatagatagatagatagatagatagatagatagatagatagataagatagatagatagatagatagatagatagatagatagatagatagatagatagatatcacagcaggcagagagaaaaaggagtggtgacctaaatatttcctcatgcttaagaaacatgtattagcagcagtaaagaaaattttggttttaaaaaaatacccttaattattcctttctaatagaagaatagctttttggtttggttttttcttcttgacatccttgattgcaaagaacagaaacccactcaaaccagcttaaacttttttttttttttttgagacagggtcccactctgtcacccaggttggagtgctgtggtgcaatctcagatcactgcaatctgtgcctcctgtgctcaagagatcctctcacatcagcttcccaagcagctgagaccacaggtgcctgccaccatgcccggctaattttttttctgtatttttagtagatatggggtttcaccatgttgcccaggctggaaaccagcttaaattttaaagtaataataacagatgagtttattggaaagatacggagatattttatagaatccaagagcaggaaagaacacctgccaaggaactgagtttagcaatgaactagaaaacgcacaggaaccaagcaagcagttcctctcccctcctctcccactcttaggcagctagtttcagcatccactgctcttctgggtcttatctctgcctttgacccctctctctgcacaagcagcctttctctacttcatctgcacatggcccagcctcggctgccccaaaatgccacccacaggcccaaagtccacatctcatccctgtaggcaccaactgattcagcctctcagattccagtttaccaagagagaactttgattacccagcccagtgtgagcctggcccctccaggatcaacatctgcccgcagagtataaacatgaccgcgggggcagttctcggggaaggggcatgtgctagataggggaccctacaagctgtctacaatgctacacagcacttacggtacttgtctatgtgtttagattctcgaatatttttgcaatcataaattacttcactgagagatttttctcatttttggttttaagtgaagtatgatctttgaaactatggtgtaaagtgagttgttgggatttatctgaggattacagtcctctgaattatcttagtatctcatggccaaatatcatctaaaattagccatattcaaagaatgtgttcactgaataaccgtccacgtgctttgtcatttgcaatcactcttgagtgtcctaaaaatagaattactttacagatgtatttagttcatcggaaaagtattggttactcattttcttataattctaaatagtcaaagataactaactcccttttttcttttctcacttacatatattcagccataaagtcagaagatgtgcccatttcagggtacacattttcagatatatttgctcaagtcaaggaaaaatcccctaatcactgtgttataattcaccaaattagaaatgattaaagttgtcagtttggaaatgagagaaccttatttttagtcaggtagaagtagatctacaacttcttaagattagccaagctaggctgagcatggtggctcatgccatataatcccagcactttgggaggccgaggtgggcagatcacctgaggtcaggagttcaagaccaccctggccaacatgatgactctctgtctctactaaaaaatagaattagccaagtgtggtggtgggtgcctgtaatcccagctactcagaaggctgaggcaagagaatcgcttgaacttgagaggcagaggttgcagtgagccaagattacaccactgcccactgcactccagcatgggtgacagagcgagactccatctcaaaaaaaaaaaaaaaaaaaaaagattagccaagctagatttcagatcaaggtggtgcctatttaaatgctaaagaacacgatctaaaccaaaaagttcttattttggtattatttttctaagaaagatatttcaaaactactagatatacatagttatgggaaaaaacaaaaggagaaatattatgtatatgtatactgaattatttataggtgaaatattatgacgtctgaaatttgcttcaaaataatctagggtggaggttcatgaaacagggttggccatgtgttaatagctgttgaggctggacagtgggcatacaggggttctttatactcttcttctatacatgtttgaaactttccataatatttaaaaaatggcaaaaatactggaacataaataccttgagtcatttacattttaagccttacaagattgttgccattgtaggaggagaattaggaaatctaacctttttcaacgtcaaatccaagattataattgtacatcagactgaaagactatttttgcccaacattttccttggggaaagtcctggatttcttttcaaatgttcaagtaagaccagagggtggggaaggaatgagcatttatagtttgtgtgttctgtttctaaactttaaaggcaaatttagaactcagtcctaagtaaatgtgaatgctcacagtaagtgttttatttctaattgccataatcttccaatgacataattcttgccaacacagtttgctgagaggcaactgggaaaaacagggggaaaactgatttttctcaggctttggaaaactatattttcagtgcagcatatcaataaaacatatcaagctttattcttctgttatttgaaggatgttgaagatcaaatattatgaagtccatattctaaaaatcacagctttggggtttgtaccacatcatgtaattggctgtacatgcccttctgaataattcaaaatgtatttactcaatttgtgagactttgattaaaatgaatcaaaatagcacccatgcttctcattttataataaagagataaagtcagattttaattatctctctacttcgttctgtcgtaacaggaaaattattgcaagtgaattcaggtgccagagaacaacttttttttgaagctccaagaggcaaacggcatataataagaccttcagaggtaataatcatacacaaagatttttaaagatattttgtgaagatttaatatgtgcattttaataaaacctatcacgttaaccactaatatgggttatatttactatacctttaagtttgatcgtgtcttcaatctgattgcttaatctggtttccaggttcccagaacatatggatttatcacaccactggtgtagcaatgtacagttggtgctctgcttaatttttctctgcctgaagacaatgaataagctagcaatttggatgttatatattcctttttccatttgacatgtcattttgtgcaaagctttttatgaacatatattttgaaacatgttttctcaatggttatttgtaattatgaacattattatctataacaacagaatttttttttttttttgaggtggagtcttgctcttttgcccaggctggagtgcaggggcaccatcttggctcactgcaacctccccctcccaggttaatgtgattctcccaccacagcctccctaatagctgggatcataggcatctgccaccacacccagctaatttttttattttatttttttagtagagatggggtttccccatgttggccaggctggtctcgaactcctaacctcaggtgatccgcccacgtcagcctcccaaagtgctgggattacagacgtgagccaccgtgtccagcctggaaattattttttgagacaaaaacaatctgcaatctgaccattgtattgtatcaaactgttttcttttttccatgtttcctcatgtccttagctacatacacgattttttagttgctgaaatcaaagcctagataaaatttttgaatccctaaactaacacctcttgaaagctagatggcttttgtagatgcgtacctctttcagggtgtacacataatgagccctggtctaactgttgatgaggatgaggaaatattgcttccttagaggaaaaggaggtaagggtatgccactgagtggcaggcatctgcctctccctcgcttcagtttgccagtatcttaaactgtcccagtattgtaaggttctccctaagacatttggacacgtgtacatttgcattgtcattgtttgtaaaggaagtatatgtgtagtacttaaaaaatatacatcgttatagatcatggcattgtattaatggaaactgttcactgagaaatttgatctcactcccctccccaattccaatttatttgtctctgatccgtcctctttttaacttttttatatggagaaacttatggccttgagtaagaggtatttttaattacgtccttcattcactggtaatttgttgactgccagatactttatacacctttatttttaattttaatttcagctttgattttagattcggggatacatgcataggtttgtttcatgggtctgttgtatgacactgaggactggcatacaaattattgcatcacccaggtagagagcacagtacctagtagatagtgtttcagcctttgccacctcctctctctgccccccaggaatccccagtatctgttgttcccaccttcctgtctgtgtgtacccaatgctttattcccactcgtgagaacatgtggtatttggtattctgttcctgcgttaattctcttaatataatggcttctagctacatccatgttgctgcaaagaacattatttcattattttttatggctgcatagtattctatggtatatatgtaccacatttcctttatccagttggtcactgatgggcatcttggttgattccatagctttgctattgtgaatagtgctgcaatgaatatatgagtacatgtgtctttttggtagaacaattccttttctttggggtatgtacccagtaatggtattgctgagtagaatggtaattcttttttaagttctttgagaaatctccaaactgctttccacagaggctaaactaatttacattcccaccaacagtgaataagcattccctttactcttcagccttgccagattctgttttttttttttttttttttacttttaataatagccattctgaagggtgtgagacagcatcttgtggttttgattagcatttctccaatgattggtgataaacattttttcatatttgttggctgcttgtatgtcttcttttgagacgtgtcttttcatatcttttgcccactttttttttttttaagacccttttctaagggtcttgctgtatcacccaggctggagtgtagcggtaccatcacggctcactgtaaccttgacttgccgggcttaggtgatcttcctgcctcagtctcccgagtagctgggactgtagatgcacaccaccatgcccagctaattcttgtataatagttttagtagagccagggttttgccatgttgctcaggctggtctccaactcctgttgccctctttttaatggggttgttttttgcctgttgacttaagttccttttagattctggatattagacccttttcaggtgcatagtttgcaaatactttctcccattctgtaggttgtctgttttctctgtcgatattttcttttgctatgtggaagccctttagttaattaaactcatcaagtctcacttgtcaatttttgtttttgttacaattgcttttgaggacttagtcataaattctttcccaaggccaatgtccagaatggtatttcctaggttttcttctaggattcttatagtttgaggtcttacatttaaatctctaatccatcttgagttaatttttgtgtatggtgaaatgtaggggtccagtttcgttcttctgcatacggctagccagttatcccagcaccatatatttaacagagagtcctttccccattgcttatttttgttgactgtgtcgaagatcagctggctacaggtgtgcagctttatttctgggttctctattccattggcctatatgtctttttataccagtaccagtctgttttggttgctgtagccttgtagtatactttgaagtccagtaatacgatacctctggctttgttctttttgcctagaaatgctttgactattcagcctcttttttggctccatatgaatttcagaatatatacacctatattttaatcctcataacagctttacatgatagttgtcaatctggttttacagataaggaaactaaggctctgtaagggcaaaagacctacagcactgtgatcttaacccaaaggcatctatgtgtgactccatggcctacaccatgaagcctctcaatttctcctgtggatttaagtgtcatttcacatcacttcagctgtactttcccttccggttttagtgcccccaaataagtatactaaaatgaaatgtaatttaaccaaatggtagaggaggatgaggctggcttggaacagatgagcaattattatataaaagataatgcacaaaaggaaaattcatgttataatgcttcccaaagtgacaggctcttgctctgaagagttaagagttaatttgttaccctgtggtgcacatttgttactccagaggctgattcctgatgatgttggttgcagagtccttccaactgatgctttcttggccaacttccctagtagtgccgctactgagagcattgaagaggtagctcatcatgttagtcccaatattataaggccctttgactgagcatgagggattttggaaaatctttttcaaagaagcaatttttttttttaagaaacaatcatggtaaactaataaaaagcttacccagcaaattgttaaaatatgacaaatgttaaaatgcccatttcaaatccatctgatacaaatggtacagttaaagcagcaccatattgggaggcaaactctctggagcaaacctcccccttcggcttcctaagcatgctgtgactgcagtgatgtaacctgtctgtgggcctcagttgcttcctttgcaaaatgataacatgtctacctgaggcaaggtgctaaggaagggatcccttgaggactctccttccatcttagttccagcattttcaacaagtttatttaacccttttgcattgacggattataggtatcatttttaatgctccattttaagtgcaatttctgtagcttccagcaagttcgacatttgcttcccctggagaacacggtgccctgatctggccaacagtgttgtgttggggtgtctgccaggggagcaataccagctccctttcctttcctgctgggatgaggccagcatcactgtagggattgcgagtggactaggagagtcttagagatggaatctagaatttggaagggagtcaatggccaaaagcatgcttccagaaccagcaagggatggttccctgcttctcttcctgtgaaggttaggttaggacatcataaggggttgagggactccaattctaaaactgaggtgatttctgggggaaccaccttgagtcaccttggtctgtgttcctacccaaggcccccaagtcacaggaccagattcagatttttgtttccacctctgtgtgcctccaaaagaaacacacaagattaaatgagaaatttgagggactaacaaatgtatagcaccttaccacgttgtgactaaaactcctggctgcatctttatcttgtaatttctcttctaagcaataacaacaagcagaaattaggcagggtacattagcagcgtgcaaaacagtttcaaattcaaaaagagagatctgggctttaattttagctacagttctctaatttcttttactccagtgctttctctaaagaaactggaatattaaggtataatagcagatgttgaatgaaagtaaatgagataaaatctcccagaaagccataatgttgttgttattgtctattattgttttaagaaagtggaaagaaaaacctcagtcttatcaggatttaacctatacaaattacaaatattctagccaagaatttcagacaaaacagttttaaaggataaaagattcatggcaatagaatatgaatagctcttcagatttttaaagtagtctctctagagcatacaggatattaagcttgctgcagaatcttattactttttcctccaaggaagcagtcatgttttttaaagttgtgtcttgtaactttttaaaataattggctaaatgatcatctccattgatcagcctaggtcagtgattctcaactgagagcaattttgtttcccaggaacatttggcaatgcctggggacaagggtatgctactggcatccagtgggcggagaccagagatgctctaaacatcctgacacgcacaggacagtcccaacaacaaagaattttccagcctaagacatcagtgctggcgttggggaatctggatccagcttatggcttatacaatgataaatgtctagttaagaactaaaataccttattattatcaaatttccacaatttcaaaatgttcattttatctagagaaaaacatttgggtatttgactgcagtgttggcttctgaagacaatgcaaataaccactttaaatatgcaacttagaatttgtgtacctcagcactcaacacaaatgcctaacgttggcaaagtaatttagaattactcaggtgcaaactgtttcttttaaataaaacaaactaggttgtgcaaaaatatcattctctttcgttctttttcagatcgagaagatagagtgggacacatggacctgtgtcctggggcccacctgtgagggaatctggccagcacatagcgatataactgacgtaaatgctgccagtcttaccaaagactgttcccttttagccaccggagatgattttggtttcgttaagcttttttcatatcctgtcaaggtaatattgcgtgtttattatctttacttgctcagtctccttaataaccttaaatattgtatctaagtgcatttttaaaaatttgaagtcataagcaattcacattatcggagtattatttatgctgtataaaaacctccctgacattgtgtttgagtgactaatttcagtgcaattctcatggcatagaattctaccttgaaaggccttcagtggtcaccaaatccaacatctcacaaactgcaaagtaagtgttacctttacaacctcacagaccagtgcctttctaactttcattaggatacttccacagatgaggaacttaatatcacacagcaccccaactgatttttaaatacctccaattgttaaaacgtttttatctatcttgagctgaattctcttcttccctttttttttttgtttttttttttttttttgttttttgagacggagtttcactcttttgcccaggctggagtgcagtggcgccatctcggctgaccgcaacttctgcctcccaggttcaggcaattccctgcctcagcctcccgagtagctggattacagacgcctgccagcacgccagactaatttttgtatttttagtagagagagggtttcaccatcttgaccaggctggtcttgaactcctgactttgtgatccacccgccttggcctcccaaactgctgggattatgggcgtgagccactgcgcctggcctcttttctttttaaataaagttctaccttctgaaccatcattaaaccattccattcctctaacagccgtcatctgtagtaagatcacatttgactccccgaagtctcatttttttttccagcctaacctttctagttgcttcagccatttcccatattcgatggcttacagctgtcccctcccttaagcacagtccagtttatcaattcttccttcaactgtctagtctagaactgtattcagtgttccagttgtaatctgatcaggtcagagcacagtgggactgctaccttcttggttttgagttttacacttgtgttaaatcaaactaaaatggcattggcccttttggctgccacactacaaaattgaatcatagacgtcaatctcaaaaatgttcagattatccccaagcctgtacttacacaattgattttctaagatctgagtacagaactttacatttatacccaaagagttttatttatttcttctcagtgttccatcctatctgtatctttgaataccttgtcagagcattttctctcccttgcagcatcatgtcatcctctgctttcacaatcccgagttctaaatcatagaaaaaaagacagactggaacaatcacacgtcaactcaaggaacctccccctcaattcagttttacattccatttatttatttattttaactaatgaatgaatgaatgacagggttttgctgtgtttcccaggctggaatacagtggcacgatcaccgctcactgcagcctctaccttctagactcaagcaatcaatccacctcagcctccccagtagctgggattatgtgcataccaccatgcccagctaatttttttactttttgtagagatggggtctcactatattacccaggctggtcccaaactcttggactcaaacaatcctcccacctgggcctcccaaagtattggaattataatcatgagccaccatacccagctgtcattctgtttattaatctacacgttgtaacaattctttaatcagtaacagacatttaaatttacccccctgtacagtcatttatcctggtccaagaagacatcattaaattcttggcaaatgtcttgcctaaagacaagtggatagtggtctctgtcatccttaatctctccttctaataaaccaaccaataaaatatgtgaggttagttcacagtgtacccattactgtctggttatcactacttctttttccaaatgcttatcgaactcctgtgtaatatttcatcctagaattttccagggattacattacctcatgaatcaatattttccggagcctatttgttttcccactgggatacaagaaccgctttgtgtttgatgccacctctcctgattcctaaacttttcagctattactgtattatttctgtggtcacgtttgaaggcacctatactcacgtaaatgagttctgttttctcctttgcggtttgaagaacattctctttgacagaggaaatgagaaattgactttcagttcatgtgaagccacctgattgagaagtgttcctaactttcctctattttgcttccccccccccccaatccttttcaaaagtcttattttttgtctttagcattccagaaactacacttaaaagttggtgcaaggcttttgtattcaatctcaattatttgctactcctgtcatttgtacattttaacctgaacatagcagttacctctatggccactttggttactttggacacttttcctttcttctccttcctttgttaataactgattaggttatcatggtgagtagccctgagatacacatctgtttctgtccagtgttacgttcattgcccatcccaaagccgcctggcaaccttctgccaatgatctgtcacttaccagcccttcctatttgatcagaatttagttctaagtagccattttccttgctatttctgtgtgtaaatgaaattgctagcagtacaaggcaaaaagttagtgataccctggttttagtagaccaaggttttggagcagctatttagataactaaatcccccacagtactattgcatcttgctagtacttcccctacctgacaaggtggcttatctatatattagtcatttcaagttgtgttcctcagaccagagttccagggaggtatatctcaggtgggaaggaaggaaccagtgcaaaagctctggaatcccgttcctgtttcaacaaagttacactatgttttgtattttgcacattcatcttctgtgtatgcttttttctaagattttattgtgaagattttgaagcatacacataagacgagagaataatatagtgaactaatagaaacccacaacctaaattctgtaatttaaagtaaactgtagaattaagaaagaaaaataaagatctcaaataacctaactttacacttcagaaaactaggaaaagaagaccaaactaagcttcctgttagcagaaggaaggaaataataaagattagaacagaaataaataaaatagagactataaagagaatagaaaagaccaatgaaactaagagttggtgtttttgaaaaggtaaaattgaccaacctttagctagactagccaaaaaaaggactcaaataaaattataaatgaaagatgagacattataactgatactgtagaaatacaaaggatcataagagactactttgagcaattacatgccaacaaattggataacctggaagaaatgaaacatatctggaaatacacagcctaccaaaactgaagtgcaaagaaatagaaaatctgaacagatcaataatgcacaagagattgaatctgtaatcaagaacctcccagaaaaggccaagaccatgtggcttcatgtgtgatttctcccaagtatttaaagaaaaaatattgccaatcctttttaaactctttcaaaaaaagaaaaaaaattgaaggggagggaacacttttaaactcttcttagaaggccagtagaaccttgataccaaaaccagataaggacattacaagaaaactacaggccaatatgcctgatgaatataggtgcaaaaatctgaaacaaaatactacaaaccaaattcaacagcacattaaaaagatcatacaccatgatcaagtggaatgtgttcctgggatgcaaggatggttcgacatatgcaagtcagtaaatgtgatgtaccacataaagagaataaaggataaaaatcatttgattatctcagtggatgtgagaaaaggatggacaaaattcaacatcctctcatgattaaaaacacttcaattagatatagaaggaaggaacttcaataaaggccataaatgaaaaacccacaactaacatgctcaatgatgaaaagccgaaaacttttcctttaagataaggaacaagacaaggaagtcctagccagagcaattaagcaagcaaaagagagaaaaggcatccagatcagaaagaaagatgtaaaattatctctatttatgtacaacatgatcttatatatagaaaaccctaaagacccccccaaaagctattagaattaataaagtcagtaaagttgtaggatacaaagctaacatatacaattcaattacatttttatatacttagactatctacaaaaactgtatcatcaagacaaataaaatgtttaggaataagtttagccaaggaggcgaaagaactgtatactgaaatctgtaagacactcatgaaataaatcgaagaagacacaaataaatggaaagagatcctgtgttcatggagtggaagaactaatattgttaaaatgttcacactacccaaaaaataatctgcagattcaatgtaatccttatcaaaattccaaaggcatttttttcacaaaaattggaaaaacaaccttaaaatgtgtatgtaaccacaaaaaacctgaatagccaaagcaatcccaagaaagaataaagctggaagtgtcacactttgaaatatacatttcaaactatattacaaagctatagtaatcaaaatgtatggtactgacataaaaacacatagaccaatgaaacagaataaagatgccagaaatatatccatatatattatatagtccatctttgacaaggataccaaaaatatacggtaaggagaagacagtctcttcaatgagtggtgtcagggaaactggatatctacattcaaaagaatgaatttggactttatctcacaccatttaaaaaaattaacccaaagtggattaaagacttaaatgtaagacatgaaatcatacaactcctagaagaaaatataaagagctccttgacattggtcttggcagtgatttcttggatgtaacagccaaagcacaagcaaaaacaaaagcaagtgagacaacatcaaactaaaaagctttgcatggcaaatgaaacaatcaacaaaatgaaaaggcagcctatcaaatgggaaaaataattgcaaaccatgtttctgataaagggttaatatacaaaatatataatgaattttacaactcaatagcaataactatgattttaaaacaggcaaatgacttgaatagacatttctccaaagaagacatagaaatggccaacaggtatgtgaaaagatgttcaacatcactttttagggaaatgtaagtcaaaatcacagatatcacctcacacctgttaggatgtctattaaaaaaagaacaagtgttggtgagggtgtaaaggaagggaacccttgtacactgttatgcccaccaacagtgtacaaattggtgcagtcattatggaaaacgatatggaggttcctcaaaaaattaaaaactaatatatgattcagtaatcccacttctgggtatatatccaaaggaagtgaaatcagtatcttgaagagatatctacaccaccatgttcattacagcattatttacaatagccaagatatggaaacaactgaagtatctatcaacaaatgaatggataaggaaattattgtgtatatatacatatacatggtggcgtattattcacataaaaaagaaggaaatcctgtcatttgcaataatgtggatgaaccagaaggacatggtaagtgagatgagccaggcacagaaagacaaatactttgtgatctcacatatacgtggaagctaaaaaagttgaactcacagaagtagagagtagaagggtggtggccaaggactggagagtgggtggaaatggggagatgttggtcaaagggtataaactttttttttttttttttttttttttgagagggagttttgttcttgttgcccaggctggagtgcaatggcacaatctgggctcaccgcaacctctgcctcccgggttcaaccgattctcctgcctcagccccctgagtagctgagattacaggcatgtggcactatgcctggctaattttgtaattttggtagagatggggtttctccatgttgatcaggctggtctcgaactcccaacctcagctgatccatccacctcagcctcccaaagtgctgggattacaggtgtgagccaccacgcctggccaaagagtataaacttttaagataaataagttctggggatctgatgtagagcatggtgactgtatttaattatactgtattactttaaatttgctaacagagtagatcctaagtgtcctcaccaaacgcacacacacacacacacacacacacacacacacacacaatggtaactatgtcatgattaatgcattaattaccttgattgtagtaattatttcacaatgtatgcatatatcagattctgttgtacaccttgaatatataaaatttttgttaattatacctcagtaaagctgggaggaaaaagtaaattttagacatcaagatacttacccctaaatgtttcatcatgcatattactatctagagttcaagatttgcttatggtattttttaagtaaaatttatattcagttgaaatacataaatgttcagtgttccatttgataagctttgacaaaaagctcatgtacctatataaacatctcttatgaagatacatacgccattgccaccccaggctgcttcctcatactccttctgggccagtccccatgccccctccctccctcagctgaaacaactgttccaatgtttttcaccataaattttacctgtttaagaatttcatataaatgaaataggtactgctttttatccagcttctttcactcagagatgtttctgagatttatccatgttgttgcataataatagttcattcattttcatagctgagtagaattccattgtgtggatataacaggttgttcatccatattcctatgatgaacatacttttccagtttttggttatagtaaagctgctatgaacatttttagacaagtctttgtagacatatgctttctttctcttaggtaaatatataggagtggaatttctgagtcatggggaaaaatatatataacattttaagaaactgccagacctttttccaaagttgtatcattttatattcccaccaaaaatgtaagagttccagttgctgatattcgatcttgtcagatgcataaaattcagctgtccaggggagtagatggtgccatccagttgtgttttcagtttacatttctctgatgactaaggatgctgagcactttgtcatctatttactatttggggaagtatctgtacaaatcttctgtccattgttttaaattatcttttcattcttgagttctgtgtatttcttgagttctctatttcttcaatcagattgaagaaataggttcatggcttaaactactagccaaatatgaattattttgataaaatcacttatttttttttaaaaaaattatttattatttttcaagatggagtttttgctcttgttgcccaggctgcagtgcaatggcgtgatctcggctcactgcaacctctgtctcctgggttcaagtgattctcctgcttcagcctcctgaatagctgggatcacaggtgcctgctgccatacctggctaattttttgtatttttagtagagatggggtttcgccgtgttggccagactggtctcgaactcctgacctcaggtgatccacctgccttggcctcccaaagtgctgggattacaggcgtgagccactgcacccagcctcttctttttttttcaacctgatttttctggcacactttccttcccaaatacatgaatctcttgccaatgaatatttccagctgtatagtcacacttgtctaactgctatcactctgttgaacaaagttcattatctgttatgaacttgaatggttgtgtcttcccaaatctgtgttaaagccctaactcccaatgggactgtatttggagataggtcatttagggaagtaactaagattaaatgagtttataagggaggggccctaatctgatagaatcagtgtccttatagaagagatgccagagagctagctttcactctccacacacacaccgcccgctcttcctgtgagcacacagtgagaaggcagctatctacaagccaggaagagagcccgcaccaggaaccaaattggccagcaccttcatcttgcccagcctctaaaactgtgagaaataaatttctgctgtttagctacccagcctagggcattttgttatggcaacccaagcagactaatgtcccatgccattgctatattctcgcattgagttctatgtcatcagtcttggtgatacctgtgagatcttattaccaccacagagctctgtgtccaaaattcaagttccgtttgttggctgctaaaatcacgtcactatcttggctctttttctcattctactttcctatgagtgggcatctcttccgggcatttttctttccatgccagacaagtatctttattaatattcagttttataggttaaagccttcccaattagatcattagtgccctgacagccaccttgtcccaacctccatgagacataccctatcctttatcagagacttaacaggagcacgacccatttttgtagtaccttaaaccatggaccagaaaaccaaattctgttttttgacaccatctgtatggcctgcagattgcttcccatagcctcccttcccttccgaacctagacccttttgctaaatggagaggctaaaataccactgtgtcatttgcatttttaaaaccctccatgccctcaagtccttaagtttcctcctcagaatgtgaaaagctctggaggatgattcttcagagagaaactttgcatggaaaattttatagacagggaaactgaaatgtgaatgtaggggagagtgcacagctttcacgagattctcaggaatttcttccctacaagggattgacaaccactactctggagacatattccagattttttttgttttaagatggagtctcactgttgccaaggctgtagtgcagtggtgtgatcttggctgacagcaacctctgcctcccaggttcaagcaattctcctgcctcagcctcccaagtagcttggattacaggcatccaccaccatgcccagctaatttttgtatttttagtagagtcagggtttcaccatgttggccaggctggtcttgaactcctgacctcaagtgatctgcccgccttggcctcccaaagtgctgggattacaggcatgaaccagtgcacctggccatattccaggtttttctggtgctatcatccattatttcatcacttgatggatagagttgtggtgaagcagcaagttctgatgggtgtaacaagtgcagtttggcttgaagacccagaaaggtcattcatcccaatggctgtgccaggtcttgaggacgtttcctccgtaggccctgccgggaaccactatacatccctgccagtgtctttctcttgagacagcagctggtttcgcagaaccttctagcaactgtcaattccctttattgttgcatggagcagtgattttctttcctattctgagaatcttgaatcacccactgctgcaggaatctctgccttgttatatctcttcagtggccctgaattttttcctctctctttcttcctctatgtcccttttttcccctctgcaacctgaatctcatcccttagagtctgtttccttgaacctttctttttgcattttttcttgccatctagaaaccctgtgtccctcttataagttgagggtgtagagaggcatttctcatgctcttttacttctgtaaagaaacagcttgcatttgtagtgtataaactggatgtgctcctgcttccagctagaagaccagcaggacacatggctgcagctgctgtgactgtcctctgtttccatgctttctggaactcacatgttcaaatgggtttttcttggaaattcttttgttctgcctatttgctagcaaactaatgactctggagggcctcctggaaatcctacctgcctgtttgcttcaggaatctttctaggctcagtactctgctgaggagtgggcagttccgctctgccatcagctagtagttggccaaatacagggcgatcttgactaggagtattacaaagtcacgaaccctcctgcacctgtttcctgctgtatgtctgtgctgttttcagattctctagcatgccagtccaaaaccctctgggagccacttgtaaattacttaataaaattttcatctgggatactggtgactctgtcacaacctcagagagtgcatgtggccttccatattctgtaaggtattccctcggagtcgctgagaggatggaaaaactccatgtctttaaatggctcccgctgcagctgtttttgccaggctgtggctcatgagctgaatatggaagctttttctggtgccagctttgattttgcaccacttgtcaggactgccctggcatgagcagctgactcacattccaccctccacccggggataaaggtggggtggcctgggcacaccactccaaaaagcttttagtcgttactgataaattgggttgtatgtatttggctatgtttgttgaaaaggagctttgctttaaatcaatgtttgcgtgtttgtattaaaaattctttctagcgtctgtggcagaaaccgttgtgttcattttacatcttacttgaggtcccaggtttataagatatcctttgctcttctgccactgcctggactgtagtacaaaagtcactgtaggagatggctgtgaagacacttttgatctcagatgtcagccagactcacagtcaggagtttacactagagacctgtggaggcagcacatttgacatttgagagaaccagaacaagctttttatatgtctatagattcccagaaaataggttctgtagtctaacatttcattcattccctcaaaaatatattgaggacctattgtgagctgggtactgtttgaagaaaaaagagacctagtgcctgcccacatggagcttacattctagttgaaatgtaggaaattgctgttgaactgtttcctttgtatccagtagaaactaacatggataaacgagcccagagaaaggaataacagtggctggggtaataaccaatttcgggctttacagggacagcacgcaagattcaagaagtatgtggggcacagtgcacatgtcactaacgtgaggtggctgcacaatgactctgtgctgctcacggtgggcggcgccgacacagccctgatgatctggaccagggagtttgtggggacccaggagagcaagctggtggacagcgaggagtcagacaccgacgtggaagaggatggaggtgagccccccacctgccacatgcctcctgcgccgaatgcacctcccaacacctcccttcctgggccactgcaaaccaactggctccccaatctctttctgttgtttgaggctatgacagcgatgttgctagagaaaaggccattgactacaccaccaagatttatgctgtgagcatcagggaaatggaaggcaccaagccacaccagcagctgaaggaagtttccgtggaagaaaggtatggtgttgccaggtttgcttgcttttattatacctgatgacaagaaacttgtttaagccagagtgcgttttctttgccctcaaagttgctgtttaagtcagtcttttataaatcttcacagagtcttcacctgtacacaggcttaagctgagaaaaaattgcacaacatcccagtacgtggcaaagggcggtttatactttgtggaagttggttatggaatgtgacttgaatagacatgaaatttagttggactacacttctccatgcccagaaaaaaatgctagggtagccccaaagcagtcctgactgtggcagctgacaggaaagcctgctgaccagcaaggtaggagggaggacaggattctgaggtcatggaggaatggctgcagagttgtgaaaaaccatcttccattctaaccagaatctgtgccttatactccattcacttggtgtatcttctcttactgtgtcttcatttgcccagatttgtccaggtgggtttggcatttccagcctatcccatttggttttattgccttggatcctctatatagaatgagtgttttctagtattattttggggcttttcaatgtgctgttataagtattgacaagaattgtcaaacactttagcatttctaaaaagaaaagctcagaattactatattacttaatttatcatattcatgctaagagtggatattgaataaaaactcttaataactaaagagaatttcgtggatctcaaagatgttttaataattctgttggctgttcacattgaggtaggctcgatgttgacaatacgctggtcccacaatatgtaatttatgagattcaagtagtttgcatttagtatggctttctgcctaacaacaataagtctgacctatcacttcttactattatgtggggttttagatgcaaagaaatgtaacctcctcctcctcctcctcctcctcctcctcctcctgcttaaattcagtgccagatgttaaaataaacttggtaaatggtgggtgtgctactggcaagaagattgaatctaatgcaaaaaagccctaatttttccctagcatctttgttagatattacaaagatccagagctttcttttaagaaaaaattagagatttttctgcagtggtcttcagagttcattttgcttgcaacatggttttaaagtggccacaaacagaaaataatttttaaaagtcctaattctaagaattaaggggaaaaaagaaccatatgcacagaagtgcatgaataggcctcccacttaaataatccaatctaaaaaaatgtttcacctgaagtattcattcctttggaaaaaaaaaaattacccagcctttctagtttcatttctagtttcacataccattatgaaatgagttgacatggccattatcccaagggtgtttctggctgatttctgtaactcattcgtacatcatgctgagattcatgctagccaccaaaatataatcatttaacccaagctccaaattccaaacactacagctgatttcaaaccctaaccaaggctcacctaatcctcttcttgtctcattgcctctttgggcaaatctgtcaacatttcgtactgccaaacttaatgaaaggtaggaggactgatgatagagaggaccctaagaatttttcattttaaaattcagaattttcatgctaccccattttattatcaagctataccccatcagataggaaactgtatagtcgcatacactggaatgactctttttttttttatcaaaaggaaaaagccttataatattatgaaataggggtaggcagttcagtagtttactggcatttaaaaaaattcacaccaggatttagtgaagaaaacaattttaagataagtatagggtctggaggagtaatcaaaccttttctgtagagagcagcttcctaggtaactttaaaagccttgacagcctcaattcccagaaggagctggaactagagcacacactgccagctgcacagcatgccgggagcagagtggggccctgccaggtagggtcagctagtaaagagcaataaatgatggccaacttagcagtctccatgggggcaaatcacaatcagagccaagaacaagcagactccaccagtcctggtcagtaattttaggggagactgaacctcagagatcagaccgtaggcatcttttttttttttttttttttttgagacggagtctcgctctgtcgcccaggctggagtgcagtggcgcgatctcggctcactgcaagctccgcctcccgggttcacgccattctcctgcctcagcctcccaagtagctgggactacaggcgcccgccaccatgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggcgaccgtaggcatcttctggaccacaaaatagaacattgccaggcaaggcagggcatttggggaatttgagagaaagcaggatgagtgatggaattgggagggtggcacaagatgttaaacagcatatcttagtcctcatctagggtataaaacaggacccatggactctagcatcctggaatgacagagggacagagaaggaaaaatggtgacatcaggaccacatgaagccaggcagcagtggccagcttctccctgggaataatcagggccgttgcccagcagctcctgatactgttttctttggcaacttcaagccctgcttgaagatttgagaggcaggggttttccttggtgttcccgtcatcgtgccttccgtatatacctgcagataattctgtatacctgggtgctttttctaaacacttggttcaagacatgcaccaatgagactaatgggagacgagtacttgaggactgaaagagatgtgagcttgggacaaccactccacgcagggtccttagcactgttttgtcacttagcaatgtttcaggcagctctacctctggtaaatcccctgtcacctaaaagcaattagaaaccttgagatgactgtagcacctgtcgtactgagaaaaatgccttgaaggtagctgtgctttatgcatcaattacttttgaagcaactgaattcctaattcctaaattttaagatatttgtggattgtttctaattagactcagttatttgactttaaaatagctgtgagatttcagatcctgcttctttgcacaattgctaattacattgtgagttcttattcttcagaagccatatgatcttcagttctaatctttcagaaaatgaggaagctgagaagaaatttacagttggtctcaaaagaatcctgggctacacctaccagatatgtaatgtccatgaggtgttcagcgggtagcccagttactccagctttcctctaacacactgggataccctgcctccatgacccagactcatctggctggtccccaaccttgggtgatcttgctgctcagctgccacgtgtggtgtgtggctgaggaaagtcatgaagtcttttttacttttgggaatccatgctttcactccttatctgggcactcagggctaccccacgctgccctccttcatccccagccgacttgacgctaattctggtctagaggaacccttccaaaccttcccacctctcaagtgccacgccccaacctgacacacctcttactctcaacttttgaccttatctcctttgccgtgttttcttataatgtactcttttgtccatctacaaacttaagatatttaattgatactttaaatatcagaaaagttccttttgggagaaaaaatgaaggaggaaagcatagtttttcagagcaatttaagatacaaaatgcttatatcatctcaacatgaggtatggtgcccaaatcctgtattcagacttcggtaaaaacagttttccccaattcgtcaagtgatgaaatccctaaggtttgcttggtaccaaattactagagttgcctgttaaattaagaattttcttttcacgttaccaaagtcacacctagcttacatactgttttttgatttataacataggggctttcaagggggtcacccaacccaaactggcctaagcaaaggggaacttactggtttacacacctaagtatgcaggagtggggcaacttcaggtggcacttgttaagagaactcaaatcttgctgccaggattctggttttttccttcatatctcagttcttcttcctctgggttattacagttcttcaggtagaaaaatggctgcagaacttatagtctctgtggttcaaaatcagtaggaaagaactgcctctgattcacaagttccccctacaaatgtcttttgaggtgctattggctctggtgggccccaggactacccttgaaccaatcactatgggctaggaagaaaaagtctttgactcttaccttggaaatagtcacctgccaccatagactagcaatgtaatcacttcacctctctgtaatcacttcccccagaggtgatttggacagacccaaaatagaaaatgtctattacagttcacccttttcttgtcatatatattctcttaaaatggccccatttaaaactattctatatataggccaggcacggtggcttatgcctgtaatcccagaatttgggaagccaaggtgggcagattacatgaggccaggaattcaagaccagcctaggaaacatggtgaaaccctgtctctcctaaaaatacaaaaattagcctggtatggtggcacacgcctgtaatctcagctactcgggaggctgaggcaccaatcgcttgaacccaggaggcagaggttgcagcaagccaagatggcactgctgcactccagcctgggtgacagagtgagactctgcctcaaaaagaaagaaaaaaaaacccactaaaaacccccactatcctatatgtaatttgaaatgcagttatgccaccttcccaaaaagaggcggctcaaagtctcagccagttgccacatccaggatctgagagtactatgaaattttctcatccaggtccagataaagcccctcatggtcctgtggctaatgataatattaaccaccctaacttgccaaatagtggtaaagagaggacagaatgaagataatttttttgaatcaccactttgaaggagggagaatgagacaacacgcagtgatcactggtccatagcgtattgtcttctgctggactgaacaatcaacgattcctgccctagccgtgtgcgagtattatatgactggatggtaatgtgaatgttggaaaataccagcagtcaggatataaaggttttgtttgttctttcaaaacatacacatatggaagtgaaaaataaaagtaggaagtaacataatactctcttaaaagtacagctctccaagtgtcccaggttcctactgggatgtcagtgatgcccctgtattttgtcattctcatgggaaaatttgtatcctcccgccctcccatgagctcctcccttgacgagagactggctcagggcttggctgctccacaggcacgcataagctgtcactttgcttgagggaaggtcaatttttagacatctgccaggagacccacatttcaggtcaatctaaattccgtttttgtcatttagtcctctggcctaagatttggagttatatagtatcaacttagaacatatatacatatatatatatttatatttatatttgagactgggtctggctctgttgcccagagtgtagtatggtggcatgatcctggctcactgcagcctcagcctcctgggctcaagcaattctcccacttcagtcccccaagtacctgggactaggactacaggtgtgcaccaccatacccagcttatctttattttagagatggggtggtcttactgtgtttcccagggtgttctcaaactctttggctcaagcggtcttacaccttggcctcccaagtgctaggattccaggtgtgagccaccatgcccagctcaaaaaatatatttttttacatctcaaactgatacttgaattctcaagggaaagatatatcaattaaacaaattactattttatttcttaagtcaaatcacttgtcactctgccctcatttttggtgataaactgagtatgagttaatttattattggtagatattccttttttaaagtatagtttatattatttgtctctggaaggaatattataaccttttgtaggctcaacaaattttcattaatggtttggtattggcattgcttcgtgtttaggttgtcacgtttggtctttagcagacactcctttggttgggtgtacgtgtcgtttttgtagtaccaccatgtacctttgaaagtgtctgttttttgctaaggagtcccatgcttatctttggtgttcctgtcctgtgaatggcgtctgggctctatgagtacacataagctggagatttggagaacacacaaaatctagttcattctcctttaattgttctttctaatggaaagtggtgattatcacagaaaagaaccttagggtattttactgttgaacagtaattactatcatttgtaactacttttgcgtatgtttttattacctagtattatatctgcataactttttaaaaatcagagatggccagcaaaaattcaaccaaatcaatgtcaagaattattagagacatttaaaactttacccaattaaagtgaaacaattttgatgagtcacagtttttataccaccatctgagcgtgccacaacaatcaacttttaaaatacattcatgctgaggtttgttacttttaaaaattgtagtcttatattcacattatgttttgttattcgcatatatctttaaaaataatgtttaaggccaggcgtagtagctcacacctgtaatctcagcactttggaaggctgaggtgggaggataacttgaatccaggaggttgaggctggcaggagtttagatgagcctgggcaacataaggaggccctatctctacaaacaaaatttaaaaaattagctgggaatgaaaacacactcttataatcccagctactcaggaggctggggtgagaggatcccttgaggccaggagttcaaggctgcagtgagctgtgatcacaccagtgcactccagcctggccaacagagcgagaccctgtccgtgaatgaatgaatcaatgtgtgtttaaacatcttgggctcatctccagaggttttcattatcacattaagagaaagccagaaattagaaacttataactacggaaatatttagtgccaatgtctacattttttgttcttatcaaattatcatgtggcttcagttttgtatactgtggtaactacacgatcacaaaggaacattctttttgataattgatatgtagcatctaataatatctctaagtgtgggttatgatcttttactgaaattcatatgagctgaccaggtattagtcttcctagttacatctggtggagccatggttagtaatttatttttaaatgcctcctgtttgacataggtggatgtcctcatttcttcctcacttaaccggccacataggggttggtcataatggatatttttatttgctatatacagttggaacctgcattctacagaaacccaactttataataagatacagaataaatggagaattaaactattacagaaattggcatataagtactcacttaacctttatgttttgaagaggatacaataattagctcaaggattgttttctcaatgcacctgagtcagccatctgtatttttttcaaggtcctttattaacaactgctgaggcatacagcttttgactgtctatccagggatgaataaatgaatgttagacttaccacttcctgtttctacattatttttataacattattttacttatagcatttttcacctgtcactgaaaagaggtttaactgctccttcttttcttacctgagaagctgcataacttatggccaaaagtcaaaattccaaactcacctaaagcatatttttttccttccgcagtagactttgggcttgttgccagtctctcctgcttagctcaggctaaaacggtcatgtctctctttttttttttttttttttttaaagtctgggccgggcacagtggctcacgcctgtaatcccagcactgtgggaggcggaggagggtggatcaccagaggtcaggagttcgagacgtgcctgaccaacgtggaaaaaccccatctctactaaacatataaaattagctggctgtggtgcacatgcctgtaatcccagctacttgagaggctgaggcaggagaattgcttaaacccgggaggtggaggttgtggtgagccgagatcaagccattgcactccagcctgggcaacaagagcgaaactctgtctcaaaaaaaaaaaagaagaagtcttaggctaagcatggtggggcaagccggttatcccagcactttgggaagccgaggcaggaggatggcttgagagcagcctggacaatatagggagaccttgtctctaccaaaaatttaaaagcctgatgtggtggtttagttgcttgggaggctgagataaaaggatcacttgagcctgggaggtcaaggctgcagtgagccatgatcatgccactgtactccagcctgggccatagagcaagactctgtctttaaaaaaaaaaaaaaaaaaaaaaaaaaaaagtagaaaagttagtttttaatgcttaaattatattgccttagctccaacttagtgtagtttactttataaattatggataactgtagatactgtgatatttatagttttagtcactgatttgttagattttatccagttattcagctgttttacctgggtagatgacatgtacacagccatcttctaaaaaaagtttcaagcaacagtgtttttatatactctatcaatcaaactttgtgcattaattaaatactgtttgtatttaaatcattatggaatctctgacttctacaagagttgggtcaatgagaatcaaagcaaaacttggctccccttggatttcctcttacgtataaaacctctttatacgtaaagaggtttgctttaatcccacttctgacaccaatctgcttcgtcctcacaggacagtgatgttagtgatgtgaatgatggaaaagtgattgtataaaagttaggtggggccaggtgctgtggctcacgcctgtaatcctagcacattgggaggccgaggcgggcagatcacctgaggtcaggagttcgagaccagcctggccaacatggcaaaactttgtctctactaaaaatacaaaaattagctaggcatggtggcgggcacctgtaatcacagctactcgggaggctgagggaggagaattacttgaatcactccagcctgggcaacaagagcaaaactccatctcaaaaaaaagttagatgaagtttctgtaattttagggtatgcagaaagctatagatacagttacataaggcaggagctaatagcaatttttaggcggcactgttagggcttcccaagtccctctcatgcctcagtgagacatacagccatgcttattggcatttttccaagcacaagaggcttcctttatttctctgagatgtattttatacttttctaccatctcctcctgaaacacatacccaaatgtttagcagaatctgagtacatgcctaccagctcccacagtataagtaactactacaaaacagttctaacatactttgacacgtccactatgggaactaactgactttggcttcaacagaaccctgcctcaggcccaggcttcacgctgtctgaggttctcttcagcacaatgtgatgggttccttggacatcttctggctgcacctgttcggatctctgagaagattttgtttgtctttgttctgttttgccaagtctgagattggcactggggaaaattgcctttctgagggctttatttttggtttccgtattatctcatttctgttggtgggagacctgggagttgccttaagaactgaacaatcacaggcccttgctgttgacctgatcagggttacacgtaaagctctcctctcccaagtaggttgtcaactctgtgaaagcaaaatttctgttttatacactgctttatctctataatctagaacatgctggcacttagtaaatgtgtgttgaatgaataaatggattccttaacaacaagatttagattcattttcattctagcccatggattagatatcaaattctgagatcttgttgacactttgtcattaaaatccataatccagctaggaaatctctgcttctaagcagttggcctccctggtcatccttccagcgctcaggctgcagcattctccatctggcttctgcctttaggcaattccaagtagtggtctgaagtggagaagcccttgccccagactgcatctcagtggtgttgagggtagttgtctgctttgtctggcagggaatgtgtgatagtggatgtttaggaggggtctagaggatcaggcaactctcctttctctgtcatacttgctgtaagtttacttccatgtggatggatgagtactgcttccaacagtccccatggacgaggactcatttccaagtaccagtagccccttgtgatatgcacccatatttggctgatcgcagctgtcagcattccatcattttcaatagcccccacttgtggaccagcaggcatgtcataatcctgaagggtgatccttatcctccccgctccctgcagtgcccctgcctgggttctgctctgtctctcttgaccctccctccaggcaacagcagaggctaacaactttcatacaagagatggttgtcctggtttaatgagatttgggcatcccatacaagtctaggggtgtgtcccaagtggaattcctctcccaattctctgtgaagagaggggaaaggaaccatttcacttcacaaactgccttccactatagaggcaacttaactctccagccatctcagcggcccggcacaagcaaacacgaggaggcggtgccagaattattcttagcagcagattataaaggaggaatctgtgaatattctgcattaatattttagtccttgtggaatatattcactgtcaatctatggcatatgttccttaggaaaccaaggaacttttaccaaaccaaaattagaagtagtttctaagccttttataaatggtggtgcccttacctgtgaactgacaggcgctagcaccaaatgacctcaaaattccactgtagtattagcattttccagaatttttattagactgtgcttacagttgaatggataaggcattaaaacctatcttccacctcattctttctgagttgatttgaatgggtttatgaactgaaacaaaaagaaagttctataaagaaaactatatactgtgggcttaaaaaaattttatggggtttcagagattttttttgtttgttttggtcatgttttggtttcaactctaaattaatagccttctttaatccttgattccttaatttattagtctgtggcgtcaatataaaatttcactggattataaactgtgtaggattatcagttccccagtggctggtactgtacctatcatgggaccactgtgtgtctaacgtggtaccttacacttaatacacagcaaacaaatacttttcaaatgaatagatgaatggaccaatttacttagcctgattctcttaatatttaatctgtcttcaagatgctgtgcaagtccattcttggtcagcgaccacttttaccttcacttcattagcaactatggatggtctttgtgggaaatgatgtgactgatgtagaatccagggtgccccagttggccctgggactgcacttggcaaaatgactttttgatctttgtagtatctgtccttcaggaattacaatgtttgtttggtttaaatctgtttaaccccaggcaaaaggaatcaagaagattctgtgtcactgtggctatcatgcctattgtacacaccaaggtgctttgtcagcaggtttacaatgaaacaaagaacatgctcataagtgactacgagaaaacgggaaggatgtagacaggtttccttcagtcaccaaatcaccgtatataagtaatcccagttttccttctaaccttttatgctgtgcttggaaacagaaatctgggagaagttgcccccagtttgtatttagtttctaattttttaattgacatgcaataattttatatgtttataaggtacatagtttcaatattttcaatgtatagtggtcaaattggtatcattagcatatctttcacctcgaacatttgtcatttatttctgttgggaccattcaaaatcctctcttctgctgttcactcatatgtggaagctgcccccagttttttttaaacgccttatttaatcaggagatctgtgggaatttcaagctcgcctgaggcatgatgagcatggtgaagtggcacagtgtcaacggcaaatgagcaacctgtgctcccagctccttcctcagcgtagccggacagaggccctttgttgtcattgatcaatagctgttttgtgggcctgtattgttagagttgctaagaactgaccatcctgctaagctaatgctgctggatttaccatatagagattgatgaaaactgctcaatcctatcttgaagcttggcccaataaatggggaggaacttctagttctacatttccatcccgtttccaaggctggagtgagcttacagagcctgagagttggtacagagatctgcagttgcatgtgtgttgtttaagctgagcccagctctccccatgggagagtgatggcacacgcgtagtgcacgcagggcgaggagcactcctgctccagagcccttctctcgaagctgcgttcttcttcatcccaccccttcgttctgcaagagttctgcccgcatagctgcagcgagcaggtagaaatgcaagactcctgttctttatgaagttggaagggactgaaattataatatctattaaacccagaaatgctgaaattaatcatctccaaggcctattgcttagttaggtaactccactaaaagctgaatcattcgttgatttttttctaagtgaatatgatgctattttcataaatgattttctttattcaaaccccttgattttctgtattggtttgaagcaaagcaatgacttctgtctgataattttaggcattaaacctgctgttcattatagaatagtttcttcacttttgatgacaaagagtggccagtgtataaaaatccagaagtaaagtgttggaaaatgatttttagaagcttaatgtgcctaggaaatcacactcccacagtgtaatcatcaaatcaaacctactcacttatggagataaaagaacacttcaaaaatatgtaagcacttttctgtcaaaagggagtgactctccgaagactgtggcagagttgggtctgattcttttaggcaagtgtctgaacatctcacagattctccatctggggggaatgggcactaccaggggtgttgatctgcctcctgtcaattagtgtgtggtcaggatgtggtaaccgaggaggcatttgcaggagtggaaggtgtgaaggatcagggtgctcttgtgggtgtgtttaaactatgttggcgtgctctttacccgactccctctcgctcatttgaagttcgtgtcatgctctgccatcttctgccccttcctgttcttgtcatctgtcaacttcctgtctctgagcaattcagctcatggtcaactggccaaccccagccagctcctgccatgccctgggttacatcatcaccaggaactcctttgtccctcagtgtcttaaccagctgtcctctggatttctcattcccgggtacacctgatcttcatcaagacaaataagtgcctagacaccttcatttttccccaagttcatcagcccttcctggcctcactttttgtgcctacccaaatgccatttcccagtcctgttggcccttctcccctacattcctcctaccacctgcctctccactcttcttataggaagtcccacgttggcacagatggccaccaccagagaggctgcctggctgctgcacatggccctccaagctcctccatcctttcctttggttggttttctctgctgcttctcagcagtcatccaggtttcaactcaacctcctgcccctccttcactgagaaaacagaagccactggcacgcattccatcttggtgcttctttctctctcctccattttgcttcccatccttcactcacgtaagccattcaccttcttccctctcttctcagaggaagtaagtcccttctcctattcaagacagttccctcacctggtgcttggccccggcctcctgtccatccatgctccctcatctgtgtctcctgtgtcactctcccacagccagatccatgtcctcaaccaaaaaatacatcccagtttcccacctccacccagctctcctcaggaaaaaaaacaggtcctttgattaatcttataaacttacacatttctgccgtcaccttccttccaacctttttcctttctcattcaggccttgtagtcttttcttcattctctatcctatctcatctgtcctctgtccctgccattctgctgacatgggggctctttaacccctgagtccagtgactctcctctctctgtcttactaagagaacttgtttcttctagagtagcattgtccagtagaaatatgtgagccacgtgtataaattttctagcaggcacattaaaaaagttgagatggtgacattgattttaacaatatattttaactcgatatattaaaaaatatttcaacatgtaatataaaattatattttacattctgttaaaaacttttcagtaggacttcaaattccagtgtgtattttatagttatagcacaattcaaacttttgaaagccacatgtggcattggctactgaattggacagtgcgtgttagagaagaatataaacgttcttctctcgcctttttgaaagaatctctcttggcccttctggtgcctccctctctcttctcagtgtctcacctctgcttcctcttccagccccttacatgctgttggtcctcaggattttacctttggctggcatcttttcaccctctaccatctaccctctctcttaattaatcttttatatcccacccattggctagtgattcccagggtcatgtcactgactcccatctctcagtggaacttccaactaacaaagctatctcacgggtgttcaaagctcaacgtgccaaaattgaactcatcatcttccctcattgatattttctctctgtctcattccatgatacaaccatctgtccagatatgcaagctggaaaactggtattgcccttgagttgcttttcctacttcatcccctaaagactctccatgacaaagtgctgtgaagtctatttcgccaacctttctttaaatattcacctgttttcttctccataaccactgctccagtcaagtgcttcatcattcctctcttggatcatcacagtggcctcttcagtattctgcccatctttacttagttccctttacgccaccctttgtactctcattttttcacccaaataactttgtattcacctaaaatagccaagtctaagacgatatccccattttttaaaacaacaacaaaaagacacaaagctgtgtgataggcttcagtcaagagcattttcaagagggtaggcttctttcaggacatcctgcagttcttctgcctgaatcctttccatcaccccatcactaagtatctctgtacatgattctggaagacataggaatacactcaacagagtccagttcttaggaatactgttaacagagtccagttctgaagaatgcacttgacacagtccagtttggtcttgataacagagaggccccctggctttggagatttttcctaaccctggatttatcctagagcagtggttgctaatttctctgtgtttctcgcccctccctttctccctcccctcccccatccattcctccctacccccctccttccctcctccttcactccttccctcctccctctctgcctcccccttctcccattcctccctctctccctcctctcccactcctccctctctcctcccatcccattcctccctccctcatccctccctacccctcctccccctcccctctttccccctcccctctctcccctcccccttctctctcccttctctctctccctcccccttctctctcccctctctctctccctcccccttctctctcccctctctctctgcctcccccttctctctcccctccccctcccctttggatttcccaagacattctaaaaccattggagcattttatgccacattttggaagctgaagaaagctgtttcctccaaggacactttgaacattgtctgatgaacacgactcaaaacaacttcaaacttgaatttcttggctagttggaactgagtttccccacactcacacccacacccacacccctctttatagaaactggttggaacgacttggtttctcacaggctgtccaagcctcactccccagttggctctcatgttgtactcatcttgggttgcaactgactcgtgacctcagtggtttcagaagcttccctgagcactttggccctgaatgctcttacacatttcaggtcattgtgtgctctgctccacctcttgctctgtcagcccagtgccttggggagggggaaaggagggacaagtacccaggcattggcctgccttgcgggtctgtgcagggcaagagcccgtgtcaggataagactccccacatctttagttgagtctaagctttctcttcagcagcccagcgctgggcagtgggatgacagcaggaattggccttcccatgatcctgccctgcccacagaatgtgccaactgtttccacagggggtacagggttgtgactctccccacaggcactgaagagcagggccgacttgttactcaacaccaagccccaggctggagttcacagcctctccctgggcttcctgccttcactctgtcttcttggcaggcttctcctgctctccagagcttcggcctgtgtgccaccctctctcctgattatccagtttgtttgctgtcttgccaggctccctccttaaatttcttgccaatggaagctctttctcctttgttccctgaccctgcccccctgcccattctcctcaaagcctacttgccccaccaggcccctttgtgtctctgctcctcccacctccagtctctcaccccctcaccttcccagatcttggccccactgggtctccctgccaatgccgggttgtgcccacagccttcctcgcactcctgtcctgtgccagctgggaatgaccaactctaatgagctgattggactgaaagtgagtgaatgtcctcatgcctccactccttcccacctcagcaaagcttttcagagtcccatttctgatggaatctgaatctagaaggatttagatccacggaaaactgttaaacctccagtgtttggctacgtgtgaagtctctggcagtccctcccacatctgatgttatgaacactgtttatagatgcctggaaagaagcttttaatacttgtattgtgttttaacttgctttcctttggaggcagggaattgtcaagtaagtattcacaccgctctggagacaaacacaggtgtttggtgaacatccagtactaagtgttcacgcagaatccacaaccgcgaagggtcaatacttaaaatccgctgaatttgccacaatgcaggtttcttccccttgctcctctcatcttcagttttgaagcaatacagctgtaaacatatgcttgcgaaatgagaaagaaacattgagattgctttacctttcggtttttttctgaaaatcaaggtgaaaaaaaaaagcatcggattgcgtctgtgtatatatatacaatctcctgtatatataaatacacggtgtttgtgcttgtacgcatactctatattcactgtataatatattacatattatacaacctgtgtgtcccctgaaatcgagccctgtgtttatcctcaaataatgccttatgagccatgccatagttccagtgtcctcttgctctcctcatagcccctggcttgcttttgtcatacacttaaacgttcttaggtgaaagaagaaacccacggatttcatttgaaagtcccactaaaacagaagaaagagcagatgtcctgggaagcgataattaatgtgaaggaagtgtctaattgtgagaactggcatgcccccagtctcccgattttgctcaatttggtggcgatgatgtcagccgggggtgtcgttttgcagagatgtgctgtctacccattcttcagtggtgattataataccgtttggtccaattatcacttatgattacataacgtgttttgattgaagagtttctgagaaaataaaggtaccctgtcttcccctgcacacaaaaagaacccccgcaagccattcgagcaggcaggctgacctaccaagaaacactgggaattattaggctaaattatgagttgaacttgatttggaaacaaagtatccattgtacataactccccacgacatccaggaagatgtcattgtttttctgacagcaagtttctccccagcacactctaagcagagtccccgggcgcattcgtaaagtcacggagagtgtgcgggaagcattgacaaagcttccttttctctccctattctgtaggcgctttagtgcagagtttgcccagagacgccagggtatgagctttctgaatttgtagactggtgcactctttcatttctgttttagttctttgctggcatgctggggaagcatggtgtgtgccacacaggaatgtctgttcacttggaaaatgcttgtgcatgaatgaggtggttgctaatgcggctctaaactgtactaagtttctcacttggctttgtttgctgctttcaaggggatcaaggtaatccttctctttgcatatcccgggagcaataactaattactttggaacatgcggtgggagctggtacagttctttctcgacccatccatagagaaatctgatttaaggaaaccccacgtcaccaagaactggcgtactcctctaggattccattagggcttacacattataaaatctcttcattaaatttggaggccccagaccccaaaacggaggcgggaaaagcaacctttggtgtggtagcagctgaatgcagacccgagtcctgaggcgagggcggagtgggaggcgggagtgctgtctgtctcctgtccctctgcttcctgcctgcctgtctgagaagtgaggccgacctaggcacttggcctgtggtccttagggccctttccgcagcctggcttgtaagtgccacttcacgccacaccatggccatcgacaacttaattctgaacaacatgagcacatccctgtctgaaaaaggtcagcaagtccaggaaatgtggcctcccgcccctcatggtcaggcttctccttggttttgaaccaagcccctcttgtttcaagcccacatgttcttcctgctccccctgctcccaggagaaggttaagcagagggaggagggctgaccctgaccacggtgcctcaagcgtggggaggcccaacccagtgcctgtgaattcaggctgggtcccgtggcaggcggggagtgagagaggagggcaggactgaacagatccaagtggaggggcctttgaggcgggaggagagaggaggccggcactggcctagacaggccacaccgggaaggcagccttgcagcccttgttcaatgctgtgcttcctctggccgctctctcttccagaccacccgttagccgagcagctccccagcctgagaaactgcagaagaacaatatcaccaaaaaaaagaaactggttgaggtgagttaaacaatcacttgtagtctgatattgacgttctaagacatacctggtagacatccccatctgcacgtcccaaagacacagtcaaatgaaacggagtaggtcccttgggctctcttttgtcccctctccctcctacgtagcactgtgtcttccatcccagggaccagagtcgcagccactgtatcgtattcctgcttcccccagccctgtcaccaggtcctttcagtactaaatctaagatgtcctgtgtccctcaagcctggctccgtttccctccacttggtcccactcagaccctcagcatcccttccatggagaagaaaggaaagagacaggggagcacatattcaccgtctctaatgttgcctgagccccgactgtttgccgggtgccctgctccatagccacgaagcgtttcatacaatcttcacacacaggagggacgcaccattactgtttccattttcccgacgaggacgctgtggctgaggggagttgagggagttatcaggtcccaagcccaagatcaccaagccagtaagtggaaagggatttgaactcaattgttgagactaggctctcataaagtcagaggcctcctgactgttctgcctgacttcagactccaccctctctctctgacacatgccccaatgcctccagagttggttttttaaagtatacatcttccatgcctcatgctggccttcagacctgggagagtcccacattgccaatgggattcaagttcatggtttcaaaaccttacccagagccaccttctaagcttaccgcctatgatttttcaccacagtgcaaatctctggccccccaaacccaccgctagtgttctcggaagctgcctgggactttcaagcccctgtgttgtcattccttctgcttagaaggctcctcctgccagctcccagtaccctggtctttccaagaccttctccagtatcttttctgtagagtctttcctgatgcttctcaccctaaaccttcctgcagttccctgcccacaccccatccttccacctgcacagtgataggcacagaggagctgcctgagaggtctgtgttggattaagaactgatctgaatcagccactgttctttgtcttagaagacaagacaggaagatgagaaagactataaacctcaacagtatctagtttttgggggaaaaaaatggcaaatatgtagcaactttgtagagcaagcaccaggcagcagaacgagcatggcctttgactctatgttctgctctacccaccctggtcacattgatgagagtttattagagcaaacctctgagccaccattcagctcacccagagtgcctgccaaggcacagacacaaaactgctaggtaccctttacagggcatcaaatctctggactttggcacactgacagagccaggaagtaaatctgggttttttggaaagtcatggtgattctgtgtgttagactgccaccccagcatttcagaaaactaaagaaggggctgcattttctcctcagccagtcaagaagcaaaatgttttcagtgagtgtgtgttggcgtcaccagccataccgttcctgggacacacgaggctgctcacgcaatgtgggtgtgttcctcggctctcccttccttcctctgagggtcacattgatctgtgtgtgtgaatgcaggagctggctctagaccacgtgtttggctacagaggtttcgactgtcgaaataacctgcattaccttaatgatggcgctgacatcatcttccacacagcagcggctggcatcgttcagaacctctccacaggtaaccgggggttaaaaaatacaggtttttcttttagctgttttttacatgctttccccactctttagatgcccaaaagcttaagcattttccttcccttatagagccattccccccaattccagcatggtctcagttaggcctggtaacgctcaggttcagttaccagagtcagagccttctctctttctgacctgagcttgacctcacctcatcataggccctagagagaaggcggccatgttgacaccagcctctgtaaccgacagccatggagaaaagcaagagacagggtgtaaggagtggagaaattccttggagaccataaccatgaagaaatcacagaactttgcctattcatttttacaatgagctattttttaacagctcagatttttcaagttgtattttgacagtttagccacatttataatgagaatgaaaacaattaaacaataaacaaaaataccaggcccggcaaggtggctcatgcctgtaatcccagcactttgagaggctgaggtgggcggatcacctgaggtcaggagttcgagaccagcccggtcaacatagagaaaccccatctctactaaaaatacaaaaattagccaggcatggtggcaggtgcctgtagtcccagctactcaggaagctgaggcaggagaacccagtttgaggttgcttgaacctgggaggtggaggttgcagtgagccaagatcgcgccattgcactccagcctgagcaacagagggagactcttatttcaaaaagaaaaaaaaaaatactcaaaccacatggtgactcaaattttaaaaatgaacatttcaaacaaaaagaaccattcagaaattaacagaaaactatatcattaccaccagatttaaacaggttcacattttgccttatttgctcatgcctcaagaaaaaaaaaaaaacacctttcattttaaatttttgttctttgtcaattctgtgtagttgttcatacatagatttaaacagtgaaatcactgggcacatgttgatttgtgtgtatctgagggggaggaggaccttgacattgtctatatattttcttcactttctagccttgccatcatattggtagcagtacacaccttccttgtgtatctacaccatcattcatctttaggttcttgagcatttgggtgggtttaaagtggctattatggaagtcagcaaacccatttgctttgatagatggtaaagtgctctttcttccacttcctgtgacatatgtcgagttagggctttccagggtaaagccatcacctgtgctgtccaggcccccaagtggattggcatttggtgagcaaaggtgattagtccctgagaatttcatattccacatgaagaagtggtaccattttgctcagtaaagcatcatctccaggcctccacccctacttctgcccagatgtggacactgagaagcaccagtcctgtgccatggagtggaggagactttgaccttcatcattgtggactctggaaacccctgtacttgaactgtgctctggacccacacagagttgtgggaagtatcgaagagcagcttgagtgtatcagataacagacagtagctccccttctcccagacccaaaacagaatatgaacattccaaaaaaacgacccttcatctccccaagtgtgattctggaagtgagaatttgagggctgtaagctctcacttttataagaagtatccaatggctccacgcgatgttttgaagttgccctaaaaggtctttaggttccactgttcaccctcccatgatctctctcccccagggagccagagcttctatctggagcacacagatgacatcctctgtctcacagtgaaccagcaccccaagtacagaaacgtggtggccaccagccagataggtaggaggtcctgtggcagctgaggctctcccagcttgcagggacgctgacctgtcagcaattattgggagagggagtgggtgggttgcttacatccatcccttcttgttgatgttgctgttgattttttgagtcctgagtgtatctgtgtcacctgcgttgacacatccagtgactgtgattctgagggaccataaagtctgaccagcgcctgagagtccaaataaacgttggcccccatccctgtggacttgtaagaatagtttttcagaccccaagtgtcaagaactccgtgtcttttgaagctggttattgtgcttggccagggtaggtttcagtaagtgtgcctggaccccctgtgccctgggaaactgccggtgacaaatgtgaactgattcacatttatgagaagtttgttttcacttagtcatctcgagcaatttttacaacttcctgcttgttttcattgaatcatgtccatttttaagtttaatttggaactttctgatgctggtgttgagtgcttcactgttggaaacgtgacttattttagctattgttttcccttgacgcttcctcattgccattgctcacccaatgcaggtgatattacggaaaccccaggtaaggctgttccatccgtgagtagtttgaatctgcagagcaaaatcatgtcattctatcatgtttgctgattgtatcttgccgaattgcagatacaaatcattgacctcaccagtttccttcgtataaaatcctctgcaagtgtgtgtgtgttgaacataaatgtccgtagggctctgcctttaaaagcaaatttcctctagtctttctcctctggccaggtcaggctataggtctcttatgcccaatgactgtaacagccctaaacatttgtcttaaaaaaggcttttgcaggccgggcggcagtggctcacatttgtaatcccagcactttgggaggcgggcggatcacctgaggtcaggagtttgagaccagcctggccaacatggtgaaatgctgtctctgctgaaaatacaaaaattagctgggtgtggtggtgcgtgcctgtaatcccagctactcgggaggctgaggcacgaggatcgtgtgaacccaggacgtggaggttgcggtgagctgagctggtgccactgcactctggcctgggcaacagagcaagactctgtctaaaaaaaaaaaaaaaaaggcttttacatgaacataagcatcgccttggctctgccatttgtcagccttacttctttgtcatgcctctccacactcagggacaacaccttccatccacatatgggacgccatgaccaaacacaccctctccatgctgcggtgcttccactccaagggggtgaattacatcaacttcagtgcaactggaaagctcctggtgtcggtgggagtggaccctgagcacaccatcactgtctggcgatggcaggaaggtaaaccagcactgggctttctgtccctccagggtgtctgcctgtgggtgtcgagcctgtgggctcgaacccagatctgcctcactccgaagcctgccgtaggcactgactgctgctgggcaagtggaaaacagggcactggggatcctggtatagctgccccactgatgccagtgcatcccagggtcccagggccaggaggaggctggccagggactccagggcccattagtgaaggggctctgaggaggttccccgatgttggcagccctcctcctcggaaggcagcagcctccccgacatctgtcttagccaccttcctacccaagggtccttgtcttccgtgctctttctgatggcccctggatcctactacagccctatcactttgtctgctttattttaggaaatgggatcatgttttatcatagtctcagaaacatttaaattttttttttaacattttaacacttttgaaatagggatttatcttacaatccaggtttacatttactgtaacaggatttctttctagtcctcccccaatacatgcacacacacctcacacacatgcacacacacaagctgcaactgaatgtgtggtcatcttagaactaaagatgtgcagtcctcctcatatattctcaggttgggtactgccctggcaagagcagatccaattagtcagaacattaatgaggtctgtctgcagctaggcagcctgtatctgggacacgctctaccaggcaagcgcagaggtgtcacttctcccatccagggctctggagtcccattatctctgcatcttcccatggagggggtggtgcgtggaggttgtaaagagatcagcacactgggggaaagttccagtcactcctgagcacccccatatgaggaaaagagcctgacagcttgcagacatttgtaatgataccatattccttcagaaggtgacatgatctataatgtttctaggaaaccacatgttctcattctctggttcaccagtatatctcacccagatggctgcacagtcagtatcccaggggtgcagattcattccttgtgatgtcaagtggccaactgattgaccagactcagcccagagaaattgagcatcttaaatgatagacagagagcatcttggagtgggaagaactagagaagacttcctgcagttaggacccatcctaaggagaaattccttcaaatgcacccctttgtcctttcaaggggtgtggctttcaaggaccccttgaatactttcaaggatgtggctctcctcacttcacaaggcagcccacacgctgtcagaaagctcttgcgtaaagccccttcttatgtggggacagaaattgcttcattatatgtttcttctgtgctgctaactgttcctagatccttggaagaaagctctcacactggccccactgcacggccttgtctttttaggttcaggctcactgtcttcactccctctacctgtcctccaagcagtgcctgctttggcctgccctagcacagactcttgctcacccagggtcccttctgacctcccaggggaaggttagaggagccagggcttttaaacaagctcccgaggaaaagaggagcctgctcttgtttgtacagagggttgtgagccagtgctgatatgtgacctatcgctagccaccacctcttccgggttgaccacggacatgtcatttctcctcccttccttctccagtgtgggtttgccttcatttcaagtcttacttacagataaatagcatgtgtttggggaggtttacatacattttatgtatcactagagagcctattattcattcttcatttattagaggattgttttggggaacgtgtgtgtgtgtgtgtgtaggtaaaaataaaatagacctaaaaatgagcttattacataaaatccatgtcgtcaggtcctaggtatatgtgtaatttgctctgagcagactagaagccaatgcagagagggatacaggtgtctccacaattagaagcgtccatgaaattaaaacaaggaaaatataaacagtggctttgaaaaaatgtgcaactcattgtttgtttgcacttctcccatgactggtgagctggaatctctttcctttgtttgcacttctcccatgactggtgagctggaatctctttccatctcattggccacttgtattggctgcttttgtaatctacctgttcaaatccttttactacttggagtgggagggttgtcttttacttataatttgtagttccttatagatctctaatgttaatcctctgaatcttataagcattgcaagtgctttcttcccgtatgttgtgttactttgtttatggtatccttggagactgtgggtcttaaaacctctgagccctaagtagagagagatctgctacagtaagtcagagattccatatgcagagagaattacagctgggagaagttctctgtgggtccccctagcctcgcctggaaagagattctgttagggagtatcagaggggtggccacaggcccagctacatcaaaacccaccaccatcatggtactagaaagctgtcataaaaacaaatgcgaagtgatgagaacgaagaagaaaaaaataggtgtgtgaataatcaagggaggggtgacaagaaatcggaacaaaaacattcagagtaagttaaagggtaacaggtttaaaacaaaaatttaaaactcgagagcttaaaaataatgagattaaaaaagaggtgagtttaaaatacaggctaaaagaatagaagccaagaaattttaaaagtagctaaaggagtgatgataatactattactactactactaatactggctaacacatgatcactcagagtatcaagcactgtgctcagggcttcacttacttcaattctttttatctgcactgcaccttctgaaataggaacaattattagccccatcttacaggtaaggaaactaaagcacagagagcttaaataatttgtctaaagttgttctacaagtaaatggtagagttggaattttattaagacaaaggttaaataaaactcaggagacataaataaatggggttaaggaaaaatagtacttaaaaggtaaaaaaatttaaacctaaacaccacaaactaaaaaggaaaacggggaacttaaagaaaatgcaggagaatcttaggaaaaaaaaaaaaaaaaaagctctctagaggaatgtgagtcccagtggccctctgggagcggctctgtcatcctgtggggggacgactcctgtggtgatgctggggacttgatggaagggggatgggggatatctttaagccactttgctgccttctcatatctggaagcttccatctcacaggccatcctttcttgctacgttcatgaatgcctgggttgggggatctgttaccagcacctgctgctctggaaacttgccagacacactttccccgctgccacctggggaatagtgtctgaaggggagagagtgctgtaaagaagaactgaggcatggcttacgcctgctggggtggagacctcctgggctgcggctcccccggcctggcccatgaagcaatgaggagcctcactggactctgtcacccacacaggtgccaaggttgccagccgagggggtcacctggagcgcatatttgtggtggaatttcgccccgactcagacacgcagtttgtatctgtcggggtcaaacatatgaagttctggaccctggcaggcagcgccttgctttacaagaaaggggtcatcgggtccctgggagctgccaaaatgcagacgatgctctccgtggccttcggtgctgtgagttctagcagatactccctgagaaggggacccagaccccctgggcatgggcatgggcatgggcaggaggggagtttggccaagaggctgaaaacagcaggaaagccatttccacattcgctcctgtactggcttatctgcaaccactgttccttttctgtagcacatatgggtgggttggcaacatacatatatatattatttttctgagacagagtcttgctctgtcacctaggctggagtgcagtggcgcaatctcggctcactgcaacctccacctcccaggctcaagcgattctcctgcctcagcctcccaagtagctgggactataggcacctgccaccacgcctggctaatttttgtatttttagtagaaacagggtttcaccatgttgaccaggctggtcttgaactcctgacctcaggtgatccgcctgcctcagcctcccaaagtactaggattacaggtgtgagccacctcgcctggccaatattttttttttcttaaaatattaaccagaaaaggtaggacacccacccaggacaggaggtttgttgttctaaaggcaaccctgagttgcaagccccagaggatattgggaacaatttccactgtagataatgatcctttttcttaccagccctcttgtgccacagatgcccccaattaccacccttaagtgggctatggggtgccctcagccaatgcaagctccaacttcgtggtcctccaggagtgggtttctccctcttgtagaggagccctaggaaagtgtcctttggcctggagtctgccccatccctgctgtcacttgggccatgcttacagaagggaagtccttgctaatgcacagctgtgctcagaggggaagtcagatgcccaagccagttaaatatagtgaatttccaagccaggtgactgccttgtgatgtgctctcggtgatttctttgcaaattctgctgctttccttagcacaaagagatcaaactgcctaggctgtctgcatctctagctctggttccttaatgagagaacgggtggctggggagggacccgcttgagtgtgttccgggtgtagaagatgttgttttgtttacagaacaatctcactttcacgggtgccatcaatggagatgtctacgtctggaaggaccacttcctcatccggctggtggccaaggctcacacaggccccgtgttcacaatgtacacaacccttcgggatggactcatagtgaccggcggaaaagagaggccgtaagccaaagctcctatggaaacaacttgtcgtttgttgttatcttgggagaaactgacaaaagtgttcccaacttggagaaaatgcagactgtcatcctcctatcttttttgcattaggaagatcagtctgctctctctccaagagggccctaagtcaagatcctcacaaggaagagaggagtgcagaggtggtttgatgatagtttaaaaacctgagagaggcatggtggttcacgcctgtaatctcagcactttgggaggccaaggtgggcagatcacctgaggtcaggagttcaaaaccagcctggtcaacatggtgaaaccctgactctactgaaaatacaaaatttggccgggcatggtggtgggcgcctgtaataccaactactagggaggctgaggcaggagaatggctggaacccaggaagcggaggttgcagtgagccgagatcatgtcattgcactccagcctgggcgacaagagtgaaactccatctcaaaataaattaataaattaaaagaaaatcttgagaggtattcttgaacaaaccacagtgactttgctgttgataaaacgttattcttagtagctctgtggaggaatggaggaaggaggagaagaggggagatgcagaagcaaagcctgaagacaggagaaacatttctgtgttctaatctaataaaaagtctgaatttccaaattacgttttctttcctcccaagatagtagcatttgaaggcattttaggaaatctgcaagctcaggaggttgggattgcttagcaccagggcctaagagagaggctgcctggagggtctggaccctggagggtctttccttctgggccccaactggccagaaccctgatgactgggaaagaggggagagggccggaggggtagtgggtcttaggatgagggttaacagcctgagtccctttcaatcttttttaggaccaaagaaggaggtgctgtaaaattgtgggaccaggagatgaagcgctgccgggcctttcagctggagaccgggcagctggtggagtgtgtgcgctccgtgtgccgtggaaaagtgagcacagccagctcccctgggggctgggccagggaagggggaagtgtaggtaccctcccagccggcactttctctgggctggtttgtttactccttgaaacaaggcctcaatacatgaattgtgctgtagtgggaagcagcttaagagagtcagactcccccaggaagaaccagctgggtgaccttgggtgtgttccttaatgtttttgtgtccagcacacaggtttgtcatgaggtttttgtgagggtcacatatttatacatgacagtgcctttcatcttacctggcatatagtcccattcaggagatgttagctactagtattatagatgatatcctcataagctcagagatactaaatagtttgcccatgccctaagctatagggccagtaaggaggagggtaagggccaccaaactgtctgactcaaagccattggtttccaactcatatttgggtagcgtatcaaaaacaactgtcgggttttaaagaatatggatgtccgggcacccacctggagctggtgaatcagaatctcaggagtgggacctggacctgtatgtttccttctatttccttctatttaaattcccccaggagatttgatgcacttaaaagccaatctccaaacttctattgaataccttgtgtttgtttttaaatatcagtctaagaatttgctttctagatgctgtccatgaaaaaggcaaactggatatggagtaccacatgattcaaaactggggattttgttcttaaatagctaagtgatgcccacctggaagggtagttatgggagatgaaggcaggactatgcctggagcctggaagttatcaggaagtagtttttttttttttttttttgagacggagtcttgctctgttgcccagggggagtactgtggcatgatctcaactcactgcaacctatacctcttgggttcgagcgattctcctgcctcagcctcccaagtagctgggattacaggtgcccaccaccatgcccagctaattttttgtatttttagtagagatggggttttcccatgttggccaggctgttctcaaaactcctgacctcaggtgatccacccaccacggcctcccaaagtgctgggattacaggcgtgagccatcacacctggccaggaagcagatttttgttcagtggaaggaagaacttactaagagcttgagctgtccaagaacaggagaattggctgctttgctctgcagtcactggaatattctggcagaggctgggtgatggaggagtctgtgctgaagctctcacctgaggtagctgatggagaaagggcaaagtaagagggtggagaagagcaattaagaatggacagtttgttgttaaaaacaaaacactggccaggcatggtggctcacacctgtaatcccagcactctgggaggccaagaggcaggcacatcacttgaggtcaggagttcgagaccacctggccaatatggtaaaaccccatctctactaaaaatacaaaaattagccagatgtggtggcgggcacctgtagtcctagctactggggaggctgaggcaggagaatcgcttgaacccaggaggcagaggttgcagtgagccaagatgtcaccactgcactccagcctgggtgacagagtgagaccctgcctcaaaaaacaaacaaaaacaacacttctcaccccttcttattttaatattaacactgcaaaggcattttctcaagttacttgttttttttttttttttaaagacagggtctcactgtgtcacccaggctggagtgcagtggtaccatcatcatagctcactgcaacctcaaattcctgggctcaagcaatccccaagtttttctaataatagtggtgttttaaatttttttaactgtggccaaatagacataaaattgaccattttgaccatttgtaaatatacaattcagtggcattaggtgcattcacatgttgtgcagccatcaccaccatccacagaacttttcttgcaaaactgtaactgtacccactgaacactgactcccctgtccaccacccccattcaccggcagtcatcattctactttctgtctccatgaatttgtctactctagatacctcatatgagtgcagtcatacagtatttgtcctttttctaatagtgtttcaattacaacagggaaaaatcttagtgggaaccaaagacggagaaataattgaagttggtgaaaaaaatgctgcttctaacatcctgattgatggtcacatggaaggggagatctggggcctggccactcacccttccaaggacctcttcatctctgccagcaacgatggcacagcccggatctgggacctggctgacaaggtgaggccgactctgcccaaactcagatgcccacgagtgggctgcgcggcagtgggagctgagcgaggagaggcccagccagcgtcatggcagagacggggatggggccaggtaggagatcgagttagaaaacctaacgataaaagaagccccactcaccacaccccgtctaaacaatataattgagaaggattattctgttgtcatgaaagaacccacaaaactaaaaatatagagacaaatcatgttttccctggatgagaagactaaaaatgatttaaaatgtgaaatgttctgaaatgggcctaatgtatttctgtcaaaatcccaacaaggtttctcttagagcttgggaaggcaatgttaaagttcatctggagtaaaactgtgaaatagcaaggagtggctgggcggagcggggtgggtgggagggaacaaagagttcttgccgatcctcatggccttatccagtgttaaaacaagtactcaagttcaactaattaaaatacttggtttcattttaaaatggctggtaagtgtttgttgtatttttagtgtcagagtcacagaatagtcaggtaaaagcttgagtatggttgctagacttttaagttagtttctgtaattatttattaaacattattagcaacagctgtcactacttgactaactacataacaccagctgcttcatggacatgatcagtgcctacaataaccttgcaaaacccttattaacatcgctattagtaaaactctaaaaactgagatgtaatttacccaaacacacccagctagtaagtgacagggccaggattcagaatttgaactagcagaggcagaagctcacactctttcccctaaagaagaggttggcaatctacagttaaaggccagatcgggcctgtggcctgtttctacaagtccagctgccctcatttattcaggtactgaggctgtcttgtgctacagtggcaaaggtgagtagttgcgacagagactatggcccacagagtctaaagtgggtgctacctaatcatttacagaaaaagctgggcagcctgtgccctaaaacttgttgtcccccaagctgctctaatcaagacatacagctctgctcagttattcagggacatttactctaagaagcaagagatttggtggcctgcagtggctgcgagggcagcctgacttctctggcctggtgcagaatgtctcctggagaccagctgagggggccaagagctcaggtgactttcctttgcatcaatgtagaagctgttaaacaaggtgagcttgggccatgcggccaggtgtgcagcctacagccctgatggggagatggtggccattggcatgaagaatggagagtttgtcatcttgttggtgaacagcctgaaagtttgggggaaaaaacgagaccggaaatctgctatccaagatatcaggtacctaagtgggtggtctgggcatggaggagaaaggcaagcattctgcttaccagtggttcccattccagccacggctggaataaagaactcagttgtgagagggtcactttcaacaagccacctatgaaagaataccttctcccactctcactcttagacaagtctttgctaatttccataaaagtgtggttaaaattacttgtaaatgtcattctacatatttcccggggattcgatccagataaattgttgaattccgtagaatgccaggagaggctgaccacatgtgagtcacaaggtggctctcattgcctttaggcctggaaggcctgtcacagaccagccttcg

SEQ ID NO: 1347 - DNA, 135172 bp, Homo sapiens
tgtttgaagtttttttttctttttcgatgtagatgcttttagttataaacttccctcttagtacttcttttgttgtatcccataggttttggcatgttgtgtttccattaacatttgtttcagaaaacttttcaatttcccccttaacctcttcattgacccactggtcattcaggagcatattaatttccatgtatttgtatagtttctaaaatttctccttttattgatttctacttttatttcattgtagtcagagaagatgcttgatattatttcaattttttgaatgttttaacacttgctttgtgacctaacatatgatctatccttgagaataattcatgtgctgaggaaaagaatgtgtattctgcagctgttggatgaaatgttctgtaaatatttatgaggtccatttggtctatagtgcacattaggtgtgatatttctttattgattctctgtctggaagatctctccagtgccaaaagtggggtgttggcgtctccagctattattggtctgtctctttagctctggtaatctttcctttatatatctgcgtgttccagtgttggatgcatatacatttgtaattgttatcctcttgctgagtcgatccccttatcattatataatgaccttctttgtctcttcttatagtttttgtcttgaaatctattttgtctgatgtaagtgtagctacttctgctcctttttagtttccattggtatggaatatctttttacatcatttttagtctgtatgtgtcttccataaatgaagtgtgtttcttctaagcgacagatcactgaatcttcattttatgtcttttgattggagagtttagtacatttacatccaatgttattactgataagtaatattcatgccattttattatttgttttctgattgttttgtggtcttctcttcgtcctttcttcttgtcttccttttagtaaaggtgattttctctggtggtatgatttaatttcttgctttttacttttgtgtctatttgttgtatgtttgtgatttgagttaccatgagattttccagcactattttataagccattattttaagcttatcactgttatcacaacctaatagtgcttgcataaacaagcaaaaagaaaactaataataactctatgccttaacttcatcccccacattttaactttttgttgtttctatttatatcttaatgtactatgcatcccttgaaaatttcttttagttattattttcaattggttgatcttttggtctatttagtataagactagtttacaaggctgggcgcggtggctcacgcctgtaatcccagcactttgggaagccgaggtgggtggatcacgaggtcaagagatcaagaccatcctgccaagagatcaagaccatcctggccaacatggtgaaaccccgtctctactaaaaatacaaaaattagctgggcgtggtggcgcatgcctgtagtcccagctacttgggaggctgaggcaggagaatcacttgaacctggaaaaaaaaaaaaaaaagagtagtttacaaatcacagttacagtgttttcatattctgtgtttttctgtgtacttactattaccaatgagttttggaccttcagatgatttcttattgctcattaatgtccttttctttcaaattgaagaactcgttagcatttcttgtagatcaggtcttgtgttgatgaaatcattcagcttttgtctgtctggggaagtctttatttcttcttcacatttgaaggatattttcacgatatgtattattctagagtaaatgttttcttttccttcagcactttacatatgtcatgccgctctctcctggcctgtaaggtttccattgaaaagtctgctgtgagacctattggagctccattttatgttatttgcttcttttctcttgctgctgttggaatctttcctttatgcttgacccttggtagtttgattattaaaagccttgaggtagttttctttgggttaaatctgcttggtgttctataaccttcttgtattaggattttgatatctttctctaggtttgggaagtttactgttattatccctttaaactttttactcctatctctttctctacctcctctttaaggccaataactcttagatttgcccctttggggctgttttctagatctcatagatgtgcttcattcttttttattattttttcttttgtcccttctgattgtgtattttcattttttatttctttatttttttatttgactattttcaaatagcctgtcttcaagctaattctttcttctgcttagtctattcttccgttaagagactctgatgcactcttcagtatatcaattacatttttcaccctgagaatttcttgattcttttaaattatttcaatccctttgttaaatgtatctgataggattctgaattccttctctgtgttatcttgaatttgagtttcctcaacacagctacttggtctctttaaatctattttctatctttatgctttcttctttcttccctggaaggatactattatgagctttcatacccttcggctagttacttctctctttcctctttcctttgggcccagggatggtgccagctacactgctgccagcctcaggctcctgcactatccctttttggttccatcacaccctatccaccataagttgttcctttgtaaataaaccctcctctaattattctaatttaagtgttccaactgttttatattgagtccttgactgatatgggaaaattggcagaatatgaatctcctagtaccatcactgaggtgtagaatactgaaagttattatggaagagttctgagatcttagcagtatagagcattgcacagtcttattcctccattatggagaagaaggggctatttggcatgtattttctgaatttgggagcatattttaatatagcaactcatgtttgctactgtttgaatgaagaaatttcactgagcattttttaatgagacactggtcaagagtgccaagcctgaaataatcataatgtattgtgccttagaagaagatgcaggccattttcaactcattttacttctctgcagcccttaaagggtaaacaagagcatgtcagggattcctgtggctccatatgaagggtcgtggagactagcagaagggcagaaaccatcagactgcagtttctccaggctaaacaatggaacatccaacctgaaaatgacgttgggatagtgtcccgatgaaatacggatttcattctagaaggagttcttttggtagcaaagataggcatgaagctgaacattgctccaagaaaaccaaacattgcttataagaaccatataatgttcacacaggtagccagtagcagatggcagagatacatttgactacttactaagtggtttcttcattctctctttgcttccttcataggagatgtatgagaatatgagactcaaagagagagaaaaaagggaaagttcatttttaaaaaaaaagataaaaagataagccctctcctttactgtaagcctctaggttcaaaaacaggtttagcttgagttaggacaggtggagaggaacatagtttaggaaaggaggctggaggcaaggagatgagtctagaatggactttgatatggaagctataaaagaagcaatcttgaatattgaaacaagagtatactattaaacaagaatgattggaaaattgtggagttggccacgaaactgttaagcaaaccgctactcaggagaaaggaagagttattagaaaaggaacacaagttcatgtttatacttcaactcttgagactcactgcaattcccttctgacaggaatttttttttgtcttatatatggtagagttaattgttctagaagcctacttcaagctaacttaagcaacaaagtgggatttattggaaagccgcttgggtgtctcacagaacccaaggaagagaattgagctggatttcacaggacctggaaaaccctcagaaactcaattgttctctctctttcttctctctccagtcagaaccttcaggaaggggagagtggctcatgggctgagtggataaaccacaaaatgggtaatatactataggtgagttttaagtgacaaatgaagtctaagctgttattgcactggtcggtgactgaaactgaaaatgggaattagaggttaagtggagggaatatgttgccaaaatgttagaaggatcttcttcaaagagaagttgaggctctagaggataatggtagggcacagagtggaggtgaagcttgtgaggggtgggggtcaatggggaggataggagagcattcctgattttgaggaggaaggatagagggttttactggtgaatgacgtgagtaagtgtcatgaccgctcgtattctcaggattcttcagtattgggagatgtgactgcagtggacagggcagtgtcagagagactagattttataatagaagcttttaaattacctacccatcaccaacttatcaggagactgacactgtccatctcctccaaaaaaaaaaactgacctgcccggcactttgatgtccaccagttgagctttatgtttatcaagaatagttgtgtaaacttccaaaactgtttatggcaggcacagtggctcacgcctgtaatcccagcactttgggagggtgatgtgggtagatgacttgaggtcaggagtttgagaccagcctggccaacgtggtgaaaccccatctctactaaaaatacaaaaaagaaattagccaggcgtggtagcgggcgcctgtaatcccagctactcaggaggctgaggcatgagaatcgcttgaacccaggaggcggaggtggcagtgagccgagatcatgccactgcactccagcctgggtaacagagcaagactgtctcaaaagaaaaaaaaactgtttatatcagttatatttgttattgtaatgatgaaatttatagacaaactaatgaaataggagtataaacataccagtattttttaaaaataagttgaatattttatgactacataaacaataatcttttaaaagtcactgtcaatttgatgactaggagtcagccatacaactataaaaggttttgagaaaactgtaaagatctaaatagaggctgcatttagtttttttccccacaagaacctttaggttctagacatttatttcaaataaatgtcaactcatctggatgtagcttatgcaagaaagacctagaagagctcttattatggacccccattcaatgaaaacacaatggccctttatttctctttcaacatgaggaggtggaagggctgttcaagcccttctgttcacgatagcccaggaggtccaggagagaggcgagccgtgggtgagcaggagtgtctggggagtgtcaactttccattgaaaaatacccctatgatcaagccatttcacttccgtggcaatcttatttatgtattcaccaaaattgggtgggagctagtgtttagctgtcatcgtccgtaggctgctgtgtttggctcatggcagggtgtgaaactggcatcagggagtgtttgccaagtgaataagggtgaggctgccctttccagagccgccgggagaaactctggatacagagaccctagcctggcgccagtcccagcgttcctcctagtcggggaggaatctgtgggtgggaggtggggagcctgaaacccaaatacaacagccactctgggctgggcgtggttccctgggagctgggtctcagatccttttaaagctgatttctccccggatctccgggcaagatgggcaagtacacggtccgcgtagccaccggggatttgctcctggcgggctctcccaacctggtgcagctatggctggtgggcgagcacggggaggcagacctagggaagcagctgccaccggtgtggggaaaggtgagcgcggactgcggtgagagctggggccctgggactcagaggtgtcactgggggccggggccattcggagggtgctgctgccccacccatgagaaacctgggaagcggggtaggggctgaggtcgggtgcacttggtgcgcctgataggaaaagcgagaggaacaggagagatgagaggcattttcctgcccgagcggaaggacagagacgcccgctggggtgggcacggcaggcccggggggaggctggcgccccgcagtaccagctgctcctcctcacctccacctctccccggctgtgctgtggaggggaaacggagccaggattctctgaaggttcaccgaccccgccgtcctccctgaagaccccaaaacctgagctgtgtactgtcgcgcaggaggcagagtttgagatcgacgtccccctgcacctggggcgcctcctgatggtgaagctgcgcaaacacaacgtgctgttgagtctcgactggttctgcaagtggatctcagtgcagggcccggggacccaaggcgaggcctttttcccctgctaccgctgggtgcagggccacggaattatctgcctgcctgagggtactggtgagctcggtggagaaggggcacagcccctggcaggctggaggaagaagcgggtggggggaggctactgtaaaagagggaaaatgagagatgagggagatggggagaagtgaagggggagggtggctgatggggagacccgagcgcggaggggtgaccagggagggcatgtgctcttgtccctctcccccagcccggaccgtgagtgatgacccccagaacctgtttaagaaatatcgggaacaggagctcgaggaaagaaggaaggtgtaccgttgagccccaggaagtctttgatcccctaccagatcccaagaaacctgccacctgcctccttacccctacctgtgtgttcttcctccaggtggggctcctggaaagatgggttaatcctgcctatagcagggaataggcaaccggaccttcctagggacgagcgattcctcgaggataaggatttagactttaatgtctccctagcaaaagggtgagtaccaggtagaggctgggcacttgcttcctagggcacaaggtgggatgcttccttgatcttcttgcactccattctttccacaggttgaaggacttggccattaaggggacactggatttcataaattgtgtgaaaaggctggaagatttcaaaaaaatattcccacatggaaagactgtcctggctggtcagttttcacaacctcccaaaaccaatatacagacttccaacccagggatttgaaaaaggagggggatggaggattagatcagtgggattaggagttcggagctcagagctcacagggtgctccccaattgatgttcctagagcgggtttatgattcttggaagaatgatgccttctttgggtaccagtttctcaatggtgcaaaccccatgctcctgaggtgttcttcaaggctcccagcctgcctggtgctgcctccagggatggaagacttgaagacccagctggagaaagaactccaggtgctgctgggctttctgcccatccaccatcccagccattacccccacctcccttctcctcccatctccagccccttctctcatctcctccatctacacccaaggtttctcaacgttggcactattaacattctgcaccacataattctctgttggctggcggggggggggggggggggctttcctgtggatcgtagggtgtttagtagcattcctggcctctacccattgatgccagcagcatccccccggttgtgacaaccaaaaatgtgtctagatagtgctgaatgtcctggggttggggagaggaggaattgcccctgattgagaacattgatctacaacatctcctcctgtatcttcttttctttctccacattcctctcttccttcttcattgaacatatatcagccttagggaaaagcgcaagcttctggagagaaatagcaagaaaaactaaacaaagccttggagagctaaaagctgaatctgtttttggggggagatgggtagctaaaggaaatatttttgctacattggctaaagctggcagaagaggggatacgtgaagaatgcagtggccttatgtggtggaaaaccagaaacttcgctgcagggagctccaagtctgaaggaagacatcagtcatgaaaactttgcattcagttttttggttctgcagaaagtgattggtgtttaaagtaaaaaagacttgggtgggtagaggaaggatccaccctggaaaatgagagaagggcagctccagaaacaactccaaccctgttttctattcctgcccctggccctgtaggctggatctctgtttgaagtggatttctccttgctggatggagtcaagcctaatgtcatcatttttaagcagcaatgcgtggcagcccctttggtcatgctgaagcttcagcctgatggaggactcttacccatggtcatccaggtgagagggcccaggtatttttctaccagacactgatctcctttagggacttagatacacaagttctcagcccccactctctctcctgctctagctccagccaccttgacacggatgtcccccacctctgctctttctgccctcgcatccccccatggcctggctcctggccaagacctgggtccggagctctgatttccagctgcagcagttacagtcacatctgctgaggggacacttgattgctgaggttattgctgtggctacaatgagaagcttgcctagcctccatcctatctacaaggtacttcagcatctctgtcattctgtatctgactgtccttcatatttcagactcctacaaagagtctaaccttgtacatttcagtctagcagcaatcaatttatatgtggagacacatacacagatacatacacacacgcgtacacatacacagtaatatggaaacacccaggacacacacttactatgagttggggggagaagtgagaataggttttgcaaaggagttgaaattttggctgaggaggtttccaggtgggcaagtgaggggtggaacattacagccacaaagatctaaagaggcgaggaaagaagggaacatggataatggctgagattgggtgagattaaagtgtagggcatgagttgggatgaggaggaagaagaagtgggaggagatgagagaagaagccatgttacttagcggggagaagaatcaagagttattttctgaccatgtggggcttccaatgcctataaagacccatttgcacatgtcaggagggcaactggatatgtgagtctggagttcctagaagaggtgtaggttgaaaatacagattttagagtcattagaaaacaaaagtatcaaagtcattgtactggatgaagttctctagggtttgtagagaatttgaccgagatataactctagggtgaaccaacatttacagactgagagaagggagcagagtgagaaaagaaacaagagaaggaacctcattgaggtaggaggaaaatcaaaaagtgcaatccatggcagccaggaaaagaaagcgtttcaagagggacgcgtgattatctgtctcaagtgctgctgagagatcaagaaagttacagagaagtgacatttggatttctcaatatggaagtcattggttaataaatggacatgcgccatctcagggaagtggaggaagcctgattcatgggggtgagcagcaaatgtgaggtgggtaagcaaagacaacactgagtgaagatttgctgtgaaagggaaagcaagaaacagggagatggcaagacaaggatgtgggggtcaagcacaggttttctttagggtatccaatattgcacatgtttgtatgacagagagaggagaaggaatataattataggagggtgaaggcaaaaagggatgggctcatatgtgggtacctgcgaggatatgggatttttagaattcttccaaggacatgaaactgtggaaataagtgaactcctaaaactttcaccacgggatgctctgagaagacattttcccatctctatattcccaaatgttaccctgacccactccaatttaacgagaagtctctccatttcataaagacccatcctctcccttcttttctgtcacttcctttaacatcctcttccctcatggatgctgggaactctcttatttgaccatgtcccatttctttcttccataatcagctcctgatcccccacttccgctacaccatggcgatcaacacgctggcccagagtagtcttgtctccgaatggggaatttttgacctggtatggaaatggatgggtgaaggggaggatggttcaatattggaagaatcctaggggttgtttccctttcccattcctcccccaagctctccttcctccatggaaggcctctcccaaacctgcctcatgcctgaagagcttcctgcttaaaagggctagagtaggatcataggcctggagtttcctgatactcatctccctccctctgcaacttggcatggctgtgggttatcctcaggtggtgagcactggtagtggaagccacgtggacattcttcagagagccatggcttgtttgacctatcattccctctgtcctcctgatgacctggctgaccgtgggctcctggatgtgaaatcttctttttatggctaagatgccatcaggctgtggggaatcatcagccggtaggtgaaggtggcacagagaggcaatgaacggaggggcgggggactgtaggtccagaaggtcctgcattggcccctgagactgagtgtcttcttcccagggaataggtacgtggaggggatggttgggcttttctacaatagtgaccaagccatgaaggatgatctagagctgcaggcctggtgcagagagatgactgagactggactgcagagggcccaagaccaggggtgagacatggatccttccccactgaaccctgtcaacacccactcctctgcaaacaatctgcttcttctcacatcatcatgagacaccccacctgcccaaggaagctgagaattctccagagtgtgtccagaaatgctaacaagcactcctgatctccccagccctgttcctacacagtgttctctctcctctgcactaagagcttcctctggaactagatacaaaacttctcttaggtattttccctcactcttccctcccctctccccatagctcaaggttcatcccaagtgcattaacctttgagcacacacaaggtgggagtcctagggtgtgcaggccagaaccacagaaaagttcttttctgtatctccacatagctttccctgcgtgagacctatttcgtgttctggtttcgagatctctgattctcatttcaccaggattctcatttcaccaggttcctcatctccttagagtcccgggctcagctctgccactttgtcaccatgtgcatcttcacatgcacaggtcagcatgcttctaaccacctgggccaggtaacctatgtgatcatcccacaacggctcctgggatggagaagtgggggatcaaatgcccaggtcatcagcctgcatttctctgggctctcctccctgcagctggactggtactcctggatccctaatggcccatgcaccatgcagaagcccccgcccatctctaaggatgtgacagagaaggatatagtggacttactgcccaatctccaccaggcacgtatgcaaaagaccttcacaaagttccttggcagacgccagcctgtcatggtgagaagcaaatgcctgggtcctgggaaggaggcagctcaaaggaggggaagtattctgggctgagagtcccaaggggctgagccaacttgtcttctgcctctcagcatgaggagaaatatttctctggtcctgagccccaagctgtgctgagacaattccaggaggaactggcttccatggacaaggagattgaggtccggaatgcagtcctggacctgccctgtgagtacctttgacccagcatggtagagaacagcgtgaccatctgagaggccttgcccgcctcagctccaaagctccaccatccctgagtgcctttgagtattccgtcctcctcacatcctctggtgaacaaattgtccccaaagctttgtggtcagggtatccagagctgctcaccacacaactatggggaatacacagtgatggtccccattgcatttggaagtggcatcccccaaagctgccctaccttaaatgtccatccagtcctgcacttcctcaccccgatccctgcacacctcctcattgccaaaggacctggcttagatacaagtaaaaatatatgattaaataacaaaacggattatatgtgtggtggtggaaggtgggaggagagaccttgctttgtttcctgcccctttattcagattccaaagaaggaaagaaaagttttcctggaatgaaaattttttctagcaatcaatgctttttccaagggtatcttggaacctctctaagttaaatgacaagtgttctggatgactgagtccactggggctaagaaacctggctcttgacaagggtttttggcttgaggcctctctgaatcctcaataagccatcccttaggctacctgcagcaacgcctctggtgcaactcccagcacagccctcctgcatgatccctccccagctgcatcccagccttcctctcagtcctgtcccaggactcttgataaaccctcttctcatcatgctctatccttgcatccttaaaacataccatctagcccacagtcctagatactggagataaatggataaagaaggaactagtaggccagactctatgttagaaattttaaatatataatctcaatttatcacaccgggcacagtggctcatgcccgtaatcccagcactttgggaggcccaggggggcagatcatctgaggttgggagttcgagaccagcctgaccgacttggtgaaaccccttctctactaaaaatacaaaactagccaggtgtggtggcaggtgcctgtaatcccagctacttgggaggctgaggcaggagaatcacttgaacccaggaggcagaggttgcagtgagccgagattgcaccattgcactccagcctatacagcaaagagtgaaactcggtctcaaaaaaaaaaaatttatcctcacaacttctctgtgaggttggtatcactatcaccatcttataacaggaaaatgaaggttggagagataagggcagaaatgacctgggaccaaaatgcagcagagtcagattccatttgctagaaggaagcaaagcccaggattgtggtcatagcaataacagttaaaagactgatcataaaatctagaggccaatgaaagcctcggatggatctgatgtaatgggaaaaaaaggagagataaagattctttgagtcttttaaagaatcttatgcattcaaattacttatgtcccatatatttttaaaaggaacatatacaatacggttaatacggtagaaatagacatgtgtgagccatccagattcacctactgatgccctcaaccttctaatgtcccgtcctgttctgtgtattgcttccgtccatcatatgacttttttcagtagatgacgaaagaattttaagatagccacagaccatagactcacagaatctgacttggttgctagaagtttttgtggttgcatggaatggtagcaaggagagtcagaagagagggaggggatgaggaagaggcagaggtcacgctgaggttttcagttgcggcacaactggcgagaaatacaaagattcagaaggaaggttgtttaagtttgatgtaatactgtggttcttatgggaagaaattaaacaggtaattggagaggctgaactgaaaaaagaaaggaggtgagttctggctgggcgcggtggctcacgcctgtaatcccagcactttggaaggccaaggtgggcggatcacgaggtcaggagatggagaccatcctggctaacatggtgaaaccccgtctctacttaaaaaaaatacaaaaaattagccgggcgtggtggcgggaggctgaggcatgagaatggcgtgaaccgggaggcggagcttgcagtgagccgagatcgagccactgcactccagcctgggcgacagagagaaactccgtctcaagagaaaaaaaaaaaaatggaggtgagttctacagtttggatgacttaggagctgaatttatgaacaagggaaaaagaagaggcagagggccaaggtgtccttggccctaacaagaattagggatataaaaaagaacatgaggccaggaacggtggctcatgcctgtaatcccagcactttgggaggccgacttaggtggatcacctgaggtcaggagttcaagaccagcctgaccaacaaggtgaaaccccatctctactaaaagtacaaaaattagctgggcgtggtggcacgtgcctgtagtcccagctactcgggaggctgagacaggagaattgcttgaacccaggagttggaggttgcagtgagccgagatcgcaccactgcactccagcctgggcgatggagcgaaacttgtctcaaaaaaagaaaaaagaaaatgaagccaggaagtgagaatgatcctagtttgaaaggtaagaagaaaagctggatgatgcaggtcacggaagccctgtcatcacttcctatgactgggttgtctccctgagctctctcattttcttttttcttttttctttttttctgaaatggagtttcactcttgttgcccaggctggagtgcagcggcacgatcttggcttaccgcaacctccgcctcccaggttcaagcaattctcctgccttagcctcccaaatagctgagattacaggcatgtgccaccaagcctggctaatttttgtatttttagtagggatgaggtttcatcatattggtcaggctggtctcaaactcctgacctcaggtgacccacccgcctcggcctcccacagtgctgggattacatacaggtgtgagccaccacacccagcggctctcccattttctagatgtgtcacctcactcccattttcctccccaatctactccccatcctcgtgtgtttcctcagcaagtgtccccatctctgcacagcacagtcatatcctcagtccagctttcaaattctcccacctcatctctcaggagggtctgatataacgactcttttactcagataatctgttcaggcacctgtgcctatgagaggcttactgtgatctctgaatctatgtttgtggtaatcctacgtggactgctcacctctagatgtcttatgaaatcacctccccttatttctacaacaggctcaaattgccttcgggaatcattaaagctcagtgttctggctttgattggtccttcgctccctagtccgcctgcactcatgtagggtcatgctattacaaaactccacagggtaccatttatgttgtattccatgtggaaggtgtcctctggagtttggcaatatagcagctgtctgtaaaaatgatattgaaagcatcctgagttctggagctgcgccgattctattaggctgagaaccccagtttcaagttcatctcttcatttttctctcattccatttcacagcggcttaacagcaggtcctttgtattcgtttctggcccatagagggatctttattcaaaatcacagggttgtctctaaatttctgctaagctaatgaatggtgttagtatgttctcttctccagggcagaggcagagttttttttttttttaattagccaaaagcaacattacacaataaatcacatatcattgtagaagagaagagttaactattataactaaaagataaaatgccatggcattcaggcaacggtggattagaagtacttcgaacctatcagttctgtaaagcctagcttaagtctgttggtctaactttctaactagacttaccttcctttagaaaatatttgatgtgcagagagctagactgaggatctagcagtcacagatcaccttaattcaatcaggaactaagattatttgatgctgggttttaacccctttaaggcctgaatttccaccccacctttactgctagggtgcagctctttgaggtcccaacccaaagtgggtgagaaagagacagagagagagatacagggatggtcgagaatccttcaaagacaacatcagccacagattaaagagaaatcttcaatgtggagaaaaatctcattactttcacatgggcatcaataatacaggtagcattttctcaaatgaaacattagctgccagagacaatgaataatcttggaagtgttgaaagaaaatacctgccagactagaataaagactttctacaaatcagtaagaagaaataggcagttcaataaaaaatggacaaaaggcctggcacagtggctcatgcctgtaatcccagcactttgggaggccgaggcaggcagatcatgaggtcaggagatcgagatcatcctggccaacatggtaaaaccccgtccctaccaaaaaaaaaataataataattagctgggcatggtgatgtgtgcctataatcccagctgctcgggaggctgaggcaggaaaatcgcttgaacccaggaagcagaggttgcagtgagccgagatcgcgccactgcactccggcctggtgacagagcgagactccatctcaaaaaagaaaaaaatatactcaagacttaaacatacatttctcatggggacatccaaatgtcagtaaatatacggaaaggattatatttgatgattctatttgtcagtttaatatcacatcaacttttatggtatctggaggaattgatcccattctgggtaagtctgatgcccgtatggctcaattcgttgcttgtatctctggctttggttactgctccagagaattgcctgattccatactgcatgaagttttaagatatttgaatactagagaaatttccaaacctagcaaaagggtcctgtattatacaaatcttacagaaatctccaaggcctctcatcacatctccaggagatctacatctgtgtctcttatatgtggccaaagaggctatccttgactaactctgggtcactgggatgcctattttccccataccaccttattatttggatactttaccagaacgggtaggaagtctgctggtcagatatagatcatagttatcacagtcaacagcagtctatgtggattcttggtggcatttgacacagccactttcactttgcttaaatacttttatctcttactttctatgacatcatagtctcctggttgtccactttccttaatggttctctgccatgcaggtacccattccagggagtccctggttcccaaagtcatcctgattttcactcacaagctacccttaatatttaaacaaataggctggaaactctgtctctaggcttttgggaagggcccataggagaatgactgggtttctcattaattgattagaaggtacattgttaaggtaacagctgctgtaacaaatcagcccaaataaataatggttcaaagacaatagttgttcttttgtttcactcctgataaatttaaaacaatggttcctaattggtgcgtagtcctccttcactaagttagggactcaggctcccttcatcttgtggctctgcatatttaacatgtggtcaccatacttaagaacatttaggtagcaaaataagagagaacataaaagatgacatgtgtgatatttttatgggacacacacatagcaatcagaatccctggcaggaaacagttggcataatcaaagtcagtgtttgtttgtaaatctcttttattttctctaccataaaaattgctattgttattttatattgatatggattattgttatatttttattgtgaattattccctctagccttcaaaaggctgggcgtggtggctcatgcctgtgatcccagcactatgggaggccgaggcgggcagatcacgaggttaagagatcgagaccatcctggccaacacggtgaaaccccgtctctactaaaaatacaaaaattagcttggcatggtggcacgtgcctgtagtcccagttactcgggaggctgaggcaggagaattgcttcaaacccgagaggcggaggttgcagtgagctgagatcacgccactatactccagcctgggcgacagagcgagattccatctcaaaaaaaaaaaaaaaaaaaaacacgtagccttgctttctgctctgaattctataatgtctaatttttttttttttttgagatggagtcttgctctgtcaccaggctggagtgcaatggcatgatctcggctcactgcaacctccgcctcccgggttcaagcaagcaattctcctgcctcagcctcccaagtagctgggactacaggcgcacacgaccacacccagctaatttttgtatttttagtagagacgggttttcaccatgttgaccaggatggtctcgatctcttgacctcgtgatctgcctgctttggcctcccaaagtgctgggattacaggtgtcagccacggtgcctggcctataatatctaattttaagattatgagtgatactttttttgtctgttatacatttgcccatccttttattttcaacttccagaattagtttattttaaatgtaccttttgtgtatagtagacagttgggtttttctttgtaatctaatatgaaaatatttttcttgtaatacatgctatgttcatttacatcatttacatctattgatatgctctatttttaagtttttcatgtgattttttatatatataaattataatgttttactctgtggcttcttattgcagttagactattcaagaaggtttataattttgatctagcaataatctttatagtttctatttgatataaagaccttaatctcctcatttaaaatatttcttagtatgagcaatgatgaaattggcttgtagatatttcctccctctcatcaccaaatttttattgatatcttttaaaaatttattcttaaatgtgtgtgtacttctactacctgaattgtcattattaaacaggcaatagttgtgtactagagttctctagagagacagacccaataggatagagagacacacatatagattacacacacagatatatatataaatatagatttatagatacatatacacacacatacacatatatgaggggggttattatgggaattggctcatgtgattatggaagctgagaagtcccacaacaggccattggtgaactggagactccgggatgctggtagtatggcttaatccaagtctaaaggcctcaggtctagggaagctgattgtgtaattcttggtgtgaggccaaggtcctaagaacctgtgaagctgctgatgtaagtcctggaatccaggctggcaaacctggagttctgttgtctaagggaggagatgagtgtatcccagctctagaagacatgtttgcccttttcttgatttatcataagtattttaaactcatatggaagtgtttggatacatgttttatttgctccttagcaacatatttctggtgagttggttttttttgtttgtttgtttttgagacagagtctcaccttgtcgccaggctggagtgcagtggcgtgatctcgactcactacaacctccacctcctgggttcaagcgattctcctgccccagcccccagagtagctgggattacaggcacccgccaccacacctggctaattttttgtattttagtagagagggggtttcactatgttgcccaggctggtctcgaactcctgagctcaggcagtccacccgcctgggcctcccaaagtgctaggattacaggcgtgagccaccgcccctggcctcaagattgttcatcacatgtgcaaagtctctttaccatgtaagaaaacattcacaaatgctggggattaggacatggacattttctacctaccatgatatccatcaactctgaaagtgtccctgtgcccttttatgaccccttcctatggttccttcctccctgcattctgcacctatgaccccaggcaaccactgatctactttttgtcactataaattagtttgcatttcctcaaattttatataagttgaattataaaatatgcagggttttttatttggcttttttcactcggcaaaattattttgagatttatctttgttgtgacctgtgtccacagttcactattcttttctgttgagtagtgttccactatatgtatatactgcaacttaagaaaaatctgccacttgctgatggacatttgagttgtttccggtttttgactcttgtgatagtcaaaatattgacatatatataaattataatacagctgctatggacatttgtgaacaagtctttgtatgggcatatgattttatttctgttgggtaaatatctataagggaaataatttgcttggggatgactggttcacatggtatatgtgtgcctaacttttgtagaaactgccaaactgtttcccaaagtgtctatatctgtttacgttcctactagagttccagttactcatagggtggtggccactggattagttttcatctgcacttaccagcagcaacagcagtggcaccatggtaaggtgaatgctccttggctgcggcaggatgctagtgggtgctggggtaccagcctccatgcaggcattcatagcagcaaaagaggtagcatggcttgggcggcacaagggtcttctgccagtgaccatgcatgtgtttgtggcggtggtgttagcatggagacagggtggtgttgggagcaggactgtgtgtgcagttgtgtgtgtgctcacatcggtggtggtggctgctcagggaaggggtgggattcgctgttctccatgcctagctttgtgccagttgcagttttggcacagggccagggcactgttggtagcagagctggtgtgttccatgcccaccaacactgacaggtatggtgaggggcaggagaacggagtgtattcatgccagcagcagtggcatggcagggtgtgcacacatgtgcactggtggggaaggaaaggcaaagtttgcctgtaaacacatgcagtggcaaagcaatgtgggtggccacaggtgagtgtgtacagagaaagctgcatgggggaggctatagttaagggagggcaagggtagcctggtgcatatctgtgaaggctgctctgctggatccatatattggtcaggcatggtccaccagcacaggagctatgatgtgggcccccaaggaggtatctgggagctgcactgcaggcaggtgcagccaggctggggctctgtgagacgccagcagaccaagggatgctgaggtcaaactggtcctgtctcatgggcaacaccacccttcagagttcaggtctgactgtgcccctagggctaaagtgtcctatgggagcaagtcaagcctagggacatgggtttccctggctgtactccagtacagacattgttgcaccgaactctctgggctctgcaccagcaggatttctgcccctaccccttctctagacatctcttcctgccaactcaagtatatctggtggttgagagctctcctcttgttgggattctggaggcccatggtgagggtgggctgctccttgcctgttagactcaccccttccacaggaatcagtgggggccagaatgagtcctggtgtgcagtatccctgttcagggttcccagcttcctccccttcagcccagcctctgtgccttccctctgtccactctcaatgccttccctctgaagatctgctaggagtgcaccagtcttcctgatgtcttggtccctcactgggagatgtttctactggctgcatctagtaggccatcttggagcagcaatttgcatgttaaggctcagactgtttgtttgaatgcacacagaaaagaaaaaaagaatgaaaagaaattaaaaacacctactagatctagggaaaagcctccaaagagcaaatgtaggagtcattggaatttgagagggagttgagaaatagcaaggtgtagaaagttattccaagaaataatagcagaaaactttctaaacctagagaaagaaataaatatacaggtacaggaagttcaaatatcaccaaatagattcagatccaaataagaccaccccaaagcatataataatcgcactctcaagggtcaagaacaaagaaatggccaggcgcggtggctcacacctgtaatcccagcactttgggaggccaaggtgggtggatcatgaggtcaggagttcaggaccaacctgaccaacatggtgaaaccccatctttaactaaaaatacaaaaaaaaagttagctgggcatgatggcacatacctgtaatctcagctactcaggaggctgaggcagaagaactgcttcaacccaggaggtggaggttgcagtgagccgagatcgagactccatctcaaaaaaaaaaaaaaaaaaaaaagaacaaagaaaggatcctaaaagcaacaagagaaaagaagacaataacatgataacatgtaaaggagctctgatttgtctggcaacagacttttcatcagaagccatacaggccaaggcagaatgggaaacatattcaaaatgcaaagaaaaaaacttttttttttttttttttttttgagacagagtctcactttgtcacccagactggagtgcagtggcacaatcatggctcactgcagcctctattttcctgaagcccaagtgctcctcccacttcagcctcccgagtagttgggactacgggtatgagctaccaagcctggttaattttcaatttttatagagacaaggtctcccaatgttgcccaagctggtcttgaactcctgaacttaagttttcctcctgccttggctttccaaagtgctgggattacaagtatgagccaccacaactggcaggaaaaaaactttcagtcatgaatactatatccaagaaactatccatgaaacatgaaagagataaagactttcccagacaaatgaaactgacaaggttgatcatcagcggatctatcctataagaaacgctagagggagctcttcattctgaaagaaaaggatcctaacatgtaacaagaaaacatctaaatgtataaaactcactggtaaaagcaagtacatagacaaatagacaaatactctaatactgcaatagtgatgtgtaagctactcctgtctctagtttgaaaattaagagataggcattataaaaaatgtgagttgagacaatgaaaagtcaaaatgtagggagatggagttaaagtgtaaagttttcttcagtttttctccttttctttgtgactaaagttaattttcatcttaaatgacaactggttaagtttaaaataatgtgttataagatgttttctgtaagccttacaatagccacaaagcaaacacctataatagctacactaaaaataaaaagcaaggaaattaaaacatactaccagagaaaatcacttaagcacaaaggtagacagtaaaaaagaaagtaagggagagaggagttgcaaaatgaccagaaaacaactatgtaatatcaatagtaagttcttacctatcaataataacattaaattgactaaatttccaaattaaagacagagtggctgaatggattaaaaaaaaaacaagatccaactatattttgcctacaagaaactcacttcataaagatgcacataggctgaaactaaaggaatagaaaaagatattctatgcaagtggaaaccaaaaaggagtaagagaagttacacttagataaaataaacttcaagtcaaaaactgtaaaaagacacaaagaaggtggattaggccatttttgcattgctatagagaaatacttgaggctggataatttatgaagaaaagagagttaactggtacacagttctgcaggcttcacatcaaaccccacagactggtacatcccaagcagaaaaaatgaacataaatctataactagacacatcagagtgaaacttcagaacaccgcagatcaaaagataatctggaatacaggcaaaaaggaaggaaagatcacctacaaaggaaccagaattagcacaacaacaaaactcccaacaacaacggaagccagaaaataacagaatcaggtcttcggtgtattgaaaaaaattattggtcaaccaagaaatgtgaactcagcagaactctaaaaaaaatggtttcaatcattttttaatgagaaaatttacttctaaagaaagacctgcctcacaaaaacttttggtaatgtgctcagaaagaaaaggaaaaataatactataaaagttatctgagatgccaagaacgtggtaatatgtaaagaaaccaaaagcaacagtgtcaggttgaaacaagcatgctttataatttgtagtatttttttaaaggcagatatgctggttcctctctgccactgaatgtaacaatgaagacctgggcagaatgcgtgaagcagcagtatcacgggggttggagtgaaagcagaaggaaaactagtaatcagcttactagattttccctgcagaactcctagactgacttcaaggcagcctaaaacctagaggtgcaagtcagcatggacagatcaagctttagggaaagccctcagttctgggataagggagtgataaaggggtctcctggaaatgacaacagcagcgggggccgataagcacgtgcagtctgaagaaggggaatcttcctctccaatcagaagaagtgtggtcccaagagcgcggggaacacctccgtggattttttttcctctctctttcctcttatcacttgaccccgaatgagggcacagatgcaagaagtgtacagcaaggtaggctaaattaggccctaaatttctggctgaaggaccaaaaaggaaaatgccaggaaactgaaaagcacagaggagatcacagggagagaggagctcaggaaggaaaccccaaaatattgtttataagctcaggggctcattcctaaactgcacaaacagagattagatcacggaccaaactactaaagactgagagctgaattcagagatagggtcccatccaggttcctaactgggtggcacatgcatgggctagatccaaatagcattgcaaaggcctggaaaacagaactagaattgaaaccaccgcggaagactcattcgaactcgtgggctgaactcaaccaggtcaatgcttcagaaaaataccagcattctccacaggacataaacaagattgtctcataacataccattcaaaatattaggatacaatccaaaattgctcatcataagaagacaggaaaatctcagttcacatgggaagagacatagatgactatgaagagaagttataaaatactccaagtcggggcaaacactgttgaaaaggtagaagacctcaggaactaaatagaaaaatataaaggagaaccaaatgaacatttcagaactgaaaaatgcaataaggttttttaactgtttctgtcaagatggcggatgagaggcattgctggcacgcctctcccacgtggaaggacaaaatagtgtagagacattcactttgtgaacttttttcaagaggcgatgcagtcattgaacaggaaaacccagggacgctttgaaggacgcaggaggctgcagtctacactgtgagtcaggtgaaggactgtgagtcccagagtgtgagaggggaagagtttttgcctctgggatacacacccccaccagggaccctgaaagtacaggacacggaggaaggccctaaccccacccagcaaagggaccaactcggggagggtggcggaatataaaaataggagcagtggcagaagacacttgcgtgcactcccaaatcccaacacaggagggcagccgttccttactgttcctcacaggggacccccgtggaggacaggcaaaaagtttagacggcggtcgcaggttgaacgaagctcccgaggggtttcatgatatatatacataaccttgggtggggaccaactcccttggccagggccaggcgtgggagagtgaaaagtgggctgcgagtgcagggggccgtgagtgcggaagccgcgggtgcaggaacctcgggtgccggctttgcaggacagggaagggtgtggcgtgaaaaccacaattgcgatctcccgtggggaaagcttataactgtggcaagttccgattacagactggctggaattcagctcgccgctgccagtggaagctgtggtagtagatctgcctcactgagtgcatgggaattgggggctcaccgctgcctgctactccccactctgcacaaactcttctgcgcagcgggggcagaagaacatcaacccagtggcctgagacccactccatcccccaacattcacaggagctgctgcttgccctgcacacggagaatcagagcacaaacctgaccgacgcagcccccatctcgctttgccccgccacttgccctggtagcttaacacaaaggacagaatctcttgagagctctgtggccctgactattgcctgtgaaaccagagtattcctccctccacgcccccaccaccacgcccctcccccccccccccccccacacacccacctaccgcagccggtgttcatttgcaagcaccacctcctggctggaggccaaccagcacagtccattacagcatctcctggtagaataacattgcacccaggaagaaggaggctctatgatctcagctattaccactgcctgcatcactccggctaaccaggaggtcctgagtccacatgaccagctcattactactataactagcattcaagaaagccaacatactatggctaccaataaccaaggaatttcagagtctacgtcactcccctgctacccccagtagagctggtgttgctacccacttctgggaaactggcattcacaactggcatttcccaacaccagcctggagggtggcaacgtcactgggcagctagacccagaggagcaacaacattcacagtagcgtggctcacagggactcccactcatagggaaagggggagtgcgccccatcaagggaagaccctgtgggaccaaagaatcgggatggcaggccttgagcatcagatccttccgctggtggaaagcttccttgagcagaggcgcagctgaagtgctaggctcagcggggaaagccttcagctctatcgcaacagtcagacagctttggtgcatgggaaggatcttggagaagaggcagtctttccccccttgttcaccaccatatgcacagttgggacttctcccacaggagctcgacatggatgcaactatagacggccattctggaacacatcaaggcgactgcatccccacaagaggagcaccctccaggatcaggcttgcacaagaaacagtcacaattcctctctatttggaacaccaacacctacagatgaaaagaggtgcctgtctgatctgaatagccagagcgctgggacaggagcatatctaagaagtggaaaacgtccctgctgaccttgcaggggagctaaggtggctccaacccttctccctgataagacctcactgtgactcaccgagggctcctccagccacctctgtcaagcctgggtcttcatttacccacttgctttacccacaaccgattcctactcagggacacctcttctactggcctgaaacctgaaccatcaaaccagtaaataaaatactgggggaaaataaataaataaaaagtgcatgagatgggagaaggagataagctttaagaaacctctaccattccaaccccctaggagataatggaatggaaaaccaaacactgtatgttctcacttataagtgagagctaagctaggaatacgcaaaggcatacagagtgatataacggactttagagattcagaaggagattcaggagggtgggaagaggaccaagggaacaaaatctatgcattaggtacaatgtacaccattcaggtgacgggtgcaccaaaatctcagacttcaccgctatataattcatccatgtcaccaaaaaccacctgtaccccattaataaattaataataaaataaatttttaaaaaaagttttagctcactgagtgagcttgcagcagaatggagacagcaaaggaaacagtcagtgaatttgaagatagctcaatagaaactatgcaatttgaatgacatcaagaaaaaattgtttaagtaaatagagtctcaaggacatgaaggacaaaaccaaaaggtctaacattcatgtcatcagagtcaaagaaagataagagtgtgtggtgcacaaaaaaaataaataacgacttccaatttttcaaatttcataaaagatataacttacagcttcgaaaatctcaacaaatcaccaacaggataaaacaaacaaatcctcatccagataatcacaatcaaactagtgaaaactaaagccaaagaaaaaaatcttgaaagcaagcagagaaaagcaatgtatttcccatagagaaataataatttgaatgactgcagggttctcatcaaaaacaatggaggccagaagattcatctgacaaagcactaatatccagaatctacaacaaactcaaacgaattagcaagaaaacaacaatcccatcaaaaagtgggctaaggacatgaatagacaacaattctcaagatatacaaaatgaccaacatatgaaaaatgctcaacatcactaatcaggaaaacacaaatcaaaaccacaatgtgataccaccttactcctgcaagaatggccatcatcaaaaaaatcaaaacataatagacgttggcacggatgtagtgaacagggaacacttctacactgctggtgggaatgtaaactagtacaaccactatggaaaacagtgtggagattcacagagaactaaaagtagaactaccattcgatccagcaatcccactactgggcatctacccagaggaaaagaagtcattatacaaaaaaggtacttgcacacacatgtttatagcagcacaattcgcaattgcgaaactgtggaaccaaccaaaatgcccatcaatcaacaagtggataaagaaactgtgatatgcatatacacatacatacgatggaatactactcagccataaaaagcaacgagttaatggcagcaacctggatgcaactggagactattattctaagtgaagtaactcaggaatggaaaaccaaatatcctatattctcactcataagtgggagctaagctatgaggatgcaaaggcataagaatgacacaatagaatttggggactcagggggaaagggcgggaagagggtgaaggattaaagaacacaaattgggtgcagtgtttactgctcaggtaatgggtgcaccaaaatctcataaatcaccactaaagaacttactcaggtaaccaaacaccacctgttccccaataacctgtggaaagaaaatttttttaaaaaaagaaagtagaataatatttttaaagtgctgaaagaaaagagctatcaactcagaattctatatccagaaaaaaatatctttgagaaatgaaggtgaaatgatgacattctcagatgaaaagaagaaaaaaaaactaagacaatcaatttccagcatatgtaatctaaaagaattgcttaagaaatttcttcagacagaagggaagtgatgtgagaaggaaacctggaacacggggaatcaagcgagaacaacagaaacattaaatatctgggtaaatataacagactatccctctcctaatgagttctttaaaatatatttgatggttagaagcaaatattttaacatgactaaaagatttttaatatacacagatgtgattaatgggctgaccatctgagttcatctgctctcagccaaaaaaataaccacggcttctccctctgctcagcatgtcttttctctaccatgaggttctacttctttgtaacttctgttccccatggccatcttggcccctctggcttctctccgtctttgttcctattgctaactgcctgatcctctctgtattttccagatcaacacacacacacacacacacccatagtgagaaactgaccctgctcttttgtctggggagtggtcccatccaagtacacctctgactgtggatggggcagatttccttataaggggatggcaggtattatgatcgccatgtagaattcagatgcattaaacattttgttattctgagaaccatgccacacatttacacccctctaagccttgatatggtctattccttcttcctgggatttcttttcctctttgcctagaaaacttgtacatatccttaaaaatccaacacgagggctcagtcactcctcctttctcttcagtccccattgcccttacatccaacctctattcaagtatttaatatgctctttggacactggttgtctatacatttgtcgccccaaccagacagcttgctcccaaaaggaggcatcaggagattctcattactatattcctactgcccattaaccgttatattcattcatgtcttgtcatccattcaacaaatattaattgaatgtccactgtgtgtcagcctctgtatgaggcactggaatgcaaacgtgaacaagtcagagtccctgccccctcggagattagcgtggaccacactgtgtctggcacatagtgaatgttcagtaagttatttttaagttggatcgtacttgcttatagttctctaccaaggagccctttgacctttctcagacatcagagctttcacagatgaaaaggagtggaaagttaagtgggccatgattcccaaaagcacctcagacttggttatcaaaaaccaagcaactcttctagtccttatgtgtcccacatctcagcaaatacacacacatcatatacctagttaccccagccaagaaccagggagtaacaatgaccaatctttccttctcttctgctctctctcacacagtctactctttctctttctcttcctgtcatcaccaattaaacaatggagtcctgaccgctccacttccttcgcatgtcttccaccctgcccgtctccattcctgcttcccctgcttgctgcaggcctttattatctctccccagcacaccaaagacgtctcctcatgggtctcctgttttctgtgcaaccacatcactcatctcttcctgacccaaaattcatgaatttccctgaaatttcatcagctccctgcaactcttgctgtctgtttgcccagaatgcctaccctctccccaactgtccttcattcccatcaacccggtagatatctacacagatttaaagactcagctcaagttgcctccctgagaagccttttctatctcctcgaggtgaacctatccctccctgctttgtgcccccataataccccacacgggattctttctccattgtaacacactgttgcatttactttttatgtctttgtttccccccactagactaggaactccttgagggaaaacaaaatctctatgttctcaatgcctggtgcatagtatatgctcaataaatacttttctgaatgaatccagtaaacaaaatacttccctgtctttggcctttgtgaaacaagcagctagaccttccaggacgggcttctttgagcctctacaagagtcaaattaagtaagtaattcactgggttgtctgcctttgtagatctgaggaggccaaactccacctaattttccctaccctgaggcccatctggttctcacccaacaacttcatgagcacatccagatggtccctctaacatgagcactgccaatgacatgtaggacagtctcacacaatctcatactcgtatccctcttctgcgatcttaatccccaaacccaattttgcctctcctttaaccctgtgtccccaccacagttttatccttcatccattcctataacatgtcccctgtttattccccaaactttatcttcttgccttcaaaccttcaacctatgcataagcataatcattctacataaaagctattgagactaggcatggtggcacatgcctgtaatcctagcactttgggaggacaaagcaggaggaatgcttggggccagaagttcaagaccagcttgggcaacatagccagacccccatctctatgaaaagttaaaaaaaaaaaatggtagccaggtgtggtggcctgcacctgtagtcctagctacctgggagactggggctggaggatcccttgacccaaggaattcaaggctgtggtgaactatgatcatgccactgcattccagcctaggtgacagagagagaccctgtctctcaatatataaataattttttcaaaaagttattgaacatctatgatgtccagatcctgtgccaggcactgaagataaatagagaaatagaaggtaaatagagataggtagagtctctgcacaggggaaactcagggaggccaaagagataatatataatatgtaaataccaacccagtctatcaataagcattggcctcaggttttggaagggtcagttccatggactgtggaggtggtcaaaaaatgctttgtgtgtgtgtgtgtgtgtgtgtgtgtgtgaagatggggtcccactatgttgtccaggctagtctcaactccagggctcaagcaatcctcccacctcagactcccagagtgctgggattacaaatatgagccaccacgcccagctaaaagaatgcttcttgaaagagacagggcttgactgggatttgagctgggaaaaaagttcttcaacaagttcaaaaaaaaggagatcaaaatttcagattgagttagtggctcaaggaaagacccaggagtcagcaaatgcagtgttttaagagaccaataactaaatgatttgggctggagtggaacacgggcgtgggaagagcaggaggtgagtctaggaagacagtttggtggtagacggtgggaggtataattaccaggattagaaattgggacagtggcaggtaagcaagaaggtgaggaattctgtgttcaggaggaagaggattaacacgtaaatagcattttataaaggttcatgtggcagctgtaaggagatgggttggagtggggacagattcatggtaggaagtctatcatgatctaggtggtaaaatagactgaaactatgggatggaggagaaagatattacaggagaagaaccagttagagctggatgttaatgagaaaagtcaaggataaggccaatgttttgagcccatgactttgggtatacacaaatgccagtgataaaaaatggaaagcttaaagaaggaaactgagacaaatgactgactttggtcgtcgacaaatctttatgagcagtggtgggtatgagataaaggaagagatgtccagcaagtaatggcaaatccagacttggaacttttgagagaagtcagatattgaagaggagatgagggagccacctgcgtggaagaggagacctgcaagagcaaaggatgtggagggaagagcaggactgagccttgagatccgccttttcaggaggaggaagggggccaggcgccgtggctcatgcctgtaatcccagcactttgggaggccgaggcggatggatcacctgaggtcaggagttcgagaccagcctggccaacatggtgaaactccatctctactaaaaatacaaaaattggctgggcacggtggctcacgcctataatcccagcactttgggaggccaaggcaggtggatcatgaggttaggggtttgagaccagcctgaccaacatggtgaaaccccatctccactgaaaatacaaaaaaattagctgggcgtggtggcgggtgcctgtaatcccacctactcaggaggctgaggcaggagaattgcttgaacccgggaggcagaggttgcagtgagccaagatcgcaccactgcactccagcctgggcaaaggagcaagactctgtctcaaaaaaaaaaaaaaatacaaaaattagccaggtgtggtggtgcacgcctgtagtcccagctactcggaggctgaagcacaagaatcgcttgaacctgggaggcagaggttgcagtgagccgagatcacaccactgcactccagtctggtgacagagtgagactttgtctcaatcagaaaaaaaaaaaaagagagaaggaaggggaaagaatagagagcccacctggaggttaggaggagaaccagcacagggacgaagcagccagtggcagagagaggttcgaggcttaggaggttggtgttgcctggtatcctgtaagtttgtattcttatggtttgtatgcacaggaagaaagcatgtgaagaaatacaccagattgttaggagcagttaaaaaacaaaaagcaaacaaaaaagtggtgaaaaggagctgaggatgttcccttctattgtccatgaatttttacaattagtagtgattattttaataattatccccactgccacgccagccaaaaagcagtggtgacaagtcactttgctctcccacatctctctctctctctctccagccatgcctcttccctccttctcagcaccccgtctctcccccagcacacccctaatctttccactccaggctttaaactctttgacatagtttcctccaagtgttggtcagctactctttgtggggagaagagtaaactgtcccaggggccaacataaaaagagagcttgtttctgcctctaatgttttgttcatggtggttcccgtacctgttactttccctccacttattgtttccagcatttttttttttttttttttttgagacagagactcactgtgtcgccaggctggagtgcagtagcgcgatctcggctcactgtaacctccacctcctgggttcaagcgattcttcttctcagcctcacaagtagctgaaactacaggcacatgctaccacacccatttaatttttgcctgtagtcctggcaactcaggaggctgaagtgggaggatcgcttgagcctaggaggtggaggttgtagtgagctgaaattgtgcctgtgcactccagcctgggtgacagagtgagaccctgtctcaaaaataaaaatagtaacatacaagagtggtttcttagttatgacaattgaccagtcatgtgagatgagaacatcaggagaagcaaactgggggaggggaatacaagaactctctgttgtcttcattaattctctgtgcgtctaaaattattccaaaataaaaagtttattgagaaaatacattagcaacatggaaaatgcttatgatataatattaaatgaaaaaaaggatgacaggtatctgctcagggtaaaaaagaagataaatggggagagaaggaggaagtgagagttggcttcctcctacctgtcccacctcgtctcaactccctgattccattcttgctgatgcagccgcccaaaggagtatctgccactttatttcctgccagttcaaatcccatcccatcagctctcattaagaaaccctttccggccgggcatgatggctcatacctgtaatcccagcactttgggaggccaaggcggacggatcacctgagggcggatcacctgaggagttcgagagcaggctggccaacatggtgaaaccccgtctctactaaaaatacaaaaattagccgggcatggtggcgggcacctgtaatcccagctactcaagaggtgaggcaagagaatcacttgagcccagggggcagaagttgcagtgagccaagatcaagccattgcactccagcctgggtgacagagcaagactctctctcaaaaaaaaaaaaaaaaaaaaaaaaaaaaaaaagaataagaaggaatagaaaggaaggcagagtactgatgacatctgatccagccacaccttaatcctattgacctcagacttagctctatgagccaataaatccccttcctactttatttttgaaattgtaaattgataatttataattaaatttatgggatacaaagtgatgttacaatttatgaatacaatgtggaataactaaatcaagctggttaacatatccagtacctcaaatacttaacatttttgtggtgagaacatttgaaatttactctcttggcaattttgaaatgtacaatactctattattaactatattcaccatgctgtgcaatagaactcaaaagtatttttaaaatcctcctgtctgactaaaatctgatgccctttgatcaccatctctcccttccccacaacccccagcctctgtaaccacaattctaccttctgcttctgtgggttttagattccacatatatgtgagaacctgcagtacttgctttcctgaacctgacttaattcacttagcataatattctctaattccatctatgttgtcacaaatgtcagaatgtctttcttttctgttgttgttcttgttttttttgtttgtttgttttttgagactgagtctcactctgtcacccaggctggagtgcagtggtgcgagctcggctcactgcaacctccacctccccggttcaagtgattctcctgcctcagcctcctgagtagctgggattacaggcacccaccaccatgcccagctaatttttatatttttagtagagacggggtttcaccatgttggccaggctggtctcgaactcctgacctcaactgatccatccatctcggcctcccaaactgccaggattacaggtgtgagccaccatgcctggccgagaatgtctttcttttttaaggcttcatagtattcctttctgtaagtatgcaacattgtctttatccactcatttgttgatgcacagttaagttgattctgtaacttgctattgtgaatagtgctgcaatgaacatggggtatagacatctcttcaacaaactgattttaaacctttttggtaaatacccagaagtgggatttcaagatcatatggcaattttatgtttagttttttgaagaacctccatactgttttccatattgactatactaatttatattcccaccaacattgtacaattgttcccttttctccacattcttgacaacatttatctttcatatttttgataaaagccattctgaccagtatgagatgatgtctcattatggctttaatttgcatttccctaatgattagcaatatcgagtatttttcattatatctgttagccatttatatgtattcttttgagaaatgtctttatctctggaatgcaaggagggttcaacatatgcaagtcaataaatgatatgccacattaacagaataaatgacaaaaatcatatgattatctcatcagaagcagaaaaaaattgacaaaattcaacatcccttaaccataaaaacaatcaccaaattaggtatacaagaaaggtagctcaacaataaaagctatccagagatgctgacagctaacagtgactcagcagtgaataactgaaagcctttcccccaagatctggaacaagacaacaatgcccactcaacatggaattggaagttctagacagagcaattaagcaagaaaaagaaattggcaatagatttaaccaaggagacaaaagacttatacaacgaaaactataaggtgttgatgaaataaactgaataagacacaaataaatggaaagatatttcatgttcatggttcagaagaactaatattactaaaatgttatactacccaaagtgatctacaaattcaatgcaatccctatgaatatcccaacatcacttttcatagaaataaaaaaaaaatccaaaacttcatatggggctggacatggtggcttacacctggaatctcagcacttcgggaggccgaggtgggaggatcacctgagatcaggagttcgagaccaacctagccaacatggtaaaaccccatctctgctaaaaatacaaaaatcagccaggcatggtggcactcacctgtaatcccagctacttgggaggctgagggacgagaatcacttgaagctgggaggcggaggttgcagtgagccttgattgcaccacttgcactccagtttgggccatagagtgagactccatctcaaaaaacaaaacaaaacaaaaattcatatggacaacaaaaacctcaaacaaccaaggcaatcatgaacaaaaaggacaaagctggaggtatcacaccaccagatttcaaagtatactacaaatctatagcaatcaaaacaacatggtattggaaaaaaaaaaaaaaaaaaagacagacacattgactaatggagtggaatagagagcttggaaattaacctactactatacagtcaattgattttcaacaaaggtaccagaatacgcaataggaagaggacagtcccttcaataaatagtgttgggaaaatgaaatttccacctgcagaacaataaaattggacccttatctcacaccatatatagaactaaaaatcaaattaaaatgaattaaagattcaaacgtaataccagaaactctaaacttactggaagaaaacacagggaggaaaaactacatgacactctctgggcaacggttttttggatgtgaccccaaaagcacaggcaacaaaagcaaaaatagacaaatcagattacatcaaactaaaaagcttctgcatagccaatgaaacaaccaacagcatgcagaaacaactcacagattgggagaaaacagctgcaagccatacatctgacaagggattaatatccaaaatacagaaggagctccaacaactcaatattaagaaaacaagaaacccaattagaaaatgagcaagggacctgaatacacatttccactaaagtttttaagacataaacatactttggcataaacactgtattatatgcaattactttttgtaaataatttttgtaaagccatcagatatatatccaaatgatttttcacctgagtgtaagacaggaaaatgtttaaattaatacataaatcaaatcatctgcactggcattgttaacctagaagaaagtggctgcatagagaatagtaaaagcaaggatatttagtccatactttcaaatggggcttgatgatttgaaacaacaaagttgttcactggcagaatttcccaccaagtctgtataaattatgtgctatttgataaaagatagcctgaatgaagctaatttttttatcttcagtatttgctttaagagaaaaatcctgaagcttgtagggatttctaatgccaaaaaagatgatgaaatgggagagtatatttagcaatcatggtgactaagctcatggtaactggcatatgtaaaattttagtttgcattccaattacttaaactgagatgttcttgatcagttgaacatactgtgagtagacgatctctttctcagagaaacaagatggagagatcttcagagaatggccccactgaagctcattggtaaatgagctttctccagattttgttgatttcctgagtttttccataattcctcagttccctggccattttctgatagaccatggtcttcctattgccctttcttattcctcaaagtttggcaaatttttcttcattttttgatacaaactggaaactgcctttggttttatctacttactgaatgcagatgccatcttgggattatactgagatttgtgaagttattcaaacagtcagagaagcttcccgccttgtcctccctgttgctggaaaacagcagactgcaccagctggctttcagttatgttccacaaagatcaatgaatggttccttcaaaatagaagtctgcagcattatttattaaagttctccaattataaatagattcctctgtaagcaacattccatagcagttggaatctcctctgacatgggtacaatcactgatgaaaaccaggtaagttttgaagatctccagttgaatgttgcctcagtacctcaaaagcatcttcaaatgcttgagccagcttgtctcgttcacacaagttatgcttcactaataaactgatgattctgtccatcagtgcccaatctagcatgtacttgtagatgtggagataatcttccctcctctgaaacacacatctgcactccccaccacccactttaattttgttaaagcagttttgagttgggtttctgtcatctgcaaaggaaaaagtcctgagtcatttatacctaagaatcagataatttaagtaacaggctctaacatatgaaaatagctgagatagtgtggggtgcaaaacagagaggagataattattcccatccctaaataatatttgaaaagttttgttatacagtagaaatgcaactggctatccaatgatttgttaaatctttggactcagccccaagaaaaatagcaagatattgaacattacttgtggcctcaaataatattatatgagaaaagcagaagttcagtccaagctatactatctaaaagcagagagggaataatgaaacttcattttttagaaaaatctttatacccataccttgcaatccttgaggactgggagtcagaatttgaaaaggccaaattctgcatcctaagctaaaatttgtgaagacaaaagcaaagagataaagaaataccatactaaaatattgggaaagaaattgaaagggacacaacaaaatgaaaagatattccagattcacgaactgaaatacttaatattggttaaattataatactactcaaagcaatttacagattaaatgcaatccaattacattctctacagaaatagaaaaaaatcttaagacatatatggaaccacaaaagaccccaaataaccaaagcaatctgagcaaaaggaacaaagctggaggcattacactacctgacttcaaattttactacaaagctatagtaaccaaatcagtatgacactggcataaaaacagacagaatagaccaatgggacagaatagagaacgcagatgtaaatccacacatttacggccagctcatcttcaacaaaggtaccaagaacatataatggggggaaggataggcttttcaataaatggtgccaagaaaactagataactatatgcagaagaatgaaactggatccttctctcttaccatatacaaaaagcaaatcaaaattgattaaagattaaatctaaatcctcaaaccatgaaactactagaagaaaacattgaggaatcactccaggacattggtctgggtgaagatttttttatgtcagatctcaaaagcataggcaaacaaagtaaaaatagacaaatgggattatttcaagctaaaaacttctgcatagcaaaggaaataatcaataaagtgaagagaaaacccacagaatggcagaaaatataactaaccacctgagacggggttaataaccagaaggtatggggagctcaaacaactcaatagcaaaaacaaacaaacaaacaaaaacaacataatccaatttaaaaatgggcaatagatctgagtagacatttctcaaaagaagccatacaaatggccaacaggcatataaaaaatattcaacatcacaaattattagagaaatgcaaatcaatgagatatcatctcgccccagttaaaatggcttttatcaagaagacaggcaataacgcaggctagcgaggatgtggaagaaagggaacccttgtacactgttggtgggaatggaaattagtacagctactacacagaatagcttggaggttcctcaaaaaactaaaaattgtgctaccatatgatccaggaatcccactcctgggtatatctccaaaagaaaggaaatgaatatatcaaagagctatctgcacgcccatgtttattgcagcactattcacaatagccaaaatatggaatcgatctaagtgcccatcaacgaatgaatggctaaagaaaacgtggtatatatacacaatggaatattattcatctgtaaaaaggaataaaatcctgtcatttgcagcaacataaataaaactagaagtcattatgttaagtgacacaaagagacaaatactacgtgttctcactcatatgtggaagctaagaaaaagtggatctcatgaaggtagagagtagattggtggttaccagaagccagcaagggtagcagaagtaggggattcaaagaagttgataaatcaatacaaatataaagttgagagaagaaataagctccagtgttcaacagatgagtagggtgactatagtttacaaaaacatactgtacatttcaaattagaagagaaaaattcaaacatttctaggataaagacaaatattaaggtgatggatatcccaagtacactgatgtgatgtatacaaattatatgaatgtattaagttatcatgtgtgccctgaaactatgtaacttattatccatcaattttttaaattgttgaaaaaatgattaaatgaataaataaaatattgggtcttggatgagccagaaaatttgggaagtctgattctctctcaaatattatattctaggtattctttgccagacaaaagcatcatatcccttataaaaatgcatccagtaggttataatcttgggggaaatgccacattatttagcttcattttccccttcaagtctttcacattgttcaaagcagacagcaaagtgaaagcattattttgggagatggggaaaagccagaatagattattggcaagaaatagaaaccacaagatgaggatcaagagtcaaggtccaggtttagacaagatctctggatgtggttattatgccacagaatcatcaaatgtcaactgaggttttaaatactgcttaaaaatgccaagcctggaaataggtgcctgtaattcttcagtccttcagtaaatacccaggctattaaagtaggtaattcccaggaatgaaatcctccttgcacctctcttaggggtggccatggaggacacaaaacacagatatttatctttggaagaaggaggtagaactgtttttgaaaatatatataaagtatagttgtgtttggagaagcagaggcatttttgaaactatatgtataattagaatggtatgtgaatatatatacaaccaaagacaaaggggtaaaatggggtaaaaatctactattattcactatacggcactcattctcaactaccttctcagatctaaactctacttttctgtagagaaccccttccctgtggttaggacagggccaacactgacttgccaccatgacgacatcagtgggtacatgacctagactcagcaaattatgctacccataacatcggctaccatgatcatttaagatctggacatgaaatctaaactaggttctccctggacattttctgaaaggtattagagagtgggtgtagtggctcacacctgtaattccaacattttgggaggctgaggtgggaggattgcttgagcccaggagttcaagaccagactgggcaacatagggagaccttgtctctatgaaaaacaaaaaaattagctggaggccgaggcggacggatcatgaggtcaggagatcgagaccatcctggctaatatggtgaaacccgtctctactaaaaatacaaaaaagttagctgggcatggtggtgggcgcctgtaatcctagctactcggtaggctgaggcaggagaatggtgtgaacccgggaggcggagcttacagtgagctgagatctcgccactgcactccagcctgggtgacagagcgagactccatcttaaaaaaaaaaaaaaaaaaaaaaaaattagccaggcatggtgatgcacacctgcagtcccagctactcaggaggctgaggtgggtggatcacttgagcctgggtggtcaaggctgtggtgagctgtgattgcaccactatactccagcctgggcaacagagcaagaccctgtctctaaataaataaataaataaatataaaagtaattttttattatacattaagttctgggatatatgtggagaacgtgcaggtttgttaacataggtatacacgtcccatggtggtttgctgcacccatcaacccgtcatctacgttagatatttctcctaatgttattcctttaaaatggaaggtattaggaagatttctttccactgtcggtcaggaatgagatggatgtggtgctactgaaggtcgccttgccactctgtagtaaaagaaacctctgcaacgaatttgaggaaatcacagctgacagatgtaaagaggacacagagccctcctcacattgttagaattcctggaactaaacaaatcactccttttaccttccagctgtgtaagcctcctcctcaaaaaaaagaaaatcattttttgtgtaagctagtgttttctgcaatttaaagctttaaaaatccaactcaacaacaaaacacaacccaatttaaaaagggacaaaagacttgaatagacatttctctgaagatatataaatggccaaaaagcacacaaaaagatattcaatgtcattagtcattagagaaaggcaagtcaaaagcacaatgagatataccattttacacccactaggatagccatttcttaaaaatagagaataaatgttggtaaagctgtggagaaattggaaccttcatacattgctggtggggatgaaaaatggtacaaccactgtggaaaacagtttggtgattcttcaataaacacagaattatcacatgacctagcaattccactcctaaatatgtacccaagagaagtaaaagcaggtgttcaaataaaaacgtttccatttgtttacaaaatgttatacaccagtgaacacagcagctctattcacaatagccaaaaggttaaaacaatctaactgtccaccaacagatgaataaaaaaaatgtgttttgataccataaagttaaatgttcttcatccataaaaaggaatgaacgaaaaatacaacatggatgaccctcaaaaacactatgctaagctggccgggtgcagtggctcatgcctgtaatcccagcactttgggaggatgaggtgggcagatcatgaggtcaggagttcgagaccagcctgaccaacatggtggaacctcatctctactaaaaatacaaaaattacctgggcatggtggcgcacgcctgtagtcccagctacttgggaggctgaggcaggagaatcacttgaacccaggaggcggaggttgcagtgagctgagatcgtgccactgcactccagcctgggagacagagtgaggatctgtctcaaaaacaaacaaacaaacaaacaaacaaaattatgctaaataaaggaagccagacaccgaagaccacatattgaatgattccatttataagaaatgtccagaataggcaaatccatagagacagaaagcagattagtggttgccaagtgctgagaagagagagaaatggagagtgactgcttagttagcatttctgtttagggtgattttttaaagttctggaccgagatagaggtgatggctgcataacatgggtgaacaggcttaatgccactgaattgtacactttaaaattgttaaaacttcaccgtgattttaaaaatgttaaggtccctgactaatttaagcccactctgcaccgtgtagtcaggaactaggacttagagctggcatagagtgggaatttgtcaaataatcaccatcattttggattcttaatgagttgccaactgtcctaagtattactattttacatattgtaatgaatgctttgtgaaacaaaagcttttgtggttgttgctgttgattacaaattttatctctttttttaacttttattttaggttcagggtacacatgcaggtttgttgtacaggtaaattgagtatcatgggggtttggtgtacaaactgttttgtcacccagctgataagcatagtacccaataggtagtttttgatccttagcctcctcccactctccaccctcacaaaggcctcagtgtctactgttcccttctttgtgtccatgtgtactcaatgtttaggtcctacttctaagtgagaacatgcagtatttggtttcctgttcctgcattagttcacttaagataatggcccccagctccttccatgttgctgcaaagaacatgatcttgttcttttttatggatgcacagtattccacgatgtatatgtgccaccttttctttatctggtgtattgatgatgggcatttaggttgattccgtgtctttgctattgtgagtagtgctgcaatgaacatatgagtgcgtgtgtctttatggtagaacaatttattttcctttgggtattggtatggtttggctgtgtctccacccaaatctcatcttgaattgtagctctcataatccccatgtatcatgggaggaacccagtgaaaggtaattgaatcatgggggcgggttcttcccaagctgttctcatgatagtgaataagtctcacaagatatgatggttttataaagggcagttcccctatacacactctcttgcttgctgccatgtaagatgtgcctttgctcctctccaccttccgccatgattgtgaggcctccctggccatgtggaactgtgagtccattaaacctctttttctttataaattacccagtcttgcatatgtccttatagcagtgtggtctactgcaggtatatacccaataaggagattactgggtcaaatggtagttctgtttgaagctctttgagaaggctccacaatgctttgcacaatgactgaactaatttacatttccaccaacagtgaataagcattcccttttctctgcaatctcaccagcatgtttgttgttgttgttgttgttgttgttgttgtttgagacggagtctcgctgtgtcgcccaggctggagtgcagtggcgcgatctcggctcactgcaaactctgactctcaggttcatgccattctcctgcctcagcctcccgagtagctgggactacaggcgcccgccaccacgcccagctaattttttttgtatttttagtagagatggggtttcaccgtgttagccaggatggtctcgatctcctgacctcatgatccacccgtctcggcctcccaaagtgctgggattacaggcatgagccaccacgcccggccagcatctgttatttttcagctttttaataatacctattctgactggtgtgagaggatgggacatttagaggaaaaatcagcctttcttgtttcttccctcacagtcagtattaataaagactaatccctttagactatcacaagaagatactgcagaggaaagatgaagcttcttttaactaaggggtcacggccgttataatttgagcatcaaaagactggatgaaaacagatgtggccagagttctagttcttgttttggaggactagacggtatcagattaacccctctgccaaaattatttataaactctgggcaaaatataacaaacaggtctttgaagggactggagataaaccttagcaggcagaaactgagcagggaacagacagtcctcaaaatgaaggaagcacgtgagatgagctccacatttaccaagatttttctcctgagggacttcccagcttgctgctgctgcacacagcggaagagatctcaaacagaaagaagcaattttaggggatgtggagctagagattcgatttggggctcccagagaagctggaaattgaggaggaaatccccagaaaagggggacctatggaaggaaaataattgatagaacaagtagatgaaaaatcagtaagaacatagatttgaacacaattaacagacttgatcaagtggacattcacacaacacagcacccaacactgcataccacacactcttttcgagaactcacaggacctttacaaagtgaatcacgctggacgataaagtaagtctcaacaaaattaggagattgcaatcaggcaagacatgctatggctagtatgagcaaacaagccagacatcaatagaaatgacctgttttgaagatggcatggtattaacacagggattgacaagtagaacaattggaatagaagaatggacagcccagaaacaggcatatatggacacttcatttttgacagaggtggtgttaccagctgagggtagttgtccaggttcttggcgttttgaacaaagaactggacaaaatggacaaagcaaggcagcaagagcagagatttgttttaaatgaaagtacactccacagggtgggggtggctcatgcaagcagctcaagattcttggttacagaattttctggggtttcaattccctctaggagtttcccattgtcccccgaccagtctgattggttgcaggaggggaccaatcagaggtactttcatttttcaaccgccaggcagaaaaaggaggggcagcaactgtcgcgcagaaaaagggggtgttgaagagtagcctctgatatccagtgagcatgaaccggccttaggtttcctgcctccagaccctattctcctgcctcatttccccccctgagagacaggatccccgtaagtctttatgtgagacagagggactgatggtcttttttctgtaactgcgtcacactgacttgactgacagtccctgcctattggaatcacagaactctcaccctgctctgtctagtggagacagggtagtttcttgatggccaggggtggtgaattcatttggaactggctggaaaccttactgcacaatcatctccaggcaagaggaaatgaatggttaaaagatttcatgggaacttcaggaggtggacacctatgctgtcaggaatgtttgttatagaaatgaattaaaagattctacttaattactatgaaggaagtgattccaactgtttgaaagaaggtaattaatctgcaaaaaaaaaaaaaaaaaaaaaaacatggctactattatccagcctacagtaactatgcaacaaaaacaccaaggaacgttggtaggcatttctcttttggctgtcttctaaacaggtacttcagggctgccacaggttcacaggtgcagtggctgatgggaacttcaggttccaggtccggggcttcaggtatcacagacttgatccttgaaaggtgtatccaactatctaatcccagtactttgaccgcagaaggcgtggccagtatcactgaaaacggtgccttccattggggttgtaattgttgaggaggtgacccctccgtccatgctttaacaagcaccttatctgctggcctgatttgaggtggctggttagcttccagtaccggaagcctttgagttccaaacttctgtataaacctgctgacattgtcctaggttaactaggtattttactaaaccagctgtttctgaatcagtaattacatcatcagttaagaatagccttctgtaatcccagcactttgggaggccaaggcgggcagatcacctgaggttaggagttcaagaccagcctgaccaacgtggagaaaccccatctctactaaaaatacaaaattagccgggcatggtggttcatgcctgtaattccagctactcgggaggccgaggcaggagaatcgcttgaacccggaaggcagaggttgcagtgagccaagatcaaggcattgtactccagcctgggcaacaagagcgaaaattccatgtccaaaaaaacaaggccgggcacagtggctcaggcctgtaatcccagcactttgggaggccgaggcgggcagatcacaaggtcaggagatcgagaccatcctggctaacacggtgaaaccccgtctctactaaaaatacaaaatattagctgggcgtgctggcgggcgcctgtagtcccagctactcgggaggctgaggcaggagaatggcgtgaacccgggaggcggagcttgcagtgagccaagatcgtgccactgcactccagcctaggcgatagagagagactccgtctcaaaaaaaaaaaaaaaaacacacacacacacacataaaaacaaactaatagccttcgtataggcttatattaaattttgctctaggggtattacagatttttaagagagctatgggcagtaagctgacccaagcttctgatgtttcctgatcgaacttagctaacgatccttttagaggttgattagccctttctactttcccagaggattgaggcctccatgctgaatgtaaatagtatttgattctgagagccttagcaactacttgagttatctgggagataaagtatgggccgttatcactttggagacgctgaagtaacccaaactgggggattatttcttttaagagaaccttataaccacagtagccttctctgatctggtaggataagcttcgacccaaccagtaaagatatctattagcactaacaaaaacttataacctctgccagctggcatatgtgtgaagtctaatcgcccatcttttcctgggtatgttctatcagcgtcctctaatacaactcccctctggactggttctattacaggaggcattctgtttcctgggctgttcagtgcacacagtgagcaggtttgacagacatgcttaaccacagaagctaagttaggctcaatgaagagcctgttaaccacggccagggtggcttctctccccatatgcaaagagtcatgcagagtttttctaattctccatcaggctgcttgagggagatgtggttttgatgccatgtaccaccagcatcctgggttttgtcccccttgctcctttattaactgttcttcctgtggtgtgtattcaggctccattggggaatcacagaaaagaagtagagctggaatctgttgggattgcaccctgagaactacagctttcgcttctctatcagcctttctgtttccttgtgctataagggttaaggccctttgatgctccctgcaatgaattacagctacagcctttggcaggtgtattgcttccaaaagctgcagaatttcaggcctatgctttacaggggagtgtttgctagttagcagccctcttcctttccagattgtagcatgagcatggcaagggttacctggtccggtggaacctcccttacttcatcatcacttactgccttagttattccctttctcattcctccaaggagagcctcaagaaatttagcccagtttttcgttcccacgagagcattagagtctcaattaggatcagttgtggggactgtgtctgggcccaggtgattgccctgagggttttgggcaaataaatcgtctgcttcccagtgggcagcctcaaaagattcattccttttcaaagggggtgcaagaggttgctagaatgaattgaacatttctctgtgagagatcgaaggctgaggtcaaagtttggaacccatctgctaatttcctgggattcttagaagagcttcctagctttccctgacaccgttgtatatcagttatagagaaggtggcctgcactaggactggcccctcggctcctgctacttcctgaaggggtagcagggctggagggagagtggaatgtagtgtcccctccgagcgtgagggggacctagtagggtgtccagggtttgggttttagcctcaggagcacttggcaaggggctacgtgggggcggttatgttcaccctgagagacaggtggcccttataaaagggggtcatctatactatctagtcctgtctttggactttctttgcggagatgattaggttttggcgtagggccgtgaaggcctgtacatatggtatttctgaccatttgccctgccaggaaacagctgctgcaagactgaaaagaaaaggactcaggtccctcacccaaaccgggtggtggtgatcaggcgcttccacacggaaccctttcagtttccctggagagtggccccaaccacaaacctgcggttgcctccatgcctaggcactgtccaccgagagtcccgagttggaaaggaaaagagagagaaagaggacaaaaaggaaaataaatcccaaacgttgggcttacctcctggctggctcaccaaaatacgttaccagctgaagggtagttggccaggttcttggcgttttgaactgagaattggacaaaacacacaaagcaaggcagggaaagcagagatttactccaacagaggacagtgggctcaagcaagcagctccaaagcctgttactgaattttctgaggtttaaataccctctagagggttcccattggcccccgaccagtctgattggttgcaggaggggaccaatcagaggtactttcatttttcaactgcctcgcagaaaaaaggaggggttgaaaagggatgaatcgggcttgggttccgaacctaagcccaattcaacccctcctttccctcataagcagcatgaatcagccttagcttccctgcctccagaccctattctcctgcctcagtggtagtgtagatcaggcgaggaagtagaaattctaatagacagtggtgggacagggaagtgtccatatggaaaaaaatggacctttatatcatacgtaaataaatttcaagtagattaaaggtctaaacataaaaggcaaaattaagcaatgcatatagaagtgtaaaactataaacatttgcaaggaagtgattgtcacacgtttggagagtggttacttccgggaagaggaagaggtttgttgcaggtaggggatggagtggggaaagggactctgtccatattctaactcttggactgggttgtagctatctgggtactttttaatttgctttaaattattttttaaattgtatataaatatggtggccttttgtgtattctatacagtccacactaaaaatggttaagaaaaaaagcatgacgtatttaaagataaccaccaccgtaagtcaaatcactgagtaacttaaagctcacaagtaatatttaagagtacccagaaacttgttctcctcctagaaaatatatacagtcaaaaaaaacaagagccctcaaaagtgttagtccaaactgcaccattatgtaagtctcccgccatttcacagaccttggtcaaagtggaacattccacgggggttcggaccgtgagaaacagcctgcctcttatcttattctgctaggagaaaatgcaaggaacaccacactccaccagaacaagggccaaaccgcctgatcaaaggaacatcttatcaatatcctatcaggcagcaagccatactgcccaggcccctcccgcccatacctataaataccccagcctgtaagcagtgggcactgacactaagctggtcccccacctctataagtttatcctggacataaatgcctgcatttgctgttgagccattttctctctctctctctctctctctctctctctctcactctctctctctttttttttttttttttttttttttgagatgtagtttccctcttattgcccaggctggagtgcagtggcacaatctcagctcaccacaacctccgtttccccggttcaagcgattctcctgcctcagcctcctgagtagctgggattacaggcaggcgccacaatgcccggctaattttgtatttttagtagaaatggagtctctccatgttgatcaggctggtctcgaactccccacctcaggtgatccgcccgccttggcctcccaaagtgctgggattacaggcgtgagccactgtgcccagccaagttgttattatctaaggacctgaaatcaatagaaaggaattgtctgggttaagataaggggttgtggagaccaagattctgaggtgggaggcaggacttgactccagaggtggggctaggacactagaccagttgaaggctagctaaaaacaggtcggggtgcggggtggggtggggggcagaagcaccttctcataagacacacccaccagtgtgccaagtcagttgaccattgccatggcaacacctggaggttactgcccctttccatggcaacgacctgacaactgggaagctatcaccctcattctagaaatttctgcataactcctttaatttgcatataattagaagtgggtatgagtgcagacctgcctctgagctgctactctgggcacactgcctatgcggtaaccctggtctgcaaggaggaggacctccgctgctgctggtacactggtgcttcaataccaacctggccaacatggtgaaacctcgtctctactaaaagtacaaaaattagccaggcatggtgtgtgcctgtaatcccagctaatcaggaggctgcggcaggagaatcacttgaacccgggaggcggaggttgcagtgagcccagatagtgccattgcactccagcctgggtgacaaagtgaggctctgtctcaaaaaaataaataaataaaaaagataacataactctttcaaccaatttccagtcagaaaatctttcaatccacctatgacctggaagctgctgccttgagttgtcccaccttttcaggctgaattgacgcacacctgacacgtattgattggtatctgtgtaacttctgtcaccctaaaacgtataaaatcaagctgtggcccgagcaccttgggcccatgttcacaggacctcctggggctgtgtcgtgggccttggtcactcatttcactcagaataaacctttttaactatgttacactttagccctttttgtcgacagcctcctgtcactttcccttgagaagacgctgttttcgagaatactcccagtacctgcctttcttgtgccaactaagaacactcctattcatcataacctgcattctcacggagggtcgcttgttactcaccaggcaaacaaaccctggctttccaggtaacagtcggccctctgtatccacagattccacctctgccattatagagggctaagtatatgtaaaacctgtcatttagagccatgtgatttaaagaaaaatatctcactcatggatttgatgggtactgatatgcacttggctataagctattggtgtatccacaagctcattggaacagaaacccaactattacaacagaccctgaaattttgtgagctctcaaaaatttctgctcaaaaaatagattctcactttctgcttaatttttccgtaaatctaaaatttctcttaaaatgaagtctattaattgaaaaaatatatactctggaaatgggcaatgttgtctttaagaaaaacttgtagtcggtgtgtttgttgttaagcagttacaaaatttaagttatagcatttctgatttcgattcttagaaacaaaactagatttgttttgctttagaaagaatgtaaggaaagctaatttgtgaagtaagtacttcctaaaatgaagatgaattcctgtttagataaaccaggagaggaagttaaactgagtgagtgtgggaagaaaaaaaaaaagattcctttgagagatgcgccttttgagcataattgaaagtgactgagatgtacaataacgagggaaccaggcaataattcattaatggagcagcagcattactctaaacaaatatttgcttttacataattaaccaaactaaaatgatctgaatggaaaagtagtttacagtaaccaaaacagcatggtactggtaccaaaacagagatatagatcaatggaacagaacagagccctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttacacctcatacaaaaatcaattcaagatggattaaagacttaaacgttagacttaaaaccataaaaaccctagaagaaaacctaggcaataccattcaggacataggcatgggcaaggacttcatgtctaaaacaccaaaagcaatggcaacaaaagacaaaattgacaaatgggatctaattaaattaaagagcttctgtacagcaaaagaaactaccatcagagtgatgaacaggcaacctacaaaatgggagaaaattttcgcaacctactcatctgacaaagggctaatatccagaatctacaatgaactcaaacaaatttacaaaaaaaaaacaaacaaccccatcaaaaagtgggcaaaggacatgaacagacacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagagaatgtggagaaataggaacacttttacactgttggtgggactgtaaactagttcaaccattgtggaagtcagtgtggcgattcctcagagatctagaactagaaataccattcgacccagccatcccattactgggtatatacccaaaggactgtaaatcatgctgctataaagacacatgcacacgtacgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcacaagaacaaaaaaccaaacaccacatattctcgctcataggtgggaactgaacaatgagatcacatggacacaggaaggggaacatcacactctggggactgttgtggggtggggggaggggggagggatagcactgggagatatacctaatgctagatgacgagttagtgggtgcagcgcaccagcatggcacatgtatacatatgtaactaacctgcacaatgtgcacaggtaccctaaaacttaaaggataataataaaagaaaaaaaaaaagaaaagtagtttggagtattaactatgtacatgattactctcaagcagattacaggcataaatggcggttgtatttcacataactgcacatcaatagctttcaaaagaatctcaaccctccactgaccacagttcagacagattttccatttagatgcctgtttgatgcctcaaggccttagacattgccagaaatgacaaatgacagttgtcctggatatttctaggaacaccagctattatgctcagaatgttataataactcttctatttattacctacagctaaaaatctaatgatggttattttatagtgtctctggaaattggaaaggtaatcatgacctcgaacttctacaaacagagtggggggagacttaaaagaaaagggcttgaattatataattaataaatatcaatttttaagcataaaagccattgggttttttattattttggtagtgttaggtacatagctataagaaggtatcccaagcccgttttctcctcccagtcctgtgtcctaaagttttcctgatgtgtcaatagagtgtcactatagccctgtgaattagtagatatcgctctaatgagatatttacgcaggatgaagttgggagaaagtaaaggaatgcctaagccagagatctctgccaagattcacaccagcacctttcaaaactttgcagcctatgaagagccaaatattgcataatccagatcatgttttccaatattgtcaatggaaaatcctaaagtaagagattctcagaatcagagatactacttcaacccagattcttgtctcagtgcaggtcgtaaagacaaacaggcttgactctgacttggtactttcttctaagttcctaagctataacataaatatgcaatactagaaggtcataattattcacaataaaatgtcaatgcatttatttattaatatgcttcatttcagacagaattaacaatcttattcttctaacatatagcacttagtgagcccaatgaataaactcttgagagaaccttaatcagactctgactaaatacatgttttggcagatgtcttagtccattttctgctgctataatggactgtcaccaacttggtaatttataaagaatagcagtggctgctgggtgcagtggctcatgcctgtaatcccagcactttgggaggccgaggtgggtggatcacgaggtcaggagatcaagactatcctgtctaacatggtgaaaccccatctctactaaaagtacaaaaaattagccgggcatggtggcgggtgcctgtagtcccagctaccgggaggctgaggcaggagaatggcgtgaacccaggaggtggagcttgcagtgagcccagatcatgccactgtgctccatcctgggcaacagtgcaagactccatctcaaaatatataaataaatttaatttaatttaaaaagaatagcaatttatttgactcacagttctggaggctagaaagcctaagaacatggtgtcagaatctggcaaggaccttcttgctgcatcaacccatggcagaagggcaagcaagcacacaaaacagagacagaaaatggagacctaactcccacgacagctaagccactcccatgataacgtcaatctattcacaagggccaagccctcatgacctaattaccctttaaaggtcccatctcttaatactatcatgatggcaattaaatttcaataagggttttggaggagacattcaaaccatagcagcaggtatgagcaggtttaagtcagaagtccattgctagctatgacttactgacgggagccattgaaacagttaaacacctaggaaactaccttcttttgactcttcaagacattttgtaccagattatattggattatacgtagggtggaagcaggttttcgcatgccctcacttacagtacatatttcctatgttaggctcttctgtgaaaacttcttgttaatttttcaaatctgatacttactgagtacctctacatttttgcacttctcatttccagtaatccattttatctctgattatttctgtttgtcttggttactgcagttttattgtaaccttgcagtctatttgatcttttcactaatatttcctagtcttttttactcattttctatgaattctaactcatgcttcagctactttggtacccctttaaattcttcagtttctaatgagctttccaaaattcctaaggatagctaagtaattaaacgttgaaaaaagtgcctttaattgttataaacaatcactgttatgtcacctattaaatgtaaacatttccataagtaccagtgtagttttttcttgatcactggagacttgcccatttgtgagctagagtgatcacgtgaaaacctcaacaactaaaccatttcccattttacgattttgttttttgtgaaatttttttaaattattagattataaactatatcagacataccaaaaagtataagcattttatatgaagaaatttcataagagtagtctcttgttactctttttatcatcttacactgaatgaccttcttattttttctatttaaaaggtttgggagccaaatgcttttgtgggggtattaaataaaatgtatcggaggccattggttttgactgagctcctatactaagtccaacagaccaaaccaaaatggagtcactcatgctacaggcccacatcatcaagacaaaactaagttgtttatctgaccttccaagaaatcaggagagtgagacataatagccaaatccccaaacaacccaattttagctggtataataaggaagtccactctgctttaatctttacgaggaaagtaactctgaaacaaccagtctaccttttattttctatttctgctttcctcagccattttctgcctaccaccacctctgctcagcaactcagagcactcattctattttgtaggatgaggtgttaccttactctagaatggcaaataaaaaccaattaaggtctctaaatttgttgtaattttgtcttttgtcttttgatgggggttagccacttttgtatcctctgataatattttattgtatacaacttgtacacctgtacaccattctccttcatttgtttacaaatatggcaattttttcttcatgtcaaaagtatctacatccattgtaaaaaaaaatttaggtaatttggatgaacagaaaagaagaaaaataatataaaaaccatacaaaattctaccaccttgagatgtttcttttttgtatatttccttttgtgtaaccagggaggaggcctacactgcttatttctccttataaaggaatttccactcatataactcctgttgctaatgctgccttattttgtgccacgtggccccattccacaagtcacacaaatcacactgacgatgaaaaccctacctatattagtcaaggtttagtcaagaaaacagacaccaccctagacttttcaaaccaaataaagaggaacgttaataaggaaattggttacacaggaaatggaaaagctgagaagccaaacacaggatgagatgatgaggccactgagaggtcggcaacagccaaaagcaactgccaccctggaactaaagggtcaacgggatgaggtagtttcatcagagcacagaagttgaggccaaacagaaagagccagaactaaggagagggtatttcccccgcaggagctggaaccacagagagagcgtttggttgggaggaattggagacacacaagaaaagctgtcacggaaaacagagaaatagggggcaatatcctaggctttcccctcctcccaccctccagtcatctgctatcatctttctgtggccaaacttacccaaaagacttcaggcaaaggaaatgatgggaggtggggtgggatgggagcaaagcacaggcaactggccaacaattgtctaagagtagcccctgaagtgactggccacacatcacctatggcgtagtcttgctaaaaatgtttaagctgaatctaatcatgaggaaacaatcaggcaaatccatattgaaagacattgtactaaacaaccagcctagactctccaaaatgtcaatgtcctaaaagacaaaagaggacagagaacttatctaaattaaataacattagggaggctcacgcctgtaatcccaacactttgggaggcagaggcaggaggatcacttgagcccaggaattcaagaccagcccgggcaacatagtgagaccccatctctatatacaagaaaaatcaaaaaatgaggcgggaggatcacttgaacccaggaggtcaaggctgcaatgagccatgatcaagccactgcattcctatctgggcaagggagtgagatcctcctgtctttcaaaaaaacagaatattagggggacatggcaactaattttgatgtgtgatcacagattaagtattggatcaaaaaagaatggtatataaaggacacgacggggcaattgtggaaatatgaatatagttagtacactagatgatagttgtatagaaatgttaaatttcttgagtgtggtaatttggttgtggttatgtaagagaatgcccttgttctcagcagatatatgctaaagtatttaaaggtaaaatgtcatgatgtcttcaaccaactccatatatatatgcttggagaaagaatgtgtgatcaaacaaatgtggccaacgttaaaactggtgaatctaagtgaagcgtctataggcattcatggtactgttcttacaactatcccaaaggcatttttttttttttcagatggagtcttactctgttgcccaggctagagtacagtggcacgatctcggctcattgcaacttctacccgcagggttcaagcgattctcctgcctcagcctcccaagtagctgggattacaggcacctgacactgcacccggctaatttttgtatttttagtagagacggggtttcaccatgttggccaggctggtcttgaactcctgacctcgtgatccacccgccttggcctcccaaagtgttgggattacaggcatgagccactgggcccagaccctaaggcttttcaaaataaaaactcaggaaaaaaaaaaaaataggatggcctctgacctccgaccactgacacgaggtaaagagatgaattaaaccaactgttcttaggaatttaaacctaaacaaaaagaatttgctacttagcaataaagttggaggtgacagaaaaacatgtggagttcggctatagcaaattaaaattacgtacacaccaaaattatgaggtggaagaaaagatatggcaaattgtttgcaaaaatagttgccacagatgcttctcatctagtaagcaattctcccatcatgagatgaaatctatgtctccctgcgttctagactggtcttgtgacttactttgaccaacagaatgcagaggtgacacggtgccagttcttgaccacgaagaggcttgacatcttgcactttccttctcttggagccctgagccactgcataaagaagaccaactgcccaggaaacaacagatgctggagaggatgtggagaaacaggaacacttttacactgttggtgggagtgtaattagttcaatcattgtggaagacaatgtggcaattccttaaggatccagaaccagaaataccatttgactcagcaatcccattactgggtatataccccaaaggattataaatcattctactataaagacacatgcacacctatgtctattgcagcactagtcacaatagtaatgacttggaaccaacccaaatgtccatcaatgatagactggataaagaaaatgtggcacatatacaccatggaatagtatgcagccataaaaaaggatgatttcatgtcctttgcagggacatggatggagctagaaaccatcattctcagcaaagtaacacaggaacagaaaaccaaacaccgcatgttctcactcataacggggagctgaacaatgagaacacatggacacagggaggggaacatcacacactggggcctgttggggggtggggggctaggggagggatagcattaggagaaatacctaatgtaggtgaccggttgatgggtgcagcaaaccaccatggcacgtgtatacctatgtaacaaaactgcacgttctgcacatgtaccccagaacttaaagtataataaaaaaataataagaagaagaccgactgcctgctggagagattggtctggccagtcttttgctgttctagacacctctgctgagccacacaggtgagtgaaaccacccggaccctccagccccaggcaaggcggcccagccaacaccacatgaaacaaaaccaagctgttcctgtcaatcccttcccaaagttcagcattgtaaaccaacaaataagtagtggttggtttttttgtttgtttgtttctgttttcttttttggagtctcactctgtcgcccaggctggagtgcagtggcgcgatctcggctcactttgcaagctccgcctcccaggttcacgccattctcctgcctcagcctcccggtagctgggactacaggcgcctgccaccacgcccggctaattttttgtatttttagtagagacggggtctcaccgtgttagccaggatggtctcgatctcctgacctcgtgatccgcccgcctcagcgcctcccaaagtgctgagattacaggcgtgagccaccgcacccggccggttgttattttaagacaatacattttggggagattcgttatacagacaatccccaacccacgatggttcaacttggtgtttttcaactttaggatggtgcaaaagcaatacacattcagcagaaactgtacctcaaatacccatacaaccattctgtttttcactttcagcataatattcaataaattacatgagataggcaacactttattataaaatgggctgtgcgttagatcattttgccaacttgaggctaatgtaagtgttctgagcacatttaaggtaggctaggctaagctaccttagactaggttaggtgtattacatgcatttttgacttaacgatattttcaacttacaatgggtttatcaggatacagccccatcataaacagaggagtgtctgtagagctaatagagaacagagcagacagacacacagagatgcctgtaggaaatgctaagttttactattccggttccttccgtgcgtaggctcaaaacaactcctactctttttgagatacagcaaaaaaagagccagagaaaaaaaatgtctcttcctggctgctctgcctatggagtagccattcttttattccttcactttcttaataaatttgctttcactttaaaaaaaataaaatgtagggccgggcgcagtggctcacgcctgtaatctcagcactttgggaagccaaggcgggcggatcacgaggtcaagagatggagaccattctggccaacacggtgaaacccccagctctactaaaaacacaaaaattagccaggcgtggtgacaggcgcctgtaatcccagctacttgggaggctgaggcaggagaattgcttgaacctgggaggcagaggttgcagtgagccaagatcgcgccattgcactccagcctgggtgacagagcaagactccgtctcaaaaaaataaattaaataaataaattgtcccttcttatcctttctctttgcaggtatttttgttatccaaagattcagaataaatatctcttatttctaattgtttcattgacttccccttttattgagtaacagcacctgatttttttttgagacagagtctcgctctgatgcccaggctggagtgcagtggcgtgatcttgcctcactgcaagctctgcctcccgggttcaagcaattttcctgcctcagcctcctgggtagctggggactacaggtgcccaccaccaagcccggctaattttttgtatttttagtagagagggggtttcaccatgttagccaggatggtctcgatctcctgacctcgtgatccgccctccttggcctcccaaagtgccgggattataggcatgagccaccgcgcccggccagcacctgattttttaaatggtttgttgtaaaatgcatcatacaaatagaaggatggataaaatttgctcgacagaaatatttaaaagtaatggcaaacgccacaattacttttgcaccaacctaatataataataaggtaaataatcatctacccagtttaaggtataaaacataaccagtcctttagaagcctctgcttatccctcccaaattgtggtctcttctccatccgcagtgataaccacgatgatgacttatgttaatcattctcctgtttcctttacagttttccaccaatatatacatccctaaacaacatgacttagttttgaaacactgagcagcaagcaccaatctagaagaataaggaaagggtgatgttaccactgtttgaggaaggctcaggaggagaagataaactgaacagcctctcggtcattgtctggcttcagcttccctaagcatttataagagctttttatgggaaaatcattgagtaagatgatgagtaacactgggaatcactgggctcagcacaggtgagacatacggtaacgctggagaatgggccgagttttagatgtttggccaggatatagtcagaaggagatggctgttgtgtatattctgctcatcacgacttctcctccacttcccagaagaggtcaaggcagaacatttctggatgacacccacagtagatcaagcatcagagcactcgaggaatgagcaggaactttatcagcatgtggtcaaaataaagaaagtacaaaggaaaaatctgggccagactctgggtattgagtccttgatttaaaagttagcatgatggcagtggggatggtggtgatggaagccctcagtgtgtctctccctggagtcctggtgtcccacttcttcaggctggacttgtttccttctgcacctagtgcataactgtcattctggactctcccatcacccttaccctagagtcccttcaccactctcctgtgtttgattcctacctgttgtgtcccatatgttctttcttggcttgtcctctcattcaagaagcacagcctccagtagccccttaagaaagaacgcatgggaagtaaatcttgcatatctgaaaatgcccttattttacactcatatttgattgataatttagctgggtgcagaattctaggctgggaatagtttttcttaagaattttgaaaagcattgctctggtgtctcttgcctctaccattgtttattgaagccggcaaagccaaagctgattcccgatcctttatatttgatcttcgtatgtaccctctcccttgctctctaagcttttaagatctcttggactttgttctgaaactccatgataacgtgccttgacaggtcttttttcatccgtttctctgggcacttgaagaaccctttcaatctggaaactcatgtccttcttgagttttgagtaaacttttctgtatggttttattgatgactgcctctcctacatattctttttctctcttgagcaccaattattcaaatattgaacacaccggtttttttttgttttttttttttttttgagacagagtctccctctgtcgcccaggctagagtgcagtggcgcgatctcggctcactgccagctccgcctcccaggttcacaccattctcctgcctcagcctcccgagtagctgggaccacaggtgcccgccaccacgcccagctaattttttttgtatttttagtagagacagggtttcaccatgttagccaggatggtctcgatctcctaacctcgtgatccgcccgtctcggccttccaaagtgctgggattacaggcgtgagccaccgcacccggcctgaacacgccagtcttaatctctaatcttctgtatcttttctcttctattgttcatctccgtgtcttcttgggcgatttcctcaagtttatcgtccaactcttctgttacatttttcaggtctactctcttgctttaatttttaagggcccttttttcttctcttaaaattatcaggatcttattctgttcttataacatgggtgcaatctattctgtacctttccaagtatattaatagtagacttttaaagtttttgtatgcttgtttattctatggggttgttttgtttttctttacttttgttttgggcttcatagtcaatgtctgaagcagcatctgattcttctttgaagaactgctgcctcccatattctcaatccatgtgagtgaatgcatcatttgctaattctttcaacttaaataataaacttgctttagtttggatgtttgtctccttcaaatcccatattgaaatttgatccctaatgttgaaggtcgggcccagtgggaggtatgtgggtcatgggggtgggtccctcatcaataaattagtgccttcgctcaagggtaagttcttcctctgttcattaccgggagaactgattgttaaaaagagcctggcaccgcctccacaccttgcttcctctctcgccatgtgatctccacacacgctggctccccttcactttccaccattagtagaagcagcctgaggccctcacctgatgcagatgccagtgccatgcttcttgtaaagccaaagacccataagccaaattggcctcttttctttagaaattacccagcctcaggtattcctttatagcaatgctaaatggactaagacaataattaacctgcctgagcttcagtttcttcatccataaaatgaggatggacacagaatctgtttcactaggattgccaagagaatttagtgaaataatacagaggacacagattatgtgttcttttctggcttaggaaggttaaattgctcaaagttacacatcaaatcatgggactcagactcataatctgacacataatcaatattcaataaatttcagctatcattattatgacatagttcaaatgggactcacacctcctctcagttaaagagaggagtacatgagccagacctggccaatgagattcagccctaggatttttgctagaatgatttgaaaggaaattctcttgtcctgttaggttatcaagttggtaaagcacaatcccagagctgctggtagctctctttaacaatgcttttagagggtctatctgaaagtaaagccaaaccaagagacggaaacagattactgatgatgaggctggatgcagccttacctgaaggcactgtggccctggactttccagtattatgaatcaatatcttccttttctttctcttaagccatttttagttgagttttcattacttgcaacagaaagaatcccttgtaatacaaaaaaatactgttttgaaactgtgtatttcactgaatgtaacattatcatatgttcatgttattaaaattattcttcaacattattttgtgtctggtattttattttatgaagtcagtattagtggacagatacattgttattaatgtttcaatattataaataacactgaaatgaatatcctcatagctaaatttttgtgaatatcatgattgcttcctgaaaataaattcctagaggtggaacttctggattaaaagttgcatggaatattaagagttttgttatatatagtaaaattgaccccttgaaaggtggtaccaatttggtttcacaccagaaacatataagaatgcctattttctccatccattgcctatagttggtagtatttctcttaaaatctctgccaagttagtaacctctgcacaaaaatggtacctcattttacttcatatttatgtattgagttatctaccatgcacatatttttcattaatttgtgctagattcagttggttactgttttatttaggaatcctgcatctatattctgaaattggttcttctggtactcttatgtgctcagggttttttctagttttatacaataaattttaaacacagaagtttgaagatggaaaacctgggttcgagtctgaattccacaatacgatgtggaagcttgggcaattcaatcttccttaccctgaagaagaataacgcaatggcaagtgagccactaaacccccgcagaacctggaaaggctcggccctgggaggttcaatgtggaaaggtgagccatagagcaacaatcaagggggtgcctaacagtgtgtcatagaggatcaaccaccaaatcccctcctaccccacacacacaggtgaaaaaactgttgtgtatactcaccgtggtcgtggttacatgaatctatacaggtgttaaaatgtgtagaactgtataccaaaaagctaattttactgtatgataattttaaaataaaaaaatttgaaggccaggtgcggtggctcacgcctgtaatcccagcactttgggaagccaaggcaggtggatcacgaggtcaggagatcgagaccatcctggccaacacggtgaaatcccatctgtactaaaaatacaaaaaattagctgggcgtggtggtgggcacctgtagtcccagctacctgggaggctgaggcaggagaatggcgtgaacccgggaggcggagcttgcagtgagctgagattgtgccactgcactccagcgtgagactccagctcaaaaaaaaaaaaaaaaaaaaatttaagagacataaaaggataccaaaggaaggctagggaactgttagattttaatagagacaagagaccaaatacagtatgtggccctggatttgaacctggattcaaggcacctaatttgattgactgattgattgattgattgatggattgatacagagtcgctctgtcgcccaggatggagtgcaaatggcgcactctctgctcactgcaacctccgcctcccgggttcaagcgattctcctgcctcagcctcacgagtagctgggactacaagtgcacgccaacacgaccggctaatttttgtatttttagtacagatggggtttcactatgttgaccaggctggatgcaaactcctggccctcaagtgatccacctgcctgggcctcccaaagggctgggatcacaggtgtgagccaccacacctggcccaaagtaactaattttaaaaagacatttttaaacataagtgaaaatataaatgcataataactattaaataatatcatggtattatatattatgatatgataaatgatatggtagttatgtatgaaggctatgtatttttaaagtccttatcagttagagacatatactaaaatattcaaaggtgaaatgacatgatgtctgggatttgcttttaaatactccagaatatatatatatatagtaaatatatggtgtgtaacagaataagagtgggatttttgtctctttgtttactgctgtgtcttcaatttctagaagtttgggagtttgtggtagatacttagcaaatattagttgaatgaattagttgaatgaactcctcttattgcctgtctcacaaactgtgacggtacatacctctacggatgtctctatctcttagctcaactatcactcctgacttctcccatgtacagtactgcaactgcgcattgatgaatccatgtctaaaatcctgctcagatagaaagaaaagtcttcgctggtaaagttcaataagcagagtcatcacgagttttccattttcttttatagttttcactgtacatatgagcccatggtaatctggcccctgactaactttccaattacatactcccactgtctccttccatgaaacctacatccaagtcccacaaaaaacttaactgtccatcacaagcaccttgatatattaaatttctctgcctttgtacctggagttccctctgtttaggatgcgattttctcttcatacatctagtagtgagttctgttcattcttcaaaattcagtccaggagtgaaatcagtaacatggcagaataggatgttccagctctcatccccccatagaaacaccagttaaggcaggcagtgacagatgagaatcattatgtgggaggcctggagtctggctgaggttccagcaccccactggagcaaatcaacccaagagtggaagcatcgaaaagggtaagaagtgcagttccactttacctgcatcagccctcccccaaggaggcacagcttgtgctgagagaagctcctttggctttcaatctctccacaggggaaggtaaaagcatagtcaacacctggcttccccagacttgaataacattgcccaggaggctcacttctgtctccctgcccagaatacagatgatcagcatgaagaacactgaatacagaatacagatgatgagcatgaagaacactgaatacagaatacagatgatcagcaagaagaacattgcccgggaggctcacttctgtctccctgcccagaatacagatgatcagcatgactgatcatctaggaacagggagaagggaatggactgcacagcaaccagcatgtggtttcaacaaccaaccacagattctgccacttagctcacagactccagcaggagacttgcccacaaatcccaccagatgactcacgtgaggaccctccacccaacgagtctatgcaacctgcatgccccaccccaccatgtatggggcccaacacaccactgtgcatggcccacattaaatgctgcagagagaacatgaacattaacaacaggcatggatcttagcagctggctcaactctgctggacttatgggaaaacatcaagcaaactaatataaatattatagaaatcccaaaaggaccagagaaagagaaagggaaagaaagcttattgaaggacatgaacagacacttctcaaaagaagatatttatgcagccaaaaaacacatgaaaaaatgctcaccatcactggccatcagagaaatgcaaatcaaaaccacaatgagataccatctcacatcagttagaatggcaatcattaaaaagtcaggaaacaacaggtgctggagaggatgtggagaaataggaacacttttacactgttggtgggactgtaaactatttcaaccactgtggaagtcagtgtggcgattcctcagggatctagaactagaaataccatttgacccagccatcccattactgggtatatacccaaaggactataaatcatgctgctatgaagacacatgcacacgtatgtttatggcggcactattcacaatagcaaagacttggaaccaacccaaatgtccaacaatgatagactggattaagaaaatggcacatatacaccacggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagaacacatggacacaggaaggggaacatcacactctggggactgttgtgggttggggggaggggggagggatagcattgggagatatacctaatgctagatgacgagttagtgggtgcagcgcaccagcatggcacatgtatacatatgtaactaacccgcacattgtgcacatgtaccctaaaacttaaagtataataataataaataaataaataaataaataaataaaatataatgacagaaaactttccaaatctgtaaagagaaaaaaaaaacactcagatccattaagcccaaagaattccatatacattgagaataaagaggtcttcaccaagacacattataatcaaatagtcaaaaatcaaagacaaagaaagaattttcttccttttgttttgttttaattattttttatctcctcaaattccttttaccagagaatttttaaagcagcaaaagaaaaacaactcaacacatacaaagaaacctccacaagattatcagtgggtttctcaccaaaaaccctgcagaccaagatagagtggaatgatatactcaaagtgctggaagaaaaaaaactgccaaccaaaaacatactcagcaaagccatctttcaaaaaggaaagaaagataaagaccttcccagacaaaccaaaactgaggaagttcatcacccctggacttgccttacaagaaatatgaaagggagaccttcaagttgaaatgaaaggaatatgtatcagcaacatgaaaacatacactcactgataaaggtaagtatatagtcaaactcacaattctctaataccatgatgatggtatatagttcgatacacaatataaaaagctgtaaattgtgatataaataatataaaatgtggggggaggagtaaaagtatatagtctttgtatgtaataaaaattaagttgttatcagcttaaaatagactattacaactacaagatgttttatgtaagcctcgtggtaatcacaaaaaaaatcctgtagtagatacacaaaagataaaaagaaaagaatcaaagcataccaccacaaacaataataataataaagccacaaaggaagacaacgagagaggaagaaaggaactacaattaacaaaatagcaatagtaagtccttacctatcaattattactttaaatgtatatagactaaattctctcattaagaggcatacagtggataaacggaattttttttttttttttttttgagatggagtctcgctgtctcacccaggctggagtgcagtggcctgatctcagctcactgcaacctccacctcccaggttcaagcaattctctgcctcagcctcccgagtagctgggattacaggcacccaccaccatgcccagctaatttttgtatttttagtagagatggggtttcaccatcttggccaggctggtgttgaactcctgacctggtgatccacctgccttggcctcccaaagtgctgggattacaggcctgagccactgcaccgggtcaataaatggacttttaaaaataagacccaactatatactgtctacaagagactcactttagatttaaggacacaaatagcctgaaagtgaatggatgaaaaacacatcccataaaaatgataaccaaagagagcaaaggtggctatacttacatgtgacaaaatagacttcaggtcaaaaactgtcataagagacaaagaaggtcattatatatactaacaaaagggtcaattcatcaggaagacataaaacagcaatacataatagaagaaatcaatacccccactcaacaatggttggatcatccagacagaaaataaataaggaaacagtggaattaaacactagataccaaacagatccaatgaacatatacgtgacattctatccaacagaagcaaaatacacattcttcttaagcccacatggaacattctccaggatagatcacatgttaagcaacaaaataagtcttaacaaatttacgaagattgaaatcatatgaaatatcttttccaatcacaatgaaatgaaactaggaataataggaggaaaattggaaaactcacaaatatgcagaaattaagcaacacactcctgaaaaaccaatgggtcaaagaagaaattaaaagaagagacaaaaatatcttgagacaaacaaacaaacaaacaaaaaccaaaatgggatgtatgggatgcagcaaaagcagttattggagggaagtttatagcaacaaatgattacgttaataaaagaaaagttctcacataaacaacctaaagttacaccccaaagaaatacaaaaataagaacaaagcccaaagttagcaaaaggaataataaaatttagaccagaaataaatgaaatagagactagaaaaataataaagagaaatcaatgaaacaaagagttgggtttttgaaaaacacaaaattgacaaacctttagctaaactaagaaagagatgagatataaataaaattatatatgaaggatgagtcattccaactgataccatgaaaatacaaaggatcagaagaggttactgtgagcaattatacaccaacaaattgggtagcataaaaaaatggataaattctcagaacttacaacctacaaaaactaagtcaggagaaatacaaaatctgaacagagcactaacaaagactagatggcttcactggtgaattctacaaacctttaaaaagaattaatgccaatctttctcagttttttccaaaaattaaagaggagggaacacttctaaactgtttctacaagaccagcattaccctgatcccaaagccagataagaacactacaagaaaagaaaaatacgagacaatatccctgataaacacaaatgcaagaatcctcaacaaaatactagcaaacaaaattcaacaatccattaaaagaataatacaccatgatcaagttagatttattcctgggatgcgaaaatggttcaaaatacacaaatcaataaatgtgatccatattacagtaacagaatgaaggataaaaatgatcatctcaatagatacagaaaagcatctgacaaaacttagcatcttttcatgataaaatctttttacaaattaagtactgaacaatgtaactcaacataagaaggccatacatgacaagcccacagctagcatcatactcaacagtgaaagtcaagttttcctctaagaccaggaacaagacaaggatatccattctcaccacttctattcaacatagtactagaaggcctagccagagcaattaggcaagaaaaagaatgaaatggcatccaaatagaaaaggaagaagttaaattgtctcatttgctaacatgatcttatatgtagaaaaccctaaagattccaccaaaaaaactgctaaaactaataaatgaattcagtaaagttgcaggatacaaaaaccaacctacagtatcagtagcatttctataccctgacaacgaactatccaaaaaagaaattaagataacaattccatctacaataacatcaggaagaataaaatacttaggaatacacttaaataaggaggtgaaagacctatacactgaaaactataaaacattaatgaaatatattggaaagtcacaaataaatggaaagatatctgcaggacagttatttagggaggaggtagacttgcactgacttagttcttcccctttcttgcttgtagttcccaagaataactataaaatgtgctgggaattcgccatcctgagataaggagttggccagaatagcccaggctctattccagtctcccctagaaataagatgtccttcagtgatttagcccagtatgtcacataccccagggtattaaaaaaaagccagccaggtgcagtggctcatacctgtaatcccagcactttgggaggccaggagtttgagaccagcctgggcaacagggcgaaaccccatctttactaaaaatacaaaaattaaccaggcctgatggcacactcatgtagtcccagctatacaggaggctgaggcaggagaatcccttgaacccaggaggcggaggttgcactgagccaagatcatgccactgcactccagtctgggcaacagagtgagactctgtctccaaaaaaaaaaaaaaaaaaaagccagggcaggctgctttttttgaggaggtccctcagctgcaatgcaggtggagcatgcacatatgacactccatccaccacaagcagttttccagagactccgggaatgcttgcaatgaacactgggtttctgttgtcccttgctgcctatctgtaggtaataaatccactatatttaatttgctgcgtataagtgtgttcagtcttactggactcagggaagttggtaatcagtgcacagtaaacctattccacaaaatcccatgtccatgaataggaaaaatcaatattatcaaaatgtctctactacccaaagtgatctaaagattcgctgcaacccctttcaaaattccaatggcatttttcactgaaatagaaaaaagaaatcctaaaacttgtattgagctacaaaagacttctaatatctaaagaaattgtgagcaaaaacaaaagagctgaacataaacattaaaaaaatgaaattagaccttatttataacatacacaaaagtcaactcaaaatggattaaagacttaaatgtaagacctgaaatcataaaaatgttagaagaaaacatacaggaaagctctatgacattggttttgacaataatttggggggtccatcaaaatccatatccatttttggatatggtaccaaaagcacaagcaacaacagcaaaaataaatagaattatatcaaactaaaaagtttctacacagcaaagaaaacaatcaacaaaatgaaaaggcaaccacagaatgggagaaaacatttgcataccatgtatctgataaggggttaatattccaaatgtataaggaactcatacaactcaacagcaaaaaaaaaaaaaaaaacctgatgtttaaagtgggcaaaatacctgaataaacatttttccaaaggagacatacaaatgcccaacaggtatataaaaaggtgttgaacatcagtcatcatcaaggaaatgcaaatcaaaatcacagtgagacataatctcatacctgttagcatgagtattatcaaaaattcaaaaataacaaatgtcggtcaggcgcggtggctcacgcctgtaatcccagcactttgggaagacgaggtgggcagattacctgaggtcaggagttcgagaccagcctggccaacatggtgaaaccccgtctctagtaaaaacacaaaaattagctgggcatggtggcgggtgcctgtagtcccagctactcaggaagccgaggcaggagaatcgcttgaacccaggaggcagaggttgcagtgagctgagatcatgccattgtactccagcctgggcaacagagtgagactctgtctcaaaaaaaaaaaaaaaaaaaaaaaaaaaaaaacaagggatgcagggaggggaaaatgaggaagtggtaattacagagtacgaagcttcaattatgcaagataaataagttctggaaatctattatatggcataccgcctgtagctaacgatgctgtattttgtacttaaaattgctaaaagagtagattttatggtaagtgttcttgccaaaaaaaaaaaagagccacacatcatcatcatcatcatcatcattatcacagaaggggacaggaggaaactttgggagatgacgatgggtttgatggtagtgttggtttcacaggcatatatttaactgcaaattcattgatatgtgataattaaataggaatagcttttcatatcaatcatacctgaataaaagtagtctaaagacttcagtattaacttctcattgaaaactcccctgactcttccaatctctgtgctcctaggcttcagtcaggattctttttttttttttttttttttttttttttgagatagagttttgctcttgttgcccaggctggagtgcaatggagcaatctcagctcaccacaacctccgcctcccaggttcaagtgattctcctgcctcagcctcccgagtagctgggattacaggcgcccactaccacgcccggctaattttgtatttttagtacagacggggtttctccatgttggtcaggctggtctcaaactcccgacctcaggtgatccacccgcctcggcctcccaaagtgctgggattacaggcatgagccaccgcacctggccatgccagtcaggattcttacacattttatttgtgttttcactgcaaggcttcttttcccagtagacagtgggtcataataatagtagttattatcatacactaaaccagtgcttactagttactattccgatcatttcacttgtattgacctttaattttcgcaaaaatcattcagggtaggtacttttcttcacaatttacaaatgaagcaactgaggcacaaagatgaaataactttcccaagatgacacatctagtaataacggagacagaattgcaaacacgggtggtctggatccatggtctgcgctctcaacaactactctacgcacaacagcttctccacacaaagtgctgcgtgcttggctgcaaccgctgcctaacgtcattttaaggtttgccaaatgtatttgtctaaagaatgcattttaagttgtaatacatcgatgaaaagtcaacaaggattcaagatatgtactatatggctgagttttaaaaggaaaaaaagaataaaaaactatagaaaggagggaaagaggaagagaaggaagaaggcaaaagaaggatagagggatagagagaggaagatagaaagaaaataaaactggtttcaaagtcacaagaaatgaccaaaattgaaaattgaaattctacagaatactgagagacgttgacacataaataaataataaagaagtacaccatgcccatggagcagaagactcagtatagttgagataccaattttcagccaggcgtggtggctcatgcctgtaatcccagcactttgggaggccgaggcgggcggatcacctgagatcaggagttcaagaccagcctagccaacatggtgaaaccctgtctctacaaaaatacaaaaattagccaggcatgttggcgggtgcctgtaatccacttcttgacaggctgaggcgggagagttgcttgaacccaggaggtggaggttgcagtgagctgagatcacaccattgcactctagcctgggcaacagagcgagactccatctcaaaaaaaaaaaaaaaaaaagacatcaattcttcctagactgatttaggcatcaataaaaatcagaacctcagacagctattttatagaaggagacaagcagaatttcaagtttaaatagaaaagcaaaatatctagaagatccaaaacaatctagaaaaataagaacaaagttggaagactgatactatctgactttcaagacttagctaactataaagctagctcagtaatagatattaatatatgaaacggtaatatatattattagcaagagtgttggcatcaggatagacatatagatcaatgggacagagtccagaaatagacctacatgtatataattaattgattttcaacaaaggtatcaagataatagaggataatcttcgcaaaaggtgctggaataatcagatatccataggcaaaacaatagagctcaactttatctcacgccatataaaaataattcaaaataaataataaacctcagtatatgaattgaagctataaaacttttttgtttttttctgagacagagtctcaccctctcgcccaggctggagtgcagtggtgtgatctcggctcactgcaacctctgcctcctgggttcaagtgattctcctgcctcagcctcccgagtagctaggattacaggcacccgccatcatgcccagctaatttttgtatttttagtagagacgggggtttcaccatgttggccaggctggtctcaaactcccaacctcgtgatctgcccacctcggcttcccaaagctataaaacttttagacaaaaaacataggagagtaatgttgtgactttggctgaagcaaagttttcttaaataagacacaaaaatacaagcaacaaaagaaaaaaagaacaaacttcatcaaaatttaaaacttgttgtcttcaaaagacacagttaaaacaatgaaaatttcaagtccaacaaatctttctttttaaaaagactacaaaaacacaaggcacagactgagagaaaaagatttgtaaaacacgtatctaatgaaagattgtattcagaatatataaagaacttctacaacttcataacaagaaggcgacccaataaaaagaggccaaatttgttaacagacacttcactgaataagctatatgaatagcaaatacgtacatgaaaagatgttcaacatcatcagtcaccagagaaacgcaaattaaaactagaatgactaaaacttaaaagactattaaaaccaaacattggtgaggttgtagagcaactggaacattgctggtaggaaagtaaaatggtacaactcctgtgaaaaacagtttgacaatttctcataaagttacacacacaattaccacatgactcagcaattccactcctaggtgtttacccaagagaagtgaaaacagtccacacaaagacccgacaacatatattcataacagcattaaattacgttcaaagcagcactgtttcctaaagccaaaagctggaaacaatccaaatgtttgtcaacaggttgatgaaacggatgatcaaattgtgacatttctatacaatgaaatattgctcagctataaaaaggaatgaatttaagattaaatggaggcacttcttcctatacttcccactaagtatagctaaaaccatggatattatagataaaacaaacactaaaaggctcttgaaggtggagagaagacagaacaattggaagccttgggaccttgggaatggcatggcagtgagttctctgggttttcttttcttcctcatatatctggaactggatgctggagaaaccactggaaagaccaatgggcgcaaacgaaaaaaataaaataaaatccccaagaaagcctggtctctctggccaaaagaccaggaaaggactaatttggcaagacagaaaacttttagacaaaaatcacactatccttgccaaacatcatggaaagaaccacaaccctgttgccatcccattagcaaatgctgagtggcagcctggatttctacccttacctggctgggacaaggcacacttaaaattcccctgctgggccaggcgtggtggcttacacctgtaatcccagcattttgggaggctgaagggggcagatcacttgaggtcaggagttcaagaccagcctggccaacatggtgaagccccatctctactaaaagtacaaaaaaattagccgaccatgatggtgcacgcttgtaatcccagctacacaggaggctgaggcagcagaatcgcttgaactagggaggcgaaggtttcagtgagctgagattacactattgcactccagtctgggtgacaggccgaaactttgtctcaaaaaaaaaaaaaaaaaaaaaaaaaaggtttcaatgagcaattataaacacacttgaaacaaatagaaaatgaaaaatatcagctgagaaataaaaaatttaaaaagaaccaaatggaaattttagaactgaaaaatagaataaccaagataaaaagctcaatatatgggcttactagcgaatgggggaaacagaggaaaaattaacgaaatgcaagacagaatagaaattgcccaatctgaacaacagaaagaaaatgggcagaaaaacaaaataaaataaaataaaaagaatctcagggacctgaggggctacaacagaggatccagcaatcacatcactttagtcacaaaaggaaaggagacagggggtggagctgaaaaaatattcaaaaaaatgatagatgaaatgtccccaaatttggcaaaagatctaaacctaccttagcaaaccccaaacagagtaaactcaaagaaatctatgccaaagacacatcataatcaaatttctgaaaactaaagacaaagaaaacatttctgaaaacaatgggagagacagacaacattataccttcaggaagaaataatttgagtgacagcagatttctcatcagcaatcacagaggccacaaggaagtagaacagccttttttaaatacagtcacacatcacttaaccacagggatacattctgagatgtacatcactctgagaaatgcatcactagccaatttcagtgttgtgcatacatcatggagtgcacttaaacctagacggtataacccactacacacctagactatatagtatagtccattgctcaaacaacctgcacaacacgttactatactgaatattgtaggcaactgcaacacaattgtaagtatttgtgtatctcaacacagaaaatgtacagtaaaagtatggtattaaagattcaggccgggcgcggtggctcacgcctgtaatcccagcactttgggaggccgaggcgggcggatcacgaggtcaggagatcgagaccatcctcgctaacacggtgaaaccccgtctctactaaaaatacaaaaaattagccgggcgaggtggcgggcgcctgtagtcccagctactcgggaggctgaggcaggagaatggcgtgaacccaggaggcggagcctgcagtgagccgggattgcgccactgcactccagcctgggcgacagcgagactccgtctcaaaaaaaaaaaaaaaaaggttcaaaatggcatacctgtacagggcactgaccatgaatggaacttgcagaactggaagttgctgcagatgggtcagtgagtgagtggtgagggaacgtgaagacccagggcattgctggacactcctgtagactttataaacattgtacatctcccctacactaaatttatctttaaaaacttcttttggccaggcacggtggctcacaccgtaatcccagcactttgggagcccaaggcgggcagatcatgaggtcaggagctcgagaccaacctgactaacatgctgaaaccccgtctctactaaaaatacaaaatgtagccaggcgtggtggtgcccgcctgtaatcccagctactcagaggctgaggcaggagaatcacttgaacccgggaggcggagattgcagtgagtcaagatcgcgcattgcgccactgcactccagcctgggtgacagagtgagactctgtctcaaaagaaaacaaaaaaacttctttcttcaataataaattaactttagcttactataatttttttactttataaactctttaattctttttaactttttgactcatttgtagtaatgcttagcttaaaacacaaacatattttacacttgtacgaattttttctttatatcctaatttcacaagcttttttctatttaaaattttttttacatttatttatttatttattcattcatttatttatttttcagacggaatctcactctgtcgcccaggctggagtacagtggcacaatctcggctcaccacaacctctgcctcccagggtcaagtgattctcctgcctcagcctcccaaatagctgggattacaggcgccctccaccacacccagctcatttttgtatttttagtagagacagagtttcaccatgttggccaggctggtcttgaactcctgacctcaggtgatgcacaagccttggcctccaaaagtactgggattacaggagtgaactactgcacccactgcacccagccctttttttttttcaatttttattttagatttggggatacatatgcaggtttctttctttttttttttttttgagacagagtctggctctgtcgccaggctggagtgcagttgcccgatctcagcctcagctcaatgcaacctctgcctcccgggttcaatcgattctgctgcctcagcctcccgagtacctgagattataggcgcctgtcaccacgcccggctaatttttgtatttttagtagagacggggtttcaccatgttggccaggctagtctcgaactcctgacctcaggtgatccacctgccttggccacccaaagtgttgggattataggcacgagccaccgcacccagcctacatgtgcagccacctgagtaggtgggattacaggtgtgcaccaccatgcccagctaatttttgtatttttagtagagatggggtttcaccatgttggtcaggctggtctcgaactcctgaccgtgtgatccacccgccttggcctcccaaaatgctgggattacaggcgtgagccaccatgcccagccaagaaattgttttaggtaatgaattactgatagccacaaaaaagtgaataaattacaaagacatgatgctgagtggataaagccagatacagaagagtatattatatataattctacttatatacaactttagaaaagacaaatctgtagtgacagaaagcagaccagctgtttcctggagccagggagactgactggtatgagcacaaaagaacatttaaggtgatgaaaatgttccctagtgatggatacatgggtgtgtacatttgctgaaacttggaaacgcacatttgaaatgaatacattgtattgtacatgagctctacctcaaatacacttgatttaaaatccctttacaaaacattagaaagataatcaaattatatcattttatgaaaaagaaaagaacaaaataatttaagatacagtaaaatatttaactgtatattttttgttacaaaatacggcatatttggccatttgggtttaagatgattgagaaggtccaatccaattgtaagacatatcctacacatatgcaaaagccttactaacattgatactttgtataaaacaaagtcatatattgtgcatcctcatattatcctcaaaatctgataggtggaaccttaacggcctattttcactgatcaatcacttcactggctgtgcagaagtgtatcccactataaaccagaaagcaaccacagttgtatagatataataagagggaaatgctgcttcaatagaggagtttcttgatatagtgtactcagattacaggagactgagatccagctactgcttgaaatattttacttagccgttatacaagagtacagggtcaccacaaataaccccaaagagaaccccaaacctaaacatttttaaacaaatttcaaaacgttggtgataaattctctgtactatctttgcaattttcctgtaaatctaaaaccattctaaaatttaaagtttattttttaaagctattgttttataaaataaatcacagaatattttttaatgttgataacaccatggcatgagcgggtggtgtgacatttctgaatcacacatcagtggaatcttgatgtcaccgattttacatgttactttttgaggttaggtggagactgcaagtcctcacagattaatgctgtaaagtagatttatgaaagggagactttaaaaaccccacccaagacgcactcccaaaaaaagtattgctgctgcttgcaaaaacacctccagataccagaaaccactgaaaagataataaatattactataaaattaacacaaactagagccaagcgtggtggctcacgcctgtaatcccagcactttgggaggtcgaggtgggtggatcacctcaggtcaggagttcgaggccagcctggccaacatggtgaaaccctgtctctgctaaaaatacaaaaattagccaggtgtggtggtgggcgcctgtaatcccggctactcaggaggctgaggcaggagaatcacttgaacctggaaggcggaggttgcagtgagccgagatcacgccattgtactccagcctgagcgacagagcgagactccatttcaaaaaaaaacattaacacaaactagctggccagtggtagggtgatctctacataatgatagagaaatttggaagattatccgtgtgaaaatacaagttgaataggagatgccaaatcaaggtggctgactttaaaggacctcctctgggagctggtggacagaactgtcgatatgatttgaatatccggcccctccaaatctcatgctgaaatgtgacccccagtgttggaggtgggcctactgggaggtgtttgggtcataggcgcagatccctagtgaatggcttggtgccatccttgaagtaatgagtggtaatgagttcatacaagatctggttgtttcaaagcttgtgataccttcttgctcactctctcttgcttgctctcttgccatatgacatgcctgctctccctttgccttccaacatgattggaagcttcctgaggccctcaccaaaagcagaagctggcactatgcttcttacacagcctgcagaactgtgagccaaataaacctcttttgtttataaattacccagcctcaggtattccctaatagcaacacaaagcagactaatgctaacacaactgtcttctatccctcctaagattaataggcaggaaccaagataataataataaaataataataataataataataataataataataataaattatccagaaaaaaaggggatgactacttccaactacatgaaaaattttaaaagaaatattaaatagtgagtcaacatgaaactataaggccatcactaggcagtcttctcatactcaaatgcattgacctttatcctggctgactcacccatagaaatatgaaaaaaaaacctaggagatgccaacttcccacccctgagggttgaaggtcccagcaatttcgagaaaatatccccacaaaaaggacccagtggctgggcgcggtggctcacgcctgtaatcccagcactttgggaggccgaggtgggcggatcacctgaggtcgggagttcaaaccagcctgaccaacatggagaaaccccatctctactaaaaatacaaaaaaaaaaaattagccaggcatggtggtgcatgcctgtaatcccagctactcgggaggctgaggcaggagaatcatttgaacctgggaggtggaagttgcagtgagctgagatgccaccattgcactctagcctgggcaacaagagcataactctgtctcaaaaaaaaaaaaaaaaaaaaaacccaggtatgaggatagcaagaaattcactccacatgcaaactcacttgcacaaatcctggactgccaggaagaacgccactcacaggctggtacattgtttgaagtcagtagttttttagccacagtctacagctgcccaggtgctccagcctagagaccgtacctctgcctcacctctggccttactcaggactcttttgtctacgtgtaacagaaagtgaattcaaagtggcttttaaaaataggcatttttaggctggtgcagtggcttacacctgtaatcccagctgtctgggaggccaaggtgggtggatcacctgaggtcaggtgttcgagaccaacctggccaacatggcgaaaccctgtctttactaaaaatacaaaattagccgggcagggtagcacatgcctataatcccagctactcaggaggctgaggcaggggaatcacctgaaccagggaggcggaggttgcagtgagccaaggttgcaccactgcactccagcctgggcaacaagagtgaaactccatctcaaaaaaataaaaaataccaaaataaaataaaataggcattcttgtctcacctaagttggagggaaacagaaaaaaagaacaataaaaataaaaggaaattattggttcctataacataaaaggtcagggttagtctgacctcaggcatggctgcatcagggggttcaaagaatatcatcaggacgaaggctcactctcttgctccctctccgtgacctcaatttgctttcctgtctgttggctttattctctgacaggctttctccaagagggtcactggagtcaacaggcctgtagtctaccagcttggcagccaccatggaaacacaaagatttcattctatttccatcaaagccccagaaaaagcctcgttagctctgattagcccatcttggaccatatgtccatctttgaaccaatcactgtccaagaagatgtgatactctcattgaccagtgttcaatggggacctactctcctagcagtagactagcagaaaaatagtaggacaccctgagattcaccggaaatatcatatgtgagtaaaagcaacaacagccaaagagaacaggaatctctggctgactgagcaggttttcaggctttgttcttccaaagataataagaagtgctaacccataaaacttaacaagcctctctaaggaatccggagttgttatgagttattatatgtaaaaagcacttagaaaaatgtctggcccaaagtaagtactgtagagctgttagcgaacatcacggaagaaggatcctggagaatggaaaagaacatattctagtagtcagggtggaggcacagaattgtttaaatattaaaaggagtgtaacctaattttgtaacaaactggtgaagcaggatatatgagttaaactactttttgcttctttgattcataatttgagaatgacaaaactgttttaaaataaatcttttccgtcaccaacgcaaggggatttgatgtaaaataaaatatctggccaggtgcggtggctcatgcctgtaatcccagcactttgggaggctgaggcggaaggatcccttgagtccaggagttggagaccagcctgggtaaccataggttgaccccatctctacaaaaataagaaaattagctgagcgtggtgatgcctgcctatggtttcagctacttgggaggctaagccaggaagatcacttgaggccaggagattgaggctgcagtgagctatgatcacatcaccacactccagcctaggtgacagagtgagaccctgtctcaaaaaaaaaaaaaaaaggagaagaagaacaaaatatccaatactggttataagatgatgaactaatagatactgcagtctacccttctacaccaaattctaaccacacaaacaacagaagcatattattaataaattaataattatgctcaaaaaccagaaatgcttgctggactggggagagagaacatgctgaaagacagaaatcatactgaggtaggaggcaggtgggactcgtctccagaccagattgaaactgactgaaggccgggcatggtggctcacgcctgtaatcccagcactttgggaggccgaggtgggcagatcacctgaggtcaggagttcgagaccagcctggccaatatggtgaaaccctgtgtctactaaaaatacaaaaatgagacaggcgtggtggttcatgcctgtaatccgagctactcaggaggctgagcgaggagaatcacttgaatccaagaggcggaggttgcagtgggccaagaccgcaccactacactccagtcggagcgacggagagagtccatctcaaaaaaaaaaaaaaaaagacaaaacaaaactgaccgaaaccagtagaggggctgaaagaacctctcactgcccatcaccgtaagacactcctatcagcaccatgacaatgtaccattgccacagcaacacccagaagttactgcccatttcctagctattcctgaataacgtgcccctttaattagcatgtcactaaaagtgggcataaatatggctgcacaccaccctgcactgtcctctcggattgcctccgctgtagtcctgctccccgggagcggtcacagagctgtgacacagccgcctcctcagtaaagttgttttcttccagcactggcttgctcttgaattctttcccgagcaaagccaagatcctgcccttcatcaatactaggttagatggaaaggggaactgtagcctacagtacctgcaggaatacatagaagacttctccctcaggaggaagcaagagcatgccctgaggcgtggtaaccacaggaagcactccacagggagtatggagccgtcacacccagcacacacgcctcccatacacctcacaagcagcccaacccacccactcccaactttcagggaaaacaaatacctatcggccgggcgcggtggctcacgcctgtaatcccagcactttgtggggccaaggagggcagatcacgaggtcagggatcgagaccatcctggctaacatggtgaaacctcgtctctactaaaaaatacaaaaaattagccaggcgtggtggcaggcacctgtagtcccagctactcaggaggctgaggcaggagaatggcgtgaacctaggaggcggagcttgcagtgagctgaatggcgtcactgcactccatcatgggcgacagagcgagactccatctcaaaaaaaaaagaaagaaaataaatacctatcaacccattgcctaggtattatgcccagcaatgcatttgctctttttcctaatgctctccccgcaacctccgccctctcctgacaggccccaatgtgtgttgttcccgtccctgtgtccacatgttctcactattgagcttccacttacaagtgacaacatgcgatgtttggttttctcttcctgagttagtttgctgaggataatggtttccagcttcatctgtgtccctgcaaaggacatgatcttgttcctttttatggctgcatagtattccgtggtgtatataccacagtttctttatccagtctatcattgatgggcatttgggttgactccatgtctttgctattgtgaacagtgctgcaatgaacatatgtgtgtatgtatctttatagcagaatgatttatattcctttgggaatatactcagtaatgggattggtgggtcaaatggtatttctggttctaaacctttgaggaatcaccacactgtcttccacaatagtttaactaatttacattcccaccaacagtgtaaaagcattcctatttctccgcaacctcaccagcatttgttcttaacttttaaataatcaccattatgacatggcacacatttgcccatgtaacaaacctgcacatcctgcacatgtaccccagaaactcaaataacttaatttaatttttttaaaaaagaaaataaatacaaggtgtaaccctgacagcagtggcagcaccctctccccaactgagctgtgaaagccaagacagcagacagtctagtaaataacatcaactgtaaacagctgtgccccaaaaaaaggctcaccaaacagttgagaagttcctaacaccataagagagaaacaaagtcaaaaaattggaggaacttacacccaataaattaataaggtatcaggatatgactttaaaaataagtataatgaatatcttccaagaggtaagtgtgggtagtataatcatgaaacaagaactggaagttactaaatgaagcaattagtgatcttcaaagtaaaaaatgataactgttgaaatttggccaggcacggtggctcacgcctgtaatcccagcactttgggaagccgaggcgggcggatcacgaggtcaggagatcgcgaccatcctggttaacacggtgaaaccctgtctttgctaaaaatacaaaaaattagccagacgtggtggcgggcgcctgtagtcccagctactcgtgaggctgaggcaggagaatggcgtgaactggaaggcagagcttgcagtgagccgagatcacaccactgcactccagcctgggcaacagaacaagactccgtctcaaaaaaaaaaaaaaaagataactgttgaaattaaaactcaatggcaggatggacagagctgaagagccaacttgtgaattggaggactcagctaaggagttctctgaaagtgcaccacatagaataaggctttgtaatgtgaggaagaaacattgaaaaacatggagaacaggtccagaagttctaatcagcttccaacagttcaaaaaggagggactagaaaaatggggggaaggcactatttaaagaaataatgttttgcagttaatcatgaaggaatgaacaaatgctcccttcttcactctcctccctccccactaaaatgccagttgatgggttaaaaaggaagacataagcccaccaatacaaagagagttgcaaagatacacaagtatatgagaaatggcatctggctgggcgcggtggctcatgcctgtaatcccagcactttgggaggccgaggcgggtggatcacctgagttcaggagttcgagaccagcctggccaacaatggagaaaccgtgtctctactgaaaatacaaaattagccaggcgtggtggcacatgcctgtaatcccacctacttgggaggctgaggcaggagaatggcttgaacccaggaggcggaggttacaatgagccgagatcacaccattgcatcccagcctgggcaacaagagcgaaactccgtctcaagaaaaaaaaaaaaaaagaaagaaagaaagaaatggcatctatattttggaagctgaaagcagataaacaaggggtaatcaattcagcagaccagggaaagttaaaagtcaaatgcttgcagtatgtaggaaaagcaataagcacaaacccttagaaagactcaggaaggggagtacagccgtttcccctcatctgtggttttgctttccctggtttctgtttcctgcagtcagccacagcccaaaaataggtgagcacagcacaatcagatattttgagaaaggccacattcacccaacttttattatagttagattgtcacaattgttctattatattctattttattctattttatattagttgttgttgctcccctcttttttcagttttcttttttgcttcttttttttttttttttttttttttttgagatggagtctcgctctgtcacccaggctggagtgcaatggcatgatctcgctcactgcaacctccacctccagggttcaagcgattctccagcctcagcctcccaggtagctgggactacaggtgcccgccaccatgcccagctaattatttttatagttttttctttatttttaatttgcatttatatttgtttattcctaatgttcttaatctcttactaggcctaattgatatattaaaccttgtcatagagatgtatgtacgatataggaaaaaatctagtactgtatccctcagtatccaggcggagactgtttcaggacctcctacagtctaagacaagtcccccctctcttgtaccaaaatcctcagatgctgaatcctcaaatgctgtataaaatggtgcagtatttgcatttaacttatacacatcatcccatacactttaaaccatctctagattacttataataccgaatatgatgtaaatgctatatggaaagttgtaatactatattatttgggaaataatgacaggaaaaattcaaaaattttgaattctggtcagtgcagatgcaaattttttctaatattttcgatacacggtgggttgggatctatgggttctgcccccatggataaggagggctgactgtatctatagatttggtatgtctatggcttcaggcatccactggggatcttggaagttagaaggtctccccactagaaaaagggggctactgtaccaataactactgaaggtaggggtacacatgaggctgaacacagtagaattgattgaaagtctacataaaggccaggcgcggtggctcacgcctgtaatcccagcactttgggaggtcaaggcgggtggattgcctgaggtcaggagtttgagaccagcctggccaacatggtgaaactctgtctgtacttaaaataccaaaaattagctgggcgtggtggcgagcacctgtaatcccggctactcgggaggctgcggaaggaaaattgcttgaacccaggaggcagaggttgcagttagcagagatcgcaccactgcactacagcctgggggacaagagcaagacttcgtctcaaaaaaacaaacaaacaaaagaaagtccatataaaaagcaaatggcccccatattcctttatcatccactaagtcaggcaattctccctcctctccagcagaagactagaagtttatcgtctgctagagcagagggggacgctggacttcggacatcaggtaaatgtgccctgtggaacaaaagaaaatgtaacaaaagcaacacactgaatggtgactccccagtcctcttcaaatactgccaataatgctgatggttgggcatctacaccccaaaagggaaattagaaggttggtctccgaagaaaccaagcatcccaatagaaaagacctacaaatactgactgtgggaggaaccgtgtcaattatcaattgaccagatctctgctcattacattgaaaaaccccaccaacagtccggattatctttttttattgcctcactcttaaataaagtcaaggatcaggggccgggagcggtggctcacgccggtaatcccagcactttgggaggctgaggcgggtggatcatttgaggtcaggagttcgagaccagcctggccaccatggtgaaaccccgtctctactaaaaatacaaaattagctgggcgtggtagcacatgcctgtaatcccagctgaggcaggagaactgcttgaactcaggagatggaggttgcagtgagccgagatcgcgcccctgcactctagcctggcaacagagccagtctcaaaaaaaaaaaaaaatcaaggatcaacagatatttaaaaagagggactcagagaaaataggaataatgaagaaacagattttttaaactatatttactatgttcagaaatactagagaagattagcatctttgaaacaaaagcaggatgttttctgaaagcaacaatcacagaacaagacagaaaatgttcaatagcaaaaaaaagttttaattcaatagaagaggtggaaatttccaagaaagtggtaaaaaaaaaaaagagagagagagagagaggtggagattattagagacaatgacaatataggaagtctttttttttttaatggagtctctttctgtagcccaggcaggagtgcagtggcaccatctcagctcactgcaacctccacctcccgggttcaagcgattctcctgcctcagcctcccaagtagctgggattacgggggcccaccaccgcgcctggctaatttttgtagtttttagtagagacggggtttcaccatcttggccaggctgatcttgaactcctgacctcgtgatccacccgccttggcctcccaaagtgctgggattacaggtgtgagccaccaggcccggccagtatagaaactattaatcagatgtttaagtcactgtatttgggggaggtttgttacagagcttagcctatacctttactaacaaacataccttcaaaactttgagagaagtttatttcccatccaggattctagtcttaggcaaattaccatcaagtttaagttgaatagagacagtttcaaatatgcaagatgtcaaaaaatgtacctcttaaacactccttctcagaaaatgactggaacaaagactaatgccacgtgcatgtgtgtgtacgctaggtgcacaataaacatatatgcccaggcacatcggctcacacctataatcccaacactgtgggaggccaagatagggggatcacttgaggccaggagttcaagaccagcctgagcaacatagggtgactttgtctctacaaaaaataaaaataaaaaaataattagcctggcatggtggtgagggcctgtagtgccagcaactcgtgaggctcaggtgggaggatcaggtgagcctaggatttcaaggccattaatgaagaaactaaagaaggaataaatgaagtgtatcccttcatttgttaaagagataaataatatctactacttagggttttgtgggattaaattgaacacattacttttcttgcttccatcaaaatcatacacacacacacacacacacacacacacagccctgactgtagccaattgttcttgagggtaggaaggcaatgtatgaatcttaagagagtcaatctgcatttttcagtttacagacactggtggagaagtcagtgaaaccagagaacttgaccttggaaaatcattcatttatgttaagaagtagatggcccattattatttacaaaataacttgaagagccattttggttttggaaagagagctggcagagcagagctcagaaaggagatgaaacaatgagagataagttgttttacataatgaaagaatacagactttccccgattataccaaacagaaccaagataaagtaagattttccacaacaaggcactcagggatggcgatggaggcgctgtggatcaagtcagccagagagaaatttctgggggttggaatggttacaaaataatgttaagaatatagccagctgtgatgccacaaccctgtgatcccagctacttgggaggctgaggcaggaagatggcttgaggccaggctttcaaggccagcctgggcaacatacgagatgctgtctctgaaaaaaaaagaaagaaagaaagaaaagtatgttaggaagatgatagatggctaatatcaagctttacagttgatcctgttcttatttaaaattctaatagtttgttcattatggatttcttccattcattttggtgttttaaatattgcattaaatcgttatttattttgagcactgagtttttggtgcccccttaaatgtggcactcaaggaaagtgcctcgctagtttcaccctggtccctgcccttctaaaccttcaggaaaagtctgtgacatggaccagctctgtgttaatgatagctgccaaatagggatcagctcagggtggaacaaagacaccatcagcagcaggcaagacatgaaaattctctatcaatcagtgacagcgatttgaacaatgaaggattacaaggtaaaccttagagcaaagagaaaaataaacagagcatggaatagtgacggggtgttgccggggatcccagagaaggggtgaagttttgctgcccctcatgcccactgttggaccctacagctcaactgttcttttagctgagcttcttccagatagaatgaaaaatacaaaatactctggctggtcttccagctgggtcctgaaaggagagtccgagggttgggtgttgtgtccctgaagactagtctagcagtgggggcttgaaggggggtgccaggatgggcctcccaatctctttacggaaatgttagaggccgggtgtggtggctcacgcctgtaatcccagcactttgggaggctgaggcaggtggatcacttgaggtgaggagttcaagaccagcctggccaacatggtgaaatcccgtctctactaaaaatacaaaaattagctgggcatggttttgcatgcctgtactcccagctactcagaaggctgaggcagaagaaccgcttgagcctgggaggcggaggttgcggtgagccgagatcgcaccactgcactccagtgtgggtgacacagtgagaccctgtctcaaaaaaaaaaaaattaaaaaaaggaaatgtcgagtagagccagctccagaataagtgaatggaagacgttcaggtgcatgcgttcaggcggtaaattcatgatcaccaattttcacctagtgtctcagccatgccaagcattcctatcccagcccctcattcagctctctctcttatgccctcagagtctattcaaactttctccactctccttctatctctgaaatgcccctacaacttccttgaccctcagaagccagatccttgccaagcacttcacaaagaaaatgcaattcatcaaatgggatatttccccacacgtcattttcaagttgatttgctgccaattccatttgttttgctttgtttcctattacgaaggaagaattgtctctcttacttcaggccatgttcctctacttttttccatcattgcccccttatggagcctttatgacttttttttttttttttttttttgcgaaagagtttcactcttgttacctgggctggagtgcaatggcacaatctcagctcactgcaacctccgcctcccaggttcaagtgattctcctgcctcagcctcccaagtagctgggattacaggcatgcaccaccacgcccgactaattttgtatttttagtagagacgggggtttctccatgttggccaggctggtctcaaacacccaacctcaggtgatccgcccgcctcagcctcccaaagtgctgagaattacaggtgtgagccaccatgcctggccctaaggcattttttcctaattgctccccgctcctgctaccttgtgaaattttaaccccttaatatatgtttgtgtactctgaccctttcgagggccacgaatcattgcaatatctaagatgtggttgcccactctgagaatgcacgatctgtctacggctatagcaccctgaacacatccaatctcatcggatctcagaagctaagcagggccaggcctggttagtacttggatgggaaaatgcagatgtaaggccagttcctccacgcattctccagattttatctcctccctcgggatcttcccctcatcacttacacccaaggcctccagcatcttaacctgtccctctcactagctctactgactacccatctccagctctggccttctgtttgttaccttcacagccctatttctcaaaaggcatgctacactccaaaatgcactctgcctccatctctccactgactctattctctgtaatatcacaaacacactctgtgtgcccacacacacatactctttcacccagcattccctcataagagcacattagcagcccttgcctaggacgtagcaatactgaatgatgtgtttcaccagaactgtttataatcagccaaagcctttttcccaactttactgaggtatgactgacaaataaaagttggctattttagggtgtatgacgtgatgtttactatatgcctacaatttgaaatgattgccacaatcaagctaattcatatattcatcacctcacatagttaccttttttccattgtgctgagaacacttcagcacatttccagtataccatacattattattaactatagtcaatgctatggtttggatatggtttttttttgtttgtccccatcaaatgtcatgttgaaatttaatccccaactggtagcggtggctcatgcctgtaatcccagtactttgggaggccaaggtgggcaggttgcttgagtcaaggcattagagaccagcctcggcaacatggtgagaccctgtctctacaaaaaaaaaaaattagccaggcatggtggcacacacctgtagtcccagctactagagaggctgaggtgggaggatcgcttgagcccagggaagtctaggctgcagcgacctgagactgcaccactgcactccagcctgggcaacagagtgagaccctatctcaaaaaaaaaaaaaaaaaaaaaagaggaaatgtaatccccagtgtagcagtattgggaggtagggcctagtgagaggtgtttgggtcatggggctggacccctcatgagtggcttggtgtgcttctcacagtagtgagttctcactctcatgagcctggattgattctcggggaaatgaattcattcccatgagtgtgtgttgttataaagccagggtgccccttgggtttggatcctcttcgcaggtgctcatttcccctttgaccttttccaccatgttttaactcatcacaaaagccttcactggccaggcgcagtggctcatgcctgtaatcccagcactttgggaggccaaggtgggcggatcacgaggtgaagagatcgagaccaccctggccaatatggtgaaacatggtatctactaaaaatacaaaaattagctgggcgtagtggcgctcgcctgtagtccacctacttgggaggctgaggcaggagaatcgcttgaacccaggaggtgaaggttgccgagagccaagatggcaccactgcactccagcctggtgacagagcaagactccatctcaaaaaaaaaaaaagaaagtgagatagccttattactgatatggagaaagttttagtggtccggatagaagattaaaccatccacaacattcccttaaaccaagcctaatccagaacaaggctcgaactttcttcaaatctgttaagggtgagagagataaggaagctgcaggaagctagcagagttggctcatgaggtttaaggaaagtagccatctccataacataagagtgcaaggtgaagcagcaagtgctgatggagaagctgcagcaagttatccagaagatccagctaagatcactgaagaaggtggcaacactaaacaacggattttcattgtagtttaaagtcttatattggaggaagataccatctaggactttcatagctggagaggagaagtcaatacctgccttcaaaacttcaaaggaaggctggacgcagtggctcacacctgtaatcccagcactttgggaggctgaggcaggtggatcacaaggtcaagagttcgagatcagcctggccaacatggtgaaaccccatctctactaaaaatacaaaaattagccaggcatggtggcacatgcctgtagtcccagctgctcggggggctgaggcaggagaatcacttgaacctgggaggcggaggttgcagtcagccaaaatcgtgccactgcactccagcctgggtgacaaagcgagactctgtctcaaaaacaacacaaaaaaaaacttcagagggcaagctgactctcatgagaagctaatgcagctggtgactttaagctgaagccagtgcccatttatcattctgaaaagcctagggcccttgagaacttggctaaatctactctgcctgtgtctttacatggaacaacaaagcctggatgacacatctgcttacatcatgatttactaaatattttaaacccactgttcatacctactgctcacaaaaacattcctttcaaaaatgactgttcatggagaatgcacctggtcacccaagagctctgatggagatgtacagggagattaatgctgttttcgtgactgctaacacatcattcattctgcagcccaaggatcaggagtaattttgacctgtcactgtaattattttaaaaaacagggccgaggcaggtgtatcacctgaggtcaggagttagagaccagcctggccatcatggtgaaaccccgtctctactaaaaatacaaaacttagctgggcgtgatggcaggtgcctgtaatcccagctactggggaggctgaggcaggagaatcacttgaccccaggaggaggaggttgcagtgagccgagatcacaccattgcactccagcctgagcaacagagcaagactctgtctaaataaataaataaataaataaaaataaacaggggcccagacatggtggctcattcctgtaatcccagtgctttaggaggtcaaggcaggaggatcacttgagcccaggtattcaaaacaagctgaataacataataacatagtgcaacctcatctctctacaaaaaatttaaaaattagccaatgcagtggtgtgcacctgcagtcctagctactcacaaggctgagccaggaggcccactcgaaccaaggagctcagggttgcagtgagctatgatcacaccactgtactctagcctgggcaacagagactctggctctaaaatttaaaataataataataataaagtaacaaagaaacaaatacatttcataaggctatatagctgccatagatagatctgggcaaaatgaactgaaaaccttctagaaaggagtcaccatttagatgccattaagaaaattcatgattgaggccaggcactgtggctcatgcctgtaatcctagcactttgggaggctgaggcaggcggatcacctgaggtcaggagttcgagaccagcttggccaacatggtgaaaccccgtctttttttttcctgagacagagtctcactgagtggcccagtctggagtgtagtggcatgatctcggctcactgcaacttccactcccaggttaaagcaattctcctgcctcagcctcccaagtagctgggattacaggcacccaccaccacacccagctaatttttgtattttttagtagagacagggtttcaccacgttggcctggctggtcttgaactcctgatctcacatgatccacctgcgtcagcctcccaaagtgctgggattacaggtgtgagccaccgcacctggcctgaaacccatctctactaaaaatacaaaaattagccaggcgtggtggcgggcacctgtaatcccaactactcgggaggctgaggcaggagaatcgcttgaacccaggaggtggaggttgcggtgagcagagattgtgccactgtactccagcctgggcaacaagagcaagactcagtctcagaaaaaagaaaaagaaaaaagaaaattcatgattcaatggaggaagccaaaatatcaacataacaggagtttggaagaagttgattccaacccttatggatgactacaaggggttcaagacttcttggaggaactaactgcagatgtagtagaaattgaaagagaactagaattagaagtggagcctgggacgggcacggtggctcacgcctgtaatcccagtactttgggaggccgaggagggcagattacctgaggtcaggagttcgagaccagcctgcccaacaagacaaaaccccatctctactaaaagtataaaaattagccaggcatggtggcgggtgcctgtaatcccagctactcaggaggctgaggcaggagaatcacttgaacctgggaggtagagattgcagtgagccaagatcatgattctatctcaaaaaaaaaaaacacacacagaaggtaaattgttctgcaaagagaggtaatgggaatgtgggagttggcttggctactggcacagacagcagggaatcgggagtttgaaagaagatttacatttggcatacacgtgtgcccacgtggcctttcctactgcaaagggtgctgacaaaatcaagcccctgatccttcctgtggcatacataagaacaaaatggtagttgttagggacaaatcaaaatttaaaaataaaatggccaggtgcagtggctcacccctgtaatcccagcactttgggagggaggccaaggccagcggatcacttgagcccaagagtttgagaccagcttgggcaacatggcaaaaccccatctctacaaaaaatacaaaaattagtcgggcatgttggcacgggcctgtagtcccagctactggggaggctgaggcagtataatcaatcacctgaacctgggagatcaaggctgcagtgagccgtgatggcgcctttgcactccagtctgggtgacagagtgagaccctgtctaaaaacaaaacaaaacaaaaggctgctagtcagtttgggctactataacaaaacactggccaggcgcggtggctcacgcctgtaatctcagaactttgggaggccaaggggggcgggaatcacctgaggtcaggagttcgagaccagcctggccaacatggtaaaaccccatctctaccaaaaatacaaaaattagccaggcatggtggtgcgtgcctgtaatcccagctactcaggagactgagacaggagaatcgcttgaacctaggatgtggagattgcagtgagccaaggtagcgccattgcactcccgtctaggcaacagagcaagactctatctcaaaaaaaaaaaaaattaaaggcttagttctccatgttgaaagtaagggaagagacttctccaccctctcttttcttagaaaatttgctttagaaaacttgtaaaattttttttttttttttgagacaaagtctcactcttgttgcccaggctggagtacagtggcacaatctcagctcaccgcaacctccgcctcccgggttcaagcaattctcctgcctcagcctcccaagtaggtgggattacaggcatcctctaccacgcctggctaattttttgtatttttagtagagatggggtttccccatgttggccagactggtctcaaactcctgacctcaggtgatccacccacctcagcctcccaaagtgcggggattacaggcgtgagccaccgcacccagccagaaaacttgtaagttattttctgtgtcttcaaaacgtgtataaatatttttagaagccacacagcctcttgccagctttactacccagggatgtctttcacaaagacccaggagccatctccttgaaatgtaaacaccaagaaagatggagccttcatttcccagtttctgtgggagggtaggactaacttaaatggacactttgcttgagctgcaaaactatctgctgtcataaaaatctgaaaagctggctgggcatggtggctcacgcctgtaatcccagcactttgggaagccgaggtgggtggatcatctgaggtcaggagtttaagaccagcctggccaacatggcaaaacctcgtctctactaaaaatacaaaaactagccaggcttggtggtgcacacctgtaatcccagctactcaggaagctgaggcaagagaatcgcttgaacctgggaggtggaggttgcagtgagccgagatcacgccactgcactctagcctgggcaacagagcaagactctatctcaaaaaaaaaagagaagtttttcttctgattaagccagttagctaacatagatggtcatcacaattgccaggtgtctctagactgcactatatgtgacaaatggtgctatcgagtcctcctaaagattatttatagtttatcttgagaacacatatgtaatgggctgtatctgcttggctagataaaagtgagacttccttctgtctttgcagtctcttagcaaactgcctgtgatgtgctcacattctggtttaatgcttattcaataataaaactgttttctttcttcactactttcgtggagaggttttttctgggttgggagaaaattttgcttctaattatattctcccaacatagcgcatgtgcttaaaagggaaacaaaagcaggagggggaagggtctagagtgataagagctctagtgagaggctaggcctagagagggacatggagaaatagcatgcggagaggaacggtagaggagcaacgctaacattcagttgtaaataatacaatcatagcagctaatacatagagggactacacgccaagcactgttctcactgtttagccatattcactcatttagcatgcgcagtagcttgaatccggtttttcaattattcattccctctctctgcacgtggccgtagagtacactagagtgggcagaaaataagtcacaaaacagcaaagaaacagtgcttttggaagtaggtatgagacaaactcttttctaggcaaaagtaacccacgaaaatgtgtgtggaaaggccagatcctactattaggcaggatgggaatttgagccattttatttggatattacagaatggggtgaccccagaaaactggaagaactggggaccagcaaatggccgacctgcagtcctgagcagaggatgtaggccagagtggacctagaagataagaaagggaattgaatccagtaagggacagacactttatttttttatttttatttatttatttatttatttttgagatagagtctgatctggaggctggaaggcggggctaaaactcccactcacttacctctaccaacaactaggccaccaagtcatttctgaggactggctcaagaaagcagatttaacttacactggcctagcccaggccaccagatgcatccacggagatccaaatgcatataatcacttgaatcaagatctagacagggacgcgtgcagcaggcttcatctgactgattcctgacacgggagagaaagcctaagctccgaatcatccttcaatgtttacaaaggccctaaatagcagtgggctaattgctgttcctggatttccaggagacctgagacccatgaaggagcaggaaagagcttggggataaaaaattaatctggaacctactggagcggaaggggctgcactcacctggaaaagacaaagttcttgggaactggccacgtaggccaggtccctaagcaattccatcccgcaccctaacaccccgactggtgttcctgggtccctaacattgtctgtacccgcttcggaggttggacaaaatgagtttttcactgccctgcctcaggcctctctcaaaggtctggcccatgatatttggtgtacattgggaccccagcgcccagatatttgaaacggggtggggagcgggtgttgagctgctacatttccaggttctaggtaccctggggaacccctggtcgttgacggaagcacagcgttcaagggcggcagagctcaggtactggaggacacatgggccgcgccgggtctagccgcgggacatccccagaccccagcacggcctcccaggccgaccttccagaagccggcccactgccttccccgggtcccagcccagaaaagcggagaccttcccctccgtttggaagatggactcatcccctacttcctcctggctccccagaagacctggagacctcgggaagtgttctcatctatgttcgctccaacccgggggctcaggcccacctcgatcccgccttcccgggaggtccaggaaggtcccgccgcacccaccccgttggcctcaccctggctcgggcccctttatcatcctgcagctacgctccgaccaggaggcacagccagtccccacagccggctctaccgctctgctcgcaggtttgggctagtctggggcggggacttgggagcgcctaaaacttgcgaggagggcggggccgcagaccggtcctttaaaggttggaagtggccccgaggcgccggcagccctgggcggtcccgggaatcgcacaggacccggctcccctcgcctaagctgctggggggcgccatgggccgctaccgcatccgcgtggccaccggggcctggctcttctccgggtcgtacaaccgcgtgcagctttggctggtcgggacgcgcggggaggcggagctggagctgcagctgcggcccgcgcggggcgaggtcagcgcggggagcgaggggagctagggcagcggggaccccgggcccaggcccgggccgagctgggctcgcggcgggagggcgggaggctgggggcgaggtgacagcgcgacctcgcggactgggacttccacgaagctgggacgaggtgggcaagattagggacagggtccgcagctgggatcccgggctgggctcaaccccatctccctttcccgcccctggtcccggcagcccccagctccttctcccagtgacccagagccaatgtaagtatgaggccagaggtcagacgtgaagctcctccaagaaccggcgcggggagagctcagttaatgggacccacgtgggcgatgctgctccagcatcagctccaggcgctgcgggccctcgtcctccacccgactccgggcgtctgagacccaaagagcaggttgtgcgggggcgggaacgaggcgatgctgtctttggaggccctgagaaactgaggttgcacaggagcgcggctctgtcctcgaaacggcctcagtcgggtccctcctactaagtctggcctgggtccggcctgcacaggaggaggagtttgatcatgacgttgcagaggacttggggctcctgcagttcgtgaggctgcgcaagcaccactggctggtggacgacgcgtggttctgcgaccgcatcacggtgcagggccctggagcctgcgcggaggtggccttcccgtgctaccgctgggtgcagggcgaggacatcctgagcctgcccgagggcaccggtgagcaggcggcgtcggggaaggaggcacaaggtctcgggaactgctgcggggctaggagggcagagttaaggacggtcggagcagacttagaggatgtatgggcccagggcaggtgaaatgtagggatcccagggtgctggacagaaaacgggaaggagttatgaattcccaaagttttacacaggctaagagaggctgcgtgtgaggctggaggcagggagtaagtgatctggagatcccatcttccaagaaggcaaagacagaaagtgggagttgcagcgatccaggaaaacagagaagcaaagtgaaagtaggaaggagatgtaaaggtgactcagaagtcaggtgaggggaccacatggaacaggagggggtgggtgacccgtgagagcagacagctaagggaagaaaacataggatgctggagagctggtttggttggaataacacggaagacacccgtgaaagacaagaagcacactggcccgcaggagacgaggaggaatgaggatggcaaatagtgaattttttttttttttttttttgagatggagtcttgctttgttgcccaggctggagtgcagtggtgcgatcttggctcactgcaacctccacctcctgggttcacgccattctcctgcctcagcctcccgagtagctgggactacaggcaccccccaccacacccggctaattttttatattttttttagtagagatggagtttcaccgtattagccaggatggtctcgatctcctgacctcgtgatccgccctccttggcctctcaaagtgctgggattacaggcttgagccaccacgcccggcccaaatagtgaatttttaaccatgggtaatgagtaaaagagagatgaatccagagatgagtgagggcagtagggatggaacatcaaatctatgactttgagacaggtgagtgtaaatgcagaaaagacccagaataagtccatagatacagattatgatagtaaatccagaaagatgaggtttaaaaaaaaaaaagcaaatgtagaatcttttgaggacaggtgaaggcgtggcaggtgaggtttaagatgtgaaattaatcaaagcaatctgtagtagacagtaggtgtaggtgtataggtgactaagatttcatcaccttaattaaggtgatttttttccaaccatagatattgatgaagtaaggccaggtaggggaagatgagtgaaggagcaagaaatggtggcaaacaggaggtttttatctacaggcaaaggatgagggctgaaataagagaaagcaggagtgcaaagttggcaaagatgggataaacgtgtctggtggataatcaaatgaggcaaagccagagataaaagcaacagtgcatggctgaaaacatggaatacggctaaccacagggagatgaggacaagaggcgggcataggaccagacagagccgtgaggccaattgtcttgatgtctccccagcccgcctgccaggagacaatgctttggacatgttccagaagcatcgagagaaggaactgaaagacagacagcagatctactggtgaccacccaccccttaaactaaccccgccaccactgtcccaccccttccctgcccctgcccctgcccctggccccatcactgaccatgacatccttcctgaagctttgtccccaactcctagctgggccacctggaaggaagggttacccctgaccatcgctgcagaccgtaaggatgatctacctccaaatatgagattccatgaggagaagaggctggactttgaatggacactgaaggcagggtgagaaaaaggctagacctcggagtgaaataagggctgggagggccaagaatgatgatagacggtgagggactgagggatcagctgatgagttaagcctcaatacctgtcctagggctctggagatggccctcaaacgtgtttacaccctcctgagctcctggaactgcctagaagactttgatcagatcttctggggccagaagagtgccctggctggtcagtggttccccgaggtctccataatcccttaatggcccctctggatgactcatcacactccacagtcccccgtaactctttgcaagaagagaccttatcatatctggtcaactcagagaggccttgagaatgaaaacgcagaagctgggttcagggagggttatatacctgaacccctggggtagattttggagaagggatatgcaggctgtggtacatatatcctcctttcaccgcccaccaaagagaaggttcgccagtgctggcaggatgatgagttgttcagctaccagttcctcaatggtgccaaccccatgctgttgagacgctcgacctctctgccctccaggctagtgctgccctcggggatggaagagcttcaggctcaactggagaaagaacttcaggtacctctccttcccctgcctggcactgttctctccttagtagtgtggtgagaacggacagagagaatccaaactgagtcagaggaaggctgcagtactgcattgccccttggtgcagtcctgtgctggaaaaatacagaaataaaatatgtaggggaagaaactatgaggagctcccagcaggaaggggaaaatagaatggatccccagcacacagagaggggctggagatgttagcaggaacagtgacattgcctggccgcagtgttctggactccagtgttcatgggcagggagaaaagtgaggaagtgccatcaggtggggagaatcggggaggctttctagaaaaagagagcggggtttggaagcaatggactgtactgaggacaagcctaggcaaaatgtgtgcgtatgcatgtgtgtgctgtatgcggtggcaggggtagtaggggaagctctctggaatatttggcagaggatgtgagatttgaatagggaatgaaagagcatttgctgagctgataggagccaaaaccagagcgcagaccattcgggaatgatcagaaaggggcctggccatttgacaggtggtcagtttacaatgcctgtgatgccaactggattgagcaggcctggttccaaacccagatctgccaccacatccacacacaagacatctaccctcaccagactgtttcttcactttaagatgagaggaactggaccaggggctctagttctcccaacagggctccggtactgatgcaggagaatggcaagaagctagactaaatctcttgccctttgccccggccccctgggggtagactttgaactctaaaaatggatacatccctcctgtccccagaatggttccctgtttgaagctgacttcatccttctggatggaattccagccaacgtgatccgaggagagaagcaatacctggctgcccccctcgttatgctgaagatggagcccaatgggaagctgcagcccatggtcatccaggtaagggccccagacctctcccacaacgttgcactctgttcacctcaacctctgctcccagggacccaacccccagctcttggctcccaaaccccatcctcactcagtgagacttgtcttcatgtcactatttgcctgtaccctcgtctcccctgcctcatccaactagaattactttttcaagagtcaaaatggcctcctggagttctcatcctgtatccaatggtcctcacacttcagtgtgcatcagaatcacctgaatgcctgttgaaatgcagatttctggatcccatgaccagactttctgattcagtatgtctggggtgggaactaagagtttgcgtttttataagttccaaagtgatgctgacactaccagttcaggactacactttcagaatcactatctcatctctcagtggcctctggctctgaaccctcgccatctcttgaatatcttttctcgcaatttcttttttttttttgagacagaatctcactgtgtcactcaggctggaatacagttgtgtgatcttggctcactgcaacctgcgcctcctgggttcaagcaattctcccacctcagtccctccagtagctgggaccacaggcatgtgccaccatgtgggcctggctaatttttgtattttttgtagagatggggtttcgccatattgcccaggctggtcttgaacttctgggctcaagtaatctgcctgcctcggcctcccaaagtgctgggattacaggtgtgagccactgcacctggccttctctcactattcttaacagtcaggtgacaagaactgtcaataatcttacacctcctacttctccttcacattccaccaccatctgagcgccgaccccaaagcagcaggtttctcccacaccactgttagggcctccttctggacccccttcttccagtccctcctgccttccacctgacatcagggcactccagctagcgagcggcaggctgggagggttcacagtcctcctgctagactataacctcctagaaggcaataatcttacttagtcatctctgtttccccaagaatgctgactataatgtcatatacggaatgggagttcaataatttctctttctcccagattcagcctcccaaccccagctctccaaccccaacactgttcctgccctcagaccccccacttgcctggctcctggcaaagtcctgggtccgaaattcagatttccaactgcacgagatccagtatcacttgctgaacactcacctggtggctgaggtcatcgctgtcgccaccatgcggtgcctcccaggactgcaccccatcttcaaggtacttattaatctattaaatcacatatccctcagaccccagagagaggaacagccccatatcaaaagatattgcagcagcaaaaactctttgtagcaatttgtgagtgaagaggagactgtctcaatatcttgagatgttgattttaattaagtttattaagtttagtcacttaacattatataggaatcctctgaaattctcagagatctgacagtctagcagtgcgctcacagtagggcttgaacactgctagtaaaacaaaagccatattcctaccttagatctagtatttagccagaaaaacaagtgatgcccataagaaccaaccagagaacagtatctggtactagagtttgaaatcacaagggacagcctataacagtatagtattgatgaagaatgtttctacccaattgaggagtcagctaagtagaaacagaccaaaaggcaaggaagaacagccagcaagccgctcatacctgcccaacagtaaggtggatagagatgtatgttagcatggtaatgacaggaatgaaaaggaaagaatctaaaacgtagtgaagggaggaaatggtagctgcagcgtgcctgggtgcaagagagagaaaagccagaagtccaagcttctgccacacctgtaagtccctggggcaggtgtgttatactgacctagaaatactgtggttttaagagctgggtgtggtggttcacgcctgtaatcccagtgctttgggtggccaaagcagtatgattgcttaagaccaggagttcaagaccagcctgggcaacacagcaagtcccggtctctaaataaaaagaaagaaagaaagaaatactgtaattttataaaacagtgagttccatatatattgctgggagaaggcaaaataagacctgtgcttgcttaagaaaatgttcttaaaatcttgatgatactttatatacagggaacttggcagagggagcacaaaaatgatacaagcttacaaaccagagtaattgtcagaaacagtaaagttagaagaaaccagagtcagcaaaaatgaggtgtttggttttaggtacatggagtttgatgtattggcaagatatgcaagtatgtcctgggtaaaaacaaccaaattgtgtttcagctgggggcctccaccaagaccccccaagcctggccagtatagctgtgccgcctctggaattttccccttcggtaacatagacaagatggagaccagtctgatgaatggaatcttggatttcattcatctcatgctgtctcctgcttccccatcctctgctccacacgaacaagtgaagcctctattcacacttacaattccgtttcctagttcagtcctctccgtgtctccactcaccacagtaatgccatgccccagcggacagctgagttgctggcagatgcacacaagggtcaagcctgcacatgtcttaacagtggcctatgcaggctctgactttggattgctggggtcttagtcctgaaccccggcctcaataatttccagatgtcctcacatgttccatcgtgaggttattaaaggttaaaatgacttaatggtgtgacacaagctaaatgctacaaaaaacattagttcttgcaaatttttttttttcagagacaagttctcactctgtcacccaggctggagtccagtggcgtaatcataactcactgcagcttcaaactcctgggctgaagcgatcctctaacctcagccttcagagtagctgggactacaggtgtgcaccaccatgcctggctaattttttttattttttgtagagacagggtttcactatgtggcccaagctagtctcaaattcctgggctcaagcgatcctcctgcctcagtctcccaagtaacctggattgcaggcacatgccgccacacccagctagttcttgcaattattattattaaggactgtttatccttaggcatcctttctcctcatgtggactttggcctttccgtgacatttggcatctttcatgaatcttctgaaaagcttcaggttaatgtgagctgctttggtatcttaacaccaaaggtgtcattggggtcattgccagtgtccagcatcaacaattcagacaagcaccaaaactgcttgaaacctgcatgttaactatgtggaaaggaagacaaacagtctaagataaaaagaaacgcatgtaaggaccatgccttttttaatagctaaggaaaatattttaatatttttaatttaataaattttaatttattaaaattaaaattttaatttaatattaaattaaaattttaattttaattttaaataaataattaaaatttaaataaatttaaatttaaaatttaaatttaattttaaataaacatttaaatttttaattttaatattaaattaatttaatttaatattaatttaacttaatttaatttaatattaatttaacttaatttaattaatttaatattaaattaaattttaatatttttaattttaatattaatttaatattaaattaaattttaatatttttaattttaatattaatttaatttaatttaatttaatattaattaatttaattttaattttaattgcttcaatattaaattaaattttaatatttttattttaatattaaattaaaattttaatttaaaattaaatatttaatattaaattaatttaaatttaatattaaattttaatagctaaggaaaatattttaatattaaaaaaagaccatggccttttttcaatagctaaggaaaagcaggagaagaggggcccaacagtgcttaagtaggggtggagaaagatttgcttaaacaggtagctgaatatagctcttctagttctgacagaaagtattctccccatccatcccctaaagaaacccccaactgtgaaacaactaaaagatggagatgcagctttgatcataagcagagaggctagtttaagaggatgtgaatgacagaggaggtagcaaagaaaatcagaaagggctgattcataaggcacctatactcaaggtagaaacaatgaagcagacagctactattccaggactcttatgtgtaatagacactctccaacatcacttaggtgagcatcaccacagcccctgagataagagagtctattgctgccccctgttgacaaatgaagagattgcagattaaaaggttattaacttggccaagtctcaaatgaggagtaaagtgtaggttaaaatcctggtcagtctggctccagggcccaactcacagggaagttggagagcacaagagtgagtgatcagaacagcaggagatcagcctgtaaaggaaagcatcaagaggagaaggcgccatgctgggtgccaggccctaccaggaaggacccaagcatggcctccaccagtcacgccctccaatctcctcctctccagttcctgatcccccatatccgctacaccatggaaatcaacacccgggcccggacccaactcatctcagatggaggaatttttgataaggtgaggagggtacggggcatgggactgcctcatccatctctccatgatctgccactttcaggatccaagatcaactatgtgtgaatgtcctcactcttaacctatgaacctgtcccttttatacccatgtcttttttttttttttttttttttttgagacagagtctagctctgtcgcccaggttggagtgcagtggcgccatctcggctcactgccatctccgcctcctgggttcaagcgattctcctgcctcagcctcccgagtagctgggattacaggcgcccgccaccatgcccagctaatttttatatttttagtagagatggggtttcactgtgttggccagactggtctcgaactcctgacctcatgatccacccacctcagcctcccaaagtgctgtatacccatgtcttaatatctgaaaatcccacatttgccccactttatggaagatgtgttggttctccagccctgtttccccctctaagacctgtgatctcctgtcccaggcagtgagcacaggtggagggggccatgtacagttgctccgtcgggcggcagctcagctgacctactgctccctctgtcctcctgacgacctggctgaccggggcctgctgggactcccaggtgctctctatgcccatgatgctttacggctctgggagatcattgccaggtgagtaaggaggagctgagaaatggtggggccggggggggggggggctctggcctgaggccagcatggggcaaaagcaagaaggtccagaaaggagaagcagagaactcaatcctggggagagatgaggaaaagtgaggacacagtgggtggctctgaaaatgaggagactgggatgaggcagagagaggaggtgaggggagctgtggggggagactgggggaggtgtctggaaaaatcaggattttctgacgatgtatgacagcaaccatgcgaattcctagaactaaggacccacatcttccatgagatgctagtgtgtttagagggctgaggatgtcccaaaggcgaggtgtcttcccagatactgtggaagcattgggcagatgccacagaaagaggaatagaggtcagaggcgggggctttctgccctcaagtgccttttccccctgggcaggtatgtggaggggatcgtccacctcttctaccaaagggatgacatagtgaagggggaccctgagctgcaggcctggtgtcgggagatcacggaggtggggctgtgccaggcccaggaccgaggtaagatccattctagagacagaagaagctcctgggagactctgccagggcgccttcccagccctgcccttctggggacaggaccccagcctctcatcacgcctcccttcctccctccacacgggaaagcatgtgtatcccattcccacctcctccgactcaggacaattctagagacccaaggactgtcctcctcagagaccctggccatcaacccctagtcccactacaccccagtcacagatgcccctgaactgccatatcctggggccccccaggccatatccacagctgggaggggtctgcacagtccctgctgggctcatattctctcctgatggttccgttttcctaactgaggatgtaaatgggaagattttccctccgaagcccacaaggacccaccctggctttccctccctctcttcctgcctgccactgtgcagcacgcacagagggtccaggaataccgcacgcttgctacagtgcaaggtcagctcttgatgcaagctcaatcctatacatgctttgcctcaaacccaaactcagcaccctgatccttggggctcaggtttctttggctaatccaactcttccaccctaaccaccccttggccaaaatctagccactacctttagtcaactctcactccccacatttgaacctctgaggaagaaaaagcctttgctgagctcttaggtttaatcacacaggcaccagcctggactgctgtcactcatccttcggcccctccccctcacacttcagatctaggctgtgaataccatcctctgcctctgtgagacaactacagacatttactggggagcccttatggcgaatcctgggaatgtggcaaacctccttaccctggagggagcctctccctggggaatctgcaccaccctacccttccaggaccaaactctctctagttcttctcagtacagtcccttaggctcctagcagtttgggctactacaacaaaacactagctgggcacagtggctcacgcttgtaatcccagcactttgggaggctgaggtgggtggatcacgaggtcaggagttcgagaccagcctggccaacatagtgaaacccgtctctactaaaaatacaaaaattagccaggcgtcgtggcacgcacctgtaatcccagctactcgggaggctgaggcaggagaatcgcttgaacttgggaggcggaggttgcagtgagctgagatcacgccattgcactccagcctgggcaacagagcgaaactccgtctcaaaaaaataaaataaaaaaaaccacacaccatagactgggtggcttataaacaacagaaatgtattcctcacagttctggaggctgaaagttcaagatcaggttctggtgagacccctcttccaggctgcccacagccgatttctccctgtatcctcacacagcagaaagatagcaagctagcactctgtcctctgctcataaaggtatcaaacccattcaggagggctgcaccctcacaccctaattatcatgtggggctccacctccaaataccatcacaataggattagatttcaatataaaaatttttcggagccaaagacattcagttcatgacacatgttaactttaacctccactaaccaccctcccccctgttctctttcagttctcatagctcacttttgtctagttttcccagcagacattttagaggctaaaattaaaaatgccatgggattagcagtcaggaacctgagttcaagatcagcctctgccttttcccaactatgcagtcctgacagtttattctctatgggctttgattttcttacctataaaatgagagtaattatatttattccacttaactgataagattattgggtctcccagcactttaggaggccaaggtgggcagatcacctgaggccaggagttccagaccagcctagccaacacggtgaaactccatctctactaaaaatacaaaaattagctgggcatggtggtgggagcctgtaatcccagctacttgggaggctgaggcaggagaatcacttgaacctgagaggcggaggttacagtgagccgagattgtgccactgcactccagcctgggcaacagagcaagactccgtctcaaaaaaaaaaaaaagattatcgggtctctgagcccccatatccactgcaaaatgagtggactgagataacctttgtgggagcccctctcagctgtgacactggaaatccatgacttattccccacattataacgcagacacttgtaattctgtctgggaataggattacgcattcctaaattatttatttattttttaatttttaaatagagacaggctcttgctctgtcacctgactaccagcaatcctcctgccttggcctcccaaagtgctgggattacaggcatgagtcaccgaccacgcatccctcaattggtttttttttttttttgagacagactctcgttgtgtcgcccaggctggagtgcagtggcgggatctcagctcgctgcaagctctgcctcccgggttcacgccattctcctgcctcagcctcccgagtacctgggactacaggtgcccgccaccacacctggctaacttttcgtatttttagtagagacggggtttcaccgtgttagccaggatggtctcgatctcctgacctcgtgatccgcccatcttggcctccccaagtgctgggactacaggcgtgagccaccgcgcccggccgcatccctcaattcttaaccactttttgaggcaagggatatttggtcactcagaacttttcagcccccaatccttccataacaataattattacttacttattgagcatttattacagaccaggtgattttgatacatcatctcatttataatgtaggtatcgtccatattttacaggtgaaaaaaactgaggttcaaataggttaagctggcctatggtaactaagtgtaagtgactgagccaggacttaaacgcatgtctgatgcaaatacgtctaaataaaataaacaaattcatcaattctaaaatatgggcatcccaaaacaacagcctttgttcctctcctcttatgctgtagcttctaactgctattcctttcctgcccaggtttccctgtctccttccagtcccagagtcaactctgccatttcctcaccatgtgcgtcttcacgtgcactgcccagcatgccgccatcaaccagggccaggtatggacagctgaaagcccaggtccctgaaggcaaggtgacctgagggagagatgggagttcaaaccctaagtaccagggttctagggttacagtttcttcctccagctggactggtatgcctgggtccctaatgctccatgcacaatgcggatgcccccacccaccaccaaggaagatgtgacgatggccacagtgatggggtcactacctgatgtccggcaggcctgtcttcaaatggccatctcatggcatctgagtcgccgccagccagacatggtgagaggggactctcgggagagggaaatgacagttggaaaggaaacatcagagtgaggggctgggctctaggtgcgtttgtctttagaaactgactgatcctttgttctgtctcaggtgcctctggggcaccacaaagaaaaatatttctcaggccccaagcccaaagctgtgctaaaccaattccgaacagatttggaaaagctggaaaaggagattacagcccggaatgagcaacttgactggccctatgaatatctgaagcccagctgcatagagaacagtgtcaccatctgagccctagagtgactctacctgcaagatttcacatcagctttaggactgacatttctatcttgaatttcatgctttcctaaagtctctgctgctaaggctctatttcctcccccagttaaaccccctacattagtatcccactagcccaggggagcagtaaactttctctgcaaagactagatccttttttacgctttgcagaccgcatagtcactgtctcaactactcagctctcctgctgcagcatgaaggcagccacagacaacatggaaatgagtgtgactatgttccaataaaactttatggacactgagatatgaatgttacatcacaaagtagtcttcttttggtttattcaaccatttaaaatgcaaaaaaaatccacaaacaaatgtgctttgtttgagacatgcacagccaggctacagactggatttggcccttgaaccctgcactagcctgaggccctgaccctacttccaaaacatccaagatcatggagcagggggatttcttagaaaaatcagcttacctcagctaactctccattcccaggaactaaccttcatgcctggtggccaatgtacaaattcctgactcagttctttggcaaattccttccacccatatttctcctattcacccatgtaccccaaaagtccctgaataagaatcatgtttttggggcagaatacaaaccactgccccaaaatggcttctttctccaaacagtcccagatgaaaggcacataattcatgtcttaaggctacttttccagcccctttaatactctgggatctatgtgtttcccacattccaagttatctttcacaagccttttaagaacaacatgcacaaaataaatggacaagaactacaaagttattctagccaatgatagtgtttatttgttaggtcctggggtctcaaggtcaaatgatccctctcaattattctgaggtcactgtcctcactagagtgggtacaacttgctcactgcaaaactgtgttcttcaaacatccctacttcttttcttttctttttttttttttttttagaagtagtctctatcgcccaggcgggaatgcagtggcgccatctcagctcactgcaaccttcgcctcccgggttcaagggattatcccgcctcaccatcccgagtggctgggatcacaagctcatgccaccacatccagctaatttttgtaatttttagtagagacagggtttcgccatgttgacctggctggtctcgaactcccgacctcaggtgatccgcccgcctcgacattcctatttctaaataattattacagatctgtcactcaccagttaaacatacaaacggcttttttggaggggatgacctatttatatttttaaatcttatatcctaccttattcaaaagtcctatcagttttcctagtttagagaagcaaagtgacatttttgtgtacatttaacaggactgcttaccttcacaacctgctcagtcggctttccctggacttctcctaaccgcccatttttcctggatttggcaccgagagttacagtatttcacgtgcgatgataaaatgttacttaggagaaacagttccaataccaagaaacttcagcaattttaaagcattttaaagccacaaaaccatgcccgatccccaaaagggggtcctaactcctttacactgtcagaatctcaattttaaaagggaggagtagagaagagatagaaacgctctctgttggtgaaaatctgtcttacttaccatttccccaacacaggagagactaaggaatttcaggtaaaaatcagatggctccaatcctccgatactaagagcccatcgccccagttcccaggagttccgccagttagactttttcccccatggcctcgctaaggctagttcctcgtcacgtgacgtgacaggcttggtcacgtgacataccagctccttccattcccgtgtgcggggggagggggaccaacaaaccggaggccctcgctcttccaatactcacgccctagctacagaggtcaaggaaggtttccccaggagcagttttggtttcagacggcgccgtctcccgcgaaagtcctgagaggagcccagccttttccgcctgccgcccccggatgggatggttgaggccggggccacgccccctctgcccccctgcgagggcatcctgggctttctcccaccgctttccgagcccgcttgcacctcggcgatccccgactcccttctttatggcgtcgctcctgtgctgtgggccgaagctggccgcctgcggcatcgtcctcagcgcctggggagtgatcatgttggtgaggggactccccggcaaggatcggagagggcctgaggggctccgggctgggagggctgggaggcgaggaaactctgggccgcaggcaggccggaggggccggggatctacaggccccggagaaggagacagactgaaattgaaaaatgggaactgttcgagaccagcctgaccaacatggtgaaaccccgtctccaataaaaatacaaaaattagccgggcgtggtggcgcccgcctgtaatcccagctactcaggaggctgaggcaggagaatcgcttgaatccgggaggcggagggtgcagtgagccgagatcgcgccactgcactccagcctgggtgacagagcgagactccgtccccaaagaaaaagaaaaaagggaactggagcggagggccctggagtgggaggagccagggctggtaaaggtggagacccctcaaggtaggagaaacaagagcggggtgcctgagaggtgcttgagttgaatggaggacatgggaggaaaagagagtgcttgttccagaaatgtgtagctgggccttgttttcccagtaatccacccaccgccacttcaagaagaaatgatatgaagaagtgccggttctccctcccctcttccgcactgtcccgtgatgatgacgcctccagagaggacgataatctgggttcctgggagagatggcttggtcactattcccacccttgcctcgaccacttgtctcaatgtcaccacctcacgccctgttccaggtggctgagtccgaatccagtaaccaccacctcgttttggttaatctcaggctcgggtgttgtagcaacattggaaatgggaggggtttacgaagtgaacatgaggtcaggtgcctgaattcaacagtctacccattccccttttccagataatgctcggaatatttttcaatgtccattccgctgtgttgattgaggacgttcccttcacggagaaagattttgagtaagtattcgggtgggggaggcgggctgggagcaggtgggaggtggcgaggcctagggtcagaattacgtctgggaggcccggtgcttagggcccctaggttagaggacttggagaggagagcggctttcttgagaatgtggttaggagccagggagtcagacctcagcggccatcccaaacccaccaccttaggtgtgacctctttaggtattttacttttctgtgcttctcagtccacctctgcaaaatggctatgacagatctcaccccataggatggtcaagaagattgaataaagtaatacacgtaacagcgcctaaacaggtgtcgggcacatagtgctcagaaaatgttggctcctattaaagtttgacccctttgcttcattcccacccccaggaatggcccccagaacatatacaacctttacgagcaagtcagctacaactgtttcatcgctgcaggcctttacctcctcctcggaggcttctctttctgccaagttcggctcaataagcgcaaggaatacatggtgcgctagggccccggcgcgtttccccgctccagcccctcctctatttaaagactccctgcaccgtgtcacccaggtcgcgtcccacccttgccggcgccctctgcgggactgggtttcccgggcgagagactgaatcccttctcccatctctggcatccggcccccgtggagagggctgaggctggggggctgttccgtttctccacccttcgctgtgtcccgtatctcaataaagagaatctgctctcttcagccctgtgtctgtgcttgagtgggggcgagcacggggctgagactagaggtcggcctctgcctggaaagtcccgatgtctgagcggaagtggagcgaagtgtggcgcggaagtgaggcgaaggctttccccatcgactgggcgcgccgagcggtctaagcgactgcgtctgatggggcggggagccgccgggttgagcctatccgctgcggggagggcgggacttcctgcgcgggggcccgagccgctcagtctccctgctctccgtggtcccggctcgcgtgtagcggcggcggcggcgtctccgtgaggaggcgcgcggggccatgacgtcagcgtccacaaaggttcgacctccctcgcggacagcgctccctggcggccacgggagggcgggccccccacttggctcgcggctcttccgccccgggcggggggcgggcgggagccgagcctggggtggggctaggggctccgggcgggacggggagggcgggcgccggccccccgtgacgctgccccgcccccaggtcggagagatcttctcggcggccggcgccgccttcacgaagctcggggagctgacgatgcagctgcatcccgtggccgactcttctcctgcggggtacgtgagcccggactgggacgtggacgctgagagcgggcgcttggactcggtcacagacacggaccctctctagcacagggacagacattagtttccctttgtgcgtggcacagcacagagtcggtgttaataaatgatcgttgggtgagggaatgaatgacagataaaaatacagacaggcccatagcccagactcctgtttcacagttctccctgctgcgaacgggtcgaccacaaaccaccgccactcccaaccaccccagttcatggaattcccccagacggctgcaggctgtgttggtgggtctgttttgaaaagcccttcctggcgagttggtttcagtgtgctgtgtacagcagccgtttaacgttgatggtggaaaggggtgtctaaggtggaggtggttgtgatttcttgtgattggggtcctcccggttcccgcagggcctcaagagctttccgcctccccttacggaggacctctttatgcatccgtggaaggggtcccagaaatcggaaggaggcggctggttggctgtgggatgcatagcctgtgggcgggctccacaccccccctcccatttttgctatcccccctctccccttctgacagtgcgaagtggacggagacggaaatagagatgctgagggctgctgtgaagcgatttggggacgatcttaatcacatcagctgtgtcatcaaggaacggacagtgtgagggagggtggctgccagaaaagggcgggtgggcagccttcttcctccttacccaaggttccatcgtcctcagaactcctttccagctcagctgcttccctactttgtcactagttttttagaatccccttgaggactgaaagaatagaattgtcacagttggtcagaagttcctaaaatgctgtggtaatccttccaagaatgtgaatttaggttgcctgagatgctgttattgtatttgatgatggaagtcccctggttatttatataaatgtttgaggaccccactgcagtgtttccagggatatggtgaccctgaactagttgatcagtaaatctcaatccacctgtaaatcaccaagctctacctgatgtctctcccagaagagaattaggagatgggcctttcccactactcagttcagggactccactctccacactccatccatcctgagtgagtgtaaaacttcgagaaagtgagaaccctaccaatgggttggggccccgacctggattcttatgaagggactcccagaaccccttcccctcccgtcccctcttctgttagtctctctgatgactcctttcctaacctcttctctcttttcttcagggcccagataaaggccactgtgaaacgcaaggtatatgaagattctggcatcccccttccagctgagtcacccaagaaagggcccaagaaggtggcatctggtgtcttgtcacctcctccagctgcccctcctcccagcagctccagtgtccctgaggccgggggtccccccataaagaaacagaaggctggtgagggctgtggagttgctgcctaggggttaaaggtcccatctgaggtttagtgagagaattgggcctgggtcaaagaagggtcagtctctcttcctgtccctgtggaggttcccagagaggggcagaggggaggggagaggaggcacaaagctttgggaagcttggggctgggggagaggctgtcaggggaacctagaacctagcttatgcccccttcccagatgtgacactcagtgctctgaacgactccgatgccaacagtgacgtggtggatattgaagggctaggagaaactcctccagctaagaaactcaacttcgaccagggtaggagtcctcctcctcccacacagctgacggggttggggagaaagggctcacctggatggcagggcacggtctccgcaggggcccctcccttgtataggggtttcagaagagaaggtgctctcatacacagcgcagggcattggatcagtacgtagcagggtgtttcagggaggtgggagtggccttggaagcacactgggggctcgctccatctcggcccattttacttcctgttccagacagcctgaccctggattctggccttctcatgacctctgctgatcctcctctcctctcctgctgagccttccacctctgacctctcactgttcatgccggacctgtggatctcctgggactccgagcaaggcctgcacgagagagggctgaaaggctgctggggctgccacctcgctattcccgcataagcatctgcccccaacccctttgaccttcatctgatggacatttttatacagaaaacaataaagatttccctctcagcttcgtgctgtctgcttaacattattagcaggagaggcctgttccctcttctctcctcggcccatgggggctcagcccctcctcggtagttttcaccaccctgcctggagcagcacagccaatattggcagactcgcttccctgtgccaatatttctgtgctgctagagccagggaagctgggtgtgggcaacaaagactccactttgttctcttgaggcagaacttactcccagggtctctggccatcagtattcttgaaactgccctggagattttagaggggtgcttacataccccaccctctccttgcccacctggcaagaagtttgtcacaaggccccagatgttttttgtgtcacttctccaggatggcctcccagggccaagcctcggcggtgcctcccccaccctcgctctaacaccacagtgtggtttggacgtggccacagtgccgtacaaaccacagtgtgctgctggggcgggagcaggaccggggtgggttgaaaggaagagagcacatagcagtgctgggaagaccccagcaccacctccaggagcggggggatagagaagccttaaaaggcaaacatggcccccaaaaacgtttgggaggaaccagggacgggctgagcaggcaactggaaggcgacggaccatggggatgagctcacagtgtagtaagattggaccatcttccctctgtaggaactcagctcaggggatccctagggtggggtcagaggcagaagaaatagggaatgactggaggggccaacacactgcctcctgtctcagcaagggcagggacccaaggcttcctgtgtccgtccttcctctccctgggtcagaacccaagagaaaagcaaggagagacagagggccaaggccagcagggttgggagttggcagtccagaggtggtggggccggaacatggttgggagaggggggccggaagtcgccctgggccctgggcctgccacaagatggaggccaaaggcaggaaatggagaccagggggaaggggagcagcagagcccaggaagagggccatctggacctggggggccaggtattcaacccccagtgctgttcccactccccagggcccctgaggacccgagccggcccccacagcaacctccatcagcccatccaccaggccagggcaggcgggcccaccccagagagccacgtttaagctgagacaaacatgcctctccccacccccaactccaggccttccctcagcccttttctcctgtccaggacttgattttttaaaaacacccctcagaaagcaaaatccaagggccaaaactccttttgcaaatcaaaatatgaccccctaaaatccagaagttatcttcctatatcccatcgcatcttttaccaccccctcttccgacacaccccccaaaactcttagcaatctgaaagatccaaggtggtgtatgtaagcagtctttttaggcccccgaagatgccagacccctcccggacacccctatctgccctccatcaaatcttgccaaggcctcctgctcctccaccaccctccatagcccccaaactaacagttgcccccagctcctacctcggcagagcctttgtggggggtgaaagagaaattaaacactatcctaacggctggggatgttggggggctctctggtctcagcctttggtttccgtctggggggctgcagtttaggggtataagagaaagcctctccaatcatccccccaattccaagactgacaaagccaaccccaccccagcacgcacctccaaacctcccccccaaccgccacgtctctcctgaaaacagaggacacttccctccccacttacctcagctactctcccctgagatcctggtcccctattttgaaaagagcaaaatttagggtgcatccctcacatttggggtgcaggagaaaggagccgccccagtcgcatcgctggcctccttcctctcggctggctcagggactggggagtgccctggggagggggcacccccacaagagatctcaggaggggttcctccactcccagtcagaattggggacacccccccaaaacccgtcccagcccatccgtctccaactcggcgggagaggcagctgcaatgccccagtcagattcacccaacactacattcctcaccccatctagaggggtcccggggtccccaaaaaatcccaaaaaaatctaggatgttgggaggacggtcctggactagctccccaaatttggggtcctcagatacccccgttttttcaggaaaattccgtcttttgcctgcctcccgccagccctgctctgtcccgatgccaattttggaagtcactccctccttcctcctccccgtctctccaggccccccccaccgctcgggggctagggtccaggacacctggcttccagaccggggggaatcactcctcaaagggctaggggccaggaggtcaagctcattgcccctgtcttaaggaagcaggaaagcccgttcctcccttcccctcccccctggctggtcaccgtggtggtttaggaaagcctggaggattggaatctgccattgctgttgcacaggcagttttttttcttgggttgggggggtgggcggtgggagggagagaggggaggagggccgaagagagaagggacccaggcgcgaagagctggcctggcttaccctgtagccccggctgccgtggggaacccctccccgccatctcacccacactcccagtcctctgtctgctttctgtttggggctcatcctagaaaatcagggtgcaagaatcacctccttgtaccccaccagcacccctccttgccacagttccaacagcactgccctggtcaggggtgcccacttggccaagggacaccccatttttctccaacttcccccaaactaaggggtgctcccttaagaaattgggattcagagtctgaaaccgccttttctccctctcttctccctcaagccacataataataaaaggagataccacaccctttccaagtttctcccttcaaatcctgggcttatttgggggttcactaaagaaacttctagaatctggggtgagagggcactataagcaaaagacatcccaaaccagggtccaaattaagtgaactcccaaatcagtctcaccttatgattatcccttagcttcaccaaaagcagccagagtgacaaaacacccccaaaataagaacaccccagaactttagtctcctgtcctcgcggccctcaccttgtttctcccctggggaaaaagcttcttgggtatccatggatacacaggaataccccacgtctttccactttgtggaacgtgagtgtccacaagactcaaatataaaagtttgctcccccctcccaggacccccaatcacagaaagcttcgaacttgctcccagcttcctataatgttccacctcaaactaatttttaaaactccaaattgaacttattccccaaatctaatctgagccttgaaacttagatggcaccccaaaatagactgcacccccaaatcagcatgagtactttggttctgctgatagtccaagatgacacaggtgagcacaatctccaaattgtgggtgtcagaacccccagaactaatgtaacttccaagtcagccccatacctgaaacttaccatataggcctcaaaggctgaatgcagccaccggtgctcacaatcaaatcaacaccccataataaacagacaccccacaactgatcaaataatactccatcctgatgccaaagggagagcccctagtctaattctcatctccaagctgggcagagacctaaataaccctcacatgtcaaagccacctcatcgtcctgaatttcccagttcccggtttctcagctgttctttcatgcattcaaataaagacacactccggtctgaaggggagggccccgggcctgatatccagccccgtggaccatggtcggccattcctggccaactgtacactctccccagcccaaatccggggagcttctgccttgcagctggattcagctctagcaccccttctccaaatgagctttgccttgcctgcccgcaatgtctcccgaaacaaaatatgagggtgtgatccatgcccatctctcagatcagggacttcaaattagggtggttaagccccctcctgccctctctccctcctccttgttttcccttctcgtttaccccacccaattttaatgttcaattaaaagtcacctccaaagacatctgggtagcagtgtctagcttaattcgaaaagaaaacccggagttcccaggctcaggtcccgcttcttgtcccacccattcccctggctcctaaagcccgcgatttctcacctcgggtaggaaccccagcctgaggggaaagtcccctcggtctcctaactctagctccctccgcccagccctagtcccctcctaggagacagaggtgcaaaataaacccgcgcaaaggggaggaggctaaaggtttcagccgcccagaccaaatggatcctgcgcccgggtctgagcgcaccccaggccgggtggagacgaggggcgaggcgaggccagtgctcggccgccccctcgtggaaggagccgcacattgccgagccttgcctacttgccgcgctggaccccggcgtcccgccagcctccaagcgtagccgacgggcgggtgcccgaggccctcgtgagctgggattgggggaaagcaagcgggctttgggcgggagtccatctctctggatccctacaaggacccagaagagagtcgggagcgagagaggccggacgcctaggtctcccgagcgtctctcgcccctccacccccacctcggggctttccccacctcctcgaggggaagcagctggcggagccgtccggtcgcaggacaatggaaggaaaccaactagaaatcatatccgccctctccgtaccccgcccggccagagcccccctttttgtaggcccgggtagagtagcctgtcattcacaccacaccctccccgtctgagaccctacgggagcccactgtcgtctgcccaaacctgctgtctcgttgggctcccccttttctcccttaacacagtacaagagagggagagggggttgccgtatgcactttgtcctgcagcaaaggttggctcctggcaaaccctcccaaaagccaacacaccaattttcactggcccaggccttccgacgactcagactcccgtattgccaacctcgatatccctaacctcctccccaattccaatatccccgtcctcgtgtccacttgcagtgacccaagaccccctacgttacgaccaccccttgtttctgaggtcccgccctcgagacggagaccccgccctggactcgccatctggagagcgagggaggaaggaaggatacagacccaggcgttcaccccacctccacccccgcccccgacatcccggccagataaaggagccgaggccaagaggggagagagaccccgccccccttaagaagagaagccgcggcccc

SEQ ID NO: 1348 - DNA, 21548 bp, Homo sapiens
gagatggagtcttgctctgttgcccaggctggagtgcattggcacaatctcactgcaacctctgcctcctgggttcaagcaattctcctgccttagcctcctgaatagctgggactacaggtgagcaccaccactccctgctaatttttgtatttttagtagagacggggtttcgccatgttggccaggctggtcttgaactcctgacctcaggtcatccacctaccttggcctcccaaagtgctgggattacaggtgtgagccactgcacctagcccagaatgttttatttttcttattatgggttgtatttttctgttgcatgcctggtaatttttgattggatgccagccattgtgaattttactttgtagattattttcatatccctaaaacagtttgaactttcttctggagtatgattaagttatttggacacagtttgaatgtttttgggtctctcttttaagctttgttaggttattctagagcatttagtcgagggttaatttttcccgctattgaagcaagacctttcttagtactctaactggtgccttgtgaattaggatcttttccactcttgctgacgggatcaggaatcattcaccatcctgtgtgagctttgagtattgttttctttaatcctttctgatggttctttgccaagcctttggttatttcctctcatgcatgtactaatcattatttagcttaatacttcaggagaatggtcagcagatctctggagttctctctgtgtcactctgtcctctctagtattctaccctgtgaactctagttgccttgggctctcaggactcccacttatatctcctcacctcacagagtcttctgggttccctctccccatgccaaagcctttcttcaggcagcaagttggagcaattgtattgctcaccttgtttgcattccatctctcatggattactatccttcactgcctatgtccaatgccttcagggccattgtttcatatattttgcccatttaaaaaaagtatttggaagtttataattactttctacttaaatttactagctgtcacaatcattactgaagaaattcactcttgcaataatatacatatgtacttcatttgacacagaatttcaacatgtaaagcatataagaatttcttgccacaatcatgtttagaatgcttacctataaggtgaatattaaaatattagtaaatacaatgacttttttcagattagacatgataaataacctgcaaggttacttgaccattggtcacacagaatttcagagagatcagaaccagtgtcaaaataggtatttgtctttttggctttttaaaggtcaaggttgaatcaagggtaaacgaaaatattgcatgaacatgaagctaaaattgaattttatgtaacacaacaacagcactgggtaaatagagataggtggatagactgtctcagtttctttttaataatttttatttttttaatcgaagctttacacataatttaaaaactcaaaggtaacaaaacctaatatgaaaaaagcccaccatgatgaagcagctgttctgcaggtgttttgccctcattctgtgtgtctactttcaattccaaatgggcttatatgaccaaagagatgcaggatctaaccaacatgtaccaacaggaaccatgagcatgtgtatggaactgggtcctgagagtgctggacaagaattaagtttgtgtttatataggacagcagtacccatttatagtattggcttagggttatgttaactcttccacactgcgtcataatccgaagagatctagaccatctaaacatcccacataatgtcacaatgacctaccacattgatgacatcatgctagctggataaggtgaataataagcagctagcatactgtacactggaggatgggaaataatccttaagacccagcaagctgttacctcagtgaaacttttagggcccagtaggctgcttgaatgccaagatatccccttcacagtaaaggacaaattattgcatctcacccactcatttcaccaaaattattctgccaccagggaagcacaccaagctgtgtaggcttctgtgggaattcagaagttggcagtactgttctgactcgtaaactgggtgagatagaaatctgccagttttcagtgggatccatagcatgtaaaagttctctagcaggtatggtgtatttagccctgttgcatggaccaattcaggatattctatgggacaagagtaaatgtgataagaagccatgaaagttgaaggcaagctccaatgggagaatcacaaggtcgactcctggcattctgtggcaaggctgggccatctgcagtgcaaaatcccaaaaacaactctatccatgctaatgtgccttggtaagaactgattatggacatcaagtgaccatgtagccagagaggcccatcatgagctgggcaaaggcaggtggtcaggctcccatgtcatatctgattctttaccaatgtcccttcctcagctcacaattatggccacttgggaggctctcatgtctagcttatggaggacaaaaaagcctgagctgaattcactgaggtttcttggaatataggttcaaaacaaaaatggactgctactgccctacagccccacacaggactggccttaaaagacagcagtaaggagaaccctcccaaaaggcataatgtggggcagtattcctggtcatcaactgtgtgtggaaagaaagtgtcttgaactaagaacatattttcatggcaaataagttggctagttgatcaggggtctggaataagactggtatatcagggacaagaagtctggagaagcagaggagaaatatatcagatatggcacataaggagggctttttgtattgtataacacaatctttatctgccagagacaatccaacatgtaagcagcattaaataaccaagtagacagatttagccagtaaacttcagcagctacaaccatcggctccaccgccccctccctccgcccccaggaatggcacagggggcttatgacaaagtagtcatcttgcaggaatgcaagtgagcaagaagccaatagatagcctccacttatccaatagccactccccaggctgggcgcggtggctcctgtctgtaatcccagcactttgggaggctgaggtgggcggatcacctgaggtctggagtttgagaccagcctgaccaacatggagaaaccccgtctctactaaaaatacaaaattagctggccgtggtggcgcatgcctgtaatcccagctactcacgaggctgaggcaggagaatcccttgaacccaggaggcagaggttgcagtgagccgagatggcgccacggcactccagcctgggcaaccagtgaaactccgtctcaaacaaaacaaaacaacaacaacaacaacaacaaaatagccactccccagtgttaaacaccaagttcctgatacagcaccaaccctcaaggataccaaacagctacttgggcagcaaattgatttatgttggattccttccatcctagaatgggcagtgattctccttgactagaaactgcccatctgcatgtatgagtttgacttccttgcctataagttgttggccagctctactactcacaggtttacaggtatttgatccatcaacatgtatcctgtgtaatattgcctttgatttagggatgcactttacagcaaaggaggtgtatcagcaggtacataaccatgagatccactagtcctatcacatactatataaccgagaaaatgcgggtctgatggaatgatgaaaaacccttttgaaggtgaaactgaagcaaaagcttgaagataatagcctgtgaaaatggaatgaccttgtccaccagggtacagtatatactctaaatcaacactcattttatggtgctgtgtctcatatatacataacatgcatgtttgggaatgaaaggatataaatagaattcctactgtgtagtaggctgaataatggcccccaaatatgttcagatcctaatcctggattctatgaatattttaccttcaagataaaagagactttgtggatatgactaagttaatgatctcaagatacagagattatcctggactatccaataggcccaatataatcataaagattcttacaagagagaggcagatttgcctagtagatgcaatgacttaagcaggaggatggggtgatatgagtaaggggccatgagccaagaaatgtaggtagcctctagaaattgaaaaaggcaaggaaacagactttttcttgaagacttcaggaaaaacagtccagttgatatcttgattttaggcttccagaactgtaagaaaataaatttgtgttgtttgaaaccactaagttcgtagtgtcatagcagtgataggaaattaatataaccacatactctcactcccagtgacccaagtggggagtttggacttctcatccccgcaactttgtgaattagaagtcctgattcccaagagaggaaccttttcatcaagagacacaataatagatcctttaaactttaacttgctgaggtttcccggttcaaggtccttgtgctaggagaccagcaggcaaggaagagtcaccatgttagttggggtaaatgaatccaatcatcaggaggaaatagcgttattgctacacgatgatggcaggaaggaatatacctgtagtttacactcaagaccatatagtggtctcttgatatgtcccaatatcaagtaaagtggacaacttccaaaacagcagggtaaacatctccaaatactggcttctctataaaagcaatgagaacacaggcaaaaatggtcagtcaactttttcagaactctagaaagtaactaaaagcttgaaataatctgaggtgcctctatttgagaaaaacagctaaatcttggtaaacagggaagcattttaacttgccttattcccagcccccacctcttaatacaatgataaatagtaatggtgacagtgagcaaccttcttactcttaactttagggagaatgcttccagcatgtttcaccattaagtgatatgctgtcctttgttaagcagtatccagagtcctattatattgttggcttatcatgtttcccactgcactctagtgtcacttttctaatgaatcaagtgaccctatatgtgtggagtttttctagactttctgttctgttctgttccatgggtcagtttttctatccatgcaccaatactatctcgtcttcattactatagcttagaataggtcctgatgtctcacagtataaatccttcaactttgttttttaagactgccttaggtattcttgaccttttccagtttcttaggaattttaaaattggctttttgatttttggaaaaaagaacctgctgagatttttttttaattgagattacatagaatatataggtcaacatctttacaatactgaatcttccatcttgaagttttattatatccagttgggtgtaactgtgaaatgagaagcaattatcagaaacccggattacaggatcccacctaaggtgaaaggtcctatacttcccatcagtgggatactatagccatcttctctgggctctctgctttgacagatgttttcaacttaagtattacctgtattcttcctctcagcagtatctcagtcctcagattatgcttgaccgtcaccgaagatgaacatattttatcattcactcatattctaatgtaaattaagtcctacttatttcatacaataattcgaactaatatcttcacagcactcctgagtcataaatggagtcactgcaaagtgctgtgcactgcaaagtgctgtgtgtagtaacaggggttccaatgagtgtatctcctacaattggtttactacatgctatactaggtatttaagatgtattgctttaattcttgtaaaaaagcaagagaacatacttgcagaggatcagatcttaggctctggaatcagaaaaatatgaatcagaaacctggctctgccactactattgactgattagttctgtgtccttggacaagtttggtgagggctaaattggatagtgcatgtcatgtatttcatatcttatgtggcaatattcttttccccaaatgatactaaagattagacagcttaaatactttgcctcaagacacagaactagaaagaggcagaagagggctagcatactgccaagcacatagaaagtattcagtaaatgtctgctgaatgaacaaaccacagtcagtatatactcaacatttacttcaaataccactatattctctgttgtttcctttaacttatgcaacaaacttaaaatattttttatttccataggtttttggggaacaggtagtatttggtttcacaggtaagttctttagtggtgatttgtgagattttggtctacccatcacccaagcagtatacactgaacccaatttgtagtcttttatcccttaccctcttcccaccctttccccgagtccccaaattctatcatgtcattcttatgcctttgcattttcatagcttagctcccacttatgagaacatatgatatttggttttccattcctgagttacttcacctagaataatagtctcctatctcattcaggtcgctgcgaatgccattaattcattcctttttatggctgagtagtattctgtcatatatttataccacagtttctttatccactcattgattgataggcatttgggttggttccacatttttgcaattacgaagtgtgctgctataaacatgcatgtccaagtatctttttcatgtaatgacttcttttcctctgggtagataacccagtagtgggaatcctggatcaaatggtaattctagttttagttctttaaggagtctccacactgttttccatagtggttgtactagtttacattcccacttctacatacacagcagtgtagaagtagcaaaaacaaactcttactatttatttggcatctacaaaaccagaaaattcaaatagaattttgatgggcacatctgaatttactttaatgagaagagaaaaaccataaagtaatttaggataagagatcaattgcagtaattcccagggtctgagaaaaagttatggcatatattttcaccatcaatcctacttgctttggttggaatgtgtcccccaaattgcatgcattggaaacttaatccccaatatggcagtactgaaaggtggggcctttaagaagtgattgggtcatgagggctggtgatccattcatggactaatgggttgatagattaatgggttactataagagtgggattggtggctttttttttttttttttttttttgagacagactcttgctctgttgcccaggctggagtgcagtggtgtgatctcggcttactgcaacctctgcctccctggttcaagcgattctcctgcctcagcctcccaccacgccaggctaattttttgtatttttagtagagatggggtttcaccacgttggccaggcttgtctcaaactcctgaccttaggtgatccacccacctcggcctcccaaagtgctgggattacaggcgtgagccaccgtgcctggcctgggactggtggcttcataaaaagaggaagaaaggcctgagtgggcatgctcagcccccctgatccctgcagtccccaccagcaacaagattctccccagatgtggtccctccaccttgaaattctcagcctcctccctaactgccagaaatgaattccttttctttataaattacccagtttcaggcattctgttataaaccacagaatacagactaggacactacccttcctaccagtatccctatcttccacttgaagaaaatacatattagtagaagtggggagtgaaggggttaaatccaagtgcatgtttcctactgcctcctcccactacagaagctagggtgcagatacatgatccaataagcttgaccaattggatggtgatgtaatttggatctcccctgcaaatctcatgttgagatgtaattcccagttagaggtagggcctggtggtgtttgggtcatggggactgatccctgatggcttggtgttgtcctcaccatagtgagttctcatgagatctgattgtttaaaagtgtgtgacacctatccccaccccctcgctcctgtttttgccatgtgaagtgcctgatcctacttcaccttccaccatgagcaaaagcttcctgaggcctccccagaagcagatgcaggcactaggtttcctgtacagcctgtagaaccgtgagccaattaaacttcttttcttataaattactcagcctcaggtacttatagcaatgcaagaatggcctaatataggtggtctctcctgggacttgaaatcttgaggaataatgaaaataaccccttaataaattccctttttgcttaagataacccagaagaatcagtttctgttgtaggaaacaaagacttcattaatgcaaatgtcaagagaaaattcaaactagtttttacacatcctacctgtaaaagttttgaaagctactaaaaggctttctgagctgttaaatctgaaggatttataacagattgttattttcaaacacgagtattctatgtatacagtttgtgtgtgtgtgtattcacacacacacacacacacactcatgaaccacactgtgcagactcaatataaatgtacacctgagttgtgcaacattcaaatcaatgcagaaatcaagcaaagattagattcagtgaattgtagctatttcttggaaacattaccttttttttgagacagggtctcactctgtcacccaggctagagtacagtggcgtgatcttggctcactgcaacctctgctacccaggctcaaggcaggctcaagtgatcctcccacctcagcctcctgagcagctggtaccacaggcctatgccaccatgcccagctatttttttttcccccaagacagagtctcactctgtcacccaggctgcagtgcagtggcgccatcctggctcactgcaacctccgcctctcgggtttaagcaattctcctgcctcagcctcccaagtagttgggattacaggtgcccaccatcacacccggctaatttttgtatatttaatagacatgggggttttaccatgtcggccaggctgatctcgaactcctgaccttgtgatccgcccgcctcggcctctcaaagtgctggaattacaggtgtgagccaccgcgcccagcccacatccagctatttttacaatttttttgtaaagatatagttttgccttgttggacaggctcgtcttgaacttctggctcaagcaatccaccctccttggcctcccaaagtgccgggatttcaggcataagccaccacacccagctggaaacatcttttatcttaaaaattcctaagcatcctataaattacctcattactataaatttaattttaacgtagtattttaacacagttgccaggacctcattcaaaccttcattttatagatggagaaagagagctcacacaggggtgtccaagggagataatacagtcatgggttcttagtttccgcttctggttgggtcagtaaatacctcctcatctctcttttccgcttatcactagaaacagaaactaaaaaccatggcttcaggctgttaacagcctaaaacaaaacagaacaacaacagtaacaaaataaggtgggttggacaagtttggcagagagcctgcttggagaagctgtgtgaaaaaaaaaaaagactgccaccgctcctgaaagttctcggcccaagatggaatttagtcaaagaaactcttacactaataaaatttgtacatcaaattaagatcagggacagttaaaacattaataaagactgaagcatttgttcatttaaaaaattttatttaatatttacatttatttttaaaataaaaattagaggaaagcccatgaactcattttccatgaacataatataatagtactcacctatctcctctacccaacttgtgttttagatgagtccttttggatctttttccccataatggcctctctccttttgctttacagtgcaatcagggcagaataacagatatgttgagtagctaatttatatttctgaagatctccatagaactcttaagttctaagtcttcatagtctttgcaccttgccaagtttgctttcctttgggaattctgtcataaccacaaggttattccccagacatgcagtttggggaaattaacccggcagtagtaaacagactggattagaaaaggtggcagtcgtaataaggatattccaataaccggggaaagctacagaaggatcttgagttaggatgatgacagttacaatagaaaggagaccagtacaagagacggtgaaaacagaatggatacaatttagttgaagaattggctgtgggtgaaaagaagaaatcaaagatgcctgaagttgtgagtttcaggtagccctgagtttataatcctagttctgactcgtactatctttggatatactagctgctgactactaactgaacaaggtagtaaccttgtcatcttgtaacttacctaagtctgtttcctcctctataaaacaaactatcaaaataaagccgatgaaaagattgaagtaaaacataaaacccttagcacagtgcctagtatccattaagcagtagataaatgatggcggtcattattagggagtagggtaaagaacagaaggttaaaaacatgagtagcagtaaggacttttgggtggggattcggtctttctactacacattacacatacctctaagcagagaaaggggttggaggggagtttgataatgtgactaataatcctcctccccctgggggggatcttgataaaggatagccacccacatggaggcctaatataaactggattgcagaatgcacttgagctgggagcccaagcgggccaggcttcttgattcctattttatcccctttaacctaggatagctaggtctatagtgcagactcagacctaacttacactttcatttgcagctgaagtttcggaacaaagacaaagatagccagatcatattaattacacggataggcaagaaagcatgagccctgaggaggaaggaagggactgtccaggtgtacttacctcaaagatgagaaatatcaaagacaggaaaccctaggttcttgcccttcagtcgctatctccttgccattagtaaaatgcggccgatgaatgtcctcacttctgtccatctgggcaggaggtgggaagggtgacgtgcaaatggatgggaggaacccttttttcggcagcacccaccacacccagcctagtgccacgcaccgcaagcgctccataaacgcacacagcgtcgcctctaccaggatcccgggcggccttcgcgggatttctcctggcgtcggctttcagactcccgagggtgggataaatcgagagggtggcatcctttggcttttcttctcccaggcagctctgaaccatgtttatgcaacgtttaatgggctctaataaaacggctaataattttgatccgcggaagcaccgactcgctcgctaagccgaatctgcgagggtgaagctgcaactccaacgccggaaagcgcggctaccgaaaagcgcatgcgccacggggtggcacgaagctagagtaagctgaggaggtgggcggaaaccatggcaaccatgggtgatgacgacatggggagcgtctctagcgctggattatgacgctggattatgacgcaggcagtgggcgcggactctgcggttcgcttgactgacggcgcagcctccgggcctagccacagcagcaacggcagaggccagcgggcgaggtcaagatggtggctccgcgggcgggggaggcagtggagggaggaggagtcagaccttagccagccggaaacaccgaaacccagagacctcctggggagccgccgccgccgccctctcggccatcgctgcctccgccgcctgctccacctcgagggacgcgagcgggcggcggggctggccgtgagagagacaggagaggaaggagggcaggggcggagttgcccgccttagcccccgcccccggccgcggccccgggccctgccccgcgcggccctgcccggcccaccgagccctggtgtggcagcggctcatggcggccgtggggcccccgcagcagcaggtgcggatggcccatcagcaggtctgggcggcgctcgaagtggcgctccgggtgccctgcctttacatcatcgacgccatcttcaactcctacccggattccagccaaagccggttctgcatcgtgctccagatcttcctccggctctttggtaagggaacagggtaccgtacgtcccgggacggctatgcgggccgagacgttccccggggagcgggcaggcgcgcagaggccatgggtcgagtatgtgtctttgggaactacagtttcatccctcaaagggtcgtctttacgggttgggagggggaaggagatgatacttgtctgagttgacagcggagcagtccccctagcgaggattcagtgttgtacctgagtgaggtggggagaaagtaaggatgtgtgagcatgcagctctttgcccgtttgccttgggaaatgagtactggcttaccgcgtcctatgcgacagccttcgaaaaacaactctgctatcccagtctcgtcgtgtgtgaccttggacttctgccaaggcgtgggcctcagtttccctttattaccaaatgccgagtacttgtatgttgtcacttctgctgcacccgagggtccacaggatcgtgaagtgtctgcagtaaatgacatccaagcgaaggagacagggttttgaatgtcagaccttgaaaccattaccaaaaattctcatgaaagcggcgatgcttaaatcgagtcctaaaattttccatgaataaacgagaaggtattgaaagtgactgtaaaaagtgatgagacatttgccaaagagacttctgaaaatcattgtctttgtttcgtatggatggagtgttaaaagtatcttatatttcatttcttcctttccatcttcacttacatcatcagagggagatgcatttatgcgtaaaataattttttaagtaattgtaacttggcaaattttgttgatgaggtaattctggtgatcggtcttaagtaggctagtgcttttgaagtgttgctgagggcagactgatggtgaggtctttaccaagcctttctgaattacaagccatctgttgctttattccttcaaaagaggagtggcaataaaggccgaattttgttcttagcaataaatagccatattttacatttatctggtattttccttttgcaaagcattttcactggtaggtattatctaacctaaccttcaaacatcccccagaggtgggtggtggtattgtcattttacaaaccaggaaacagggtcatagaggttaagtgttttgctcttggtaggctgccgctaagtggttgccagagcctgagcttaaaaatcttttgacattaaatatggtttactttcctccctaacagctgcaatccagatacagaatgcagtagtaatgatcatatgctagatcttaaaactaaagatgtaaacgtgatgttcagcccaagctgcttcagtaacccacctgctacctaattccagcctttcctacttgccactgctaacgtataccaccaccataatttgtgttaaaaactgggctctgtttgagaggattctgcatgttcatcccagaaacagtgtagtgactgctttgaatattcttacagcatgataactgcagattctgtgagaatccctttgggacctggtgctttaatgcagtagtctgttgagcttcaggttaggcagcttcaaggaaaagaagtattttctttaattaaataatttgtagtgtaagaacattgaacaaagcaatctgatattttccttgtactaggcatgtttcttttgtaataaatcttggaagtttgtgtttgacaaagaacaacatgacttaaggcaactgctcagtgctttggtttcttatttttaccttttaaaagatggagagtgaggttatctgtttcatagggtgttaaagacaataaatctattttaatgcttcatttaataccatattttgttagatattttggtcttttgaaatcatcggcaaaatattggtgttgtttatttgaaaattttgatccctggaatctctggatcagactttgagaaatacgaaatactcttcaaatctatcatccgactcttcttactgtgtcatgtaattatgctaatttttcacatttgtaaggatgataagaatgaaaaaaactgatttcggtgctaaaaaattatgttactaaaagacacaggtttgtgtgtaaatatgccaatggatagttgaaattaatcgttctgccttgttagtttttttgtagttgtagacttctcagtactactgtgtataagtcttaccacttgtcaacctcacttttttctttaaaattaatgtgtaaaaatggaaatctctaagtaaaaagcattaccagttttatgtgtggtggtagaagtatttactcccctctacctacaaaatggtgctacaactgtaccttcatttgatatcaaactaatttgagatttcaaccggttagaaaataaagcaactcattttggagatccaaataaaattctatgacaatatatggaatattgaagaacataaagctgtgttttaagggatgttaaatactaaacgaaactcaacccagagcagcataatgctgagttagcaaatttaaatccaaggcagaaaatgcaagcctaggagtttgttttaatagtattactaatatggtgataattcattgaggtgggaaaaggctttaaacataacagaagacccagaagttccaaggaaaaatctgaaaaatttcagtacataaaaataaaaagcttttttatggcaaagcttaaaaaagaatccttaaatgacaaactgagataaaatacttctatcataagtgattcacgttccagtaagagttttaccctgccagggaagctgaggcaggagaatcgcttgaaccagggagttgcaggttgcagtgagccgagatcgctccactgcactccagcctggggatagagtgagactctgtctaaaaaaaaaaacaaaacaaaacaagaaaaaacttatactcccttaggaaaatgcctaagacaagcaattcacaataaacaaaatgcagatgttcaataagcaagagaaaaagtatttagcccttcctgcagtagcttgattttatgggggaaaaaaaaaagtacctagccttgtttataattaaatactgtcaagaccgcttacggtggctcacgcctataatcccagcactttgggaggctgaggcaggcagattgcttgaggccaggagtttgacaccagcttggccaaatggcacaacccgtgtctaccaaaaaattagccgggtgcagtgactcctgcccatagtcccagctactgtggaggctgaggcacgagaatctctcgaatcggggaggtggaggttgcagtgagccaagatcgcgccactgcactccagcctgggcgatagagcgagactgtctcaaaaaaaaaaaaaaagtcaaaaaaaatttatcagattggtgaagagttcaaagttttattagttttgcaaaggtatttacctttttgaaataggtaaatttatacaattttggaagacttttttttttttttgagacggagtttgctcttgttgcccaggccggagtgcaatggcgtgatctcggctcaccacaacttccacctcccaggttcgggcgattctccggcctcagcctcccgagtagctaggatgattacaggcaagcgccaccacccccggcaaatttttttctatttttagtagagacaggttttctccatgttggtcaggctgttctccaactcccgacctcaggtgatctgcccacatcgtcctcccagagtgctgggattacaggcgtgagccaccgtgcctggcccggaagactcttaatttcagtgtaaaaccatttggcagtatcaactgtcatttacaactgacttctcagtgttttgttttgtttttgagacagtctcactctgtcaccaaggctggagtgcagtggcgtgatctcagcacactgcaacctccacctcccaggttcaagcgattctcctgcctcagcctcccaagtagctgggatgcctggctcgtacaacttttgactcacaatttcaattctagggaattggcctagagagatagtttgcttaaggactatgggcaagcattactggaaataacaaagcaacaaacttaatctaaatatgtattgatacaaatctgttcattgtattaggtctagccatgcaataaagttcttgaaagaaatgagatagctatttttggtgccgaaaaagacttcagaaaacctctgaagtgaaaaaacaaagccgaagtaattatcactggcagaggaatagacagagatttctcaacagtggcagtattgacattttggacaggataattctttgtttgcggatgggagctctcctgtgcactgtaagatttttagcagcatcactatcccctgcccattagatgccagtagcaccttgcacccccacaccccagtgtgacagccaaaactgtccctggatattgccaaatcatggttgagaaccattgggatagacaaatagattagtacttagccttatttataattacatagcccagaaacagacaccaatgtatatatagaaataatgtgtttcagagatagaattgaagtacattgaggtaaatatggactgttgaattaatgatcattttgttacacctttggaaataaattatactagatgtctaccttatgtcaatatatagacagtcacttctaggttgagcagtgtagtgagaccctgtctctgcaaaaataaatatttaaaataatagccatacttggtggtgggtgcctgtagtcctatcttactcaggaggctggggtgagaagatcgcttgggcctaggagttcaaggctgcaagtgagctatgattgcataactgcactccagcctggctgggtgacagagcaagaccctgtctcttaaaaaaaaaaaatagtcatttctaagtgtattcttacctagatgtatatgtaaatatgaaatgcagaactttaaatttttagaaaaaaatatggaatattttatttttccaatcttagattaaggaagaaatccttaaaaatatataaaagcaaatacataatgaagattgataaaccgaatgatattgaggttaaaaacctatgttaatcaaaagatcgcaccactgcactccagcctgggcaacagagcgagactccatcactaaaaaaaaaaaaaaaaaaaaaaggaagtcaaatcttgggtaagggggaactactgtacttacatttacccatttattataaaggcaattacaaaggacacagatgaattaacccgatggaaggagatgtacaaggtgagacaaagaaggagagaagaggagaaggggcgtggagcttcagtgttcagctatctgagagctcacagaactcagtccttttgggcttctatggaagttcattaaataggcaagattgattagatcactagtcattggtttatggactcaagtttcagcttctttcttcccagaagtggcggctgggggtaggaatcaaagttataacccttaatcactgggctgattcccctggctacctagcccccatcctgaagctatctaggggcccccaggcaccagtcatctgattattgtacaaaacagtcatcactccagagattccaaggattttagaagctatgtcagaaaatgggacaaagaccaaatattaatattttttttatgatatcacagatgggaaagacaaactagaaaaacttgctttaactcttcatttaacacctctctgtagggtttggctttttaaaatccatgttcatatatttttgataaaagcatacttattataagtttagtttaaaagcaaaagtttaattttgtgttaatacttagaataccaggttttttttcaacctaaaatgagaatccaatagaaatgttttctttataatttatcaagtataccaacagattaacaacatttcaagacactttgttgtaaacttcattgcggaaggctcccttgggagtaaggtagtagtaacatttatttctgtgcttttccatatttattctgtcaggtattgaaatgtttttccacaggttgctttttgttttagaggtatttcgggtacttggagaattgtaaatattatgttttgtaccctgatttttagtcataagtttccaaaagagggtaagggtatgaatagactttacacataaaagagtgaaacactttgttatgtaacatgtatagtaagtttttattttttcttttgtttttatttgcctgtttttggtaatccaaattgaaaaggcctgaactctttcatgagttgagttcatatatagtttcaaagttcctgaattgatttggatacctgcctctttttggctaccttgaaaactctagtgaactctcttaatcactggagaattggactgagatctctgagttgtgatttcagtaaattctgttctcaaaattttttataaagcagcatttatatacagtcttgattacttgtgcaagtcacttccaaatcctaatgagaaactgtctctggacttttatattttcttagacctacagtttaaataccaagaaaggctttcatgtctaatgtaaaaatgcagtgaaactttgatattattctgcaaaggccatgagaaagatgattactttggagacttgttacttaggatattggtttttaaaatgagagcagattcttcccaaattccataggtaggaacgtgactataaaaggaaaatctatgaaccccatatacctacaaactttgggtaggaattaaaacaaacatatactattcttgaaatgttaactcactattacatcttggggggtgtgattttaatcaggatagagtattgtcagattgttacttgctgggatacatccaaattttgaggttgtagtcttactacattatttgtctatctgatgccttcccctttttttctttgatacatttgcataaagcaaaatggcactttttcactagaaatgtttctaaaacccaaataatttcttcatttgtgtgtagtaaaaacaagcttcaggaaaaaagttattagaattttaaaaattagttataaaattatggcaaagctcatgaatagttactgaagattaatttactactttgtgaatagcaagttgacaaaaataatttacagttcctgcttgactttctcccctctaagtggcataaagtagaactagagttattttgttttggttttgacccaacttagaagatttgttttaaagtttctgaagttttgtctcaggaaaataaggtggttttccatgtagagaatgtaagattacatatggcatctggtaggctgaattaattccattttcttgttaccttccatggaagaagtttctaataaaaaaatcttttcagggccgagcgcagtggctcacgcctataatcgcagtagtttgggaggccgaagcgggtggatcacctgaggtcaggagtttgagaccagcctgaccaacgtggaaaaaccctgtctctactgaaaatgcaaaattagctgggagtggtggtacatacctgtaatcccagcttcttgggaggctgaagcagaagaatcgcttgaacctgggaggcagaggttgcagtgagccaagatcacgccattgcactccagcctgggcaacaggagcgaaactccattaaaaaaaatataaaaaaaaatatatatatatataatatatatatattatttaaatatatatatatttaaaaatatatatattaaaaatatatatatatatttaaatatatatatatttaaaaatatatctattaaaaatatatatatattatttaaatatatatatatttaaaaatatatatattaaaaatatatatatttaaaagagcctgttctgagctcacaactctttgggggattattagtggcccattttcttggggaatcaggtggtttgtatttagaggtttatatgtcttctactttattgtgtccttttgttttccttttcacagatgacttgacattttggcacagaatacattttaaatccctggacagagtcatcacttaaatgaactagcccttgcttatatgtgcagtggattgtgaaatgcgtctactgtaataatatgcaatgtcttgattacctgctgaaataaggtggatagatggatttttattttatttaatatttatttatttatgtattttgagacagggtctcactgtcacccaggctggcatgcagtggtgcgatctcagctaactgcaatgcctcccgggttcaagcgattctcccacctcaaccccctgagtagctgggagtacaggcacgtgctaccaccctggcatatttttatatttttggtagagacagggtttcaccatgttgacatggtcttgaactcctggcctcaagtgatccacccgcctcagcctcccaaagtgctgggattaccattgtgagccaccacacccagccaagatggatttttaatttggagtttgtcactttttctgtactccagggtatggtttctcattgtctgaaacatagattttatttttcaagcaggctatattttgtggttgcctttaaaaacatccagatgtgacagacatttcctaatgaatactaattgtacttattttgtacaaaatattgtagaatccatagatggacagggtaggatctttgctttctgttatagatacatgtgtaatagggtagattatacttagataactgcagactacaatatcaggtgatatatgagtgttaaatgtttcactaagttctgcaggtatgctgaaagaacagtttctatcaaagaaagtaggtttctaggataggtaggatttgaatagtcagggattgggaggttggggacatcattccaagcaaaaagaatgtaaacactgctgtagctatagtggagaaaggaatgtgtttggggaatccaagtctggagcactgatgtgtgtgtgttaggaggaatattactgtaaagcaaattgggttcttgaatgccaggagcaagaatgtagattttagttgatagtaatttcagagccgctgaagtattttgagcagggaatgaagaaag

SEQ ID NO: 1349 - DNA, 25283 bp, Homo sapiens
aacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagaaccaaagacaaaatcacgattatctcaatagatgcagaaaaggcctttgacaaaattcaacaactctcaataaattagatattgatgggacgtatctcaaaatcataagagctatctatgacaaacccacagccagtatcataatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtacaaaaatcacaagcattcttatacaccaacaacaaacagagagccaaatcatgagtggactcccattcacaattgcttcaaagagaataaaatacctaggaatccaacttacaagggatgtgaaggacctcttcaagaagaactacaaaccactgctcaaggaaataaaagaggatacaaacaaatggaagaacattccatgctcatgggtaggaagaatcaatatcatgaaaatggccatactgcccaaggtaatttacagattcaatgccatccccatcaagctaccaatgactttcttcacagaattggaaaaaactactttaaagttcatatagaaccaaaaaagagcctgcatcaccaagtcaatcctaagccaaaagaacaaagctggaagcatcacactacctgacttcaaactatactacaaggctacagtaaccaaaacagcatggtactggtaccaaaacagagatatagatcaatggaacagaacagagccctcagaaataacgccgcatatctacaactatctgatctttgacaaacctgagaaaagcaatggggaaaggattccctatttaataaatggtgctgggaaaactggctagccatatgtagaaagctgaaactggatcccttccttacaccttatacaaaaatcaattcaagatggattaaagacttaaatgttagacctaaaaccataaaaactctagaagaaaacctaggcattaccatttaggacataggcatgggcaaggacttcatgtctaaaacaccaaacgcaatggcaaccaaagccaaaatcgacaaatgggatctaattaaactaaagagcttctgcacagcaaaagaaactaccatcagagtgaacaggcaacctacaaaatgggagaaaatttctgcaacctactcatctgacagagggctaatatccagaatctacaatgaactcaaacaaatttacaagaaaaaaacaaacaaccccatcaaaaagtgggcaaaggatatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcaattcctcagggatctagaactagaaataccatttgacccagccatcccattactgggtatatacccaaaggactataaatcatgcagctataaagacacatgcacatgtatgtttattgtggcattattcacaatagcaaagacttggaaccaacccaaatgtccaacaatgatagactggattaagaaaatgtggcacttatacaccatggaatactgtgcagccataaaaaatgatgagttcatgtcctttgtagggacatggatgaaactggaaatcatcattctcagtaaactatcacaagaacaaaaaaccaaacactgcatattctcactcacaggtgggggtggaacaatgagaacacatggacacaggaaggggaacatcacactctggggactgttgtggggtggggggagtggggagggatagcactgggagatatacctaatgctagatgacgagttagtgggtgcagcgcaccagcatggcacatgtatacatatgtaactaacctgcacattgtgcacatgtaccctaaaacttaaagtataataataataaattaaaaataataataataataacagtatactaataatggtaaatactacgacatttacgcaccaggcaccacactaagagctctgtgtatattaaatggtcctaatgagcctacaaaaagtgtaattatgattatccctattttacagatcagaaaactgaggcagagaggttaggaaacttgaccaacgacacatagctagtaagtggtagaactgggattcaaacctgagcagtcaggctccagagcccatgctctcaaccactccacgatattgtctcttggacatttgaactgagaaaataaggatgggtgggcatctgcaaggatggacggatggaagggtgggagggacagatggctaggtgggcgagatcatatgaaggtaaaaaaataggataggccaggcacagtggctcatgcctgcaatcccagaacttttgggaggccaagataagtggatcacctgaggtcaggagttcaagagcagcctggccaacatggtgaaacactgtctctacttaaaaaaaaaaaaaaaaagaaaaaaattagccaggtgtggtggcacctgcctgtagtggcaccccgctactcaggaggctgaggcataaggatcacttgaacccaggaggcggaggttgcagtaagctgagattgcaccacagcactccagcctgagcaacagagtgagactccgtctcaaaaaataaaaaatgaaaacaacaggatggagaccgtgatgggctgaattgtgtttccccaaaattcctatatgaaagccctaaccaccagcacctcagaatatgactgcgtttgtaaagaaggtctttagagaggtgattagtttaaatgaggacattagggtgggccctaatccagtatgaccagggtcctcatgacaagaggaagagataccagggctacaagcaggggaaaggccgtgtcaagacacagccaggaagtggccgtctgcacaccaagaagtgaggcctcaggggaaaccagacctgtagacaccttgagctcggactgacagcctccagagctgggagaaactaaacttctgctgtttaaatccccctagtctacggaagtttgctatggcagctgtagcaaactaagacagagaatgcatgaattaacaaaaggggatggaaggggtggatgcacctgtggataaatggacaggtggtcaatccactgataaaaggctaaaccagctaggcgtggtggctcacacctataatcccagcactttggtaggcccaggtgggcggatcacttgaggtcaggagttcaagaccagcctggctaacatggagaaaccccgtctttactaaaaatacaaaatcagctgggcgtggtggcacgtgtctgtaatcccagctactcaggaggctgagacaggagaatcacttgaacccaggaggcggaggttgcagtgagccaggatggtggcactgtactccagcctgggcaacagagtgagactctgtctcaaagaaagactaaaccgatggcatgggtttgacggacacatggaccaacggatagacagacaagggagaatgggatggaggggtaagcgaatggagagctgaaagggggaccgggagacagaggactgcacgctgcagggtaggtttctttagacgcccacccttcaccctctcgttgctctcccaggtggtcttcaggcaggacctgccccctgcctctactgtgtgtaaagctgggcggacccccagcttctataccagcctcaccctgcagggccagggctggagcacaaggttccacagtgaacttgggcctcagagcccacatgtcctggtcccaaggatggcagcctaggaggcaggagtcaccccagcaccccaccctgaggccccgagactaacctgcacctggctctgggccgcagcgaccctcctgcggaactcctggagccgagaccgctcgccagcatcctggagctccttgccctcgagctcccgcagctgcctctggccttcactcagctcggcccgcacctgctctgcctcctgctccagctcccggatacgctggctgtgctggcggttcagggcctgagctgcctttcctggaagaaagcgggaatgtcagcacaggcagccctgctccaccgagagggccagctgtttgtccccctgggaggtttcccagcccttggacacctgtgtgggtttcaccaagcctttgcaccaccagtaccacagtttacttaatatttttcttcaaatcaactctatttatttatttattgagacggagtttgctctttttgcccaggctggagtgcagtggcgcaatcttggctcagtgcaacctccgccttccagattcaagtgattctgctgcctcagcctcccaagtagctgggattacaggcacgtgccactacacctggctaattttgtatttttagtagagattgggttttgccatgttggccaggctggtctcgaactcctgacctctggtgatccacccaccttggcctcccaaagtcctgggattacaggcgtgagccaccgcgcccagcctcaactcaccttttaaataagcctcatccactgcagcgacccaaggaaattacaaattagttttatttttaccaaatgcattctaaaataaatatgtaacctgaacctgtatataattaagcctttagaactaactttcatttccaggaaatctggaggacaaaagaatgagctaaatgacaccacaaaaaagcaaacagacaaaccccaaacgtggggtttgggacattcagcaggatgactgagagaagggagatgtcagagacctcagaaacaaatacagtcggccctctgcatctgtgggttccacacccatgggttcaaccaaccatggatggaaattatatttttctaaataaatggctgcatgtgtactgaccatttacagatttttcttatcatcattacctaaacaatacagtaaaacaactatttacccagcttttacattgtattaggtattgtaagaaatctagagatgatttaaagtgatttaaaggaagatgtgggtcagttactgtaaatactataccacattatttactaaaccttttttgagcatccacagattttggcattcacggggtcctggaaccaatcccacatagatatcaagtgacgactgtatgatgtgtgtgtggaacaaatgtggagcctgattcaagcgatccagctataaacagacactgctgataatggagagaatgtgcttatgctctggtcattaagaggactgtgccgggtgcggtggctcacgcctctaatcccagtactttgggaggctgaggtgagcggatcacgaggtcaagagatcgagaccatcctggccaacatggtgaaaccccgtctctactaaaaatacaaaaattagctggttgtgttggcacacgcctgtagtcccagctactcgagaggctgaagcaggagaatcacttgaactcgggaggcagaggttgcagtgagccaacatcgtgccactgcactccagcttggcaacagagtgagactccgtctcagaaaaaaaaaaaaaaaaaaagaggacattagtttcattaggtgtgctgatggtattacagttaagtaaaaaaaaaaaaaagttcctatttttaaagcagcacactgggaggtgtagggaagaaaggacatgaagtctggcatgtccttcaaaatattcagcaaagaaaaaagggagaggaggtaaaacaactgtggaaaactcttggtaactactaagtctggaggatgggtatatgggacccatggtactcgtctcatgtctggttgaaaatatttatgatgaatttggtaacaaattcattaactattaaaatataaacgctccactggccagcacctaaaactaccccgtgtcccctccttcactcatatcaccagtcataggcataacacaatttggagacgctcagtcctccatgacactcactgtgtgctccccaggactgagagatacttcgcccagcacaatggctgaaacattgcaggcactcgataagtaagaagaagtgccgggcatggtggctcacgcctgtaatcccagcacttgtggacactgaggcgggtggatcacctgaggtcaggagttcaacaccagcctggccaacatggtgaaaccccatctcaactaaaaatacaaaaaaaaaaaaaaattaggtgggtgtggtggcgggcgcctgtaatcccagctactcgggaggctgaggcaggagaatcgcttgaacccgggaggcagaggttgcagtgagccaagatcacgccactgcactccagcctgggtgacgagtgaaactctttctcaaaaaaagaaaaagaagaaaaaagaagtactgcttactaagagctattctaagcacttcacctgaattaactcacttcaccctcacaacacccctattcagtaggtataacgactatccccattttagagatgaaaaaactgaggcacggagggtttatgctacttgctcagggtcacacagctggaagaggctgggctgagtatcaaacctaggccatccggcccctgctcctaaccacctcattgttgaaatccctctagaacagtgcagaagtaacgatgagaagtccccctcgggtgagaggcccacctgatgcccacgcctcacctgtgcggaccagctcgccaataagctcctccttcatgcggatgttgatagccagctcccggatcttctgctgggcctgggccagccgccactctgaggctgtggcaggggggacctggcgggcctgaactcgggccttgctcccaccaactgctgcaacaggcagcctgtcaaggttgctgccccaactgacagtgggggagacagaggagtggagagcaggggctgccagggatggtgggtgggactgtcccaaggtggctggcccagaaccgtggaggggcagtggggaggaggccctctctgcatcccacccagcttacctctggaccctggaatggctgcatccaactcctcaaggcaaagctctgggcccttcctctctggcagactccctgggcgtgcccccgccctctgactgcagttgctgatcctatttctggaggacagaagcaggaggccatgctcctccccagcccctgccccagcctagccacccccaggcctggagggaagaagagaggccaccgggtcttccacctcccagggtcaatataaacccaggatgtgagtctggcagaatcaggagtccaggggcagagttttaggaggtacagggcagctgggggcatagagggccaccctggaggctgaagtcaggaggcctgggcccaccttgtatcacactcgctccagtgagacctttcggctcagtgccccacagctctcccccaggggctggccagggcaacatgagggcatcctaggacccagaggcttccccactgctgtcaggagaggagacggtgcgatccccagcctgcctagccctgggccctgagcaggtccttgtcaggtgggggcagtgggtcccactcacctgcgcaggtgtaaggtccgcctgggcggctcctcctcctcctcttcctcctctgaagcagctgaagagccacttcccagcctgttcacctcagtcagcaactcagctccagcctccctgccatttgtcacctgctaggggagtgagccatttcccatcccaagtcatcatccctgcgatataccccaccttgcctgccctcctcatatctctccctcctcaagccctgccttaccttcgtgatccagctcaaatgacccctctggcagccttctgaatctcaagctggggtgagagcttcctccctcccctcccctcccgcctgctttggctcccatgatacctggtactcctcaggtgacaatctgccctttctaccttgtgtacaggtcatgtgcacccaagtcctatctcaccaccaattccctgccagagtgatgggtgaacatgagacttctgccaacccccagctttgagagctgagatgacccaggcctaaaagccccagaggacccagaactttcaggcaggagtaacctttgtccaaacaaggttccccacgtggaaaagtgaacttgcaaagagagccatccaaagacagagggggtggtctgaaaggtgatgagctctccgtatgcagaagtgtgcaaggtttccacccgatgccggaagcctgaaccccctctgtaacctcctcattccaagcgatcttcagctaccccagggatgcccgatggcactgcacccttctgagaggcccagagtcattcaaatcttggctcttcctctggggacagctgaaagcagcctctcgcatctcacagccagtcccatgaaagcatgagtgggggacacgtgccccagtgcccccttcccctgccccgaacttgaccagtccagcagggcccacagacacccagcctcaccctcttctcacctctcccctctgctcagagccaacttcatctccagggaggcaggcaggcggcaccatgcccagcacatgggcgtgggcaccccccaggggggctgtatgaggtcgaggcacaaaggacccgggaggcaggccattcaggagccgcgggcccccccagcctggccgcaccagctctaaccgcagccgcagttccaccatctcctcctgctgctcacgcagccggtcgctctgcaagacatggtccaggtgccaagggggcatgaatgccccgacaggcaggagtgtaggaaactgaggaacaggtctgaggccactccaccgtctctgggctgaaaatgaggagtgtcaaatactcctctcctccccaacaactctgtaggagttcagactcaaactcaccccacagatcccatcacactcctatcctgccagaccgccacctccaaccgccgccaccagagggcgccaggagcaatgctgacctggtgacgcccggctccaaggtcccccgctgctgcccctcctgtcccctctcccgtccaagctcacaccacccagcaaagctgccctgcctggcggtcctgcacacccacctgcgctgttgtgatgctcacctccacactttcgctcatgtgcacctcctgactctacacccctaccccgcagtaccctaccctaactccctcccatcctgagaaactcagctctgccttcccttcatcctcctctgggaagccttccccgcactgtgaagcgggcgccgcacctgcagtttgtactgctccatggcgtcctccagcgcagccagaaagtctcggttctcctcctccagccgcgccacctggttctgcagggtcagcagctgctgcgccccctcatcctcctatagggcagggagaggggcttcaggggcgggggttgacagggcgagctggacacccggcctcttcttgtttagccctgctttctatctactcttccaagccctacctgcagtgggaactccagacccactggtgggaggaaaccccagaccccagctggcctgggtgccctctgcaagccatttgggtcatctcttgtaattatccatcgtatttgtattaataatatcaccactattattaggaacaatttactgcgtcttcaccggcatgctaggcacatgtgacaccctcagcccttacaacatccccactaagagatggggtaagtcctacggttatccctattttacagctggagacctgagactcggtgaagttaaggaagtgaccacggtaatcagcagaagtgaccgaatcccgaacgtgccctgctaatgggcaggaggcaggggcgcagctgctgtctgaagaccctcttccttcctctccaccactccccactgcccacaaccacaaccacaacctgtccctcggccacctttcgcccgccggccccctgcgccgcctggtcctcgacggaggcgctctcgatgccgctatcgggcccggaggcggagctcagggcgctgcgctcgccctcgacggcgcacagccagtcgcgcaccttgcgggcggcggcgccgggcagcccgggctcggcctgcagctcgcgcaagaggctgtaggcggcgtcggtgcaggcccggtagcgcgcgcactcggcgcccaggcgcatggcggccgccgcggaggcggtggctgggcctggggcgcgccggccgcggtggatgatgcgggtctcggagcggtgccgtggcggaccccgcgcgccgctcgccgtctcttcgggtggccgctcggcctcgggccgccagttgaccgtggcgcggttgcggatgttctgggcgcggctggcgtagttgagggtgttgagggtctcgtcgaagtcggaggaggaagggctgacgcaggcgatcatcaccgtcttggcgttcccgcccagcgagtctttgaggatcctgagggcgcgagggggaggctctcaggggccccgacgctccaggcccagggccagcgggccagacctgggaccggctcctggcgcggttcccgtgggctggagacctcaggggacctgggcttccacccccactggtgtgctggacactccccgcctccccggcccccaggccacataggagccagggggcagctcaccgggtgatcttggagtcgcggtagggtatgtggctgccccggcgctgagggtcccccagggcgctgatgacgttgcccagcgccaggaggctgctgttgatctggatgctctccttgagccgctcgccggtgctgcccgtcttgagcaccctctctgagcccgccaggtccacgaagtggaacttggagacgagcagctggcccggggcggggcggggtaggcggctgggggcgcgcccccgctgctccagggtcacggtgaagaccgtgtgtgagcggctagacaggtggttgaggtgcgtggctcccgtgtgccgcgccgcgttgcccatctccaggaggctcagcacctcatccaggccctccacgtcgacctccttcaccccgcacagcactgcgggcacagaaggccgtgagccccagggcaggggccgccagactgaccagccaggagggcaggcagagcagaactagccccaaacctgcccttcctgacccactgctccctccccatgcccacggggtactgcccttcctagttccggcttgaggggctccggcttcccactggcccacctcagtgcctctcactctgggtatagaagcatgtactgaactcagtggaggcaagaagctaaagcaaaacctcccagggcttgggttttccatgaggagttgccattcccagacaggtaagcactccactccaaacaggtgaagcccccctaagcccctctccgtcagtggaggaccccagagttcctcaccaacattcccgcgctcatcttcccggagctggatgtcacggctggcagtgcccacctcgagcaggtctcggaactcctccttgtacacttccaggtaggacacatgtaccagacagtcaagcaggtcgttctcatcgatgagcttgaaggcctcggccatggccctcgggacaatgccctgctcatcctcaaggagggaggctggggagacaccgcagggcctcctgccacttcagctggacacggcccatggcccccaggcccggaagctcataggcccctgccagagctggaggatggtgctctaggatggagaaggcagtggccgaggccaggatgggacaggtggcctgagcttggccatgctccagcgtggtcaggcagaattataaaatttaagagttggaagcaacctctcctgattcaatcaacccctttcatgctgtaagcatccccttcactgcatcctcaacagattatcaaataaccttgccttgattactcctaatccatgctcagttatctaaagggcctcctaaatttatcccaaggaaataatcagaggaacttcagagcagcactcttcctcatgacttcaaaaaatgcaaacatcctaagtgtccatccgaagatccaataggagatctggccaaatcaactttttttttttgagactgagttttgctctcgttgcccaagctggagggcagtggcgtgatctcggctcattgcaacctccaccttccggtttcaagcgcttctcctgcctcagcctcctgagtagctgggattataggcatctgccaccatgcccagctaatttttgtattgttagtagagatggtgtttcaccatgttggccaggccggtctcaaactcctgacctcgtgatccgccggcctcagcctcccaaagtgctgggattacaggcatgagccaccgcacctaaccaactattttatattcacaatggaatgccaggtagccattaaaaagttagatttttttttttttggtagagacagggtcttgctgtgttgcccaggctggtctcccaactcctatgcccaagcagtcctcccagctcagcctcccaaagtgatgggattacatgtgtgagcccctgcgcctggcctaaaaagttagattgaagaatatttcatgatacagagaaatgttcatgatacatttgttgttgttgttgtgtttttgaaatggcatctcactgttgcccaggctggaatgcagtgaagcaatcttggctcactgcaacttctgcctcctgggttcaagcaatcctcctgcctcagcctcctgagtagctgggattatagacccccaccaccatgcttggccagttttttgtttgtttgtttttgagacggagtcttgctctgtcaccaggctggagtgcggtggccagatctcggctcactgcaacctctgcctcccaggttcaagcgattcccctgcctcagcctcccaagtagctgggactacaggcatgcaccaccacgcccagctaattttttgtattttagtagagacagggtttcaccatgttggccaggatggtcttgatctcctgacctcatgatctgcccacctcggcctcccaaagtgctgggattacaggtgtgagccaccacgcccggctcagtttttgtatttttagtagagatggggttttgccatgttggctaggctggtctcgaactcctgacctcaggtgatctgcctgcctccgcctcccaaagtgctgggattacaggcgtgagccactgtgcctggccaatgatacattattaagaaaatcaaacaggacacaaaagaatgtatataatataatcccatttttgaaaagtaaaataatcttcccagggaaagaaactggaaggctaacagggcaggggatttccgaaaggcaattatcaagtacattttatttcgtgcatgtgttttgctgtattttcctaattttttttacacaaagtatctttctgtaactgctatggtctgaatttgtttatgctccccaaaattcacatgtagaaatccttacctccaatatgatggaagtgagggctttgggaagtggatggggggagccctcataaatgggattagttcccttataaaagagagctgagagagaccccttctgtgtactaccatgtgagtttagagagagacagcgactgtctgtaaggaagaaggcccttcaatctgctggtgccttcatcttaaacttcccagcctccagaactgtgaggaataaatttctcttgaggagccacccagtctatggtattctgttatagtgaagggagcagagcaaggcagtaacccgacagaaaacagcttgtgttacttaaaaggggacacttccttcagttggcccaaaggatctttctcgaaactgctccagagcctggctgaagcaccctgcagccctgctgtgcagtatccaaagcagcctcttccaggacacacggcccccattcccaactgctccagctagaacagattcctgaccttccctagccagcctgacaacctctagagacacgccaccttcccgtgcccttcctctgctgaggtccccagagccaggcagcatggcgccatctctatggaggtgagaaggccactcacctccaacgacccttccttcctgccctgcctagcccacagacatggctggtcccagcctgggccacagatccctgtctaggaaatcgactcttcctcccccagcatccccaccttccacagaacaggcagcaagaggacaaggcagaaatccaggaaggaactaaggctccttaaagtgggcacagggccacgaacagggtcactcacccacactggcctcccccatggtgtatgtcttccctgagcccgtctgaccataggcaaagacagtggcattgaagccctcgaagaaggcctcaaggaggggctgaacgcaggcctggtacacggcctcctgccccgcatcctcggccagcaccacgtggaagccaaagtgtcggtcacggcccagagtgacgcggccaagccctggctccacctgcaggcagctctgatgcccgtgcagcagctccttgggcagcagtggtcgaactcgcagggcaacccgcactggggcctcctcagcccctggcagcctctgagcctccagccccatgccgagggaggactgctctgggccctgtggagagagagagaagccctggccatcagcacttgtactccaggagctggactcaccctgcaggggactcgagccagatcctgcagctcctgaccttggagggattgggggagggtggtcaaagttcacaatatccccatgtccaacctggtgctcaaaaattgcaagggccatgatatatatagtcccccacaggaacatgtcatggcttccggcactggcgaaatgaggccctaactcctgaactccagtgtttcagctgcactcttccctatggcccctatggccccatctcctagaagaacgcacacacacagcaccacaccacaccagggaactcctgtccctaacacccactgggtttaccacagtctttgtgtcaagtcactcacatcccctgccccaccttcttcaaaaaagtcaacagatccttcaagaccaagctctcaccaccaaatcctgccaattccatctcctaaatatctctcaagttcacctgctgcttcccattctgttgctaaagccctggtcctggccactgacatcgtgccaggatgactttgagcagccttccccctggcatcagtctccctgtcccctcccgcagggcaaccagggacatctttctttttcttcttgagacagggtctctctctttcacccagactggagtacagtggcatgatcactgcttactgtagccaaggcttcccaggttcaagtgatcctcccacctcagccttcagagtagccgggaccacagacatgtacctggctaattttattattagtattagtattagtattagtattagtattagtattagtattttgtagagacagtctggctatgttgcccaggctggtcttgaactcctgggctcaagggatccttccaaagtgcagtgactacaggcatcagccactgcgcctcagaggcatctctcaaaatgcaaatgcaattatttcactccctgcctaaccccaactcccccaaaaaaaggctctccactgcccttgggattcaaaatatttttgtttttgtttttgttttgttttgttttttatttgagacggagtcttgctctgttgcccaggctggactgcagtggcccgatctccgctcactgcaagctctgcctcctgggttcacaccattctcctgcctcagcctcccaagtagctgggactacaggcgcccgccaccacgcccggctaattttttgtatttttcatagagacagggtttcaccgtgttagccaggatggtctcgatctcctgacctcgtgatctgcccgcctcggcctcccaaagtgctgggattccaggcgtaagtcaccgtgcccggcctgggattcaaaatattaaggggaaaaaaaaaaaagacaagccttaaatcaggccctgcctccctggactactcacttcccacaccccaggcctttcctcgcctcctctctctgcctgcaacggctaggtgttacccaagcctcctcatccctcccggctgaggctgcagccaccttctaattcagggagccacggaagctcccctcctctgtaaccccaccacgacacgcacacaacccccagtgctgttccacccgcccgtgaccactccaactgcaggttactacccgcttctctccccgacctcccagaccaggagctggaaggcagggaccctctgggtccactttgcactttatcaccagcgcccaacacaaggtcccacgctgcccaacagatagtgatggataatcttcatccagggaactttccctgccctccctcctcctaccgcgttcctcacccccaccgccagcccggcacttcattctttacccttcaacctctctctcagcacagtaacctttcgttaattcaatcacccagcccctattgggctcccgaccctgggcacacagcggtaaactctgcctcgcaataccgtgtgggccttcgcgcacccctccgcgtgagcgttccgagcccggtgcagtcccggcttccgcgcgcccctgctctccgcacagcgctcccgctccgaaggtgctctgacaaccccgcaggcgctattcggagccggggcagggcagctggggctggaggcggcgggcgcgggacggagctccatgaaagttggaagaagtgattacaaatcgggacccgactctcgcagccttggcgctcgcccctccacgcaggcccgggatgccggcctcagcccccagatgtcgggaagacggcgccggccagtccaaggaagagcttccaggaggctggggagcaagggtgccgggctcctcatgccgggtcaggtctcccaggagtgccggctcccagggccactaggcccaggcctgcgcgaggagggagcgcgcgcctccctccacccacccggtcctcgcccctaacccgctctccggcccacactcacctgcctggctgcaagcgccgtcccgggccaggcagtcaggtttccatccccagtgcggcgcgctccgatgccgtcatcgggacccccgccccccaaaccagcccccccctcacccgcaactccgcccgccggggcgctcgggggcggaggcgcgagccggtcggcgtcgcggagtcggcccgcagacagggcgggcggggcccgtgctcaagggctgggcctggagagtgtgcagcatcctcatgatggcatcgccttattttctagaatttgtctccaaactggactccagaccatcctgtcctcagccccgagtcaccttcatccccggtctctgttttccactcccagtcccaaaccacgcctcctgcacgccactcacacagccggcagaaactttaatctccccacgtttaaaaaagttttctcagttataagactctctttttctcacattttagcattcctaaaattgagttccatcttacactcattgtcaagggaaacttggcaccaggaggggcaggagaggtgatctgggggtgtccacggcagcctcaaagagatggttggtgtcttcacctctgagacctctgatccattgtttgcactggaagcaccatgaatgggtgaattttaaaatctgaaaacatatttgtcacttaaaacgccattagaaaaagtaaactccagtgtagtttctagtgaaattttattatgtatatagaagattacctgtcatagacaggcaacataattaaaggccatagaaattgccaggctcgtcagatagatctatattaggaaaccctcagcctccagtaacagaaaccacaatttgaagtggcttgaaccataaggtcatgtgttatctcggggaacagtgaaacccagagggatgagggctcctgggcaggttgagtcagtggcaacattaccaaggaggtggcctttttaactctttttttttttttgccatcaacttcagacacaaaacgtccagaggaagaagacagcagtgtgtggtgaagcatgccctttggatcaagagcactccaagctgatttccttcccattccatgtaccacacagcttaggcctgtccacccccaaactaatcactgtcaaggggatggaactaccatgattggcttgcaataccagtgtgagacagcgtggatataggaaagtcatccacaatctccacaaccacatcctcgaagcttcatagaggagaggctggccaactgattcgtgtatcacaaaggaccatgattcaggtaccaagcatctatctgtcagatgccaggagctgtgccatttcctccaatagacaattcaattaaggagaaactaaaacctcgagcaattggaaagagcacatgaaaccccagtgttctttgacatgctgtagaatgacactgttgttcccaaatattctaaatcaattggggtcctgaacaagaacaacacagagcagcctgccgccgtgatgcccaaagagaatcattttagaccctgaaaatgtgaagaagctgaaaactgaacttggattttcatatgtgtaaaatgtaataaaaggtgatgatgattaatgaaacatcatgctttaagaggtacaattctgggccagccaaggtggctcatgcctgtaaacccatcactctaggaggctgaggcaggcagatcccttcagcccaggagtttgagaccaacctgggcaatagggcaaagctgtttccacaaaaaatgcaaaacataggcaggcgtagtggcatgggcctatagtcccagctacttgggaggttgaagtaggaagatacactggcttgagcctgggaggtggaggttgcagtgagccgagatggtgccactgcactccaacctgtgtgagagagtgagaccctgtctcaaaaaaaaaaaaaaaaaaagagagagagacagaggtacaattctaattacaattatagtaattaaattgtagagaaaataaaaactttcatgttacaataaatttttaaagaatttcatgatggtggaactatcaatgttcatgattttagaaagatttatcttttttcttgctctttctggtggatgtgcagtgtttttctgtgtatcagtagcactcatatgcaacaatctggtgtgtacccgagtgtccaaattgtggcctttatcactattttccattaaaagtagctgattccatgtattagggtaagaactggaataattattttgtggtcaaaaaattcagatgcttttaaaatgtatactgtaggcctgaaatgacaaaagccccaacttaaaggggttcttaccagccaacttgtgacatcatgagcttcagaagagcaaagaataattatagttacttgaaacaaattgagtcggtaaaaattccttctgtggaatttgacaagctgattttactacttacatggaaaagcaaagtgccggaagttgcaaaagacacttgcagaagggcagtatgggtggacttgcccaagaagatgtgaaaacatatttgaaactattgtaattcagacaatgtgctaatgctacaggcataacaaatagaacaaatctggaaaccagatctatgacagagtagagagtgcagatcagtaggggaaagctattcaatccatcaggccgaacctggtccattgttcatcagatatcagtaaatgagaagtttccagctgacattcgagagaactcttaagcttcctgcagtatacagtttatttcgagagaaactcaaggctgagtatggtggctcatgcctgtcatcccagcactttgggaggctgaagtgggaggatagcttgagcccaggagttcaagaccagcctgggcaacatagcgagacctcatctctacaaataaaaaaaaattagctgggcctggtggtgtgcacctgtggtcccaactactctggaggctgaggtgggaggattgcttaaacctgggaggtcaaagctacagtaagctgtgattacaccacggcactccagcctggatgacagagaccccatctccagagagagagagagagagagaaaacacaactaaaaattcagttaggaaatgtataagacagttatccacgtggaagaaaaaaattggattcctacttaaaccatacttataaaaattaattaaatgtagggctgggccaggcgcagtggcacatgcctataatcccagcactttgggaggctgaggcaggcagataacttgagctgaagggttggagaccagcctgggcaacacagcgaaaccccatctctacaaaaaaatgcaaaaatcaggtgggcatggtggtgtgcacctgtagtcccagctaccctggaggctgaggtgataggatagctcgagcccgagaggtcaaggatgcagtgagctgtgatggcgccactgcactccagcctgggtgacagagtgagaccctgtctcaaaaataataataataataataattaatgaaatgtaaaatggataaagcgttagaggaaaatcatcatggcaaatattattaggggagcatcatcataccttcatggtaggggagagcttttaaaacataactttcagcaccacaggaaaggttaaaaacaaacaaaaatcataactcaaaactgcaaaccacgaagggaaagagtggtaattgggactaaatcaaaattaagaacttttgttcattgaaaggatgaacaaagaaaccagaaagagaatgaaaacaaaagcaacaagctggaagaagatatttgtgatatttatccttgataaagagttagtattcaggaaatataaagaagttctaaaaatcactgagaaaaactaggcctggcatgatgactcacacctgtaataccagtacttttggaggctgaggcaggaggatcgcttgagcccaagagttcaaggctgcagtgagctatgattgattaaaccattcattctagcatgggtgacagagcaagaccctgtctcaaaaagaagaaggaaagaaagaaagaaggaaggaaggggaaagaaagagagagagaaagaaagaaaaaagaaagaaagaaagagaaagaaaggaaggaaagaaggaaggaaggagggaggcagggagggaggaagggagggaagaaagaaaagagaagagaaagggcaaatacttcacaaaagaggaaatgcaaatattaaataaacaatgttcaatatcattgctaatcagggaattaagtccatgacaagattccgttttactctcctcagatttatgaagtgattaaattagacaatatcaagtgctgatgaggatgctggtaagaggactcatatacttctggtgagaatgtcaatcagagcaaccactttgaatggcaatttgtcaatatctagttaatgatacacacactttatcatttaggaatcccactcttagtcatattccctgagaaactcttataagaatgttcattatcacaaagtatgtaacagtaaaaatacggaaacaggccgggcatggtagctcatgcctgtaatcccagctgttcgggggaccgaggtgggtggatcacttgaggtcaggagttggagaccagcctggccaacatgctgaaaacccatctctactgaaaatacaaaaatttagcctggcgtggtggcgagcgcctgtagtcccagctacttgggaggctgaggcaggaaaatcgcttcaacctgggaggtgggggttgaagtgagccaagatcgtaccactgcactccagcctgtgggactagaatgaaacttggtctcaaaaaacatatatatggaaacaatccaaatgtctattgacaggagagtgatgtggcagagattacaagttacccccatccctgggatctacttcccctccatttaggacttctgatttttaattaggtgcatagccactccagatgaaaactatatttcccatcccccttttaaaccaggagtggtcatgtgactaagttctgtccagtgggttataagcagaagtagttgtaatttctggtgtggaggcatgccattctcctttctccttgttcttttctgtggctagaatatggagttgatcgctggagctggagcagctatcttggctcatgaggtgagtttaggaaaagaaatcattcacgacagaacagtaagatagaaggaacctcaacccctggcactgctgagtgtcatcccagtctggactactcatctctgggcttttacaggagacagaaataaactcctatcactgtgtgctagactgtactatcgttcagcaaagagttgctccctttccccttccactaggggagaagtctacttccctgtcccattgatgtggacttggctgtatgacttgctttggccaatggaatgtaagtacatatgatacaaggagaggacttgtggtgagacttggttctgtgctccagtgatctgttgtgagaagagtatgccccatatagccactgagcccttatcctgcagccctgaaatagcacccctggtgcagaactgaacccatgcacagcctggagccaagttcagctgatctgcaggctgaagcagagccattgggagtaccacagtgatgagctaaaccatagttgacctatgaacataaaaataaatgcatgttgttgtaagccacagtcttaggatagtttgttatgcaacagtatcatggcaaaagctgactagtatacattgttattgggagccttctgtcttttaaaactgaatccattctaatgcaaatgactgaataaattatggcatatttatatatactcattaaatatagagttttagaataaaaatctctagtgaaaacaaatgaagctcagaaacataattttgagtgaaaagaagcaaatctcaagaatacatataatcacacttaaataaagctcaaggcatgcaaaactcaatcatattgtattggggtgtatatataggaagtaaatctataaagaaaagcaagggaatgagaaacaaaaaaattcaggactgtggttttggcaggttggggctggggatggggagggattgtggatgtcatgcaggatgttttaaaggtactgcttgtgttctggatgtagagcagtgaatagaagggtccaatagtatatcctagatggggagctgaccacacagtcttggtcccctctctgcgcacagaggaacctctagatgaccgcactagctctaatgacatactaacaaggtatgcagaagtttccattgacccagtttacagaaaagcttagaagaatttgactttttagtttgtaactaacttttttttttttttgagatggagtttcgctcttgttgcccaggctggagtgcaatggcgtgatcttggctcactgcaacctccgccttctggtttcaagcgattctcctgcctcagcctcctgagtagctggcaattattacacttattacaggtgcgtgccaccacacccggccaatttttgtatttttaatagagatggggtttcaccatgttggccaggctgatcttgaactcctgacctcgtgatccgccagccttggcctcccaaagtgctgggaattacaggtgtgagccacctaatcaacatttaaatatttaaaataatttgatgtatgcattttataaattttgattaagtgtgaagtattaaatggttaggaaagttatgcttaagacaatgagcactgaagcacaagtcatagtggtatctctctctccatgcccggaagtcccttggatattaagatcctagataattatgggaggaaggccaggcatggtggttcacacctgtaatcccagcactttgggaggacaaggtgggcagatcacttgaagtcaggagttcgagaccagcctggacaacatggtgaaaccccgtctctactaaaaatgtgagaattagctgggcatggtggcgcacacctgtaatctcagctattcaggaggctgaggcaagacaatcgcttaagcctgggggcatggaggttgcagtgagctgagatcctgccactgcactccagcctgggtgacagagtgatacggtctcaaaataaaattatgggagggaaaaggggtaaataattgcctggataaatgtatgttattgtctgtaattgtttgcatctccaaaagctgtggctgagttagaagcgggttttgtaagctaggatggaaggcattgggtatttctctgaaggaccctgggcaacccgatgtgaagtggaggtctttgctaggtcctgagctacactgaagatactgagtatgggtggaccttgccaaagtgatgccccgcagaacagaggaaagtcccccattgagcctagagccaaggaagcaaatgtctgccatttagaggagctactttgcccttgttactggccaagatgtgttcaaaatactgagaagcaggtttagtgtaccttgctgcctaatcaagaggtttctaagagcaaaaagaaacttataacttacactgtttgcttcctgggctgtcctattccatatgcggcctccagcacccgtgctcaggcccagggctgggtgaaggaactgggcctgaccagcaggcatgttggcggccacagccctcaggcggctgaggaggcagctttcctgccttccggagtatagcctagcaggaggagccgcaggaccggggaggagtaaagagctaggaatgtggtttccggagcaccaggaagaaagctgcatgggtgggtgaggcccagg

SEQ ID NO: 1350 - DNA, 20001 bp, Homo sapiens
tacatagagatattcaggttctccctccttgtgcaccttccctatctctttgatcactctgaggtctccacctctccaattgcaatgagactttcacttatatgattcccttcccctcatcttttcaaccaggtattaggggtagtaatgggagtgagtgcacactgtcctgtggtctttgagtatggccaacatgagcccttgtaaatcccctgatgccaggtgactggctggccatcctgtccatgaggttcccaggtcactctcctttcccagtgtttccatctccctccactcctggctgattaccgactgtccagccctcccctttcctgcctgttctcagagcagggctgaattaatccaatgaccggggaactcaggggacttggagggaggtcctagttgcaggcacaaactagaagagaagctctttcagggtaacagaatgagctttcagacctcaggcagaggaattcctctctatggcatccaaggtcctgggctaggaatgggcaacaggtgagaggaacacctgggttcagatttaggaagagaagcaaggtctgcattgagagaggctgggacaatcagtgacactatcccaggggtagtacatggggcctgggtgctggaacagggcccagggtcagcactaccagcacccaggcagtcaccaagtgtggacagggttgaggatgcccctaccccatcagggtggccagccagagaggcagacgacaaccaagaagttgtgctgttgggaaggagctgcttggggtctgacagcctcttccaccagccagacccatttgcctacctgggctcctcccacccctgactggacagctgcccactccatgagcttccagagaagcctgcaggttccgtatgtgaggaaggttgacaggtacctggtgacgttgctaggctggggtctctttctacacctcactggggctgtggatagctgaatttacaagatcctcatgacagaccaggcctttgaggctttcttgctcagctcagtgcagcctcactatagctgggatgtgggatgttcccaaccaaactcctgaagccttgatccccaacacagtagtgttgggaggtgggtcctagtgggagatatttagatcgtggagacagatcctttatgaagagattagtgcccccttccacctcacaggcttgagttttagctgtatctggaatggacaggtttccaagacatcgggatcaaaacagagtcttgcttccttggtctctctcctgcttcctctgtcaccatgcaatctcagcatatgccactccccttttgctttctgccatgtgtggaagctgcatgaggccttcatctgatttagctgccaaaacttaaacttttcagccaccagatcatgagcaaaataaacttcttttctagatcaattacccagccttgggtattcagttacagtaacacaaaacacagcaaggcaggcccttagctcagccttgctgtgattcatcttgaatctaaatcttgaatggaatggaggcctggagtcttttccctacaggtgtgagcttctccctctgatctcctagataaatatcgtttgtctaaactcagctaccatgggagcctcaggagctggagagggtgtgggcaccaggggagacatggtatgaggctgtgtgcagggggatggatcaaaccaggccctgctagggttctggcacaattgggcacacctcatctccattttccctcttcagtagggatttatctccctgccttagtgtctcctcttctaaccctatcaccttccatgtgaagctggacaaagcatgcaagcttgtgaaccttattctagagaagagggaagatagagggattgtctggctgacaatcacgtatgtaggtaggtagcatacaggagagatttagatggacacattggatgacaatccggtaggggctgtgctaggatgaacaatgggtctccatgttgtccacatcctaattcatgaaacctgtgattgtgggactgcatatgtcacaatggacttttgagtaagtaacggatcttgaggtggtgacattatccttgattatcttaataagcttgatgtaactaaccacaagggtccttataagagggaaagagatgtgaagacagtcacagagagagagatttgaagatgccattggctttaaagaggaaggaggggaccgtaccaaggaatgcaaaaaaggcagctctggagctgaaaagccaaggggcagggctctccctgaaaccttctgggggtgggggtctggccctctccagaacttgttttaattcagtgaaacccatatatctgactttgacctccataactgtaagagaataaaagtcgttatttaaaatcactgagattgtgatagtttattacagcagtaataggaaactaatataggaacagacaagcaggcaggaagaaggagacaggtgtatgggcagacagtctggagggcaggcaggagtttgggaggtgggtggagattcagggatgttggggtgttcagacccaacaccaggtcgtgggggtgacaaagtccggcagagtcaaagcagtgagaaaagacagtttgagagagaaagtgggtccagggcgccaaagctaaggatggaggctgtgaaggccccgagctctggaagtgcagattatttattggtgatcaaacaaagaaacaggtggtgagaatgtgggggtcgaaagggcatgttgcattaagcacatgatttacagctgtgacggtttagcatctgctctgctacttgagataatggagagcaggttcttttaactcaagatacaattgatcctgggagagcaaggagcgaggaggcagcaagttcagacacattccagagccacgagccctggattctatccaagccacgaggggttttatgccccgggcttagattatggtgcgtcagggtagccttccacccttcagcacagagcttggtgttccaaaggccacaaggggttttagaccctggatcctggacatgatccaagactcttttacattatgtcagacatgcaagctcggcctcagcttctcccaacactcagcttttctcccaacaagagatacaggtgggtaggagacaggtagacaagcaggtagggagcctggagaaaggtgagagagagaagggcaggcagactgggggacagcaggcaggtgggaagaagggaaggtgggcagacagaaaacaggatatgggcagacaggaaggggacagaagcgggggtcaggaagacaggacggcaggtggaggccctcaaagctggtccttgtcttcacaagggttagggagcctcctgagacgcaggtggattccatttttggatttcaacacaagtcgtgcaatggggatggggatcctggtgggatcaggcagcagctcaaagcggagcagggtcagggccgtggccaccttcagctcgttcatggcaaattgtttcccgatgcagttcctgggccaggtggagataatgaattgagaagtgtcctcaggccccattctgatctgagcaggttttggcccctgaccccagccctgagctggacattcagtgcccaacctcatgtgtccagcccctgcacacatacagcccatggacacttctaccccgtcctggcttcacactatcccaatccttggacagagccgtcttcctgggctagctcctaactcctaccctctacctctgctctcagcagcctgaaaccctctatcaagacaaggccagggctctaaggcacagagtctaatcacatgaatagataaagagttaatcaatggtttgttcactcctccacaaacatttcttgttctccagtgtggaggtcagttcaggtcctgtagggtgagggtgggccacactctcaggtgcttcccatgtagtgggacacacagggacctgaatcctcataggggccccgatgggtgtattaagggagtcagaagggcagtgggaggcttcctggaggagaactgggtgggtgatcctcagtgttgccccacctgcctcccaccccagggtccgggctcctgtctaacctcactcctccatccaccagcccctgtagccttctaattctactccagaaacatccttccttgcccttcctcagtattcttgcctggactttatggttttctgcttcccctcccagcacactgaagccacagcccagctcagaccctcccacgctcttcatcacaggtgggacagcatcccaatgcctcagctggcagataagccctccatgggctcttgcctcacccacattttacctgtccagcccacgtcctggccctgttcatgtggagatggctcagaatgtcctccctccacctctgcctgccacatcctcaaggctaaagtcagatcccagctgcctctcactccctgccagctgggcctctccctcccaggcccccaggtagcattcacgatttatccatgaacactcacagtccagtgccaaggacagcaccagggacagggacactcaacacgccactcagtgagtgaatgagtgaaaggatggttgatggaacgatgtgtgtctggagcacaggatatatttctgtacaacacatttttgtactttttatctctgttttctcatcatgctgcataggacttgacccagagaggtagcttaagaaatacttctatatttgaatgatgttaagttttaaaatgaataaaatataatgaaatacactgagagtaaatattaattctgagctagaaatggaccttaggaatgctctccagttctctagtggcagcgacatgatttgcaggcaatgtttaggaggactttctcatgctgggatagacagaccagtgctggagaaggagtttcaggaggaagctttttcttaaagcctgttctgtgtaagtggactcaccgtttcaaaaagtcacataattatttctttgaacaaactttgtttctactaagaatttatatcgtttttgcctgtgtgtatgtcacaggacgattcctgatgccacaatgatctccaccgcaaccattctggagttttcctctccagctcaaaagcaatttcaagtgtgttttatatttcacataccaggaggcttcaaatgttgtgcgttatatgataattattgggcttttctctccaagacagtgtactgttcacatttttatgtttttggccaatattgtgctaagtggattacaggactatggtataaagatctcaaggcatgtacagaatttgtcaaacgggaaaatagatgtaaatatgtgaacactatataatgcagtaaaaatttcattgggcaagacagaagaatgtatgatatgacacacactgttgtaaaactttcttcaaagggctaccttaacctctcccttatatgacttgaaaggtaggacttgcaggtcatctgtattataaacagatgcaaagacttcaatgattcatctctacgacagactagtgaattaaatagggaaggtagtgtgctgcattgaggatgtgtggggggagagaaatctacagtttactattcctgacaactgagaaaagcaaacagctgaagttgaatttactggagaatatctaattttgagaattcatatccttaaagtgaggaaaatacatgaatatactgaagtttggaacatgcactgacagtgaattcaggctgcccatttgaagaagcagagggagcaaagtctccatggggtgctctgaatgccaccttccttttgtacacagagacgcccacaccaggtgcctgactttcccacaaataccaacatttaagagcacacctgaagatgccacatatgaacatcaggctcacaaagatcagagggttgaccagagacttccctcattcctctattcgaattaccacacaggacgtctcaccttgatcctcctgagaagggcaggaaagcgtggctgtgttgagcagaacccggtgcaaaacggaaagggtcaaacacctgcagagagagcaccagagccaggatagttaaggatccagcacctacttgccacccatgggggacaggactcccagaggtggaagcaggagaaggtattggtcttgagggatcacctcatttcctcctctcaaggaccacatacctctgggttgggccacacttttgggttgtggtgaaggccataaatggagaggaggaccatgatacctgtggtgcaggttggaaacagagagaagaccaatcatttgcatggggtggcctggtacttcagccagcaggcacaaaagaaggcccaaaaagcctactttccacaaattttcactttgactgggatgattctgccattatgcaggtgggttaggcttaacaaagcatgtgagttcagatgatgaatagacaaccatttatgcaggaatgagaagcaagaaagaatcagagcattactctttagagtaagtccagtgacatttcacattcatcaaatatcctccaagggtcattggagaatatacatgaactcactcagtacaacaacgctccaagtaagacattcttttgctctcagttttcaggggagatacctgaatctcagagagaccaattgtcttgtctatgttcacacaactaggttatggcaggactgggaccagaacccagggagttgcaccttggtgtccccagatctggtcatcactttctctctgccatcaacctgagggttcctcagagactggacaacagctgacccaggaaatgaaattcctgataagcctcttttgcactgaccccatgaggaaagaaacacatccctctctgcccttgtctgattctctttccagccctgcacatctcagggaatagaattttacagttactgacccaaggccacattcagagattaacatttatttcttgaacttttggtgggttcaagctctcagccagacttttcaaattctttatcccaagtacaaagtatgtttttgatttttttagaacaaaagggagacccagagatgtgcagaattctgatgcacacatggatttctcaccctccacacgtccctgtggagagtttaggtgagagggtgggggaacttcatacctttgggcaaggagcgcccatcagggaaggtgacgggagtgctgagctctctgccaatgcctggcaccggtgggtagagcctcagtgcctccttaatgcacatggtggtgtagggcatctggtccaggtggttcctgaaacaattccatcctgaacaccagcaaggcctgggcagaccaggggcccctgtggagaaggcagggaaccccatcttttgagccctcactcaccaggtgatggaggctccatcacccaggaggctgtggatctcctcccggcacctctcctgatgcttggggtgtgtggccagagcatagaggatccaggagatcccactggctgtggtgtcgtggccctcaaacatgaacgtgtccacctcagcacggaggtccttgtctgacaagatgctcccattctccatctgggaagaccgtggtgaaaatgcagggcttgtctcttgctatgtacttctgggcaaagactcaggcctctcctacacatactcactttggccaagaggaggatatccagaaaatccaaatgcctcttcctcttgatcttctccagctccccctccttctgtagttgagccttcctcagttggatcacttggtctgtaccagaacaatggttaccaggcagagctgagaccgtcagcagcccccaggaggcctagctgcccaactgccccagtgtgggtgcctggtagatctcagcatgaatgtgagtgtgggtgcagggtcaggggtggaagctctagtactgtgtgaggcagggcacccctcccgccagtggcacagttcatggaggctcctcttgaatgctgtttggacagggtctcattcagttatctccatgtggggacattgataaaccaaggcacagaatctggcccctcacatctcagctcccagcccctgagcaagggaattccccaggctgagtgtgttctgcgttctgcagggttactaggggccttctctggctgaggagtcagggcaagttctttcgctgtgcctgggaaaggctgggagacaagaggaaaagacagaacctgtgtgctgatgggccagctggcaggcgcggtgtgtccagcggccagcagaggtcaggctgtagatggtgtcattctggtgaaaggcattcctcacacgggaaaaaaccaggttgttcaggtcactaatggcctgtatgtaggactgagaattcctgagggagagtatgaagaagggactgcagtaggggtgggcccattacccggaagtagaatggggtctgagaggaggcagcctcggataatggggacaagcagccttgaggcaatgtttcttctatcttacagccctattatcctttggcctttatcagatggtatgaacatccagggtccacctgtgctaggaattaggcatctgttcctgagactttgtttggtctggactggaattagagtttggtcagggactgactcttcctttgtgtggcggtgagccttcacgctgccccacctgcccctcaggtatgtgcactccacttgataagaacaagggccctgcagctggagggttgtcactgacctgtccacctggatgctgccctgatggctgaaggcacacttcatgatggtgtccagggtcatcaaggagacgtgctgaaagacctccagaggggaatcctggccaaggagctcttcccatttgtcctgtggtgggagggggcatggaccttcttaatctccaagaagtgctttgctaataaggcctggctttttcatgtacctgcagatatcctgttttttcctgtagcatgcagatatcttggttgggattcctcactttacagagcagatgcattgtagaaactgagactgtaaagccagtgttggtaaactgacgcctaattctcacacacttttaatacaacattcaacagatcctctcacaatagcatggattaagtattgaattttgagattcagttaggacatatggttgtgaaaattgtattgctattgttgttctgggataaataatgggggactcttcagtgttctgagagctgagctagttctgagggactagtaggaaagtttcagtgccaaagatagcttgaggggccggaatgggcactctgttgtagagaaaacagggacttcaattcttttccattcatcaaaatgtgctgggcacagttgggtgagaaatcagagtcctgactggagatgatgctatctatggaaggtattgctctgagaacatagacctggtgttcatttccttcccagggtggcttaaatccatgcagaaacccggggccccaggccagagcctgggtgggtgacatcttggcctgtccatgctgccactgaagctgccattgcccaggccagccagcataggaagtcctactgtccagcaagattgcatactcctccagtcccttgtgctgaaggttccaaagtgggaggagaagggccttgcattcaccatgaatctctattcctatggtggggaacaaagcgtggatatgacctgatgcctgggtgttctcctaccttatacaactctggggaaccctctactctcacagcaatgacctgagagtgttgttccatgtgtctatgtctatgtctgcctgtgggacacagggttgagagtggagttggtgagagtgtgtgctgtgagtgggtgtggggagaggagagagacatggactcaccagcatcactcgtacagagtctgccatgagccccacatagggcttcaggatgtcatagtggaaggctggggtcagcatccgtcgatgctggaaccatgtctgcccattcaacaggagcaagccgtaccctaagagagacatgaatgtgtgtttgtgtgtgtgtgtgtgtgtgtgtgtgtgtcaggggctgcaaggagctagggatgactggtgacaatttgggagggagaaaggtggcttctcaaggggagaactatccagaagaagccacgtcatgggcaaatgcaggaaaaggaggtatatttcaggcatgtgaatattctgattgagctgctacatgcatgtgattatgacagctgtgagataaaagttgaaaagggttgtgggcagatgtaaaataaatgtgaggccaaggatgtctggagagaactgagacatgaaatagaagaagctgagcctcaggaaggtttgtaccagcattaggaaggggtgagggtcttgttagaagaaggaagtgaggcttgatttggggataaggtcatgatagtggtggcctctaatctgttgttctctgtgagccaaataaataactcaaacctgactagggagtgggctgcagtcctagtttgcacacataccaatccatggagccaggaatctgtaggaaccatgggatttcgggtctgaaaggcaagaaagggctttataggaaactaggagttactaagaaggcagtcttagaggctgcatcaattcttggtgtctgtcagttggcagtttgacccatgtcacctcccacttgactcccatccacttctatttctgtcctgaaggtcagtgtgggctcaggaagacagactcagtgttccagcaggaaaacatccagagggttaggaaggtgaattggtgagaaacataggctaggtcttcaatgacaatgaataacatagagccatgggtttttctacattgatgatttcctagtcacctcctgaccaagacaggcaacaattagagctttgaaacccaggtcaatgtgggtatgaaatttgttttacagatctgggacaatttacatttcagaaaacctcaattttcttaatagagaaatagaaaaaagaatagaaaattcagccccacatattgttttaaacattcggagttcagtaactatttttgactatagcctgggcatggtgggcttggtggatgcgtgggagaggtttcagatattgatgtttgaacagccactctcttctggaattttacagacccaggagcatgtgtcaagagggaagacacattgcagttgggatgggggttcgatctcacctgatctccccagaatcaccttcatatagtcagggtcatagagctggacacgaactttgcctccccatagccaatgaggacaggcacttgggaatgtctccacccatttctgaatccgttgtagctcctggtcctgttggagctgtcaacaagggtagacagatgaacactttcatttacttctagtctttgcagcaggagtgaagggcaggacaactacaggagccatgtagcgcaggttagggatttagatctgtttctgatgacctgagctgtgatccagattcttgctctctccccaggacttgaccttaggccaagcgctatgagccctcgctcaatgctgccagcagaaatttaagtcagccattgtcttcatgttgtgtaacatctctggaagtcataaatacaacaatttccatgggcaatgtgtataactcatattagttgataagtagatttgtaaaatcatttagtatatctagagaataaaatgaattaatgtaaacattttaaattacacaatgcctttatataatcatacttgttatattttcaatattatcccagcatatacggtaaatatttgttaagataaaatagcatttgggatgtgtattggtaagcaaaaaaagattaactataaaattgtgtgcataatagtattctacatgttgaatatgtacagatttatgggatggagtctgagtatatgcatatggtgctggtgttggacaataattttgagatttgggtttcttattctcattttcacttatcaacgaattatgagctccctgctgcctgcagtcatctttctaaactcttcgatgtggatcacaaagcccttggctttctggcttcaacttctcttttcttgcctccagccctgctggcaattccaccatcacccgtttgtttcagctccaatgccgatgccaccactgctgctgaatcgcacaccagctacacctgctcactcttctgggccctggcacttgctcttttctctaccttgaatgcccttcccctctgccacagagcagccacctctcctcagctttcaagactcagctttgctttaatctcatctggaaccctcaaagacattgggtcctagtgatgttccatgtagccaactcttctttatttcaactgcttctagtaaatcaaagcaactgtctaccacataggtatcgaatatctgcccatctccttctgataatcatattgtccagctctgaggcagcttgccctactgtggggtaggctccttcattcagcccatgcttactgcacacatactatgtgcccagtgtggctcaggcactgcgttaggatacagctgtggtccttatctgtgtggaattttcagtctagttggggggtaagaaagattagaggctgtgcagtaggggataatggacatgatatggaatgaaggacaagcatctggggaagctttgaagagggacctaactcagaactgaacattagaaagctcttcctcactcactgagtcatcatttactgagggactattgggttacaaacataaatcagagatggtctctcccagaagaatcccacacttatgacactgcagaacaataactgagtcaagttaacactgctctggcctcttgagaaggatagctcatggaaaaaagagtcagcccttcactactgggagacccaggaggccttcttgaaggaggtagcttggtgctgggccttgacagatagatatgcgtgagaagataattccaggtagcaagcatagtgtgatcagagacctaaaggttgaaatgcagaggcaggtagtgaggtagtgagtaacatatggtaaaagaggagaatgggaaagaaggcagagtggtattgggaccagtccatatagggttagaactttggcaggtccccacatttgttctgctctgctgagaactatgttgcctcctttgctgagaaacaataggcctcagttccctgcaacccctatctctacttaagtgtgttcaattcatagcaccttggtgagtccctctccatgcagccgtttacctgctctgttcctacccgcccccctccccttgtagggatagcagtgcacaggggatgggctgtgtccctcctcagccctcttgctgctcctttctcttcttcctctgttcctctacacctggtgtgtccaatcttttggctttcctaggccacattggaagaaaaataattgtcttgagccatgcataaaatacactaacactaatgatagctgatgaactcaaaaaaattgcaaaataatctcataacgttttaagaaagtttacgaatttgtgttgggccacattcaaagccatcctgagctacatgcagccccatggggcgtgggttggacaagcttgctctacacacctgagctgatcatcaagctgtgccaggattttgctgattgccggggcacaggaaggggatgacatgctcaccgccagggagctcacagtccgggtgtgtgggaggagagccaggaggtcaacacaccctgttcaatgtgcaactcaaacaccagtctcctcacctggagaacattgtgcaggctgcccccctcatgtgtacccataattgtcaggttttcagatcctaaatcacctgttgtggaaattccgtgagtcttggggaaacttacttagccagttggtcccctataccagcagatctctgcctcagatatccaccccagcagagtgagctcctttcctgcagtctgacaccttctcaaattcctgcctgtattcttcacagaccataaactcctcatggcatggattcctcagatgggtgtctgtgctccctggcaaacacagggccaggcagagtgatggcattgagtgactgggcagagagcatctagaagccttgttctttgatgaaagccaaggcttatggggtaatcagtctggagacaatcaggcattgccctccacatgcaggactgccaagacacacttgatatctgcagaaggagggcacgggtgatagagctgaggaccagcaggatgggcttcatgggagaagtgagctcctcatgactgggaaaagctgagaccagagaggtaggctgggtgttcctttgagtcctcacatttgttacaaaacaaggctttgctctatggattttgtgaccagggtctcagagccccatccctctttgccctcccactcccccattgagttcctccctacctcctggatgtgcccgaagagccagtgggagggagggcacgggaactgctggagggctttgagcagccactgcctgtgcaggtagagctgaactgccttgatcagcagcagaagcagaatgagcagggaggccgcttggaggattccagagacatcacccaggagtctgctggggctcagcacagagacactcatggtgcagcacctgctggatctctgagtgcccctacctctctctgaccacccccgtccccctgtgctcaaatccagggaggattgtcccgcccacttgtggggagagtgaaggaggagggcagaacttggacctcagagttcagaatcaattgactatggatgatccacctagggcaacagtgggagaaaagcttcatcagctgtctaccacattcccctgtccatgtacctcacaaatatttaatgagcatttactgtgtgccaggcagtatgctaggtgtgtgggcaccgctgcgaggaaaacagacttgaatgctgacctcaaggaatttgcattctgctttactacattgcaataatgttcattcagtagcactttttttttgttatgtgttcaaagaaaattctcaacatgatatgtacatttaaacttaacattaaccaagccctgaatcattacttttgtcttattgcaaatctaattttatttaccataaaaaccacttccatctatatattgagtgaagagtgggaattatgtctttctagtaactggatgatgatatggacaaacagatgctaatatagcagctgttcaagtactttattttattccattggggaaactggtctcataatatgcatagcatgattttttttctcaattcatatacatgacaatttaaaaaaattctacatcatgttaggtatgactttttcccctattgataggtctaccttttctaccagagtaagtcctagagcaattttagtcctacttcagtctagtactatagtcacagcaggagcctgtttaccaattctctttcaccctacaatagtatgtaattacacaatcagaactttgcactctgtttaggagtcctgaccaaggacaatctgtactaaacagaaattaatatttaaaaaatgattgctttgccaacctcaagtaaagtaggttaaatagcaactgttgctatgaattaaccctccctggcatttttacatgcatatctgtgcatgagcattctttttttcctctttttataatttcaacttttattttagattcaggtacgtatgcaggttttttacactggtgtattgtgtgatgctgagggtttggatacaaatgattctgccactcaggtagtgagtatggtatatattagtcaaatttccaatgcttactcatatctgtacctacccctttagtagtccccagtgtctattgttcccatatttatgtccataagtatccaaaatgtagttcccacttataagtgagaacatgcggtatttggttttctgttgctgtgttaatttgcttaggattattgcctcccaattcatccatgttgctgcaaagaacatgatttctttatttttttatagctgtctagtattccactgtgtatatgtatcacattttctttatccagtccaccattgatgggcaccaaggttgatgccatgtctttgctattgcgaatagtgctgtgatgaatgtatgagtagaggtgtctttttggtagagcaacttattttctttttgatatatagctaatattgggattgctgggtcaaatagtagttctattttaagttctttgagaaatctccaaactgctttccacagtggcggaactaatttacatttccacaaacaatgtatacacattatgttttttttctgcagcttagccagcatatgttgctttgaaactttttaataatagccattctgacttgtgtgagatgtggttttgattcacatttctcattagtgatgttgagcatttttaaaaatattttttggctgctcatatgtcttctttagagaagtgtctgtgtctttaatggggttgtttgtttttcgcttgtattggaagttctggccaggtaagagaaagaagtaaagggtattcaaataggaagagaggaagtcaaattgtctctgtttgcagatgacatgactgtatatttagaaaaccccatcatctcagtccaaaatctccctaagctgataagcaacttcagcaaagtctcaggatacaaaatcaatgtgcaaaaatcacaagcattcctacacaccaataatagagaaacagaaagccaaatcatgagtgaactcccattcacaattgctacaaagaaaataaaatacctaggaatactgcttacaagggatgtgaaggacctctacaaggagaactacaagccactgctcaacaaaatgaaagaggacacaaagaaatggaaaaaaattccatgctcatggataggaagaaacaatatagtaaaaatggccgtactgcccaaagtaatttatagattcaatgctattcccatcaagctaccattgactttcttcacagaattagaaaaaactactttaaatttcatatggaataaaaaaagagcccccattgccaaggcaatcctaagcagaaagaacaaagctggaggcatcatgctacctgacttcaaactacactacaaggctacagtacccaaaacagcatggtgctggtaccaaaacagatatacagaccaatggaacagaacagaggcctcagaaataacaccacttatctacaattatctgatctttgataaacctgacaaaaacaagcaatggggaaagggttccctatttaatatatggtgttgggaaaactggctagccatatgcagaaaactgaaactggacccttccttaaaccttacacaaaaattatttcaagatggattaaaaacttaaacttaagatgtaaaaccataaaaagcctggaagaaaacctaggcaataccattcaggacataggcaggggcaaggacttcatgtccaaaacgtcaaaagcaatggcaacaaaagccaaagttgacaaatggaatctgattaagctaaagagtttctgcagagcaaaagaaactatcatcagagtgaaaaggcaacctacagaatgggagaaaatttttgcgatctatccatctgacaaagggctaatatcgagaatctacaaagaacctaaacaaattcacaagaaaaaaacaaccccatcaaaaagtgggcaaaggatatgcacagacacttctcaaaagaagacatttatgcagccaaaaaaacagcaaaaaaagctcatcatcactggtcattagagaaatgcaaaccaaaaccgcaatgagataccatctcatgccagttagaatggcaatcattaaaaagtcaggaaaccacagatgctggagaggatgtggagaaataggaatgcttttacactgttggtgggagtgcaaattaattcaaccattgtggaaggcagtgtggcaattcctcgaaggtctagaaccagaaataccatttgacccagcaatcccattactgggtatatacccaaaggattataaatcattctactataaagacacatgcacatgtatgttcattgcagcactgttcacaatagaagacttggagccaacccaaatgcccatcaatgatagattagataaagaaactgtggcacgtatacaccatggaacactatacagccataaaagaggatgaggtcatgtcctttgcagggacatggatgaagctggaaaccatcattctcagcaaactaacacaagaacagaaaaccaaacaccacttgttctcactcataagtgggagtggaacaatgagaacacatggacacagggaggggaacatcacacacagggacctatctggcatggggggttaggggagggatagcattaggagaaatacctaatgtagatgacgggttgatgggtgcagcaaaccaccatggcacatgtataccaatgtaacaaacctgcactttctgcacatgtatctccgaacttgaagtataataaaaaaatgaattgtttaatttctttagggattctggatattagacctttgtcagatgcatagtttatgaatattttcttccattctgtaggttgtctgtttactttgctcaagtttcttttgctgtacagaagcagtttaattaagtcccacttgtgaatttttacttttttgcaattgcttttgaggacttagttataaattctttctcaaggctgatgtaaatcatcatgtttcctaggttttcatctaggattcttatagtttcaggtcttacatttaaacctttaatcgatcttgtctttttttttttttttttttgatgttggctcactgcaagctcagcctcccaggttcatgccattctcctgcctcaccctcctgagtagctgggactacaggtgcccaccaccacgcccagctaattttttgtatttttagtagagatggggtttcaccatattagccaggatggtctcgaccttctaacctcgtgatctgcccacctcggcctcccaaagtgctgggattacaagcgtgagccaccgtgcccggcccctttaatccatcttaacttaattgttatatggtgaaaagtcagggtccagttgcattcttttgcatatggtcacccagttttcccagtactatttattgtatagggagtccttttcccattgcttatttttgtcaacattgttgaggatcagatggctgtaggtgcatggctttatttctttttttctctttttgtaaaatattatttgttaaatttttgattcagagggtacatgtgcaggtttgttacatgagtatatcgcatgatgctgaagtttgggctcctagcccaggtagtgaacacagtacctaataggtagcttttccatcctttccccctccctccatcacatccctttttggagtcctcagtgtctgccattcccatctttgtgtctatgtgtatccaatgtttaggtcccagttataagtgataacatgcagtatttggctttctgttactgtgttaatcggcttagggtaatggcttccagctgtatccatgttgctgaagaggacatgatttcattcttttttttttatattatacgttaagttctaggatacatgtgcacaactcgcaggtgtgttacatatgtatacatgtgccatgttggagtgcttcacccattaactcatcatttacattaagtatatctcctaatgctatcccaccaccctccccccaccccacaacaggccgatgcgtgtgcccctacctttcctactgatccatacctcctgggtcctgactacgactttcctgaaagtgtagccccaaaatcctccttacttctgaatcgacttcctctgatccctgcctcctagatactaatgcttcaggctttcacttcctctcccaagtattagagcaggttgtatctccaaagggatctaaggaagctc

SEQ ID NO: 1351 - DNA, 20001 bp, Homo sapiens
tcctttcatttcacttgtatctctgtacttcaacagcctcccaacaaggattctttcctagaggccacctgaaatgcccttgtccaccgtccttgcctgggtaactcatactgtccggtaagacaaagcacagacatcccctcccccaggagccttccatgaccttccacccaaaaccaaggaagaggccttcttctggagcacaggggcttacctctggccatattctccatggaactgtgagtcattttggaagggaaatgcatcgacatcacataggggccatgagtgactgaaagaacatattattaaaatctgtgatgaattccttgctttctaggacacaggagagttgctttgtctcttcaacagcattctaagaaaagatgaaaaatacaaagaggaagagaattgaaaggaggagatgaaaaaggaggagaaaaagaaggatgagtctccccaccctacacctactctcccagatgccccaaatgactttttctcttcagatatacacctgggtattccaagtccttccactctcaggcctctgtctactgccaggacctcaatggggctcatggtgatgtcacattaacctctgagaaccagtctcaaaggtcaaaaatgcttcctgatctccccagcttaccttttaaaaacttttcaggtatcaagcatccaaaacctatataaacatttgagacatttttgattttagccaaatattcttcttaggaaatgacttaaacctaccccttcaagttaagagattgaacataacttttttttatactttaagttttagggtacatgtgcacaacgtgcaggttagttacatatgtatacatgtgccatgttggtgtgctgcacccagtaactcgtcatttaacattaggtatatctccaaatgctatccctcccctctcctcccaccccacaacaggcccctgtgtgtgagaacataactttaaattaaggagaaaggaagggaacatcatcatatttaaagacccttgaatttggtcaacttcagcaaacacagaaccaccattttaaggaaatgggggcttctttcaaagtaaatcttttcccattttcaattaaatgagattttcctctactcccagctctcccacatccaccttctgtattccttcattaatacatttaccccatcaataatcatttgtcttccatcatcttccacttactatacctatggcatagtacctatcctctaggaacttataacccaggaaaaaataagatctatatataaatatctggaaagtcctaatttcaatagtaaatgtcatatgaataatataaataatagataccatgggagtgcataaagaggtggattcatttctggtttagagtaatcaggaaaggctctcagagggtggtagacatgagtaaagctttgcagaatgcttaggattcccacaggcacagggagaacacaccaggtaaaaactaacagcccaaactagaaagtagaggtagagaaaactgggtgtgtttgctttgaaacttttcctttcatcccctgacttttattgacttgagttctaagaaaacgttttccagaaggcaaagagacaagttaactttgttccagcctgttctcctggtcactatgaaaactctgtgagtaactccactttcataagggtgtcataaatcaaggttgagaagatgaagattgtctgccttctccttcctctctcttccccttcaccccacttcacaacccaagagtaacaaatgaaccgcaatttccctcaagaccatcacgcaggaaaatcactctcttcagcaggctgaaagccctttgttcgcttggaaccacaggacgagccttcatccttgcatctgaagggtgactttctaggcttgatgaagaagtgtctgcaacaggccatacaagcccttgacccagagaggccccaggccttaggcataaaatcttcccattggtgaagatgagatgagcaaggtggatcttatctctcaccacatcctgtaccagtttgggcagacaaggaatcctggttgaacagactgagataacactttatgaacattcttttcctgctgcctctgatgagagagatctgagagaagcccctccctgctgaggtctggtgaggacccacaggccaaaatgcagtctgattaacaggcatcccaagcagtgactcaaaccatcggcaatttcagaggaagcttgttatggtgactccacaattaataccacagcccatgtgaccagtcagtcccgcgggaggctggactaagcaacatataaaagtcccaccttgctgggcttcacagtccacagcctttgttgagtcttgttgaagatcaggtaagtggggcatctgtgccctctctctccctgttactctgtctttaggcggccgctgttctgttcctcttatggactgtactttctactgattttttaagtggtttgccatttcttgggcctcacaaactatcctgtatattctatccagactagaatttgcctatctagtctagtctcttgcacctgattttcaaaaggattcgtagactagaagagaagggaaaaaaacctgtggtaagactggggtttggagctatggatgtctagacagaggccaggagaacactcccactttggagacaggtgccacagggagctgcagccaggatagaaaagagaaagagataaaaagcagccaagaaattagttcttacttccactcctcattccattccattagttcttccatccactcctcattcctctttctcaacccttcattccccagttcccatgctgatatttttaatacagataatttcgaatcttgtgtttttttcaggctctgcaaatcaccctaggatgtccttcagtgagcagcagtgcaagcagccatgtgtgccccctccatgcctcccaaagacccaggagcagtgccaagcaaaggctgaggaggtgtgcctccccacatgccagcacccctgccaagataagtgtctagtgcaggcccaggaggtatgtctttctcagtgccaggaatcaagtcaagaaaaatgcccacagcaaggccaagagccatacctacctccatgccaagaccagtgtccacctcagtgtgcagagccatgccaggagctattccagacaaaatgtgtggaggtttgcccacagaaagtccaggagaagtgctcatcccctggcaagggaaagtagctgctcatatgtcatctgggttcaagaagatggccagcagatgaaaccctgaccccagcccacgctctggtgaccttcttctgtgggtacctctgtgtgcaatgtaccttcttgcctcctggcttccttagcattccaggacttggtctgtgtctctgaagacagttctttctgtatttcatcaccctctgtgaataagcattgttctcagcagtctgatggaaggtctcaaatgtaggaatggtgtggttgtcagggaagaccacagaagcctagcacagcttccttggtgcaaaaattcacccagctctgggtgtgtaacagccaaggataccttcattcatctttcagagtttcaggctctcaaataagcctcaaaacaaactgaattctgatggactttccacttatcaccaccaccaccacctccaccaccaccaccaccacaggtgttgagacaaagcggcttgcggtgtttcaaaaatcaaaaatttggtgattttgtctctgtacactaaaaagaacagcaaattattgaactttgaaatgttggttgtgcttttttaaaatgaaccgaaagtatgtaaacgattgaatccaaacaaccagaagggaaagataagatggatgtttggtgcccttgtcaatctctgtgcttcatagctggtctaatgtgggcccttagttctcaccatgtacactctttagagatgtgatttgtgtctgtgtgatgcaggctggtctgttctccagcttccttgccttcttctccctggtgaaggtaaaatacataataaagctgatcctaaggctgatatctgacttgacgtgtgctctcttttctccaccatcaaacccctcattgtccttgtgacaactgtcttctcctttggtgggggaggggagtaatctgaaacaggaataaaacacagacctcaccggtgcataaaacagcagttctgaaagaggcttcctgaaggtcactgagaccaccccacccacaacatatcctaggttcacccacttgtgcacttcacacatgagaaaatccagcaaggggctaggacctgcccacactcaaaacctcaggtccaggttctttctactacagcatctttcctctctgatccttgctttccaaagggaaaggctgaaatggaaaggaggggagatgtgtggaagagggatcccaaatcaattcataacacctacaaacatagcatctgtgtcaaaggagagagcaaagcatgcctctgagattaatgcagactcgaggaccaaaactgtctgccctgccatctggccaggtttcaggtaggcctggggcctgggtaaccggcctgctgccccccacccatggaggaaacacaggcagtggccactggggtttgtgaacgggtggagagggcactgtactgacatgaaataaccacaggctgctccctcggcagtgccccgagctccgacctgagcccaaaggaagctatgccaaggaccagcttcctaggggggatgtagcttcttacccattctacaggtgccccctcccttctcaatcctcatgaggaagaggtggagggccgggacagcccctccttgtagggcgtgtagagctctatgtctcagtcatttggctaaactgagggtcactgagtctgtgggtgacatggaccaggccctgaactccatgcacattctctatggggattctaacagcagccttggggagttcctgtgctgcccatttgcttaggaacttgtcctaaagccagtaagtggtgaagtcaggatgctaacccaagtccctctgactccagaatggagctctcacttttgtaatgaaagtgctatggcatacagaagagatttccagaaactcattcattcatttatccacctaaaacatgctccctgatacctaccaggtgtcaggcaccatgccaggtactggagagacagtggtgaaccaggcagtcagtatccctgtgcagagttacgagctgtctcttctgcaggccacatgcaccaaggatacctttctgaaaacctcctggatatctcaagtccctgaacatctccagatgcctgaatcacagttctcttgcctccttgcctagtcgaaataggttttctcatccattttccaaccttggaataaaccagctgctccccagggccagcagctcccagagctccatcctgcggagatgtgccagagaggccttcctatcagtgaagcttctgttcacagactcttctccagcttggctcaagtccaagaaacatctttgttctccagcatcaaaggcatgcacagattggagtccaagatcagacacccaggcattaaaggaagcacgaggctaatgaacagggagagtccagacttatcagagagaggggaaatctgctgattacaggggaggcctctacggttaggaaggggacaagtctgcagattgcagataggagagcaaacgccaagcagccagcaggccttcatctagctctgtcataggaacctccacacctcctcatcctcacagaggtctgccccagccactgcctgggccactgctgctgcagcctggtctcttaagacacagaccaggtccacagccacagaggccacagggacagctaggacacagcattcagacttccccagctgccgcttctgtgctgagcctttcaggaagtagggaggggccttaccaaggaaagccctggatgttaggggttctagctaacagttaactcaacatgagacaatagtggatctgtgggccccatatgccaagaggaaaaaatacaaacagacaggaattcacaggaggagctgtggattcactcaatcactcaaaatatttatggagaaactactatgccaagccagactctggaaacctgcgacagtgccaggaggtgggcaagcagagcagtggcctgaaagactttcacatcaggaagagttgaaaaatatttagtctacaaaagaaaatacccaagggagtgggacagctgaactcaaatattttaagtgcttttatgagggaggagtgagatttttgtgaagtgccaaagaacaaagttaggacccatgggcagaaatcatgaaattgggctcagtttaagaactttcttataatgagatctattggactgcgacaggagctgcctttagatgcactgtgtcccatgaactggaggtttgcaagccagtagatgacaaccagctcctcccaatccatcaaatactgtgactcctctaactgtaacttgtacgtggaaatgggacccaggggcagggagcctcccacgaagggagattcagaagacctgaccgcaagctcaggagacaggaagtttccctggcttccagaacactgctgggaggctcttcggggggcccaaacttctggggaccagcagaatgtgtgaccatggcttgaaactaaaagaaaggaggaagacaggtaagtcatgggaagaggctcccccagatttggggttttcttaatgtttttggacccacaaatgcttcagccctgagaagcaccctacagtaattcctcactgctttctaatctcgttcttcccagctgggtttagtgtgctcgctcccttttacatctcatttatttaccatccagataccctttctcttctgtaccaaagtgatccgcctgttcttccacctgacaacccatcgcagattcctttctgccttcaccttcctctctcccacccaggactctcccctgtttgtctcagccaaaccaggggtttcaacctgacctccaggaagccctccatggtttcagcctagctcctaagtactgcagcttgggctctgtgctgcagtggccgcaggggtctgcagccctctaccagctgcctgtatttgaatgacacatgtctcctgtcagcatgagagcccagatgacagctcctggggctggctgtgttcttgcctgacttcacagggcccatcacagtgaggtctgagacacctgtacggctggccaccagcatgccccctgagcagagacaaagcggggtgctggcttctagaccacctggacaatctcttttattgatagggtaaccagctcatcttgatttgcctggaactgtcccaattttagcactgaaagttctgaatcctgggaactccctcagtccccgacaaactgggatggttggttgccctaagcacctgtgtgtataagacatgatgctttgttccaggtgggggagcacagagggaaagcagatgaggccctccatgctggaggaacttatagcccaagggatttttctggaaaactgtaaacccaggaggcctagttcccactgcctgccccctccatagccacattctccatgagcaggggtgggggcagcaggggctggtgaggggtgatcaaatactagatcaatgagcaggttcccagcctaggcctgtttcagcatgaactggcaggtcttgaccaggagaagtggtatcgtgggggccaccacccctattcgacagcagatctggacttgtccactcctgctctccttctctcctacggacacctgcctcacatctgaaaatggttgaaagaaaataagtggccagctggcagggccttctcaactcaacctccctcatcacccggttcccaagccagcctcataacctgtctttcctcctttagaagccgctggggaccgtttctcttctcttcccaacagcaccacctgctggccatagaggcacttggccttctactaatcacacccagtctggcctgagttggagatggccgcacacactccggccgtcagtgctccatgtggagaagacaagagtacagagatgcagcatctaacagagtcagaggaaggctatatgtgcaagacagagttacactatttatagggtgggagcaacacgaataatggttcaggacataggctcaggaatcagacttctggaattcaaatctagactccaccacttctattgttcccttaaaacaaatttctcctatgtgagagtaagtgacacagaatctcctatgagccaagcactggagttacagcagcgaaccagatacacagaatccctgcctcccagagctcacatgagaaggaagacagacaaaaagcaactcagcaaatgcataaataagaaagtgaaaatgaagaaaatgaaacaaagtggtgaggagagaccagagaagaggggtgctctttagctcgggtagcgtggaaaggccgatctgagatggggatgtcggagtagcgacatgaacaataggaggagccatccatgtgggatcggggtaagtatcagcgcaaagagaacagcaggtacagggagtactgcaggtcagactgcccctggagccttaactcggatgctgcatttgaaggtagaccctggccaacttttagttcatccaaattaatgtgagaaaaagagcgaggtctctgggcaccttgtcacatgagctgtggctgaaggaagggggcgtttcatccagagatgaggagacttagagacacacagtggctgtcttcaggcctgtcaaatgtcaaagagagaggcagtggatatattctttgtgatcccaaggagaatagcatggatcagtgagttctgggcacagaaaagcagattctgctcatatcaggaataaaatggcccagcaaatgaaatgagctgctcatgaagtagtgatcccaccatccatgaaatatgcaagcagagaccaaataagtagctgagattataggaagtgtggatgcaatgcttttaatctttaattatcacctactcttgcacttgaattgcttataggttaccacaagattttgcttctctctgaatacagtaaaatagcctttgtcagccagtccctgaagggatgtccgccccagggttggggaacatcacagcaaggcaggagaaaactggctgttgggtacagaacacgcttcttgtcaaacccggagcagactctggcaaagatgaaaagcggaggtcctcacctccctttcatatgctccccttttctgtcccagcaccagaagatggaacttccttttccttacaatggtctaagaaaaaactagtctaagcaattagagaaaatatcctacaattcccaagtcctaaaagtttttatgttgcacatcctggtaataaaaatatttcagcctcaccaataaacatataaaaacggtgttcaacctctcattattcatcagagaaatgcaaatgaaaacctcaaagagataccacaacacaccgactggaggggataaaagtaagaagacagaatcacagtgtgggtgaggttgtgggagtgcaaattggtacaaccactttggaaaactctttgacggtcatgactaaagtagaatgtatacacagccaatgactgaacaattcctctcctaggcatctgccccgcatacggtcaccaaaactcaaacattagaatgttcattctagctctcatcaggcatccttgtgaaagtggcatcacctttaaaccctgcatggcaacccctgacacactgccaggctgcccagggaatacagggcaacctggaagtccaactacttccttcagatcatccaatttttcaatcattatctgaaatgtttcattgtagaagcagcaatgtgggctccaagtagatgcagcagatccacatgtccctctgagggaaagccatggtgccaatgggcaagaacaccatgatgtgcaaggccatccaagggcacctggaaaacaacccagctctggaaaaactgttgcctcatatccagggaaatgtgggctttgcgttcaccaaggaagacctcactaagttcagggacatgctgctgaatagtaaggtgccagctgccacccatgctggtgccattgccccatgtgaagtcactgtcccaggccagaacaccggtctggagcctaagaagacctcctttttccaggctttaagcatcaccactgaaatcctgagtgatgtgcagctgatcaagactggtgacaaagtgggagccagtgaagccacactgctgaacatgctgaatgaacatctctcccttctcctttgggatgattatccagcagctgtttgacagtagcagtatctacaaccctgaagtgcttgacatcacataggaaactgcattctcacctcctggagggtgtccgcaatgttgccagtgtttgcctgcagattggttacccaactgttgcatcagtacctcattctaccatcaatgggtacaagcaagtcctggctttgtctgtggaaactgattgcaccttcccacttgctgaaaaggtcaaggccttcttggccgatccatctgcctttgtggctgctgcccctggggccactgccaccactgctgctcctgctgcagctccagccaaggctgaagccaagaagagttggaggagttggatgagaatatgggatttggcctatttgactaatcaccaaaaggcaaccaactcagccagctttatttgcaaaacaaagaaatgaaggcttacttctttcaaaaaaaaatgtttattctagtgttattcataatatccaagtatcagaaagaatacaaatacccatcaatgaataaataaacggtggtatattcagacaatggaattccatacagcaatgtatacaaatgatctacagctacacacagcaataaggatgaatctcacaaacataaagtaagtggccaaaaaaaagacacataaaaaagcattaggatgaaacatatgaaattgccatttatggaggtcaaaaactgttcatagggttcaacataaaacacgctgtatagttccatttatatcatttatgtacagtacaaaagctggccaaataaatctctgttgtagacagtaagaacgtggttgtgtgtgtgttggttgtagtagcgtggtcattggatgggagaagaaggaaggtttctgtgttgctggtaacattctatttttttatctgggggctgcttatctggttgtgttcagtttgtgaaaattcattgaggtggacatttacaatatatgcacttttctgaatgcatattttaataaagagttgaaagttctattggggttcatcatataatacatacatattatttagaagcaatagatatgtactgtcattctaacatcatgaaagttaaaagacaaacacaaaatacagacaattttaaaagaaaagataaaaatacataaagaaaaaattcaaattttttctttctgctcccaatgaatagttttatgcaccctcagtgaacaatcagctcttctggagattttttataatgaagtcctggattacgtaaatgctgcatgatctttggcaaatctcccagcctcagtttctgcatctgtaaaattgcactgatgatcacccacccatcctagatggctgtcctcaggatcgaatgaggtatttgtggaagtatttagtaatttgtaaaatgtgaagggttaatatgattattactattagcagatagttactattaacatagatttacatgatagtgaagccaattctatagtaaatagtttggatttcattaaaagtagctagagatttcaagaggagtgttccccatcactaggatggcaaaactatctgccaaaggtattgtagagtgattcctgcaccaggaagagagtggaaataataatattaaaagtgataataatggtgaatattatgtggcagatattttctaagcactttatgtatattagctgctattataaccgttataacaagcaaaagaaggaggtcatattaatatgactattttatagacaaaaaactaaggctcaaagaaattaacctacgcgagatctcagagataacaattgagatagcctagtttagatgctcttcacattaccctccaaagctgatgcgagcattcaaaatctattcccattcagcaaagttcagtctaatatcaaggcaaacttcctttcattaatctattactcagcaagtatttttgagcccctattacatgccaagctctatactgggtattgggtatgcaatgataaataagcaaacacagtccctgcactcagagcatatgagctagtaaaagaggcaatcaatataagaaatacacaaaaataaatacataattctaaattttgttacattcaacaaaagaaagttctaggttatataaaataatgaattggagaacctaatttagattagagatcaggaaaatcttccatgagaaaataaaatttaatctgaaactggagaggtaggaggagttgtccaggtgacaaaaagaaaaaaattatagtgaaaacaaaagatggttctgatataggaaaagcctgattgttgtctcagacacaaagatagagagtgagagggactgtgtccccagacagggacaggaggtgtgtgggcaggagcagaccccacaagcctctgagaccacgtgacaggttttgacttttgccctaagagtgaagcattaaagatttttaagcagagagtgacaagattcaatttgcagattgtaaatattgctctagttaaagtgtggagaatggattagaggaagcaagcaagaggtgaagcgggagccactggggacaccatggctatagccaagtctctgtgcagcagcagccaccatttccagaagcagctgggaaagactgaaggaggaacaggtttgggtgcagtccaggtaagaagaccaggggctcagttttgaacctgtcaattttgagacgcatacagaataaccaagcagaaatacaaagtaagcacttacatctatgagtcaggagcgcgggaaaaattcaggaatggagatctacacttgggagccatcatcgtaggggtagcattctagctttggggtgtatagatcatccagtgacagaatatagattaagaaaagaagggaacttaagaccatgccctgagaaacctcaacagctaaaggttgagaagagagagagcccttggcaaaagattaagaaggagtcaatgatttaagagaaaagtcaggaaggagagagtgtgcaaaatgctgaatgccactgaggatcaggaagtgcccacactgagtgacaacatggagagcaggcatgggggtgggagggtccagccaggctggtcacccagggattgctcaaatactggaacctcttcccactcacttctcttcttctaaggcacagtggtttgccattagatcctggtacatgggaataagtgagtgaatgaatgataaatgatctgaggacccaaaaggtttaacagcttgaccaagattatccggccagtaagtatcaatgccagagctgaaacccagctcatctgattccaatgcccatattcttggtttaaaaatacaagctttaacccaggggaaatacctttgatgacacactctctgtcatgtttaatatcatactttaaggactattatacttatctctaaaactgaatctatggcttaggagttcatcaaaaactagggtagggagtgagaggcatcccctaaggtcgcctatccaggggataatgcatgaaggaataacctttacactaaatgaatgtatagtttgggttacatccttgagaccctgtctcaactgacgagcatgtgagagtctggccactcgccctgtagggccagctcagaggggagcttggtgttctggagttgtcggtcaggggtgatggtggtgactgtggtatcgtgggggccaccaccgccattcatggttgaaagaaaagaggtggtcagctggcagggccttctcaactcaacctccctcatcacccggttcccaagccagcctcataaccagtcctccctcctttagaagccgctggggaccccttttctcttctcttcccaacagcaccacctgctggccatagaggcacttggccttctactaatcacacccagtctggcctgagttggagatggccgcacacactcgggtccagtcaatgctccatgtggagaagacaagagtacagagatgcagcatctaacagagtcagaggaaggctatatgtgcaagacagagttacattacttatagggtgggagcaacacgaataatggttcaggacataggctcaggaatcagacttctggaattcaaatctagactccaccacttctattgttcccttaaaacaaatttctcctatgtgagagtaagtgacacagaatctcctatgagccaagcactggagttacagcagcgaaccagatacacagaatccctgcctcccagagctcacatgaggaggaagacagacaaaaagcaactcagcaaatgcataaataagaaattgaagaaaatgaaacaaaatgaccagggaagaggggtgctctttagctcgggtaatgtggaaaggccgatctgaggtgagagcaacagaaatgatgggttacatgatggtggcaatggcagcgtgctggaggtgagaggaaatctgagggaacattttcttgaatgtgaattgactgacaaaagtgtcactgaacacattacctttgattcctaaatagccagaatgacaaagcctatctgtagattactcattgtgttctcattcatttattttttcattcaacaaatctttgttgagtagctactgtatgccaagctttcctttaggtgctggagatgtagcagtaaacagaccaaaagtgctgtttttgtggagtttacacttagaggacaccaaaagctcatttatccattcactgagctcctgctgagcacctaatgccaagcatgatgccagacactgatgggtcccagaccctaaacaatagggctatcttggggtgggcacattgtggccagggtgaatatgcacctgcatctgtttaggtttgttcacaggcataaacacacacctgcctgagcatgtatcccatcaaacctcagacaacatgtatatactgttcagatgtttttcaaaatgcatcgggaagaccccgaaggggtctcagtagaggctttttatttgattcaaagcttcaaaagattattccatctgcaaaatgtataaaggctggatgttggaggaagcatgaaatagggagaggaaggacctgctactagagttatggctaaaggtggtagatggcagcagtggagacaaagacaagagggtgacgctaagtgttttggaggaataactaacaggagtagcagggggactcaatgtgtggggtaaaggaggagaaagaaggcagaaatactcccaagtttatggcttaggccactaggtggatgcagagaggtgaggactaggagatatgtgggtacatgtctgaagctcagagatatctgggccaaaaatgtacatatttgagagctgtcatcacatagaaggtatttaaagatatgtgagtggctgagatcacccaaggagaagaagagagggccctaccgagctgaggactccacaagatctcaaggttggacagcgcagaaggagcctgtacagccagctgacaaagagcggtcagtgaaggaagagaaactaggagggtggagactggaaagacaagagaagacaggtgtccaagaaaggaaggaaaatcaatggagtcaaccaatactaactggtcaagaaatgcagagtggctggtgaccttgatgaggacagcctgagtggggacacagaggccagaacagaacagagtggactgaggagcaaagggaggtaccaagcagggcagtctgtggggttcctggatgcagctggattggtttgctgctcaaagaaaatcccagctcagacctactctaggacagaagaggccttcatgaaagatgcctggctgcaggtgtccaggtgtgggaaggtgagtgggaggaggcaggactgagcagcacttccccaaaccaggagggaagccaacaccgaagcccaggcttccatttatagagtttccacaagtggacccggactactccaccctgttcacaaagcaacctcgcctgaacctttgacaccagaggctgagtcaggcccagatggcaaacacactttaagccctaatcagactttgcatgggtttactcagcccatgcctgcttctctgcccctaccatgtcctcctagaagagggagcacctcttccccgtcaccccccagagactcacctgcatgaggttcacacactgcactctctcacaccatataccacacacacacacgcacacacatacatacacaaagtcagtgtgatgattccagatgctggaaccatgcctccccttgccctttgccaaatgcctgccatgctggccacagaggcagaaggaaaatgacaattctgcccttttgtaatgcatgctactatttttgtccatcacaggttcctcaatttgaggcctaagtgttcctagacttcatccggtgttggaggaagcccttgctgccagggaagccccagtgtgaagacaggacatagcaaacctcagggagaccccgggatgaggaagaagacagccccaccctctggagcctgcagagggaatgcagtggagagacacagtcctggccttaaggttatccccagtttgaggagaaagaaaaggtccctggcctcagaagatccccagtgctaatgtccccacaaagtgtgagggtctccatcgtacgcatctctgtcctcaccctctccggacttggattttttaaagatatagtacaaaatacaaaatgaaaatcacatccaacttactcacctttaaagagccctgatcaaaatatgacaagtgtgtttctccagtcatatgttgagtactcacctgaagtctaacccaggctggagttaaaacatcgactctgacactccagtctttatatcatcatatctaccaccaacacatcacccacgtttaccttgacccagtttcaaatatgagaattttagattcagaggcagagcaggggtcaagaactggcgtagagccaggctcctcagaatgtggcctgtccctgttcacacggcccaggcaaagcctcaccagggaaccatgctccagctccctgccccactccaatcctgcagaccccaggtgacattcctgaggccacacagcctgagtaatgacacagcttagtggagctgactcatggaaagagttgccccatgtgcatttggaggacaaggacagttgtgcaaggtgtttgtgacaggccatgaggaggggcaggacgtgaggcagcaagaagtaccagttggtaattgtcattacttctactagaatctccaggtgacaaatctacctcagtgcccatagccctagatgttgcaaagcaaagcagcacttccacccacggcctcaaagagcattaaagagtcactctgtttcagctcacatgaaatcaaaccatcagtccatctgactgccctctggatcgcagctcttggctaggtacaagagctggggatatgaggtcttttcagcccccttatctgtgaaagaatgggattgcactagatgctctttatggcttcttccacctatgacatccagtggttctaagcaggtctcaacagggaccctgaagtatgtcatacatatgtgacacaagaggggaacccactcagagcacccaagttcaaggtcccaagaaaggaaagcccagtctccagctccatactacaggctagtggcaaatccctggcacaaagaatgttggcagtcaaatacaaatgtgaggatcgttcatcaaactggcatgctgtgtccattcatctattcattcatttgataagcatttaatgggagccttctatgcctgctatggagccagctactagatatgcagaaaataatagacaaagccactcccctcaagggcctcaaagtcaactggcagaggcagaggcagaaagaggaagaaaaaaaaagcaacatgctgaaagaaatacaatgttggagaaatgtccagcttaaaaggggccaggagagggattgccaaggtgagcgaggaatcaaattcactgaagacatagttgagctgttaacacttaaaagaaactggacttggaacccccaccatcaacttggactctaattcatgacatatatgacctttgtactctctgtttcctgacttataaaatgaaagtactgaagtatgtgcccacaaagcacagagttctgaatactaaaaaaattaatatagtagctccaagcttaagcatggactcaaaaacaaaatataattcaatctctacaggtcaaaatcagccatgggctcaagcactaagtaagctcaatccttaatgagtggcaacattcaaatctcagtacaactgcaacattttaagcatttaagtgttagtaaatgtcttagaatttccttgataattatactaataatataataacactgttagattaaatggatttgtgccttcctgccatgcgtagttgaaagacagatgatgtagctctatatcatgattcaaagtctcaagggactaggtcctagaacctaattagtcagagagtatgggtcaacaataattgataattcatgaaaatggctaccttgggtaatttcctccaaaattcaattgactcaataattccatggagcaaacctgtacattgtcctggaaagagtggcaatagagattgtaatgggaaaccatttgcagctaattcaaaacaaaggaatcctgagagaaaccctcagctcatgatcaggggagccttgtacagaattttctgaaaccaagcaaatgatttgctttcaggacaaaataatctgtttgtgctgtgaagcaggagattggggattcagccaaggacctctgtaggggacacagctgaccctaagctgcttcctacagaaagcccaaccctacctgtgggtggagcaaaggcctggccccattcagaggcaggtagctgtccatctagaagagtgcactggtttgacttctcaattttcatactagattatcaaccctgctacctattcatttgatttccaaagcatatgtaaatacattcaacagcatcttcaagagcttcaggcatgtatctgagagtgtaactcttaatcctcatgggtccagagctcatcagaaggctcaactgaaagaataatgactaccttaactaacagtgttgattatttatgatgtgccgtctcatctaattcatacaacagctctcttcagcaggtacaatcatctcctccatcgtgagattaggacaccaccctgaagagatgtcagcgtcagagaattagagaagaggtgtagacaggatttgaacccagcagtttgactctaagcctttactcctaaacactgggaatggtagtctaaggaagtcactatctagatactaatcctttcctctgagttctatccatgagacaagttagacaactgtaagactaaatagtcaactgcattaacctagttgctcagaaaatggtcttccttggactgaaacttcatgtgttgacctgagattttatgctagtattaatgaaaattggccatgaaaaactacttccacatgttaccacactcttgatggatacttggtattccgtggcactcagtatctcctctgtaaggtcctactgatagatatttcttagggagaaaaaaataagattttccctagctactgtgaaag

SEQ ID NO: 1352 - DNA, 20001 bp, Homo sapiens
aaaattagtggggcatggtggcacgcacctgtaatcccagctacttgggaggctgaggcaggagaattgcttgaacctgggaggcggaggttgcagtgaagcgagatctccccattgcactccagcctgggcaacaagaatgaaactccgtctcaaaaaaaaaaaaagagatgcttctaaatttttcctgccatgtggccacgcagctgtgcttgactttttgtgagaatgtggccttccattacttcccaaggaaagcccactcttatctttggacagctctagaaattaaaaagttcttccttactataatgagcaaaatgattttgttgtaacttctactcactgtacccccttgtgttacacagaacaaatctaatttctggccctcttgacaggccttcagataactaaagacactgcttagctcatgcctatgttttcttaaaggtatactatttcattcgaatttttttttcctcagggtttttaactttttcaaatttggaattccttctccatcctggcctttttatttttatttttatttttgctgttaacctatttttattttgttttatttttattatattttaagttctggggtacatgtgcagaacgtgcaggtttgttacataggtatacatgtgccatggtggtttactgcacccatcaacccgtcatctgcattacgtatttctcctaatgctatcccttccctacctccctagcccccaacaggccccagtgtgtgatgttcccctccctgtgtccatgtgttctcattgttcaactcccacttatgagtgagaacatgcggtgtttggttttctgttcttgtgttagtttgccgggaatgatggtttctaacttcatccatgtccccccaaaccactcgttttttaaatagcatatctccagttttaaaatttgggacccatgacttacttaccatgttcctcagatggatgtgtccagggagaatacggcaggaaggcagggttttatttttattttgtacaattaaacaattgtacttgtgacaggatgtcagaaatgatatttcaagatacagtggacatgaaattctgaagctggatcatcatatgaagaatttacaaaggaaatggttgaggatctatctgttccttgacttttggactctgaaatcatgtcaagggataaaaaggggccaggatatggagaggagagaggatctgtgaaatgatttatttgccatatttccccttcatagtggggaggcatgggaagcttacctcctcattctcaagcctaatgagaaagatacccatggaatcacccaggtaggtctgaaatgtattctctgcagtagggagatacagggaactgggcctgacttaggcttgagaaagttaaagtgagctatggtggtaggatagaagagcctattttaggattagccagccctacaaaagatccaggagccacatctatatatatttctgtggcctatgaaaaacagagtgcttgctgggcacagtggtgcatgccagtagtcccagctcctcagggggctgcagtaggaggatcgcttgaacccaggagttctgggctctagtgcactatgcccattgggtattcatactaagttcggcatcaatatggtgatctcctgggagcaggggatctctagattgcctaaggagaggtaaatggcccgggtgagaaatggagcaggtcaaaactctgtgctgactaatagtgagatagcacctgagaatacccactgcactccaacctggccaacacagaaagacactgtgtctttataaaaagaaagaaacaataacaataaaattaagaagaaagagacctagtatggggttgccttggttcctgtactatagggtcaccaggaggggcagataaaggcaccaaaaagctggagttgcatctatattcctaggggcagaggaaagaggtgcactggaacacctggaggagagatgcatctgccttgagcacaacaccctaaggaaacaattcccagaaataaacatccaaaaagtctacaaaaatgctcatgggagaacaagttagctttagccacctgtcaaattcagagagtagaaagcagctcagccaaataactttctgttcccttacctattctccctttcttccctctgctctcctactttggcctacgtgagaagcaaacagacgctaatgagaggaggaggggatgtggagagagagagagagagggagagagagagagagagaaacaccaatcaagtcccttccccaagtcaacaccttaaatggataagtaagaagacagacttacctttggataaagactggaggtctgattaacatctagaatgggcatcctgatttagaaattgaaactatacttgtagcctaaagtcattataagactctccattacctaaagaagcagaaaaatcatggctatttgcaaactttaatgtacacatgaatcaccagggcgctgggtgattcatgtgtacattaaagtttgccaatatccacggcaaatgcagattgtgattcagtggtctggggtggggcctgagagtctgcatttctgagaagcttctaattgatgccaatgttgaaggttcttgggccacactttgagtagcagggtgctgtgagccagggaggattacccacactgaatacattttaaattgattttgaaagataaaagagctacattttgatcaggtaatgaattgtgcttttaacatacaagttacactttatttaatttttcaaacattattatgaatatagtctatttgaaaacttcatactgtattaaaaaaatgttaagcctatttttcttgccatcctcccacccactccctcagtgggttatagatgtaaccactatttaacaatttgatgtgcactcttccaggccttttattttaaaaaagagctttttaagtatattattatattgatcaggattcaatttcagagaacagaattaactctagctggattaaggaggaaggaatttattacacagtatttaatagcttacaaaatggttgggagagatgaagagacagactgtagtttgtgttctcagcaaagtttcccaatatcagttcaacaagggagttgctgcctcttctgagatcagaaatttgccagccttgggtcacacagccattgctatgattaagaaaacagtcacgatagaagagacactgctattgctacggtgccaagaccatacctgtcttctatggtccaaggaatggatgctcagggccctgcccctagcaacacaaagctagatcctggacactaggtaggtactattgctggtaaagaaaaaccaaaatctttctcaaccaggtttccagaagcaacatcagctgcagtagtacagcctccgcttcacttttaccttccatgtgttgtataagggcttctgaatggccagacttaaattacaccaagcacctcactgcaggggagtcacggtcccttttacatttccaggctctgcagttcagaaaggcacttgagatggtaatgagtggatgttgacaccacctctacagacaacaaaggggttagtcctagaattttattgctggaaaagacttagggatttagtctaacttgttaatttgagagaaaggaaattgagacccagagagctgaaatgacttgatagtgatggaatagaaatagaactccagccatttacatggagttgaatgtagcctaacgagatagcttcctctccaggactcgtgatattctccagccccattgggcttattgcctataaacttaccagagagattgttttcatctaaagcacacctctttgctccccaacttttgtttatgcagttcattttggggaccaaaatgcaaaaccttataccttatatttatctcttttaaattatgtctttgttaatgtaataagacaatttttgatcccagtacagtccctcccagcttgtaacacatgcatattaggtaagcatatctttatgctctaatcaaaattacttttttaaaaaattgaataaagcagatgaaagaaatttgggtggagctctatctcactagaaatctatttcttgatcgctacctatctgtgttgtactcttttggtatgattgtttgaccaattaccagcctagttgactgttctctctctattttttttgtattttttttttttttttgagacaaagtcttaatctgtcactcaggctggagtgcagtggcacgatcttggctcactgcaacctctgcctcctgggttcaagcaatcctcctgcctcagcctccagagtagctgggattacatgtgcttgccaccatgcctgactaatttttgtatttttagtagagacagggtttcgccatattggccaggctgagtagttgactgttctcatattgagctcataattatctcccttgtccacaaggaggtctgtccagaagcctagggaagtacccagtatatgaacatttccctaatctgcctgtctactcatcctgtcaaaaaaaaaaaaaaagaaaaccaaaaaaacagactatcagggcaagaccattcttggtaagctcatgctggcacctagtggacactgcttctttttaggagcatttacaagcccttcctgcagtcatctgccctgagaatatcattttggattggaggcagccttaaggtttgatagcctgaaggtatagaagcaggtgggacttgcccatggagtacccctgtagccccagtaaggggatttgagatcctctgtgagagggctgtgaacatgaagcctgtgagggacaaggacacgagactgcaggagccctggcctatgacagcactgcgactctgtggccaccataagggcggatgtggccagggtgactgaacacatgttccaagacagcttgcaaagtctcaaaactaattctcctttttgcctagacatgccaggcacattgaataaaacaacttcaagtgtcttagccttcatgtctctgccacctttgcctcatcgctctttctaccaccctttccaggcccttatccctcatttctttcacccgtgggaaagacccagcttaaagtcacctattctaagaatttttcccagcttcctccagctaaaatgaattatttctttgtcccagccgccaaagtattttgtttgtactgtcaattgaacgtatggtttgagacatctgggagaaagaaggggatatatttggtggtaaggagatatgtttgttggcatgacatcttaaaggatttggaaataatctgtggactaacctaaagtttacaggacttctgatttttctagttcaaaaatcctttagggaatattagagaaggcattattggccttaactttttttggataggggcacagaagttcagagagcttaactggctgggccaaagttatttaactactacgtgacagaaccaaaatttaaatctagggtttgtgcatgcaagtccagagctctttccactataacacactggcctaagtgcaggcagcaaaagctctccaaggttgtgacgggacccatggccattctctgcattttgtctgtccggggaagaatggagggagagggtttgtgcaaagtgtcactcagcaaaccctgatgtggaatggggaacatctgtggtctcccttgccccactcatctgactctctgtttaccaatttcttcttgaatcaaaaaaggaactgagagcatggcccaaatgtcacgaaccggttcctgccccagcatttctcagaaggacagataaacaatgtgatggatgtgctaatgttgggttgggtggggagggtcggaagttgggcaggaagagttatttgctcagttggccaagttattcctacgcagtgagagggcttcaactaccaatccattatcgctggtcctagggttctgtagagctgaagttattgcctcagaatcttgataataggtgctacagaaggaggacacatctttacaaagacgagcctctaaatgaatatgcagacttagggatgtggttgtggcagggtagatgattaagatctacttttctctaagttctcatggccattgaattcctggactggttgtgtagtgatttatctctgcccaacagcttttctcaccagtcacccatagccatttctccaggccacttcttcaccatagctccagcctctcctgttctgcatcctctctgaactgcctctagtgcagtggtttaacttagaatttctttatcgcactaatgagatatgttgtccattcttactacggctctgcaatgtgcctatacttattcctattttacatattaaggagctgagacttgggaaatcaaataactttttaagagtacacgattacctattagtaagtagcaggcccagatgcagcttgggattcacttctaggttttctctggcctcagactatgtgcctcaaagacagtgctaaatttgaactcatcacgtcctaggtacctaccttctatagaatcatgttattattcttccatttatatttttgttcgacattgttatttgggagcctcaaagtatattttcacatctgtcctagatcttaagtcgcattaagaacataattgtaaaaattgacaaacagttactgataactcacggatgcaggagggcactggtggcaatgctggaaatattaatagaaagaggaacttgtatttggaccatgatgaggaggtgatgagacaaaagaagggaaatttctctgtgactgctcagcagagatctgcacttatagtaaatgttctatagatgataattataaatcacaactgtgactatgctctagaagcccacaagttttgagaaacaactagagtaagaagactggggtcatgtgtatccgcatgcggtcagccttgttacataaaatgggtgccttctcaaaaaagcaagccatcgcacacttgacgatctcttagcatttataagaaatttttgcttactcaatattcatcaagattgcagttttaatggtgataaaaacaaattgtggctgtgtgtgtgtgtgtgtgtgtgtgtgtgtgtgtgtgtttgtgtgtatctactaatcctaaaacagagagcctcttctcctttccttgacgggaaagcaacccagctccctctctaaagatagcatttccttccttgggcctaacatcctgattatgctcttacagggcttccatattcatttttccttttttcaagacaagtgcagagaaaacgtattttaccaaaaggcaaataatgccccctagtggctaaaatcctaaatacagaagctgttaaattcactcccagttagatatatactgagccagcctctgcgggcattcagtaacaatcgagatgtgtctcctgcccctatccttgaaggaacttatgcagtaattttagggaattgagaagggaaatctcacttctaaggataccataataaaatgtcagtaaatgaacccttacgtttcacctcttttccagaatataaatatctattattcttcatggtgaagaattttaataatactagttgaaatagataaataaaaactatataagaagaagtacataatgcatttcatgtaagtctctctcataatgcccactcccataaataactagttaatggttttatataccatctatctttcaacatttttcatatatgtgcatacatatatgtatttttaaagtaaatgtgctcagacatttctacttgtaaaccagctttttaaaactttatgatataaccatacaatccagcaatcccactgctaggtatataccccaaagaaaggaaatcagtatgtcaaagagatatctgcacttccgtgtttgctgcagcactattcacagtagccaagatatggaagcaacctatgtgtccatcgacagatgaatggataaagaaaatgtggtactcatgtgatagagtactactcagccatagaaagaattagattcagtcactagcaacaacatagatggaactgtggatcattatgtgagtgaaataagccaggtagagaaagacaaacatcgcacgttcttacttatttatgggatctaaaaatcaaaacaattgaacttatggagatagagagtagaaggatggttaccagaggctgggaagggtagctggcggttagggaggaggtgaggatgattaattgttaccaaaagaaaaagaaatagaataaggcctagtatttgatagcacaacaggatgactatactcaataataatataattttacatttaaaaataagtaaaagggtgtaattggattgtagcacaaaggataaatgcttgaggggatggataccccattttctgtaatgtgattattacacattgcacgcctatatcaaaacatctcatgtaccccataaatatatacacctagtatgtacccacaaaataaaaaaatattattttaaaaaactttctgatatagctaccacatccctctttgttatatttcttagtagttgcctagtatttcactgaattgataaaacaacccatttaaccaatctattacttgtagtcatttagatgtctccagttattcaatattatagacagtggatgctgtatcggcagtcaccaagatcatcctcaggctccctcaggctccctcaggctcactgatttactaggaggattcacagaactcagaaaagctgatatacaaagttatggtttattagagtgaaaggatacagattaaaattcagcgaagggaaaaggcccaggggtgaagttcaagagaaaccaggtgcaagcttccaggtatggcctcccagaagaatttgtacagagatgtgcttaattttcccagcaatgatgcatggcaacatgtgtgaagtattgccgagcaggaagctcacccaagccttgggtttttattgcgggccagttgcatgggcatgcgtcacctgcatgactgaccttacctactcaatttccagcctcccggaggtcaaactgatacagcatggcccagggcctcaggcatacggaaacaggctttaccatagtcacgctgttagcatatctagtcaaactgatatagtgtggcatgaggagttggtcaagggccagtcctcccgaagacagaccattccttgaacttgcagggcttgagcaatcagaacctgcagagttaaccctttactacacatacgtcttttatatttatgatctgaacactgactaggccttcagcagcccgttcccacaggtctgcttccatgtatgctctccacagagagtattcacatattcgccactctcctcaggcaatttttcctcaaactggctattcttctcacagctctatcctcacagcatataaactaggtttttatttcacccagaaaatagaaaccatcagaagagaatgcctttaacttcttgccgccaaaactcctgagcctcccttcatccccacccattattttcttctttcctctggttaccatggaaaaggttaatcatccactgggctttggatcccattccaccccctaattaattcaaggactccttttctcctgtatctttaactgttttccctcttctgatatgtctacaacttttcctatagaaaaaagaaaaagaaaagaaacacctccctcttgcacacttccctttgggtatggtctctcctttctttcatcttgaaagttgagtccacacctaccacctccattttcctgctttccacttcctccttgcctcctgcaatcaggttccatttccccaaccccactcccaacaatctcaccgaaactactctcgctatggatactaagaccttgtgattgttaaacctgatgaaagcttttagtcctcactttatttggcctctctagtatgactcatccttggtttctaagataccaaattttcttattatctgttccactatgactcagtttctgttgtgggttccttttgcttatgtgtcccttaaatcttatttttcctcagcaattgctcaattctttttgtattttattctctcatcctaggcaatctcatcaatcctagttcattcataaaatgatgactggggctgggcatggtggctcacacctgtatcccagcactttgggaggccgaggcaggtggatcacctgaggtcaggagttcaagaccagcctggccaacatagtgaaaccctgtctctactaaaaatacaaaaaaaaaaaaaaaaaaaaaaaattagccaggcagggttgtgcgcacctgcaatcccagctacttgggaggctgagaatatcttgaactgaggaagaagaatagctgaggcaggaaaatagcttgaacccaggaggtggaggttgcagtgtgctgagatcgcaccactgcactccagcctgggcgacagagcaagactccatctcaaaaagaaaaaaaaaaaatgatgatgatgatgatgattggatctcttttttatctcttttctgagggtcatatcccagtctccagccagcccagccaatgatgacatttacttttctccaaactgtccctcctcctttgttccccatcttggtgaatgaaatcatcatccactcaatcactcaaactagaaataaagttatctcttattcctccctctttcctctctcatatccatttggtctctaagcctcctcccttctgcctttttaatcgctcttaaacacattcccttcctctgtgtttcctctaccagcacccttcattccttgactcaattattgccttaattcttaaccagactctgcctctagaattgtcctcccagcctattccacacactgtagtcagggttgttttctaaaatacaaatcaagtggcattattctgctgcttaaacttctttagcatttgcacgatctttaggaaaaatttaaaacttcttagcaaggcatacgttgcccttatgatctggtcatgcctatctttccagtgtcctgaaagcaactgtgaacaccatctgcatcatccttctttctcccttttccaacaacacatttacacttcgatggggctttctggcctttgtgcctttgaagatgttggtccttccggttagaacttctttcctcatctccctcctttttccctgacaaattcccactcatccttcaagatgcagatcaagcatcacctcctctgggaggccatccctaattaccctccttccattaggattggatgcctccatgtgctcccttagtacacggcccttgcctctactataacactaattagctatttacttactttcactccagcatttcaccaagttccttgagggcaaagactgtcatacatctttatatcctcagcatctacagtcgtgccttattttacttagcataatgtcctcaaagtttttattgttgttgagatggagtcttgctctgtcacccaggctggagtgcagtgatgcgatctcggcacgctgcaacctccacctccggggttcaagggattctcctacctcagcctcctgagtagctggattacaggcatgcaccaccatgcccagctaaggttttgttttcatttttgttttttaggatggagtctcgctctgttgcccacgctggagtgcagtggcatgagttcaagggggttcaagtgattctcccgcctcaccctcccaagtagctgggattacaggcgcctgccaccatgcctggctaatttttgtatttttagtagagatggggtttcaccatgttggccaggctggtcttgaactccggacctcaggtaatctgcctgccttggcctcccaaagtgctgggattacaggtgtgagccactgggccccgcctttttttttttttttttttgtatttttagtagagacaggttttcgccatgttggcacggctggtctcaaactcctgacctcaggtcatctgccagcctcagccccacaaagtgctgggattacaggcatgagccaccgtgcccgacctcaaagataatctatgttgtagcatgtgacagaatttccctctttttatatggctgaataatagttcatcatatgcatataccatctttctttctttctttctctttttctttctttctttcttttctttttctctttctttctctctctctttccttccttccttccttccgtcttccttccatccttccttccttccttccttccttctctctctctctctctttctttctttctttcctttttggagacagagtctcgctccatcccttaggctggagtgcagtggcatgatcttggctcactgcaacctccgtctcctgggttcaagcgagtctcctgcctcagcctcccgagtacctaggattacaggcacccaccaccatgcccagctgatttttgtatttttagtagagatagggttttgccatgttggccaagctggtcttgaattcctggcctcaggtgatccacctgcctcggcctcccaaagtgctaggattacagacgtgagccaccgcgcccggcccataccacattttctttatccattaatccatgatggacatttgggttacttctacctttttgctattgtgaataatgttgccataaatatgggtgtgcaaatatctttgagatcccactttcaattcttttggctatataacctagaagtgagattgctggatcatgtggtaattctatttttaatcgtttgaggaaactccgtactgttttccctggtgggtgcaccattttacattcccttcagcaatgcataagcgttccaatttttccacatccttgctaacacttattttctgtgcttgaaaaaaatactagccatcctaatgggtgtaagatgatattattattgtagttttgatttgcatttctctaatgattagcaatttgagcatcttttcctatgctttttggcctcttgtatatcttctttggaggaatgtctattcaggtcgtttgcccagttttttgaaaattgggttacttgtttttctgttgtcgagttgtaggagttttttatatgttctgcatattaacgtatcagatatatgctttgcaattattttttcccattccatacaaattccttttctctctattgactgttttgcttgatatgcagacactttaaaatttgatatagtcccatttgtctattttcgcttttgttgcctgtgcttttggtattttatccaaaaaattgagggagaagaaaaggaaaaatcagttaggtagacagctaaggctagcccttggagaagcagtctgcctgaaaaatcacagctacaaacaaaatagagcagcttaggcaaaactcaggctgcacctgcacagataagcaggtagggtccagcacagacgcttttcattcttcgtgtaattggcgagctcccaggaaaaactttcctccccttttcaggtatatacacagtggactccgtgggaacttgcacaggaaggaggggggcttacctaaaacaaacctacagtgatacaaacaagagaacccacgctttgtgcttgcctagagacatacccacatcggcagaagataagggaagttgcacagacagatttattcataagagaagttactcaaacaactatagagatgagaggagtttcttataataggttttgaattcagctgtaaaaatggcaccccacttgggctcccctctctgctgtggagagctttcttcttttgcttattaaacttttgcttcaacctcactctttgtgcccatgctccttagttttctcggtcgttagacaagttcggataacaccttagacaatgagaccattaacccttacctgtttcaacatttttatcaaatccaaggccatgaagctttccccctatgttttctactaagaatgttatatttttaggtctttaatctatttggagttattttttgtgtatggtccaaggtaaaggtccatcttcattcttttgcatgtggatatctagtttttcccaacactgttgaggagattgtcctttttccattgtgtggtcttggcactctttttgaagattattctaacatatatgcagtgttgcaggtgattagcagctttctgggctggtgacatgggtggtaggaagaatttaccaacacagttgtaggtaaagaaaggcaggtttattagataaagtatgaaaatacattgcaagggtgcaacaggcaggtcagcaagagagaagctgactgctaggaaacaaaggcttgctggggattttgtagaatggtgcttatgttgtgggtggaagagggctttgtgcagtactaataatgccagggttgcagtgaactaacttccatttttctatcagctgagggtctggtgatggctgggcacaggcagattgtgagttatttgcacagcagggctatgtgtcctggaccacgaagaaaggcagacttatggcttgtctgctttctccttttgcttcccttcgtccagccagcctgactccttttccctaattaggactccacacgcaagggtttgttctgttccagaatagagacacgtcgatgtatctatctttataccagtactatagctgctacttcttgaccaattacagctttagtatctctctcacctgtcctccctatacaaaagatatataaaatatactcactgtactgagtatcttcctgcagcattcagtctggagcaaagcctgcttccttcaaccctttccaaaatccccaaataaaagcccaaaatctgtagaggatcttcctaacatcctcgtgctgagatgccctgaaattctccataactcatgactgagtaataaaaccaacttgcttaattaaagttggtttcttgtagtcctggccggaggacattgacttacaaaaatataggattagtatcttcaaaataaatagacagtaaacatcaacaaggattcacaccccaataatgaaattgggcagaaaaaggaaaaataatcatgaaatgcacagtaaagatggctccataatattgaaaaaaattttacttcaaatgcataaaatgatgcttctgattcagctggtgcgacatttatttcacatttgagttcagctgctcctgatgtctctttcctgaaaatttcaatactaagagctcgagaaaccctgtatttggggaagcttatccttcaccatcaactttgggggtaggggtcagagggaacaagggtggaaaggccgcgctgaatggggccgaagctccgcccctcagcgataagtccagattcctgcggccgacgtggtcctccgagggagcagcagagccgccgaggctggcgagtcccaggggaaggatgttctagccggagtctactcgatggtagggcaggaagccgccttgtctctgggcgcggccatgttggaggctccgggcccgagtgatggctgcgagctcagcaaccccagcgccagcagagtcagctgtgccgggcagatgctggaagtgcagccaggattgtatttcggtggggccgcggccgtcgcggagccagatcacctgagggaagcgggcatcacggccgtgctaacagtggactcggaggagcccagcttcaaggcggggcctggggtcgaggatctatggcgcctcttcgtgccagcgctggacaaacccgagacggacctactcagccatctggaccggtgcgtggccttcatcggtcaggcccgcgctgagggccgtgcggtgttggtgcactggtgagtggccgggtcagtgggtgacgtgccccgccaagcttccagccggcccccgtcgccccttaccttccgaggccgtcgggaggacaagagcgcggtcatgccgcgtgaacctcctcccgctgcctcccgcaggaggcgtgtttccaagagaggaggagggttgaggcgggcccctggtgtgtgcaggctttcattcattcatgctttagttggttcttcctgcagcagcagagggcgggggaggtgtcatctgataaatgacaaattacctacaccctaaggagtttacagctctgttggagaagctagacacccaccccgattattgtaatgcagattaggttgcttggtgtcttgtaaacgggatttacaaagatttagggttaaatgtttttgtttgggatgggtggcgggtggttgatgaagagatgaattggtttggatctaaaggatccctgggctttgcctagggaggagatggttgcagcaaagacaaaaagaaaatgggaatcccgcagggcgcggtggctcacgcctgtaatcccagcactttgggaggcaggaggatcacaaggtgaggagttcgagatcaggctggctaatatggtgaaaccaaaaatacaaaaattagccgggcgtggtggctctcgcctgtagtcccagctactcgggaggctgaggcaggagaatcacttgaacctgggaggcggaggttgcagtgagccgaggtcatgccacagcactccagcctgggcaacagagcgagactccatccctccccccaaaaaaagaaaatgggaatccctaagcagttcttggttggattggagtataataatcgtttaaatttattgagcacataaaagaagatagtgatgaaatcaaaagaagtctgggaccagattttgaggtccctgaatgctaagatgaaaggagattggatttgtttttgttttgttttatttatttttattttgatatagggtcttgctctgtcacccaggctacagtgtagtagcgtaattacggctcactgcagtctcaacctcccaggctcaagtgaacctcctgcctcggcctccagagtagctgggactacagaccccaccacatccggctaattttttgtagaggtggggtctcactttgttgcccaggctggtctccaactcttggactcaaccaatcctctcacctcgcctcccaaagtgctgggatttcaggcgtaggtaagccactgtgtctagccaggagtttggatttgttctgagccattataaaaattttaaaaattactgttattatttttgaataggtaatagattcacgtggttcagaattcaaaaggaaaaaggaataattattttgtaccttgataatatttcagaggcaatgggcttatttgagaagcaaaaatgaagtgggcctaaactttactattaatagggggctgggctttgtgtgtttttttttttaattgttgctatttgctgttttattttaaaggtctctttttcagtcatgcaggagtcagtcgaagtgtggccataataactgcttttctcatgaagactgaccaacttccctttgaaaaagcctatgaaaagctccagattctcaaaccagaggctaagtgggttctttttttatagtaataattatgcttttgtgatataattttaagaaaatgaaactttatatttctttatcattacaggatgaatgaggggtttgagtggcaactgaaattataccaggcaatgggatacgaagtggatacctctagtgcaatttataagcaatatcgtttacaaaaggttacagagaagtatccaggtaagtaataattgctagtgtgtaatgggctttctagatgacatttactttagcattgtatgctttaccttacttccagcaatccctgagaaactattgtttctttttgaaactgatttagccagaaataacctattcaaaatcacatggtttataaatggcagggtcaggatttgaattcaggcagcccgtgcccagaacctaagcacttaaatcactgtcctctcctaccttagcctgatttctcaacactggaatttgatttttttttttttttaatttttgaggttagcacttgttgcctcaatttgacattaactgaatttatctgaaaatgcagagttgattttgacaaataaatacattttaattatgtcatatagaattgcagaatttacctcaagaactctttgctgttgacccaactaccgtttcacaaggattgaaagatgaggttctctacaagtgtagaaagtgcaggtaaactattttatatcctttggatattttatcttgtctcagtagctgaaaagtacttaatgttttattttcttaaatttctgtaggaagattttgtttaattgaaatttttagttcagatctgttttcagaaagaatataaattcttaaaaagagaaataatcagattgtaagggttattgaaaatttaagtagtgtaatcaatgttacattattttgttctctaagcaatattgcacattttgctgggcgcagtggctcacgcctgtaaccccagcactttgggaggccgaggcaggcagatcacctgagattgggaatttgagaccagcctggccaacatggtgaaaccccgtctctattaaaaatacaaaaattagttgggcatggtggctggtgcctgtaatcccagctactcaggaggctgaggcaggagaattggttgaacccaggaggcggaggttgcagtgagccatgatcacgccactgcactctagcatgggcgacagagtgagactctgtctcaaaaaaaaaagaaataccgcacatttcatccatgttttcatccttttggaagtcattaatgcttttgtttgtttgggggttgcaggcgatcattatttcgaagttctagtattctggatcaccgtgaaggaagtggacctatagcctttgcccacaagagaatgacaccatcttccatgcttaccacagggaggcaagctcaatgtacatcttatttcattgaacctgtacagtggatggaatctgctttgttgggagtgatggatggacaggtgagaacacattttattttctacaattttattttatgatctatattttattccttcttgcattttaagctctattttaactagtgttttgctccatttcttaatttctttatttctgaagattatatctttctagtgtagataagactatcaaaaataaaatatttttcaaaaaccagctgatccaacatagtgaactacttctggttgagagccctggtctaagttaataaatttcctttaaggctatttatatttttttcaaatataagactaacatttatttttaaactaattagaatatattggctgggcactcttgcctcattagctcatgcctgtaatctgagcactttgggaggctgaggcgggaggatcacttgagcccagggtttcgagaccagcttgggcaatatagtgagacctcatctctataaaagaaagtaaaaaatttttaataagaaaaaaagaaaagaaaaaatgtattaaacaaaatttgaactttgtaacaagatagggtaaatcagggattttaaaattaggttaaaaattctgtctttctttttctctgttggcttcctgtatgtgtctttctcttttttcttatcttttaggagagtgaaatttagtttgttttgctatgagattctttttcatttccagttaaataatgcagctcatcctattgctcctgtaaccagtgggtagggaaataaaaaaagaatgcagttcatgtgacattttacataaaaaagtgtttaacttggttggagtgtgccatgacagccacatttctcctttaggtttacttgatattaatgtgaaggtattctataataatcatcttaataatgattttgaaagtttgtatggtttgtataaaagtttgtatagtggctagtttatgaaaccctttcactgtattataccatttgaagaatgccatagctttataaaataggtagagcagttatattcacgtgttgtgcatgaggaaactgtttatgagtagtgtcttgcctagaaagtggtacca

SEQ ID NO: 1353 - DNA, 20001 bp, Homo sapiens
aatgctcctcccctgtttttttatctttgtaactcctaactccagacttggagtcacctcctcaggaaccgtttctctggtgtcaccgctgccgcctcttccatctcagtctgagtgagacacactcctgtgtgctcccagagcacctgtgcttttccttccacactgctgggagagctgatatcctgctctctttctttcctgttaggttgtaaacatcttaaaggcatgtcttattttcctttgtgcctcccagggagtggggcatatgctaaacatttaatatgtacctgttaaataaatgaatgaacaaatagatgagtgaattatgggcaatatgctgacaccagatgaaaccttttttttttcttagcctagctggtgcccaacggtcggtttcttagtgtatgggcttcagatcacctgcatcagaatcttctgggttgcttaataaaattcacattctagggccctactttgcacctgttgaattgaaacttctggggatgtagcctgggaatatgaattttatcaagctgtgcaggtgattctcatacatactaacttttcaaataaatgccccaaatccatgagtccaagttttacaatattcagagctaccctggctaaaaatgcgctccaattttaagcagttgccaatgatcagtccttagtgaacacaggttatggtgagcattgtgctttgaacagtccttgggtcttgtaacatgtttcacatttcactggtgcaaccaaacaagagcaaaggtattgccatttccacctggtcttctccatgtctgcagagaaagattggaggtgtggctgtctgcaggctgtctgtggaagtgacacatgcaggcaggcagggggcatccctgctccttgtctcaacctgagatgtacttacgtgaaaagatcgatgcatcattacattcctttctatatttcccaaattaatatatatgtgtatatatgtaaaatataaaacaataaggagatgttctctctctctctctctctctatatatatagatagataggtagatagatagataaatagatagatagcatctccttattgttttaacatacattcctttgattattagtatgacgaattctctgtctaaatacatttaagatagaaaaaagtagatactagagctcatagatgaccaaatatagccttttgcctctttgatacttgactttttctcagcaatctgtgcttttctaaaaaataagaatacttattccatatgccaatactattagaatgtattcagaacaaggttgaggcaagcagagatgtaggaagagggcagatgataaatgggagcagggctaaagctttctttgcagcagactcactcaccgtacacacaaacgtaagggaatgcatatattggcagctctgttgctgggtaccttcagtcacctctctggacctcagttttcctacctataaaatcagggtatttcaccaagttgcagactgctaatgctagagaaaactttagagagtatccggttgaccttgcccattatagatgtaccactgaggcctgactttagaagaatgtgctgctgtgtgctaccactgaatgtcccagtagattgttgtctccctgctatggtttgaatgtcccccaaaattcttgtgttggaaacttaattgccattgtaacagtattaagagatggggtctttaagaagtgattaggccatgagagcatgaccctcatgaatagattaatgccattattgcaggaatgggttcattattatgggagtgggatcctgataaaaaggataagttcagccccatttctgtctctgtcttgcatgctcacttccagcttccgcccttccatcatggggtgaccctcactagatgccagtgccatgctctgggacttcctgtccaccagaaccaatagccaaataaacatttatctctataaattacccagtctggggtattctgttatagcagcagataatggactaagacaccttctaactttcgctccagcattttgttgatttctggacaacctgtttgtcatcatacacagagctagctgtggctactttcttagttattttacccatcaagagtgctaatatatcattcagttgatcttaaaaaagctctacttatgaggcaaaagttctactctttaaagtgatcaatagaatcatggcataagggatttcttaatcatgagtaaacttagggatggagccctcctagggctaatttaaatggaagagcaggtaatagttcacttgggttcattttctagtttttaaaatgccatttcttttctagcagaatcaatgtttaagctattaacccagctctcaccagacatttttcttgtggtttggcttattctggttgatacttaagtcttcccaaagggaagcaccagatcataggcatgtgctctgagaccctggtgcaggcaccatggaggctgtggtgggggcctggtgtcacagggaggagagagggtttggaggcacataggccagggctggcattgcagagccacatcatctcatcatgtgaacctgaggttggggtctctgagtctcatctgggaaaaggtacaataagagaaaaagtttaagcagcctgacataatcttcctgatagtcctggtgggagtgtaaattagtgtcaccttgtgggagggtaatctggcaatggctacttgaattaaaaatgcccatacccttgacctgcaattctgcttatagaaatttatgcttcaggccaggcgcggtggctcacgcccgtaatcccagcactttgggaggccaagacgggcggatcacgaggtcaggagatcaagaccatcctggctaacacggtgaaaccccatctttactaaaaaatacaaaaaattagccgggcgtggtggtgggtgcctgtagtcccagctgctcaggagactgaggcaggagaatggcatgaacccaggaggcggagcttgcagtgagtggagatctcgccactgcactccagcctgggcaacagagcgagactccatctcaaaaaaaaaaaaaaaatttatgcttcagatttacttgtgtattcaaaatgacttatctgcaaggatggtcattgtagcattgcctgttatgtcaaaacatttgaaagccacctgaatcaaaaaaggactgactggtcaaataaactgtagcatatccattcaagggaatagtctgcaactattaataagaattagacagctctatgataaatgatttggaaaattatctaagatgaattgttaagagaaaagtctagatgcagagcagtaagcatataaatgttctttgtgtaaaaaagaatatgtataaacatgctaatgtattcatacaatctctttggaagaatatccaataaagtggtaatggtggttgcccctggggaagactactagagaacctgggaatgccacacagttactcaagtcccaaagtagacatttatcatttatcctcaattcatcctccgtctcctcccctcccctcccctcctttcctctcccctccccctccctccctctttccttccttccttcctttcttccttctttccctttccttttcttttctttttcttctttttgctttccagttagtccagtagcagctcctgtcaattctccatcttcttgtttagatacacccacttccttccctctgcattctgccatccatcccagaccactgaaatagcaacacaacggggcaccctcctttcagtcttgaccctttctaatgccatctccacccagcagtcagtgtcatcttttggaaacaaactctcccatggctttctgttgcaaccacaataaaacccaagggccatgctaaggtacctaagaccacctatgatgttggtactcctaatttccaacttcatcttagccgtactgaccactttctgttccccaaatcagcccttcctgcctctaggcccttaactggatgtccccgttccttgaaatgttcttctccaagcttttccagaacttacaagtttccaaccttcaagtttcagggtctatgtcctcaccaagaataatgtccaagaacagaatggtgttctcgccaagtttctccctgcctttgtcatgatcactctggtttttctctcttagcatgtatcacaggttgtaatagttggttggttaaaatcccgctactggattttaagccctgtgaggctaggattcttgtatatcttgtccaccttatccccaaagcctggctcagtgcctgccatggagcagaggctgaatccgtaactgctgaatagatgaccacctggatgaatgaataaaattggaaatgagtccactttggactctggcctggaaggtggctggagggccagctcctctgacaaggtagattcagaatagaccaagaaagccagctaccttcaccaaccttgtttacagaaacagaggctctcggctggtcctagcttacgaaaaacagctcagccctgacttgccctggatcatagtggttaatacttatcttggaacaaaatgctcagtgaacctttgctttctgcccttggctctggctttcacggatcccatttggtgcaggagttggaaaactggtcttcagggcaccactgtggccttgtcattgctcccaaaggtgagcagggagctttgcttcagtcccaggctgtgtcacttagtaggtggctgatctttagtgagagtcttatctcctggaacctcttttattttttttctcccaaacatatctattctgcttttgtataactggaattagcacaaaattaccatgagaaaatgctggcctcggccttattcttggtccctttaggctctcatgttctagaatttattgattcactcacttgttcctttagggtttactatgtaaggacccacttgatccttaccacatgcagaactctgggtcataccaagatattgtcatgggtcaggttctgcacggagaaagttgattgggaatgaggattgcagggctgggccagcggagaagtgcaaccacaatgtagtctcagcaaagacttcagctgattccagagcagctctaggtttgggatggttgtttagagttttcttgaattgagccagaggggctaagccttcctactccacattgtccagttgttgggtacagactgcccctgggaagaggatgtgaccttggaccaggggctgtattcagctaaggcaattctggagaactgccagcatttccagcaacaggggaaatgctcacctcggtccaagaggaaggatctgggcagagcaccgtgcatcttctgcacatgtttccttggccttgcagagatggcagtacctgtcttgcacttgtggttctaggcacatttgaattctagtcctggctcaaccatgtactggctggtccctggacaagctccctctcctctgtaactgagcgatgtcttgtacctggtgaactttcctcacagttaactgtgggatgctttgcatggttgtagagggccttaaagtgagagaaaggactttgatgtgctgaatatagcagtaaacactcacccacacatcttggtgggagcagaggtaggcttgagtagatcagacaccagcccaggtggggtgtggtagtgccacataggctgtgaagagcagtacagtcctgggacagcgggactgccattcatacaaggcactgctctcacctccaattgccccatggatggctggtcactaccctcctgtttcccccaagaatcatgggcatgcttcctgtgcaccacctgactctgccactctctccttccaggtgacgcagaagttctccctggtgattgtgcagggccacctggtgtcagaaggggtcctgctttttggccaccaacacttctacatctgcgagaacttcacactgtctcccacgggtgatgtctactgtacccgtcactgcttatccaagtgagttatccacttctcccagcagattcttccctgagccccattcatccttaccagccgcccccactattccccttctcaccttgttcttacagtgggcttagatttgggcctgaaactgagccatgagataaaacagaaggacctgcaggcataggccatccatggccatggttcccctaagcagtgatcaggactgggtactaatgtggcagctcctcacatctcccctaatgtggaatgtcaggactcagggatcagtccttcaattattcgcatggctgaattcagtcgccgtcaacttactcactcaacgacatgttagttgctcattctgcgtgagaaaacaggcaccgcccctctcttccgagggacttaatgcaatcggcagcatgcacaggttctttcagaaactgttggccacacactatggtcgtgggacaaaatcttcagggttcaggcttggagggatggcctgggactggagtggtggggaagagctacctgaggaagggatcaagatctgggttttgcagaatgggtgagacttgggaagaaacttgaagtcatttttacacaagcaaatacaagagacctttggcaggaaatgccaagttctttaggatcaagtgcagttggtctatttgggtacagtcagcccttattgtgcaattctcctgtgtttatgaagtaaggccattcaaaatcaaattgactgagcttttgccaaaagtccagttgtcaagtgtatgttttcacttgatcattgtctttgaagatatttggatgaagagttcttcgtgcagagataggccttgccttttccagttgacccaggttcagataatgacaagatgacttcttagcccagtcgctctcaaactagctgacaccagcatagcctggagggcttgttagcacacagatgcctgggtcctgccccaccctagtttctaattcagtaggtctggggcagggcctgaggtttagtaagttcccagctgatgctgattctattgctggtctgggaccacactttgagagctactgttttaggctgctgactgaggagtccaagtcttatctgccaataaccaagaactttaacttccagttgtcctatcacttccaacctatgtaaggaagaaagagttgaaggagtgcggaagagtagatgtcagcccaccttggttgatttagatcaaaatgctttaaaatgcttggcatttttctctctgctaatttccatattttattcataccaaatgttcaccgattgctgtgagtcttctgtgcttctccaaggcaggagaagcataattaatacttggctcctcatcccatcttattgctcatgttttattgatactgatcaatatggacaatgggcctgcagccgtgcctctctgagagcggatgaaagctttctactctatccatatgcacggtgtgcccctgtgatgactcacataatccactgctgtgctcttcacctctggtttagatagtgttagataagatcttattgattaggtaaattgtgtttatgaggtgtacctaatcatgatcaaattcactatatctgcacttttaatagaagcccagtggtcagattttatgtactcacttgatttgcaatgacagacaagggagacttctcatgtctgaaaatgtacttctctagaatgcaagcaggagtagagtgagaacaaattactaccctggaattgcactggggaagtgcccagatagttttagtcaccatacctcaaagaagcatttgttaatcagtgctttctctccagggtctcatctggtgccctaagaaactactagcattcctggagatgcagttctgagacagactattagatcattccagatcaatggggattaagtcttattttgaccatggagattaaagaagatacataaataaacttgttaaaaataaagctaagtcaaacctgaaatgtttctgtaaaagactgctatggaattgagtcagttgcacattagaccttgaaagagcctgtccgatgtaccataaaaacatccaaaatcagactcaagaacattacagactccttgacagtgactggaatttgcactttgcactttggaaatttcctcagaaactaacagccttctgagaaggttagcttttgcttgtagtaagtccctttcttagctgattagggtggctgtattcatttgctagggcagtcaaaaactgggtggcaaaaaacaaacaaatgcacacacacaaaaaaacagaaatgtgttgtttcatagtcctagaggctggcagcatgaaaccaaggcaaggccatgcttcctctgactgctctagggaagcctccttccttgcttctttaagcttcttgtgtttgcagacaatcctttgcatcccttggctttgagatgcattgattcaggcacctggtcatcttgtccctgtatcttcacatcatcttccctctgtgtgtctatctccgtgtccaaattttccctttttataaggacaccagtcaggttggatttggacccatcccaatggcttcattttaacttgattacctctgtaaatatcctgttttcaaatacaatcacagtgtgaggtactgagggttaggatttcaacatatctcttttgggggacacggttctacccatgacaagggcattcaagctcacaaggcagagaatttgattaacttagtgggaacctaagtcatccaacaggctctttgtgatagagtattttaaatcagataattcttccccatcagtgagcagttttaatgcatcatttctgttttattcagttcaacaaatatttattgaaaatctgtcttatgctcagcactatggtggactccatagatggaaagagtgaattagatgtggactaaatcgggtagagagtttacaatctagtgaatgtttctgggtataaattccaggtataattctggcaacagtcaggtaacttcaaatgtgggccaaatcgaagtatgttttatcctgaaatccacttctactatcaaagaacaggtcaaccaatatcataactatcatttatctcactgtgatttatctagtcagaatattgacagttatcctaagcacatggacagtttttgcagatcctgctggctgttatgctgacgaactgtgaatggcagcctctgaactatggtaatggctctacccaaagaatatggatcagctgccccttctacccagtacccttgactgcctgaaattcgattcattttgtagaacatgtagggtgtagtattgtcgaagactcccaatcacagctgtgtgaatgttacatatgatagacctcaatttggaagtcaatcaggggaatcaataatgtacataatttagcttttctgagactttgggtctttctgaggatccatcctctatatggctattcagtttctacaagcaggaggaaaatgactatcttttctcctaaaagctcgttaccattttccagagcattcttccatatgtcatctgtgtttcagagtcctgagttgcagaaacagtcagcacagagcaaactgaaagcagtgagccagtggtagagctctgtaaaagctagggagcatttctgcctccagggagaaaaggcactattgaaagagcatgggtgttagagttggaggacctgggtttgaaaccaagtttcacctcttgaggaccacatgaccttggaaaagtctcacctctctggaatgcagtttcctcatttatgatatgggaataaaaataagtcatggtcagtataaggtttccttatgaggatccaattaaataatgaatagggaaatgcttggcaggccagagagcatgacagtcacttagcaaacatgtcctgagctcaggggaagatacagaggacggagagccatgggcaaagacctgcgccttgtagggtctgcaggggagagagaacagccagacctgcagctaaggtatggagaatattttctgtggttcccacaagcatgggatgatgggagcacagaggagtggccatgtcatccccaccagtaccttgacctgggatgctgctagacctaagccaaaggtaggaaggagaattgtctctgtggccttactgggagtcagagatgtgtaggagcagctcagctgagatccagatagagacattaataatggacaaaggacctcagccagcagccggtttgtattaaagcatcctggcagaagcattcagaaccaaagcggtgttttgtgtttgatccatcctaccacaatgcggcttagaggagagggcctgggagggttgttctgagaagggtctgcagagagcctgagtctgcaacctcaaagcccagctgttcaggggcctaagcaaggggctcaggctgtgtctcacttgggcaggcttccctgctgcccagcacaagtcgaagctcttagtactgcacatgctggactgccactgaccatagactagagaattccctctgggtctgtgactgcttggcctctctcaacttccccaagaagtggggcatggaggctccatgggctacattgtaggctgggccttggggaccacactgggagctggaatgggagaagctgaaacaatttcctcacccactccctgtcaccttaggctggggctggcaggaccaccttggggcaggggcctttgtagcccttggctctctgggcctgtggttggcacacaggcttcttgagggctggcgtgcttgggaggccttcgtttcttagtcctggcatcttatcagaatggctgtggttgtatacacaatttaagatgactacatgccccagatgttcagaaatgtaactgtctataacagaaatcaactttatttctgaagctcccatgtgtccagatgatgaaaagcttcatatgattagctcaaggcatttcagttatttccagtgtacaaattgttctctttgggaataaatatttggacaaatttattatcctccctttcccctcctctcttctgcttctctgggaggaggggtcactctgagatctttctggaaaagcttcctgcacacccctcataactctccaaggggcctcatctcgggactgcctgatgcctgctggaggcatgcctctgttcctccaggtgcccaggaggtgggtccctcatcacacgtgggtcccttctctgccttttcagtgagttccttatcacctctccaagattgcttctcactgctccaggcctggcctgggaattttaagatgcactccctacattttctctgtccagcctgggtcttgcaaactgaatgagctctggctttcaggaagttatttctgctgtgtgactgagcaatcgcttcagaattcagtacacctctttgtcctgggctgggtatacccagcagctcaggcctgtgcctttgtatggtctgcaggggagacagaccagtcagacatgccgccaaggggcaaaggatatttgctgtggttcctgttagcatggatgctgggagcacagatgagtggctatgtcatccccaccagtaccttgacctgggatgtggtttgacctaagccaagggtaggaaggagaattaccactatggccccactgggagtcagagatgtttaggggcagctcagctgagagccagatagctctcagggctgccgaagatgtcagggagacaggccaagggtcctgaagagctccctggtttgacacgagacatcactctacagtctcagtgagagcctcactcacctctgaagagacctcatcctgaaggttgccagggcccaggccaggctgggcagcctctcaggatgcaggcgctgtgcagatgagctctaggtgctgtcctcatgccttgccagcggcctctttgccttcctctgctccactccctcctcttccctgtggtgcctgacccctcctaactctggtttgcattcagtctcacagtcacctgacttccctcaaacctccctgccaagtgctctgtactccccaatcctgccatgaagggtctgagtcctgtcagtccctgtggcagccacaggccacacctgactcagttaccttgtccagcccctcagccctgccagggaaagaggtcattcaatacaaaacgagaacacctgggcagagggactaaggtgtgtggcacggcaggtatcctggggctgagactgtcacgcctgggcagaggtagctggcacagcgccaggctgggcatgggggagccagggaagagaggccacaggaacccacgagggctcctgggcatggtttacagtcacgcacaggacccatgaagccctccctgctggcccccactctcacccaggggccttctcaccccgaccctcataccctttgtcagcatcatcctggaaactgcgccgtcatattgctgtcccctggcctggtgaggctggcaccccaccctgttcctccagggcagggcagctttcacgtgtcagcggccagtgctagagctgacatgggcaagcactcagcaaggatttctcagatgagtagggctagcacactggttggcagtgaccaccgcacttctctgatgtgtcattggaaatgtgggtggagctggtggagggcaggaagaagaagaagcctgcacgtgtcctcactctgatgtctgaacatgtgccctgcatgcctgtttccttttcagcatcagcgatccgttcattttcaacctgtgcagcaaagacaggtccactgaccattactcgtgccagtgccacagctacgctgacatgcgggagctacggcaggctcgcttcctcctgcaggtaagcacactgggtgctggcacgcctggggcctgcgagaggcagggccatgggacaggtggtccaggagccatccagagacacacctctgtgactcttctttgtgcctatgcacagcccagtgcccttaaggagacacccgcaagttccctgggcttgtggtggccctggtcccaggtgggagttctgacttctgctccactctgcagtccttgccgttggctgttgggccttttgctgtgtcttttaggatttagctgcttcgctgttttgctcttgacacagcccagagctgccttggagatttaggaatacagggcaggacagatacattacctcccagtagagctgataactgggagtagagtgccttctgccctgtcctgcccacaggggtaagacctcccttgctgacatactctccccctttctccccaaggtgctcgcctattgccaagctcctgcttggccctgtttctggggccaagtggtttagggatctcccagctgccccctccaaccaggatctttcagtgcctcacccatgccttcaagggcttagccaggcatgcaacagtgatggtggctcctttcagaggaaaagctcagccataagctggtcataacctcccacttctcatcccacttcacagatagatcacactttctagaaacatcacctgagcagcaaagggagtagggtaaacttcaggggcccccagtgacatcaaacacatgttgccttcattaccccaagctcagcaatagcaaagctgcatccccagtccctgggcctccagggcagctggcagaaaaggggatcctagggaccacgtaacaggagggtcaggatctcttcccaccctctctacaggatcacttagttccaaaggccagcaagagagcagtgcttggcctagatgaactagacatttttcatttgtaaatctattttctgtacgtaggtcattgattcatccagtgacccctcctgcaagagggctcactatcattctctgaaactgaagctcagggtggcctttaaggtgggggaattcctgaaaggccccagctgccctcctgtcaagggtttgccagcagctccactctagccctctaatgagcactcttcctccctctgctgcttttgcctgcaacacagttagttctcattttgcctgagcttcctgagggcctttgcagggtgaaggagcaggaagagcagagtggaagtagcagccctgccctgatggttctgggcagtgctgctggttctgggccaatctccacctcagctctgccacattagctcctgtgggcacctctctggtttccttgcccttcagtgagcgggaggccgtgtcctgcctttccactattatacatacagcactgagtacaattttaggcacaaaataggtactcaaaattattttttatgattatatgtctacctcacatgttatatagagtagcagataggtatcagtcagtggggttttttccccaagtacatggtgattgtttccagagggttggttcacctgaagtggtggaagccaaagggagagctttttgagcaaggccaccatttgtccatccctggattctcccaggagaaaggcagagcttggcactcaaggtatccagggcaagctgtaccctccacaaattctgcattcacttcctgttttgcacattatttatatttctatttgtagaaaaaaatccaagagtctcctgttcactagcagaggagagaaggtatgcaacatccttgcagataccttctctctgctcaggagagttaatgaactggactttgagaactcacttccagccaggtagatgcaggacaggactctgctattgggtgcagtacccacctctgagtctgaatcttaccccaccccatccttccctccatgtacaggtctcttctctccctaactctcccttcagccctgggaattctctctccttggcctcatctcatccctgaggcttatcttataggtaactcactctatctcttattccaagtttattatttacatagcttggaatagaagggagttagagaggaaacaagggtgggagaaaaaaaaagaaaagatagttatgtgaatttaatttaggcattaaggaaatacccctgacaaaaactttactatgccagtggggccacatcaaaatggcctcggcaggggaccctgtgctgcttaagtctgtagatcaacccatgatgctgcccagctgcacgcactgaactagattccctagttcagtttctggtaagttgaccccctggctcacccatgccataactcagaagtgaaaaagtctgaggatggcatgggtgctttctctcgtgtctgcttcacgcttgccctgggagtggacctttcgcttcctgcttcaacagaactccaagctgtggtcaggccccctgccctcccacacattctgcagaagcaccccatccctgtcaccaaggtcttcctaccatgggaactcaaaaggacgacccaggaagggtcttctgacacggagacccgcaatgacccatttccagcagctgtgtcaccctggggcgtctctagtccacaaaatatcaggagcattaaaaggggcttctcttcacaggacatcgccctggagatcttcttccacaatggatattccaagtttcttgtcttctacaacaatgatcggagtaaggcctttaaaaggtaagagcttgaaaatcctccttctgaggaaactgatcctgaactgagagcagaggggcagagaacactcagctctgtgctcaggaaaagtgttctcaacccacagtgaacgccactcaggctgggcccagggaggcactgctggcctgcagaactgccaagtcatgaaatgatgtacaggaacaggcagagaaggcccttccttcagtcctaggaagcaggctccattttcctgaactgaagtggcatagaacaggaagtgagaaaaaaattacgcagctaccacagagttaaggaactggctgtttaatgggccttccagaatgttctggctttattttctaattttccaagtaatttttttggcttaatctttctttctgatcccagttgccaattttagttgctccaatttcatatttcattggaaggaattccaaacaactgatttcccacatgtgcactgaacatgtttttctccagatggatcagtttaagaaatctaagccagtgtgtaagttcttaataccatggttatttgtttttattaccattaaagttatagatcagtagattggtttgtagtgaatctagaaagaacagaaaggaaggtcagttcctcatcattatagaccacagagaggctgattaacagagggagtggttatgtgctgctccacatgggctggaagttctgaggtgagatttgatatcccctggccaaggagcccattttgtgctcagaaattcaagccctgccttctagtggccctgtggaactggcacccagggcccactactgcatccaagaggcagggccagggtggagaaaaacaactgtagagaggcttttgtgctagttctaggcgcacttccttggactcaggtgagcctgctcatgcggttcttccatgctgctgctagattgccccctaaaattatattcaaggcctagtttagaccaaaccaaacaagcagacatacaacccattaaacttgattcatttccccctatggtttctgttcattaaacaaagtttttcacagttgatctagaaatcttacacctccatagctcaggatgtgaaggtggcctaatgcagactccacaaccactacccactcggctcaaggagcctggcattaagatggcatttgtcctcacagcaacgcactggaatgtacagcaggattgttgacattggcaatgttgtcaactgcctggcccagaggcggtacctcacacacactgcctaagtaattattgttttattgttgtcattgttggtattaaggcaatagtgtgtaatgccagagagtgctgagggttgcctcagaggtacacccaggcctggtgttcacgacctgggggcaggatggagcgagggggagcaataatgagcctagcttcctgcctgactccggaaatgcctctgcagcaggagaaagggtcttgactctgctgatggaattatcccttcccttttcatgtagcttctgctctttccaacccagcctgaaggggaaagccacctcggaggacaccctcagtctaaggtaatggcgggtagccatgctgtctgggcatggcactgccctggctttgatgttcctcctctgcctcatcccactctaaagaagtcttgcagagagcatgcccaacagtttccctcatttttctctctcctattcctatacatccttcatcctactcctgaaattccttctgccagttaaacctctgtgaacagacttgaagtctcacatgccctgtggctttttcagacccaagtggcaggaagccatcctctgcctttggtgactgggcaggtggcacagaggtgtggagtcaggcccagccttggaggtcaggccctcccatgggggtgtgtgagcaatcccatgctgtccctcctgtgatgagggtttctgaacgcttagaagctaaattcatacaagttggtgtgcgaatcagacattaatttaggaatctgtgctatggggcgtctctcccagtgaatgaattgcttgcagtcccccccgccgccgccaggtcccctttccagctacccagttctctggaaggccacttagggatcagtaggtgtttttatttcagtcggggtgagaatagaagaaggtggtagctggttttctacaggaatgtgtggggaccaatcaagagggtgtccccaggaatgacattcaagatatttataatcagtataaaatgggtctcactaattccttcaaaattatttattaatagcttgtgatacatggtatttgcttgttgatggagcaacaagcaaatagaaaaaaaaaatcccctgtccttattgagttcacattctcaccaggaggacagacataaaccaatataaatgagtgaactataaagcatattagataattataagtgtaagtgtaaaaaaccaagcagatagaggtgggcattgaaatcttagatgaggtggcaagcgaagcccttatcaagaaaacaatctttgaattaatacttggccgggcgtggtggctcactcctgtaatctcagcacttggggagaccaaggtgggcagaccacctgaggtcaggagttcaagaccagcctggccaacatggtgaaaccctgtttctataaaaatacaaaaacttagccaagcatgatggcaggtgcctgtaatcccagctacttgggaggctgaggtgggagaatcgcttgaacccaggaggtggaggttgcagtgagctgagatcgcgccactgcactccagcctgggcgacagagcaagactctgtctaaaaaaaaaggtggagaaacatgttatgcagttaattgagtaaagagtgtgtcagacccagggaagagcaaggcatggctgaggcttatcaaattggagtgcagggagttagttggggtggaggtgagggaggtcacaggggatagttggtgcaagattctcatgtcggtttttattccaaatagatgggaagcgttggaggattttaagcagagggttgatgtgaactgacatattaataagaatcactctggctgctgtgccaagaatagactggagtgggtcaaaggcagaagctggagactagttaggaagctattgctggaggctgttgcagtaatccaggtgagagatgatggtggcttggatcaggaacatgaaagcaaagataatatgatgtgatcagattatggacatgtttaaaggtacatttgatgggatctgatgacaaatcaagtgtgagaaatgcatgtatgtgacagaggacttaaggataagacagaggatttaggcttcagcaattggaaaattaaatgaggatgatcagagaaagagtggctgtagggccactgtggctatctgaagctcagatttagacatgtgaattttgagatgcctatcatacatctcaaagacatcatggagctattgggcatatgaatctggagttcaagagagaggttcaagtgagacataaatttagaatagtgtttaaagtgatgagaatgggcaagattatcaagaatggatgcacatggaaaagagatcagaggactgtgccctgggcacaccaaacttaccctctggtaaggacatgggcagagccagctgaagagatggggaaggagtagccagaaaggtagcagaaactgtaggtgtggaagacatcctggaagccaggtagagtgactcaaggtgggagtggtcaagtgttgttggtaggccaagtgggataagaactgagaaatgaccattgagctttgtaacatgagagtcattgatgaccttcaatagactaattgcagtggctaccagcagaggctcctattgtgccaggcacttaccctttatagattgtggtgaagtgcaaggcatgccagggtatggtccaggggacccgggcagcagtgggtcgctggagttggggtggctgtttaccaactgtaatgggcatagtttaatagttcaacaacaggatagtcctaattgtgcatatctgctgaatctcagccctgctgatctcatattgtttatgtttcatataagcctttatgttcatacttggatttctcagcactgtttcagtacaaggtaaaaagctatttcaaactaattgaagcaaaaaagaggattcatgatagcatctacctgaaggtcaaaaatggtctggctccaggcatggctggaccgctaggcacaagtaagtctgcaggaagtggtggctctccctctctcagggaggattttacttggcctggctccatttctcataggcgttctcatcacaggggcaccgatgcccccaacagctccagactgacagtcaatcatgcaggaatcccaccacacaccgtacatgctctatcccggtaactttagcaaa

SEQ ID NO: 1354 - DNA, 20001 bp, Homo sapiens
tcattataaatttttgtaaaagttgttataaatatatttagtttttttatggaccaaaccgtgatttaaacataattaaggaaccagttatatcctagagagatcccttgtttttccctccatagttttatttgttttctaatttatttttagattaatcctgcagttattttcttctttttcctgcctttacttacatgattttaatattaaaaaattttgggtttattcctagttctgtctttaatatatgtttaatatatgttctatctttaatgtatgcttaatgttcaatgttccttaatttctttatgttataaatatggcctatttcatagattaagcatgaagggcttaattatatactgtttctaaaatagaatactgctctgcatgttatctatagtaaatacgaaatagttgttcgccattactagagtcatcttattacttgcattacagtgttttttaaatcctgatgcttgacaacattgttacaattagagatgtttatattcataaaatttcattttatatcatataatattccctgaagttgggatccagctaaaggacaattagtgttaaatgtatacatatatgtattcattgtagacacatacacgtaactaacatgcaattaatttaaaattttgtgaaaatttgatttccttgaagttcttattggagggaaattgataaaaatgccaatttttcataagtccatcgtaaattagatttgtatttttcatatatatgttttaacgtaacctcttagtctctaaaaagaaatatacattcagaaatacttatttacaaaatttattcttatcttgctacatctataatatgaggaaagctgtcttcacaatattttgtaatctcagctcatattctttttttgtttgtttgtttgtttgttttttgtttttgagacagagtcttgctaagtcacccaggctgtagtgcaatcgcatgatatcggctcactgcaacctctccctcccgggttcaagcgattctcctgcctcagcttcccgagtagctgggattacaggcccccagcaccatgcccggataatttttgtattttttagtagagacggggtttcaccttgttggtcaggctggtctcgaactcgtgacctcaggtaatccacctgcctcagcctcccaaagtgctgggattacaggtgtgacccaccacgcccagcctgctcatattcttataacctcacttctatgttcctcttctcaactttctattcctcctttcttgtttttaggtgatgactctatttgtaaagtccttttgtcaccagccactttcagtcatcttttcagccaattttattctgttagatattttcctttctgtctctgctgctattgtctaaatagtgttaatagtaactggcatatgatattttgaaattgactacattctccatgccagatatctctcccaacttaacacccttcttgatccttactctgtggagatatgccaattttttgataaaatctacaatacaaatatacataaagcttaatataacaactttcaattgttgcccatcatcctctctcccctggatggtaggaaacttgtcatttatttattccttcagtgactcacaatgtaactcacatgtctactcaataaatgtcagctgaatgaattgatctagtttaaaataagaaattcatgtgttcataattactcatcgtatactacaagaaagttggtattaaatgtatcaattggtgtaagttacaattggaaaaaaagttttatgcacaaacaggctatagagaaaatgcactgagaagtaaaggacttaattctaaaagcagtgattgagggagtgaggacacatattcaattaatttattcatgcaaaatgaaatgtaaatttgtagattacctttggagagtgtttctaatgttgtagaataattgtcttaaaaatgcttataaccattctcctggttagtatgccttacgttgcaaattttttaaaaattgtgtaagtttactttaactgtaatgaaatatattatttcatataacagtaagcccagtgctgggcaggatgcaatactgattgttttagcagcccatgacgtaattaaggatttgctttctctccagccttttagaagttaaacacttctatcaacaaagatatagacatcttcttttcatgactgattgtccagaattaggttgtatgacaatttctaaactttcccctgataaggaggttgaatttaccattactgttgtatacgaatcatcttaggtaggataggtttctggtaatcaatgtaatatgccatgcatcaagtgatttagcttctcaaaatttcttcatggttaattgtaatttactcattcaatatgtaattataaagagtatattcagtgagaaatatcttttctgaagatacaaatgttaaaagataagtatggaaactcttacacaaataataaacgttcagaaatttggccaggtgcggtggctcacgcctgtaatcccagcacttttagaggccgaggctgatggatcatctgaggtcgggagtttgagaccagcctgaccaacatggagaaaacccgtctcgactaaaaatacaaaattagccaggtgtggtggcacctgcctgtaatcccagctactcaggaggctgaggcaggagaatcacttgaaaccgggaggcggacgttgttgtgagctgagatcgtgccattgcactccagcctgggcaacaagagcgaaactacaactcaaacaaaacaaaacaaaaataaaacttccagagatttacatataattatatctatgtaatcataggtatcatatacatattacaacttgcaattttaaaatgttgagaaaatgtacaatattgtggaataattaaatgagcatatattacatattaagatgatacactgataaaatctgagaaaaagtttcactattttatattgagtgaaaaataagagaaattaaaaaaattgacattcttttaaaggcataaatgtgtacaaagataaagggaaaatattttagtgttagtgattagtgatttttataaatatatttgtgtgcattttattttattatatattttttttcaaattgactaaaataataggtgttattatataataaaattatataaataagaaataaatataagtataaaagtgaagttggttgcctagagcaggggtccccaacccctgtgctgtagactcgtaacagtccatggcctgttaggaaccatccgcacacctggagatactgtggtatactgtagtctaaaatgtaactaatctttttcctccataaatagtccccctttctttgtagtgacgtagtcaatttgcgtcaataattaatcattttgtcaacaaattttttatgggacaacattgcacacatcacaatattaggtaccacagtacctatctatgttctatgtaatggtacacaatgatctatgtaatgatttcaggattttgctccttagtagatgaggtatttcagcattatattgtataatgttccaaataaaaataatgtgtgttataaatgtgtaagaaagaggggaggaagcagaaaatggtggtgggaggcatgaataaggtgatcaggaaggaatgcataatcaagctttatagaaggataagttaatttctctaggcgaataataggtgagtacattctaggacaagaacaagaaaatattagaaacacatgtctttgacttagcttatttcagtgcatttacaatgtgcattcattctaatgaggctctttacaacacggtagaagcaaatcaaaatttttcttctgatagttctgttaccacttgtgccattctgattatttctgtatttccaaccctcactcattccttgagttaatactcacttcaacgctctttattcttatgttatgattcaaatatagttttgttttgtcttgttctctgtcctaaaaattccacatgaaatcaaccaaataaaagatcaaacagtatatatgatatagaatattttagggagggtgctcaaacttacatttttattttaggcttgatgattggacatgtcattttgtatgtaccaattttatatattttttaaaaaacattagcttttatttctttttacacaaatatgagatggttatgaaacacaaacagtgccttgagattgaatgcccatctgaacatttattttttgtaaactttttctgaggaactgcacacttttgattaccagagtcagggaagtaggtttaagttataaccaaattcttttaaaaacaggtgcctcctaaagtgagggaaacacaaattaattcaccttacttcctctctaaataacttctttcagagtttcccttttataatgagtataaaggtgaacaatttaaaaaaaactttatcaaatgacccaagcaaagtgcttccttgtttctttgactgcaagtcctaactctaacactgaagattaaaaatcttaagagcacaattttataagtgtctgtttaatctttactcaacaatatttctgttaaatgagtctattttgtatgtaatggcagttccgttgtgtttgttcttttttgtttgttgcttgttattgttacattattttgtttcatcacttcacagataggatttaatgaatacattcctttaaagaatacacactactttatttatatattttaccactatcagatatttgactttaaaatttttccctattatgaataaaatcagtacaaacgtttttatatatgtatttgagtaaacataattacttatttcttttgagtatttacttaggagtaattactggtttataggtgatatagtttggttgtatccccacccaaaatctcatcttcaattgtaatccccataatctgcacgtgtcaagggcaggaccaggtggcagtaattgaatcatggagacagtctcccccatgccgttctcatgatagtaagttctcactagatctgagggttttgtaagtgtctggcatttcccttgcttgtactcactctatcctgccaccctgtgaataaggggcctgtttttcctttaccttccgcaatgattgtaagtttcctgaggcctccccagcaatgcagaactatgagtcaattaaaactctttcctttataaattacccagtgtcagatagttctttatagcagtgcgaaaatgggctaatacaatagggggtagttagcctgaataggctcttccagttgccaaactgtttaatagttattctgtatctttatgaacactcaggattagaggtcttaattttagccatactgaatgggttgtagggttgttacactgtggtttgcattagcatttttcctgatgagtagtggtgtaaatttttttcttctacttattaactatgttcttcttttaaggttccagcttacgtttggctctttttttatattgagttgtttgtcgttttttataaacttatagtaaattcattgcagtattttactgtattataagtactataactgatatataatatatatcaattatattatatattatatataatatatacataatggaaacatcatatctcaagcagtggcttccttattcaatgtcttaatgaaaattttgataagcagaaaacttgtatttaagtatgagttttcattattttcattttccatgatttgttttatgaccagttaaaatattttctaatcaaaggtaaggttatacattgaaggaccttctgtgaatttttaaaataatcacagaattttaatgaataagaagctgggaagcaaagtgagatggcatttaattttttttctttttttttagatggagtctagctctgtcaccaagctggagtgcagtggcacgatcttggcttactgcaacctctgcctcccaggttcaggcaattctcctgcctcagcctcccgagtagctggggcattttaattttgcaacatttttacttttctcattctattcgaacattctgcattttggacctcatggaaggaataaaaatagaagaaagagaacaaatatacagaaactgttgggttttgaaatgccatggaaggaataaaaaataaaagaaagagaacaaatatatagaaactcttgggttttgaaaccatagcataggaaaccagatttaagtatttctcctatattacatacattttctttacaaatttgatgctacccagtgatacctagggataggttgatgacgtggggaaggatacttggaggagatgaagaaaacgtagatagtaatggaatctgcttgagaaaaaaatgtattttatgtcgtgtctttttagggtaggcccagtgatggcagtaaattttgagtcctcttttgttttaagcttttaggaagaaagaagatcaggtctctattcctgttaagtttagcaaaagggcaaaatccccatgttggtatggttgcaactgtgtgcacagagcatcaaaataactttacagaattatttctgggacttacaattgaataacaacaataaagattccacagtaacacagtatcacaaaagagcatggaatctgaattcttgaaacattttaattgactccaattatgtcttataatctcaaagtagcatagaaaacacataatctgaatgtgtttaggaaggcagcaggaggaagacactgacagatgattcggatggaaataagacaactaaaatcaacaacttcaaaggacgaatgatgagggcataaattgtttaaagcacatctccaaaattttcagcattacagatgggtttagatacatctggaaatgggacggcatctaaaacaactgtttatgtttctgccgtgtcagtggattggaaacataaagttttacttatgaaacaaattaaaaaaaactacatttgcttcattattgcttattctaggagtgcctattgcttaaatgtctcagaaagcataattttttttcaaatttaatagtaacagtgccacatgcatgttaatttaaaatatcatgctgaaagggtacagttaatatcaaccatccttaatcccagccaacctaatctccagttctattccctgaatacattcactatgaaatcttctagatgtatattctggcacttaattatacattaccttatgatgggtttatttaaaaatgtggtgattcattctgttcaaactggatttattaattacctgctatatacatgagaatttagattaattatattaatattcactcagactacccaacttcttgtcttactttctgtctcactgtgtgtgtatatatatatatacacacacacacacatatgtatatatatatgtatatgtgtgtgtgtctgtgtggttgtatataggtatgtgtgtatgtatgtgtttgtatatatatttatatatacaatacacatttcatatgattttttctacaattaagtaatatagtgttatttttattactttactacttttattattttattaatatagtgttactttctacaattaagtaatgtagtattactttatttttactcattatattaaagagatattttgatttacactgtaaattaagcatactatcgatacatttttttcctttggcttttgtatatttcacaactctaaatatagtacttcctattattttatttttatgtattttaaaattcatttttcttaactcaaagccagtaagatgagcctgcatggaaaagagataagaggctttatcttatctgataaccatgatatcttaataaattattggtgagtgctaaagcattgatgtgggaaaggggatacatccattggtaattgatgacctaaatctgcactattgcaacatctcataaattcagatgtaaaatttacccaagagattcagtttgccttgtgtgaatgttttgggaacattatccttatgtatctgacttcctattgacaatgtatgtgtcagaaaagaggatgggaaggggtgtctacttctgctctagtccctccatccccagtgtagaaaatgggatctttcccaggagactctgagcaaagtaattactggttgatagaagaaatttgagttggctgtaattctagacatgccccacagggccctaaatacttgcagattaaaactctcttccctttagttgatatgatagagctctctgttggaggcgagtttctcattaaatgtgtcatagatacggagagtgatcagaggctcttgtctaacagctaagcaacaggctacagctgaacatattaagctgatatttgatacctcactattgcagaaatatttcctgacagaaagaggtcttaatggatcaggctggaacacttaaatttttaaagtaactatctgcaaagggaactttaagttgtggtataaatgaaaatttccacttccagggataatcatgtatcaaggcataattgttaataacagcaaccacaatgataatagtaaacaatgttatcagaggaccagagatacgtgcagatttatacatttgattgcaaagaaggtggcagaaaaataagaatactagatataaaattaatataatcttgcacaatttactggctgggaaaactatatttttaatgtcatttataaaatacttttcaaaatttggactttctcctcttattttctctggactcaattagatttaagaccaaccttcctcccttcctttcttctctttttttctttctttctcctacttttcttttaaaaatattttccgactttcctgccatttctatctctactcctccattttttccttctttttgtaatagtcctatttatcttttctttctggaaggaaggaagaaggaaggtaagaaggaaggaagggaggaaggaaggaagggaaggagggagagagggagggagggagggagggaaagggaatatcagaactgcagtgtgggaaatcagtaacatagatctttttagcctggtgtcaaccactatcattgtctttttaaaatttctctcaagtttccttatttcaacaaatctccttatttccccactctcaacaagattagatacaattaatattcctgggaatttatcaaccagtagaaaatttggtcttatttataaattatattctcaccagaagactactggcaaaaacacgcatttctcttttaggggtgatttccagctgcagtgtttttcatctttctgcaactattttcatatctgaagtattatataatacagtgtgtccgtggggtataggaataaacatataaagaataaattaataaagcataagtttttattttgggtctgactttccaaatatgctccatggaaattactgataccaaataaaccggtttaaggattctgctagattttctgtcattcttcacggctagttacactcaggtttttgtatatattgtcatgttttgtgggcagatagcagtgtctttctgtgattttgtacgttgatctgtataattaaggtctgctttgtcttcaaaaaagactgacatctcactaaaacataaccttcattttcaaaattcattccaggttttgtacggggtttgaacaaatgagtatattattgtccagaacctcagaggaagactcaggtctccctctgagtcataaagctaatttgtcttccagttgaagaatgcccagtctgtgtctagatctgactttggactcaagatttggcaataattttctaagaaaaatagagataaaattaagcttattggagatattttgagctaaacatttataaattttaattttccttctagaggtggtcagctaatacttttctcgtcaatggcaagatgttccacaccaccaccaccattttccacccagacaccttttttctgacaggcatcccgggacttgaggctttccatggctggatttccatgcccttttgctgtatttacttgatgcctctgctgggcaatgctacaattctactgacaatctggtctgatcgtactcttcgggaccctatgttctactttctagccatcttatcagccatagacctagccctctcaacatcctcagtgcctcgtatgttgggtatcttctggtttgatgcacataaaattggctttggagcctgggtagcccagatgtttctgatacacactttcacaggaatggagtccactgtgctgctggcaatggcctttgaccgctatgtggccatctgtacatcactccactatacctctactctgacaccccgagtattggcaggcattggtgtgagcattataatgcgcccagtcctgctcatgttgcccattctctacctaacccatcgtctgcccttctgtgaggctcggattattgcccactcctactgtgagcacatgggtattgctaagttggcctgtgctagcattcacatcaatgctatttatgggctttttgtggcttcttattttggatgtcgcacttgttggaatctcctatacctacattctccgagctgttttccacctcccatctcaagacgctcgtcacaaagcactgagaacgtgtggctcacatgttggggtcatgtgtgttttctatacaccctccctcttctccttcctcacctaccgatttcgcaaaaaaaattccccgttatgtccacattcttgttgccaacctctatgtggtcattccacctgccctcaatcctattatctatggtgtgagaaccaagcagattcatgagcatgtggtccatactttcacctcaaagtaaggtctcttatttctttacttcttgagggtgtggatatggctgagagaagtcaattttgagacttcactaggtaattattttgtaagtgaatttcatatcaagagattctgcaagtcctaaaggaacaaactttggagaatattttccggtcttaaacctccatgttgtctctcctcattcgtgttgagtgttcttctgaatataaagtttcattatagcaggagaacatatcccactggaatccctttccgtttttaactatggaaatcaagtgaaattctgtttctgtgtattaaaaaacaggttagtcttccagtgggtcacaattagttgcctgcaactgtctagactttctccgcaaaaagaactaaatgaaaatttaaaatgaaaaagatcttggtagaattctaatttaacaatttaaatacatcttatttttctgagtacaacactgggatactgagtcacattttttaaaacgtatggtttttccctttcatttcagcagccatttttttgttttgcttttcttaagatcctgtaggcactatgtgtcctcactgtaccactgcctcccttctcatttctgggaaagcatgaagtgaaagtacctgaaaaaaatacttgtgtgaaagaatacaaatcttgtttataaaaggagctgaatgcacagaattctaagacttattttccaaattatgtttaatcactctctgtgtgtgtgtgtgtgtgtgtgtgtgtgtgtctgtgtgtgtgcatgtgtgtatgtatgtgtgatacttttaggcaaccctctatcagacatcagggcaacttcttctgcaaaggtctctttatttgtgcaatgtaacgtacatacatcctttgaggcttgatgtttcgcaaaagttgacgaatctcagataatttcagatacaaaataaattttcaaagtcagctactttaacaggaatttgctggatgtttttccacatattttgtgtagctatgaagacataattttgctacaactcctgtgagccaaaggcaattttgtgaatattctttctcaatttactattggcagaaactgacatgcaaagaaaaatgatgaagcaaagcagaagagtgactgctcaggagactaggaactaattttctgatgccatgttcattgcatgatggtggaaaaataactttacaatttctggcatgattaaaaggatcagaacaaaaatctttagagttcagaaatatgggagatagattaattatattttcagcaaagattgtcgactagagatttcaggtaaaaccttctggaaggaactagtggagaataacacaaggagtatctgaatatatttgtctgaagaactgattcctgtgctcttaaggaagtgccctgttctcttaaagataggaacaagaatataatgaattttccagggactctttttgtcagtagtttattcaatagcattcttaccagtgtttttctcaacttggatttgtatcttaagtaccactcaaatttaataatgtttcattatacatcattcttcaaataaactagatttatattatcttctctttagaagaaaagtttacacctatttacagttggtcagacaggagacacatgtaagtaatctttaagtaacaatgtactctactaaacatttcacagatgtttttcatgttctaataatgtattttatagtcaaactcttcatttttttccaaccatcattttactttttgttttcatgccctacaagaaaaatacaagtaagcgtcaatgacaaaagcattggaaatgtgtctcgatttccagttttccctcagctatttaacctacgtaaaacccactacaggaaatatatggttgcaataataaaaatagagatggggttctgaagggcagatttctaagtaagaaattatttttcatgagcaaaaactgaaagcacaattcacataatatgcttttttaaaataaaagttttacttcaaaataataaaactgatctttgtgtagggtaggctgcatgtgtccaatgtaatacaacaagttaaataacgacatttggataggttacatagcaacccaaggtaacatctgaaagtggcattttccttgcctgcacctcaaacccatgctaacacttacatgataggcatatctgtggtagataacagaatgtggttaattatcatagactatagaatgctataaacagaataaatagtcactttatccagataatcattactagatttgtaactataatgttatgtcttatttcccttaagagaactggtattttcccaaccatgaaagagagtagggtctagaaacgatgactcatacctgtaatcctagcactttgggaggctctggtttgcagatagcttgagcccaggagtgagatatcagcctgggcaacatagtcagactttatctctacaaaaaacaaaaacaatagccaggtgtggtggtacactcctatagtcccagctacttaggagactgaggtgggagaatctcttgtcccctgaagtttgaggctgcagtaagccaaaatcgtgtgactgcacgacagagcaagatgttgtcaaaaagaagaagagaaggaggaggaggaggaagaagaggaggagggggaggggggaggaggaaggagaaaagaagaagaagaagaggaggaggaggagaaaggataattgtttttcttcttgattttcgtctacacctatctcaccctcaaaagatgcccacaccatcaaagacaataaatataatcctgtttgaaagaaataatatacatagccctaattcaatccacttcctttattctatactcttaaaaacactaaataaatattaacaattatgattgcctattacttttattattattaaagtataataaaattattgcaaaatatcagattccaaattctgctaattggtataagtaacagaggcaacaactaatttttaccaaccaattagcagcatttctaataataataaaaatggacattattttaattttattttatttgttacaactttcagcacataaaatttataatcatttatacaaacagctctataattcatatgcagtttatctcaagtaaggtatacagtattcccccattatccacagtgaatatgtttcaaaaccttcagtggatgtctggaactgctaatagtatttagccccatatatcccgtatatatattctatttttttcctatagcatagttattataaagtttaattaatgcattagaaaaagattaacaacaataactagtaataaaatagaacacttacaacaatataataaaagttatgtgaatattctttctctctcttaaaatattaatacctttattgtactctactcacctattttctgaccatgattgaccatggataccgaaatcatgaaaagcaaaacaacagataccatatatgctttatcttttgctatcctgcaagttatctattatataacttcattttcgcctattaacacattctcagtgaaagaaaaaacatgttcaaagtagtaaaactagaaaaaattctaatatttatttttataatcatgtacttcattttattttttagttgggaacatcctttacaagtcaatgttgtaattaaaaatcaagcaactaaatatgcaaacatctatgaatctctttaatgaatgatataagatatctaccttgaaaactatgtaataagttaagaagactcagataaatggtagaatataccacacttatgattgaatttaaagacacaatattgtaaataatatgattttccctataaagatattcagattcaatgcaatctcaataaaattttctgaaagtcattttgtggaaattttcaagtagcattgaaagtttatatggagatgtaaattaggtcctggaatactcaaggctttcctgtaaaacaaaaacactgagggataaacacaaccagatgcaagattgatactaagtagacgtcagaaccatatttgctgtagtttgactcaaggatacgcaagtaggctaatgaatcaaaacagacaatgtaaaatcaaaccactaatatggagacagagacagtgtactactttgagaaaatgattttttaaaggaatggtgatgaaaatagctcacgtatatgaaaaaagcaaaatgaatctcaacccctcaattgcactatatactaaaattaatcccagaggaactttaaattataatataaaagctaaaaaaataaagtctttagaaaaaatgctcgagggagtgtggagaaaaatgaactcctatatgctgtttgtgggactgttaactggtattgccattatgaaaaacaaaatggaggtttctgaaaaatctaaaagtagaactaccatatgagacagcaatctcactacagggtttatgtccaaaggaataaaaaatcagtatgtcaaagagatacctgtactcctatgctcactgaagcaccattcacaacagctaagacatcaatctctccagaaaggataaagaaaatgtggtatgctatgtatacacaatggaatactattcagctttaactaggaagaaaatcttgtcatttgcaacaacagagacaaaactgaaagacattatgttaagtgaaataagtcaggcatgcaaagacaaatactgcagggtatcacttacatgtggaacacaaaaaagttgaactcataggagtagatagtagaatggtagttaccagagctgaggaagttaggcagtgaaggggagatattggcaaaagggtacagaattttagttagaccagaagggcaagtttttgagatctattgtacagtatcttgactatagtaaatgataatgtattatgcatatcataactgctgagaataaatctcaaatgttattaccacaaaaataagtatgtgaggtgatttatatgttaattggattgattgtatatattagttgtgtattagaacttttcattaactcagtgcatctaaaactcaatgtatctagaactgattattaatatatctaatatgttaattacattaatgttaattacattgatcattgcataatgtatacatatacaaaaatatcacattgtaccttataaatatatacaaccattatgtcaaataaattaaaagtcaaataatatacagaacatgtgtcagggacatttctaaataagtgcatttatttctatgtgtaaccctatcagacaggtactgtcactacctcatttcatgcatagggaaagtaaagagcatgcagactaatttgccaaatgtcactgccaaagacttttggcacttttgaatgctactgccaaagacttctccagccttcctaactcacctaagaggaaataaacatctagtcaacagatgtcaaggcttcaaggaaatagattaggaacactgaagtcagggaagagaacagaggaggagagagggcactatacaaccagagaaatacttgtgaaggtaaagacgtgagccaaaggcaccagaaggctcaggtttaattggaagattattgagagctttccttctgccataccttgccaccatgcaagcagggttccagtataatagtggattatacttgaaggaactgagaaataatctttaggatgattatagtcacgtgttgcttaacgatgaggatatgttctgagaaatgcatccttaggcgattttgtcattgtgtgacatcatagagtgtactgacacaaactgcgatggtacagcctaatacgcgtctgggctatagattactgcctattattccttggctacaaacctgtacagcatgttaccgtgctggatactacaggcagttttaacacaatgttaagtatttgtatatctaaacagaaaagttaagagtaaaaatatgatattttagcaccactgtcctacaatactgtagggcccaccccctaacaggtcctagtatgtgttgttctcctccctgtgttcatgtgttctcattattcagctcccacttatatgtcagaacatgtggtgtttggtttcctatccctgtgtcagtttgatgaggaaaatggcttccacctccatccatgtccctgcaaaggacatgatctcattcctttttatggctacataggattctatggtgtatgtgtaccacattttctttaaccattctatcattgatgggcatttggcttgattccatgtctttgctgttgtgaatagtgttgcaatgaacatatgtgtgcatatatctttgtaactggacgatttatattcctatgggtatacacccagtaatgggatttctgggtcaaatggtatttcttgttctaggtctttgaggaattgacaccctgtattccacaatgtttgaactaatttgcattcccaccaacagtgtaaaagtgttcctatttctccacagcctcaccagcatctgttgtttatttacgttttaataatcgccattctaaccagtgcatgatggtatctcattgtggtcttgatttgcatttctccagtgatcagtgatgttgggccttttttcatgttttttggtcacataaatgtcttcttttgtgaagtgtctgttcatgtctttgcccactttttaatggtggtgtttttttcttataaatttatttaagttccttgtagatactggatatctacaatgctttgtcatagattgaaagcattttcgttcattctgcaggttgtctctacattctaatgacagtttcttttgctgtacagaagctctttagtttaattagatcccatttgtcaagttgtgctgttgttgcaattgctcttgacgtttttgtcatgaaatctttgtccgtgcctatgtgctgaatggtattgcctagattttgtagttttggggtttacatttaagtctaattcatcttgaattaatttgtgtataaggtgtaaggaaggggtccagtttcaattttctgcatatggcgagccagtttcccagtaccatttattaaatatggaatcctttccccattgcttgtttttgtcatgtttgttgaaggtcatatacttgtagatgtgtggtcttatttctgatatctctaccctgttccattggtctgtgtgtccgtttttgtgccagtactatgctgtttttgttaccatagccttgtagtataccttgaagctgggtagtgtgatgactccagctttgttctttttgcttaggattgtcttggctataggggctcttttttggttccacgtgaattttaaagtagttctgtgaagaatgtcaatggtagtttaatggggatagcattgaatatataaattacttttggcagtatggccatttttatgatattgattcttcctatccatgaacatgtaatgtttttacatttgtgtgtgtcctctcatttccttgagcactggtttgtagttctccttgaagagtccttcacttcccttgttagctgtatttctaggtatttaattctctttgtagcaattgtgaatgtgagttcatttgtgatttggctctcttcttgtctattgcaggtgtgtagacatgcttgtggtttttgcacattgattttgtatcctgagattttgctgaagttgcttactaacttaagaagctttcaggctgagatatgggggctttctagatacaggatcatgtcatctgcagaaaaagacagttggacttaatttcttctattcctatttgaatatcctttatttctttctcttgcctgatttccctggccagaacttctaatattattttgaataggagtggtgagagcaggcattcttatcttgtgccagttttcaaggagaatcgtccagtttttgcttattcagtatgacattggccgtgggtttgtcataaatggttcgtattagtttttgatatgttccatcaaaatctaatttattgagtttttaacatgaagagatgatgaattttatcaaaggccttttctgcatctgttgacataatcttgtcatttttgtctttaattctgtttatgtgatgaattacatttattgatttgcatatgttgaatcaaccttgcatcttggaataaagctgacttgatcatggtgaataagctttctgatgtgctgctggattcggtttgccagtattttattgagaattttggcattgatgttcatcagggatataggcctaaagtttcctttttttgttgttgttgtatctctgccaggttttggtatcaggatgatgctggcctcataaagtgagttaggaagaaatctcttcttttcaattgtttggaatagtttcagaagaaattataccagctcctctttgtacctctggtataattcagctgctaatccatctggtcctgggctttttttaaagactatttattactgtctcaacttcagaagttgttactggtccattcagggattcaaattcttcctggttcagttttgagagggtgtatgcatccaggaatttattcatgtcttctagattttctagtttatgtgcatagaggtgtttatctctgagggttgtttgtatttctgtggggtcaataatgatatcccccttatcatttctgattgtgtctatttgattcttctctcttttctttatttttctagctagtgatctatcttattttatagatttttcaaaaaatcagcttctggattcattgattttttgaagtgtttttcatatctctatctctgtcagttccactctggtcttggttatttcttgtcttctgctagctttaaggtttgtctgctcttggttctctagttcttttagttgtgatgttagggtatcgattttagatctttctagctttttgatgtaggcatttagtgccacacatttttctcttaacactgctctagctgaatcccagagatactggtaaattgtctctgttctcattagtttcaaagaacttcttgatttctgccttaatttcattatttacctgggagtcatcattcaggagcagattgtccaatttccacgcagttgtgtggtattggatgggggtggagaattctgtagatatctatcag

SEQ ID NO: 1355 - DNA, 20001 bp, Homo sapiens
cagttgagagtatgctggttttaaaatgtgtccacaattttctttagtgttccttccaaaaaaaaaaataaaacaaacaaacaaaaaacaaaccctaattcccctccacttgaatgtggccagacttagtgactcacttctagtaaaaagaatgtgttagaagttacagagtgacttctgaaaccaggccataaaagacagtgctccttttcttcttgggctctgtctgtctctctcagatcactcattctagggaaaagccatgccctggagacactcaagcagtcctatggagaggtccacagggcaaggaacagcagcttcctgccagcagccaggaggccttgtgagccatgcaagtcaatcatcttggaagtggatcccacagccacagtcaagccttcagatgagatgggagccccagccaacatcttgactgcaacttcacaaaagacttcatgccaaaaacatctagctaagccactctcaagttcctgatccacagaaactggatcagatcatccatgtttattgttgtgttaaactgctgagttctgggatcatttgttacagtggatagctaataccggggcctgtgactaaatctggagccacaacccccaatagggcatcaaacccacagcggtggcccagtcagtgcccacagcagtgagtggggtgaggagatgagacatagggacccaggcagggcatcaacaggtcctgccatagctggagctccgaatgacactcagagcaggcctggctgtgtagggcatgggcaggttctgggttgttcagtatttccaggaaaggcagtgagagggaattggtcatccttgttcctggctctacccccatagatacagctatgtggctcatctagggcagcaggcaggtcagggtagaagtaagcacaaggaggcatttacctcacctggtctcaaactcctgtctcccacttattatctgggttatcctacacaagtgaccttcactctctttgcctcagtttctcatctgtgaaatggtgataataaaccctactttgtggggtaatactctcacggtgtggtagagcctcgttacacgaaaatcagatgataaaataaatatgcagcatcacacaaagtcggagccccttaagctgtggcaccacccagcccctggagccaagagaacaggtttagctgtgggtctgcttttctttgccttctgactcccacgtggcccatatccctaagggcagaatcaatttgtaccgaagcttaagaggaaatatttctaaaagcaccctggttatttctgattcatatcaatcttccaacttgtttgcagactaaaacttggccttgacttcattccattctcatgacaaccctggttgctcactgaggcatgtttgctttgcttacctaagcctcagtctcctcatctgtgaaacggcgctagcaactctactggatccatttggttgttgggttgggttgggttaaatgaagtctcaggggaatgggcctagtaggctctcctcaaatgcttaggataactatggcaatgaaaatttcaccagggcctgcaacactaaatacactcttgtagcacaaaatgtaaacaacatggggatcctgacttcttttatagaataagtctatgctctttttgaggccttctccttgaataactgactgttggaaaccccaggaaattctgacatgaggcaagagtctgtcttcctccctgatcacttgctgcatcattccgtccagtgttcacctctgtacccactagtacacctcccacatcagtgcccactgcatgtaggtgaagaacctatgggatggatggatggactggttagtagatggatagatgggtagataagtgggtgcctgagtgtgtggatggatgtgtgagtagataagtggatgcggatagatggatgggtgaacagatgggtaagtaggtggatgggtgggtgagtgagttgaagaaggaaggaaggaaggaagatttcagctctccttcactccaggccccatgccagacctcaccctattccttccttggggctcagtatatacagagagaattcctctcctgcagggagagaggagagagagagaaacatcaaccatcccacaattagttttcaatcttaattatacacatttctgatgcattcatcaacttcccctattaaggctgccgtagcaccgtctctgccctagtgtgtgcagagggaaaacgggctgttctccccagaagagagggagagaggtgtcctagctaggtctagaagcctgtgttcttcagggttcagggggtccagcagccaggagcaaagacacagccagcgaggcaggagccttctaccatgtcctgacccctgtgaagtcttacgattctctaggaggaggatagagaggaccctccctccacccacaccaacaccccacaccagagatgcccagagagatggctggctagtggctgggagattattttgatgtcatggaaagagtcctgcacttaagtcagaaggcttggactgaagattcagctctaattcctactgaccatgagaacttggacaagccaaatgacctctttgaacctcattttggtgaggaggttaaattagataatcttgtaagatctctaccatctctaaagagtcattgggtccagaagatcagcatcaaggtcattcaagaacccctgatctggacagggagatcaaggcaggagaattatgcctattagctggccacctgttggcctggatgagtcagggaagcctcccaggtcctccctctcaagactgtggctgttgccaggaaggacaccctagcagagcctggagccttcacaccatgggctggggttggcaaggaggctgtagcagtgccagaaacctctgagcataccacacaacttcccctctgcagaggcagctgccctgtagggagtcagtacatttctagtcccaaagcttccaggagatggagagccagaaccactgcctagtgcccaatgaggggctcatggccacattcaccctgcaccaagtcctcaagagccaggtagaagctccagccacaggcacaaccaagcttcctaccctgtgctccagcctccaccttgaactctaagccacagtctccttgctgtgagtgccacctggccagcccaggctgccctggcaaggacatggaaccaggccaggtccctagtgtggatggtaattcatggtgcttcacctccaccaggccagactccaccaatcaggagacatgtctctctggagctcagcctcaactgctccaaagccgagcctgggaagagggaagggtgacatgaatggccagccctcaccttctgccaagcccagggaagaagagggccggcattacacaagtactttcctggagacagtacttgttaagagcctttgcttccctctgggttccaacccagcctgcccaccctgtggccaagaacatccctggcccctggctccagccacagctcccaaagtcaactcattctgcaagtaaaagcaatgagcccaggaagaggagacaactttcccaaacagcagcaatagagagaagggagctcttcctggctgtgctgccctgtggctccaaggtagagggatggcagtgcaggctccaggacccagcaccagactcctccttgggtttggctgactcccatgggagggtctctaggaagacaagaaacagaggcctgaggtacacctggcttggagaccggcttcacctgtcctcatgtccctgccactaacctgttgcatgagcttccccctaagagacctagtcccaacgtgtctatggttcctcatctgcccagcatcccccttggctcagggcttcttgggaggtccatatgagcaaatgccctgcatcacccgtagatgccagagctgcaaagagacctggacaacaaccatcccaacctccggcttttgcagttgtagaagaggctcagataagttaggtgatttttccaaggtcacacagtatgtcctgcaagaatgaattaaaacattcatcactgtataaatataaggaattaatagaaacaatgtttatataacagatatttgaatcagtgattacctgataaaagttacagactctccctctgagaaacacacatgcgtcaaagtgcagactgctcatgtgatatgagggggttggctcctgaagcccattcatggattagcctgtggtcaaggtttccagctctgtcactaggacaacttacctaactctctgtgcctcatttcttcaacaaccaaagggaacaatagtacatgcctcatggttgtttgtaggatttaatgagtttgcaacgtatttggaacaatgcttggcacataataaatgctgaataaatgtttgctgttattactccctgaagacagtcttggcaccctcaaggagccccagatgccagggaagccttcctaccagggggcctttcaaatgtccaggagtacctgctcatgtctcctcaaactcccagcttcacctgggctggatgagcaaactgtgagatgaggatcccacccgcccctgcctcccaccaccatcaggcaaatgaccctgattcaagccttggtcaacctccacctgcccactgcccacctggacagccactggctgcagtttcaggaagctgcctcttcccctcaccctccccacggcccaggaatcaatgcaatcccctaaaagctcataacttggaggtaattataagaagcatcaattacccagcaatgtggatttcatgaattcaattaatttgcatggcaatcgatacgggcgggtttcactggggtccccaggggaagttaggacattgttctgcacgctattgattttacaatgtaaaacaaaacctctctcctcgaattcatagatgcccattcagccatattaactttcagatcatttatttttgtatgtctttcaactctgtttgttgctatcacacagatgcagagtattacattgtagggaataattgaatcaatacagtcatgctacaccagacttccccaactcaaggaagaagagcagtttgccgaccagctcttctgcactctgccttccccagccagctgtccaccctcgtgcccaccccaaactctccctctcccaagcaggccactcccctaaccctaagtttctcactctgtccaatgtgtcttcattcaggacagacttaaagtgcagctggggaaatatggttagacaataggaagaatttttctgtcggtgaatggaagctgaaggggagttggaaggaattgagggcttccctttttggaagggtctttggaaccaagaagattgcagactgatgggggcctaagtcagtggcctctcagggatcctggacaggggaagagtgcttcttttcctccactagaagcaatgagattgaggagacagcattttctgaacattaatccatcccactctagaagaaggccaagtttaataagaggagtgattatgaaaaaagtcaggggcctaccagccttagcctcccatgcctccagctcaggtgcgcccagctttgctgtgttcttgaatcgtgccccctctacacccaggcagccagctccctgggtcctctttgaggccagcatatgctctgagcagcatctgagactgctgcacaccctacatatacacacacacacgctcatacacacacacacacactcacacccagcagagcaaggctggagcccaccaacccagccacactcccaggagagcaggggccaccttcctgccccgcaaagcccctactcagcacaccaccctccactccccatgtctagagaaggagtgaaggcttttttttttcaatttgcctctgccccccgcccgtcaggatattagacagctaaacagcccagcgcctgtttccttcagataaccagctcctgacgagccccctcactgtccccagaatctcagcgccagtgtatagagtaggtcatttaaccaacagtacacacaactaaataaaaatccattttccaagagaaaattctattcttatcagagttttgcaagagggttgcaagcggcccatgttaattgaagctttgatgtttgtaggaggaggcctctaatcaacaccacaaaggaggctgattcactgcagtgtgcccctcggccgaggagcagagtcgggggagctggtgatggggggcatggggtgcagagggccaggcaaggacagaggatccaggctagccaccagacaccacaggctcccagccactgcctcaggcccagaggcaggcacaaagatgtcagggaggcaggtggctgggtcaggaaagtcagcaagactggaggtgggcaggacccagtgtcagacaagcctggagtcacgatctacctggtgatttgctcactgtgtggccttgggcaagtcacttgacattgctgagcctcagtttctcctctggatgaccgtaatcctctttacctatcctcaaaagccatttgatgatgaccaaataaaaacaaaagcacagaaagtgagtttcatttctgagtatgtcctatgaactaggttacccgctaaccactttacaagtggcttagtgtagtgcatctgatgtgcttcctgccttctgctgactgctttgtaattgtcctcatctcgttcatcttcaaggtggggaatcttagcccattttgcatatagggaaactgaggctcaaagtgcctaagtgtctggctcaaaacttcacagtagaaagtggcagagctgggattcaaaccttgctctcttcaactccagaatccaaacagttttctcttacttgagctgcttctcctaaaacaaggtaggagggcccatccagacccctcatgcctatctccccacttcccacccctttaccttctctctctcactcacacacacacacacacacacacacacacacacacacacacgtcatttcctttgctcctcacagcaaccagcaaagcaggcaggtaggcaccctaaaacaagaaagggggtcttgggggagtttgtgtgggttaatgagctattcttcataaagtcaactctgccaggaccataacaaactctcaagaactggcagccccagcactgtgataatggtggtggtggtgatggttttcatacccagcacacaagaactgctcaaaacagacagttaacaatagccataaaatcattagcatccctgttttctagatgcatatactggagctcagaggatttcagtgagttaccccggccacagccagtgagcagcgatgtcaagatgtcttgaatcctgggcctcagctgcaaagccgtaaccagtcctctgtgttcccatgggccagtgctttacaaaggtccttgcaggttaggaggaaggggaaatctaaacacaggcctgcccagcacctgcggagcgaatcccagtcctgagcaccaggcataggaaggaagtgtcttcagaagagaaaggagaaggagtgggcgaatttgccagtccagattaggctagaaagagtttacattccatattcaacatgtatttacctgtgagctgccagtcctgtgccagggcttgcgggctcagagatacaagaacacacggatgagaggctttcatttccgtgggagctgtctaaagccaggggagctttggcagaggtctgcttgggccctccaggaagagaaggtaggtttcagctgccatttccaggatgcgtgggggtgtccgggcagggaattgaggagtgagagggtctccaggatctttcacacccatggccacatttggcgactttaccagctgagatcaaccaacaacgaggaaatcgaggcccagagagctctggtgacttgttcaagatcccgggatctgcagagagctgaagtggcatccaaacccaggtctttgactacagtgtctttcccactatgccaagccagtaggggatggatgcaaaatgtaaagtggctagctcaaaatcaggcgttaaaagcaggtgtcaggaaatgggcactgggtagagcctgcagcgctggccttccccacaggcaccagggcccaagatctccaacaggcagtccctgtgcccagcagtgtatgcagaccgtctgcaacacttggacccaaagggaatggggcttggggaagggagggagaaatttctttctctctctcttttttttttttttttttattgagatggagtctcgctccattgcccaggctggagtgcagtggtgcgatcttggctcactacaacctctgccttctgggttcaagaaattctcctgcctcagcctcccaagtagctgggattacagatgtgtgccaccatgtctggctagttttttgtatttttagtagagatggggtttcatcatattggccaggctggtctcctgacctcaagtggtccacctgcctcggcctcccaaagtgctgggattataggcatcagccaccacgcccggccgagtggagcaatttctacccaggataccagcctctagcttctgcctgctcaagagctgtggggcctgagaaaagatgatggagaggttcaggggaccagttactgagtcaaggccaaagtgaatgggatgtgttaggaccagcaagcctcctactccttaaccatctccactgattccatttgctataacagcagcagggctttttgctatgagctggcataccatgagttaaaagtttaacaagcatccaggaaaaatgctttataaaaacaagatgtcacaacctgagtctcctgatcatgaaatcaggtcccgtggaagcctgggttactgaaaggctcccaactgctcttctaaccctgaacctctgtcctacccactctgttctccactatgaaagctagccagagagatgactctatggcaaaatctgaccatgtcactccccacttaaaacccaccagtgcttcctcactgctctggggacaaaatccaaagactgtgctgacacataagacctttctctttttctcctgcatgcccttccaggagtcttgcaagcccctcctcatatgcacgctcctacagacagtgcccagcatgcccagcctcatactgcttatgctgtccctcatcctgtaacatcccaccaccaccactacatccatcctatgtgtgatgggttgcattaatggccaccattccaaagagctgggtatgtgtgtgttatcccactaaagaggtggaatatatggaatatgtttccctgcctcttaaccttgggtgcagacatatgacttgctttggccagtggaatgttagaagaagtgtgattgggctttctctcttttcctttttctgtcaccattagagaatcatgccaggttaggctggtggtcccagaggaggataagaggcttatggagcagagttgcctaatcaggcccagccaagatcagcagaccctcaaccaatacatagacacacgaaccagataaatggttttgttatttgccactgagaaatggtaggtgtttgttacacagcatattgtagcagtagctaactgatacatcattttaacttgagtaaattctatccactcattggatctcagctgaggtagatgtcatatcttcttagaaatctaacctgagctcctcgcctcttccacaggtcagcactgggggctcccatggcacccagaattaactcttactgcagcacatagcatgtactgggttaaaattgctgtctccctcacccatcctgagcttcttgaggtcaagggttgcatgttattcacaatttctgacatagaggaattcaatgactatttagtgaaggattgaatgtggaagtggccttttctaaggggtagaagcaaaaaaaacctctcacttttccacctcagcccaccactatcatgaaaaatgcccaaagtgggacgaaaactcacgtgagttctctgcacttcctgccagcctctggcacacacactaacacacttgaatcccaaagttagccaagctgcacttccctgccgcccgcttgcttggtgatgaagcactttttgagccactttgctccatctttctgcaatatcctccagcaaatcaagcatccccttcttgggatgttttcaatctgttttatgttgattttaattaaagaattcgaaactgaacaaacagttcctagcaggtggccatacaagtgtgaaataagcaaactgttttatctgccacaaactctgctagtaaatttcttcaaattaatcccagcctccgagagtctgctgattccaaggagaaagctaagcaatcctagcctccaaatatttgcttttgttacagctcctggagccaacgactggtggtgtccgtctttctccatgctcatccaccttttctcccagtcccatctctggcactctgttggcccaacccatctgcccagagcaaggctcatgtggccacatcactgggctccacagccagaactccagcagggtggccagatgcccagggagacttcccagcccaccttcttctgagcaccatcttgcccatctttactttccacttcctctaccagccctccagctgagcctgggcctcccaccaatgcttgcccaccccagggaggcacagacatgaaggcccagaacaaggcttgcttcctttcccctggtaccactcaggaatgagaggcgcccttggaaaaatgacaccacccagttccggccaagggtatgaggaaatgggccacctccttcaccaatgatgggagcttaaattagcacagcctttgcagagatcggtttgtctacgcacatcaacagtgttagcatctttcttacttttggatccaaaaattccacatataggactttagccccctgcaaaaaaaaaaaaaaaaaaaaaatcaatgtgcaatagcaaacatttactattgcactctttataacagcaaaaacggaaacatttatggttcaacaacaaggattaaatgatacagccatataaaacattatacaatagtatttaataatgtggaaaataattttatgatcttagtggaaaaagcaggttataatcaatatatatagcatgagtttatttttctattttatgtgtgtacacagaatatatcatatgctacatgtagtattatatattatttatgtagtatactattaatattatatactattaatatgtatatacgtagtatatacatttatgtagtatactacatgtatctacagaatattatcattttataggtaatatattctatatttataatgcatatggaatatgcagaatatattgtatagtctacatgtagtataaatattgcatatacattactctagatatgtaatgtgttatgtgcattcacacataagaaaaaaagactggaagggtataaactaaaatgttaacaatggcagtctctctaggcattgggaatataactggtatctcttttttttttttttttttgggagacggagtctcgctctggaactcccggctggagttcagtggtgtgatctctgctcactgcaacctctgcctcccaggttcaagcaattctcctgcctcagcctcctgagtagctgggaattacagatgcccaccaccacaccgggctaattttttttatttttatttttagtagagaccgggtttcattatgttggccaggctggtctcaaactcctgacctcgtgatctgcccacctctgccttctaaagtgctgggattacaggtgtgagccaccatgcctggcttttctttttctttttaaaaaatcattattttgttagttttctgattttgaaaactctggctagagaagcagaagacctgggttgtgccctagcagtgacactgatacaatgccatctcctggcctaactccaaagccagatctggagtcattaatatcacttgtgtcaacttcccgatctacatacaacatgtaagagaaatcaggtcacctgtaaggttgcatccagcttccattttatagttctacagtgtgtcctgaaccacagttgagagagaaaggcagacagggaaaaagaaggtacaaactcagcagaacttcatccagtgtaacctgttccctcgttcaaccagcctcagagccgtaaatatcactgaataggcattcactatgcaccaggcactattacattacacactaaatgcaaagggattgcacaaagtaataacccgcatttctgccccactgtaactgcaggttcatccctagaagattgtggtatttctggccatacgcaggaaaggtgccacagatgctcaagtataggcatcagctaccaccccatctgctggtggtgctcatacttctccgggatacctcccctccagtctcctccacccctacagggtcagcactgctcttaagccttgaagtgtcacatctgcatggcagctgccagcaaaagggagaaaaatctctgtatcccttcaggtgacactagttgctgtatggataaacacctaaatctcacttggctgaacacaataaaagtttatctggtgctcacagcactgcccagtggggagtcagctccacacagtcattcgtaaacccagtctcctcctatcttgtggctccacccttctccaagaccccagaatcctctctgttctgctggcaaatggaggaagagctagaattgcacaagggaggttccttatacaaggccgtatttgaaagggtccacagcatctgctcacatcccactggccaggactcagtcacgtggccacatctaactgcaagggaggctgggaagtgtattccagtgtgtgcagccagggaagagaggaggccatgttgctctgggcaacaacatcaggttctatcccctcttctctccccacttacggggtgaccctcttggaggcctctcagttgcgcaacctcacaccccaatgccatacagagtttcttacgaagtggctctttctcaccaccctttttatttttccctggagcccagagacacagcccggttgtaggcatgggggtgaggggtgttatcagccaaggacacaacagcgtactggaatacagtggcttctaaaaccacctgtggaaaagaaccaaatgcaatatccccatcagtctcccacagcccaaacactgcaaaattctagaggtcgccaaggaccacagtcgccagaaacaatgacttcatttgggtctttctcatttagtctttctgaggtgttggacggcagtgacaccttctcaaggtcactctccgggccgcatgacctggcgctccccaggcttccctgctgtttccaactttacctcctccaccccctgtgagggctcctttccttactcctaatgatgctgtttcccaggcggccacttccaccctctgcttctctcttctcatctccaccctctgcctccctgggactctcatctgcaccctacctcagatgcccctttcgccacagctgcagacctctcccttaggtctggacattgccaactgcctgctggtcacagcacccgcatgtttccatttatcttgtccaaagctgggctcaccgtcatcttcctggaatctctcatcctccctcttagtgaataagtccaccctccacctcgtcacccagggacagtcccagaaggcccctagcgtccagctctgtctggcccaaagcatggtggcgacaagccatgccacatccagctccctggtttgtctgggtgctattccttcagtagctcgacctccaccctgtcccccaccgtctcttacctggaccacccaggagacatttctcctggtctcctttcctccagttatacccctctatagtctcctctccccaaagaagccaacacgctcttcctaaaaacacagatttcaccacatcactccttccaaacatgcgagatgtggggtcctcaagagaaaggccaacctacctagtttgtcaggaaatgcatgtcaccacctggacaagcccttcactctaactcaccccacctgctcctcccgttctaactgcatcctctaccatagcctgccccagcaccaccaagcccaagaccttcttagccctgagccccatacctgcattcacacctctgggtcagtgcaggtgaaattctctttttacctggaaaaatcctatccatcttccccaggaacactccttctccccttcccctgcctcctgaggaaggaagggcaaagtgcccctgcctcttggcccccaatactttttcttcctcgaagccactctcccttgtcccactcatttatttctggtctaactctcctactggatggtgagctttgggggggcctagcgtgggggctggcacttgtaaaggcacatgagttctatagaagaacactaggtcctcctccccgcccctcctcaggccagggtactgcggagaggcacacatactgggaggtgctgggaggcccacgtttccaccctgacactctccccagaaaggctgcagggacatggccaacacccctctctgcttctctgccaaagctgatttgcctatagccttgaaggcacaaagccggcaagaaccctctctgaggtagcaggccctgcatgctgctgagggggccgagggggcaggagaggcagatggcctatacagcatcctcctcctcctgggagatgatgagaaggggccggtggcaaacaagaaatccttccccttcgcctactgatccacgccttccctcagaactgcttatcagcatctgtaatgatcactgtgccaccaggttctgggaatgtctccccagggtgcagtggcagcctagactcaaagtcagtcccaccaccacctacagtgggattctcagactgccttcccactgcaagggagtccagagcctgcacccagccagggggatgggggtgtccccttcctaacctgagggcagggaagcttagggatccaccaaggtgaactcaccagagccatgcaggtgcatagtattgtccctacacacacacacacacgtatccagtacagatacaaccccataggtatagacagcatgtactgaggcagatacatatatgggaataaatgccatctggccacttgcctggggccaaagccattgcttccagttcactttcctcctcatgctccattcaatcaagaagtactacagattgggcccttgctgcattcctggcatagatctagatccacacagtacaggcccaaggcaggacagcaagacccaaagcaggaagaaaattgtggggagaggaagcaggagaacagtctgggtaccctggcgacatttgcctgagaagggaggaggctggtaaggggagagaaggtgataggggattctgggagctatagcagagccaggaggccccctccccccgactgccctgctgctcaaaggcccagggtatgcagggcagcctgtgcccagcctttgagccaggtgagtcagcctgacttctgaatattcaccactgcagcagttccaccattccccacagcccactctgcacacagcagccagaatggtctttcaaaatctgatcttatcactccctgctcaatagtgtcctatcacgctccggacaaagtctgaagtccttactgtgagctagaagttcctaagtgatctggcttctgcccacatcttagcactcctgacactgtaacatacatacatgtgcatttatgttggtctccccacagaatgccagctccctgggcaaaaatattgcagtcctcactgctatgtagagtcctcacagtatgtagagcagcacctgccacatagtagatgcaggatacgcctttaccgactgaacacctattgcaagtcaagtcctggcaagcactgggaatggagcatatgtgctcacgatccatgcttgtctcacttagcttgggggttcttaccctgagataatgagggggtttatgcaggggtttcagagagtccttgaacccccagaaattagatgcaaaatgagtttataaacacttttctggggagagaatccatgcctgttatcaaatacccataggggtaagagtccaaggaactagagggaaaaagaggggactgtcaatgacactgtatggggtttgtccccagggggagggccaagcggtagctcacacaggcacaaacctgaccagatgccagggaggcaggtgtgtgaggaaccccagcaagtgtgcacacaggaatgtgcctttgccatcctggaaggcttccccagggaggtgatcagagcaggcctgagaatgagcagacaacaggctttctgtgcagacactcttccttcctggccccaaggaaaaggaagtggagaggatgagggggtctggggcagggcagggggatgtcagtggaggctgatagaaaatgggagggggacaggtggcctattttgtagcccggactaggcaaacattgtcaaggccagcagcagggacacatggtgaggggcagagactttggggtcctgcagacttggaggtatttaaagccatgggactggaagaaattgtctaggaagagagagaagagaagaagtacaaggaccgagccctcagaatttgaagagatgagcaagaatcagcagaggagttaagaaggggggtctgaagtccaggagagcttcccggggcctgaaatcactcttggcagctcagacaataatcacaaaattatggaagctgaaaagctaagggacaagacaagtgataaatgactttgtggacctaagaatgctgaatccacagctagcaacaggaaaagctgagaattagtccaatttacactgtaaaagtccacaaaagcctcaggaactgacagttccagacacctctggaacgagggctggggaggaggtggtgaaggctggggaggaggtggcgaaaacagaaaggactagaggaaagcctttttgagaagcagctagcaatgaggccattcacttaaacctctctgagactgtttcttcaactataaatctataaaatggggatgactgcccatttcacagggttattttgaaacagaaataagtcaaatggaaaaagttcttcacaatcactgccatagcttcctctcctaccattttctctagaactcattctgatcaggctttcattcccatggctccaggagacatcattcattgaggtgaccaatgacctctgtgctgccaggcccaagggttacttttccatccccatcttactcatcaggctgttgggcacaggtgatcactccctctttcccgaaacctctgtgtcacttgcttcagggacactactctgtcctgtctgtccctctccttcactgccctctccttctcggtctcctcccccattccatgctgctgggcaactgccccccacccaacccactgcagaacactggaagtttattctctagaaagggtctctacagaccaaacagcacaaatgagggggtgagtaccagaccataaacaacggaaaccagttagcatgtaacactaaatatgggagccagagacttccagccctgatcgtctacttggttccagaatgctggcaatcagacgtttatccttcaggcaggagtttggtaaagtaccatctgggaaatacagccagtccaagaagagggacccaagacaccgacattgttctccaacaaacagcccattgaagttggcaagcacccctcaagttcagagcttataatcagctcttcagcctgctgagtgacttgtgagctgacagccatggattatcagatacttgagggaagaaagcttctaatacaaaagatagaggccaaagcaaataaacagaaaaaaaataataacttggaggagaaaactagacagaggaaagaaaatttagaagttaaaattaatgtcctcagagagataaaagaagatactgcatccacaaaataagaatggaatactataagagaagaacactgaaagaacagcaaagagctcttggaaatttctgatagcaaaaacaaaaaatgcaataggaaagaagataaatttggggaaataccctagaaaacagagcaaaaagatggaaaataagaggaaatgtagccagtatatttttatggcagccaaaagtgtgccacaggtgcagtagcatgtgcctgtagtgtgagctgcttggtaggctgaggcaggaggatcacctgagcccaggagttcaaggctgcgttgcactatgatcacgcctgtgaatagccactgcactttagcctggaaaacatgagagaccccatctcttaaaaaaaaaaaaaaaaagtaaaaaacttagaacactagttcaggaaattcaacatcaataacaaaataaaaacaaaaaatagagaaaaataaatcgataaaataactcatgagatttcccaaaaacaaaagaacatgaatttccaagctgaaagaccaccatatgttaagtacaattgatgaaaataagtgaacactaagacacatcattatgaagtttcagaacactaaggttaaagataaaattcaaatagaaaaaaaatgggaaggtcacaatgaaagaatcaagaattagaatggttttaaacttttcaacagccatactaaagaaggcaaaggagtgacatgtttaacgttctgaagaaaaacaatttacaaattagaattctgtattagtcaggatgggcttggttatactacaataacagacaactccaaaatctcagctgttaacacattcaactcagttcagcagggacccaggctattggagttttcatctatttccatagtagaaaaggaaacatgacaaatggctctcttaaaaattctgtcaaggtgatatcaccaaattggtacagtcaaagcaacctggctttattctctcccacaaaaaataaataaataaaataaaatccagtaccaagattatcaccagcattatcccagaactcaattctgaggctgagacaatccccggaacgacagagaagtaaaacactctgagtagatggtaagagaaacagacttctctatccacaatgcccctccttcaatctgccaggcaccactcatggatcatttcttccagattcacattttctacactggaagaagtgaaagcaaggcagacagccagcttcctcactttcttgggttcccttgcacaaacactgttcctacctcagcccaccagaagcaccacaagtgcctacagggagagaaaaccctgagggtacctagagacaaacaggggaggcaggactagaaaccccagcccacaaaactctgctttttatctcagccaaaggagatgccaaatcagagtagctgtttaacagcatgctatagaaggcatgctccacgggcctactgggcatacactccttgccagccttcccatttagccagaatatcccccattcaggacaagcagtgctctgaacatttggatgggcagtgctctgaacatttggatggacagtgctctgaactttcgtgagagctgaggcaaacctgagcttaaagcactacctagtgccaagaaagagaggcaacaatataggattaaggagacttgcagacagctacaaagaacctttaagcaaatataccctagaaagaccagaacatgtgagacagtgatgactagaataagtaactaatctttcaatgaaaatccataaatgtacatacacaagaaacaacagcaaacagggaatcatgacctccccagatggacaaagcaaagagccagtgatcaaccctaacaagatggtgatgtgtgaactctcagataaagaattcaaaatagcaattctaaggaaatgcagtgaattccaaggtaatatagaaaatcaattcagaaaa

SEQ ID NO: 1356 - DNA, 66735 bp, Homo sapiens
acttatcatcctgtctcagcttcagtgtcacttcctccagggagcctttcctgaccccctaaactgggttaagtgcccctctttcaactcctgtcacttcctggactttgcacataaccctctctattgcagggacctgtatcaccctccagactggaagccccacaaagaactgggacagtgtttgacctgttctcattcttattccccgtgcctgacaagtggtggatgctcagtatattttattagataaacaattgtataatcacatccatcacttcttattaccattaggaccagcctgagagaaagacagggcagaattattattctgtttttcagctgaagaatccaagacccagagaggtacagtgatttgcccaaggtcacacagctggcaagaactatcctactccttgccaggtgcttctcctccttggtacgttgcactgcctctcaagcatggcaccccaaactgccccccaggcatataagagtgttggaatggacacccggcttctcaacctcccgcctctccatctccttgtctcctggcttccctctccttagcagtgagacctggtagtgtaatgggtaagaacagacataatgggtttgaattatactctaaccacccactagctgtgtgaccttgggcaagatacttaacttctctggatcaactgtaaaatggaggtaaagtagtgcatacctcagagggttatagagtaaggactcggcacaatatctggcacatatgagctctggttatctgctttttactatttctctaacatattctatcttgatgtctctattcctcactgtctttcttttctaccctctgttggtctgtctattggcctatctcccaaaccagctgcagtccccttccacacgctgggccacgcctgggagactcagacacttctgagatctccatgtgtatctcatcctggatccagaagagatcttgttccaggaatggagctacggttaaaaaataaaataaaataaaataaaccacacacacacgcacacactacaccacccccacatgcatgcacatcttcctcacctgtcacaggccagcctgtgagggacctgtgtggtccaggggcagttggaaaaaaggcttgagaggttgtgggggtggaagggttaaggctgagtggtggggacagccggttggggggtgggggtctctggctgagaagaaaacaggtggacgggattggccccgtcctcggggagaagtggaagccaaagctgagccacctgcccatttcccaagggtcggattacccaacagcaggtgcttatgagaccctcccatgcctgatagagtggaaggcacagggcatgcacaccccacctccacctctaggtcttatagatggagggtcatcgggcccctggagaggccacactgaggggaaggcatcgtgacctcagcatcctgggccagtggtaagaaccaggactggcctcagaagacctaggtttgggtgaatgcacagccatgtactggtcatatgaccctggggaaatcgtatcatcgctctgaacctcagtctcctcatctgcaaaatgtaacaatagatgctctgctgcgtggctgtgaaaattttatttagaaagagcaggtaagaaagcacttgctaaactacctggtgctctgtggtgtccttgggtcattattggcacaggctggatggcgcccacagtgacccctcatcatcctgccccactgtcacagagcacccattatcaatggtgacaccaggaagacagacagacactccagtgcagtctggcaacatcatccagctgagcccctcatcatcctgctatgtgaccacgggcccttccacctctgggccagtttcttccctacaccaagggggatgggccaccgtgtggaatttcaggaattcctgaaattcctgttagcttcatgttggtagcttgaactcagccatggtagaggtatttacacctcagaaatcagcaaacattacagaccagggtaccactgtttaggctgacatcccaaatctcctcctcccagtgtctggccaggaacagagcagctggtccaagcagattgcctcaagtgctcagcatccggctgccttccagggactctcccctgataaatatggatgcacacctggccagcagcaggcctgaaccccttgcccccacacacacacatacaagcgtgcacacacacactctcatactcacactctcatacactaacacacacacactctctcatacactcacatgcacatacacccacacactcctacctggtggatccctgggcatgggcaggggcaggagggaggcagcccctgctcttgtcaatcacaggaacaaggctccacccacctggcctgggtattccatgaggtcttttgtctccggtgctcctgcccctcctcttctccacccaccatagggtggaggacgggagcttgcccagactccagcaggccacctgctttgtaactgagggcaccaccatgcagaccccactctctctcctcaggactgcccctccacagaccgccacgtggtgcaggagtgatacccaggcagtgccacccagttagactaggaggtgcctagtgcccctgcagcagggtcacgtgacactttgacccttcaccctcccaatacttagaaggcaaatcagtccgggaggcccaagtgaggagatagagtggtgagggagggtttctctgagagagagggaagctgggccaagtccctgcccacccttctacgctgacccccagcagtgtcttttgcgggttgtttgcattgctcttttctgaactaagcactcaggcactctcctgctccctgcaatgggttgaattgtgtcctctaaaattgctgcacagaagtcccaacccccagcacctcaggaatgtggtctcagatcttactggagacagatccttgattacagaggtaaccaaatcaaaatcaggtcattaaggctgggcgcagtggctcatgcgtgtaatcccagcactttgggaggccaaggtaagtggattacttaagcccaggagttcaagatcagtctgagcaagaaggcaaaaccccatctttacaaaaaaaaaaaaaaaattagccaagtatggtggcacatgcctgtagtctgtagtcccagctacttgggaggccgaggtgggaagtgggggctgtagtgagtcgtgactgcaccactgcattccagccagagtgacagcaagatgctgtcttaagaacaaaacaaaacaaaaatccggttattaaaactcaggtcatgagttaaaaaggttgttagggtgagccctaatccaacatgactggcgtccttatagaaaggggaaatgtggacacagagatatgccccaagggaagagcatccacagccaagcagaggggcctggggaagaagacagccatccacagccaagcagagaggcctggggaagaagacagccatccacagccaagcagagaggcctggggaagaagacagccatccacagccaagcagaggggcctggggaagaagacagccatccacagccaagcagagaggcctggggaagaagacagccatccacagccaagcagaggcgcctggacccgatcctcccctcactacccagagaagacactaactctgccttgattccgaaatcttggattctagcctccagaacgatgaggccgtgcatttctgttgtttaagccaccccgtgcggaggggtctgttatagcagccttgcaaacgaactcatccccactctctgaaagggcaggtgagagaaaccgcctgtgggtatctcagcttcacaaccttcggaagcatacacattgctgcatctgatccccaggccacatgacccttaggcgcaacaggtgccattcatcccctttgacagatgaggacactgaggcccagggggcagggtgcttaccaagaggctctccagagtcaacaactaagccaggaccagaaccaaggcccccttatgaatgacccaatgggcttgcctacaccaagccaaatgtctcctcctgaatgtgtacagaattctgtgagcccacagtgagaagacactgggacatctccctccaccagaggaaaacttccaggcaaaggtcctgaaccctggatgctccgtgaatcacccagagagcttcgaatcagtccagcacctgggccccaccccagaccaagtgaataagcacctctgggggtggggctcaggcactggtcttttctacagcgcccagatgatactaatgtgtagctggggaggacagccggagctagaggactccctggtgccagcatcctagcagcctgagtgtccccactcagttgcagaggggcctggggtgcccagcaggcaatcacacctcaggaaatatgagacataaatgaaggtgcaaattggcagtcattcatttttgtattaaggcctagaaaatatcagggttgaagcaagtttttctaatttcttcatggccggggctggtgggtgggggaagtatctttaaaatgctaatggaagagaaaatagtgtttttctttaaatttgggcctttactctttcatcttgtattagcttgttctcatgctgctataaagaactgcccaagcatggtggctcacgcctgtaatcccagcactttgggaggctgaggctggcggatcacttgaggtcaggagttccagaccggcctggccacatgtgaaaccccatctctactaaaaattaggcgtgatggtgcatgcctgtaatcccagctacttgggaggctgaggcataagaatcgcttgaacacgggaagcagaggttgcagtgagctgagattttaccactgcactccagcctggacaacagaaccaggccccatctcaaaaaaagaaaaaaggaactgcccaagactgcgtaatttataaagaaaagaggttgaatcgactcacagttccacagggctgggaggaaacttacagtcatggcagaagggaaagcaaacacatctcccctcacacggtggcaggaaggagaagaatgagggcccagagaagcggggaaagccccttataaaaccatccgatctcgtgagaactaattcactaccacgagaacaggaggagggaaacaggccccatgattcaattatctccacctggtccctcccacgacacgtggggattatgggaactacaattcaagatgagatttaggtggggactcagccaaaccatatcacatcttaatcaaatgtgattgcttatcaggaaaactaaaaagctacactggaatccttactatatggcaggcatgtgctaaatgacccttgtgttttatgcctatgcctatgtggttatgcctaggcatcataacccacattttacagtgggagcaaccaagccttagagatgttatttgacctgcccaaggttacccagccactaggcagtgaagctggaatcccacccaggcagtctacgttacaccaaaggctgtgcctttgaccacccaccacagggtcctctacattcataacctatttttgtaaaagggactaaaataagaattgtcaccaggcacagtggctcacacctgtaatcccagtgctatggggaggctaaggtgggaggattgcttgagcccaggagttcaagaccagcctgggtaacatagcaaaaccccatctctacaagggaaaaaaaaaacagcaaaaacgtaaacaaaattagctgggtgtggttgcacgtgcctgtagtcccagctacttgggaggctgaggcaggaggatggcttgaacccaggagttccaggttgtagtgtgctataatcgcgctgctgcactccagcctgaatgacagagcaagaccctgtatctaaaagaagaagaaaagtattgtagatattaaatgtttaaataatgccttttttccagggctcccagatttccagagatttttcatccctaacttggaactgaagagctcaggcattaataggaagcagaacaggcaccctcattcccagcacaaagaacgccaacgtggacaccagcaccagcaccccgcaccccgatctcttccctgcctaggcccaccgtcgctggaaggagagaaacacgggcctggactcccctctagtggccatgaagctaactgcaccagacacctccacacccacccaggccagccaggtgcccggggcctgagccccaggtgaagtgggaacctacgcccaatgggcacacacacccactgagatggcagcaggcccctaggcttggagactttatccaggtactggaattgaggggactgaaagctgcggccccaaaagaccaaaccatacctgactccatctcatccttttcacctcatctgcctcccatccatccccccagctgaagggagcattagaagtcaggaggaagctgaccccaagaagcaggattctggccctgggacaataaccagaactctgaatgaatgtccagaacacttccccacacttggcctgtggcctccctccaaggctctcccccactcctctccatcctgcacgccccagcactctgcctctccaggaagccttcactgagccctccctccacaccatggtgctcagtccacagtctctcccttccctgatctcctgccaggagtaccaaggtcacctctcagcgcccagcacacctttcaagaccatcggttctcccctccccagccgtccccccagtgaaccggagcctctgaaggcagggattgcaccataaatatctctggtgcccaccccctcagagtgtcgcccaggccaggacaccagaacctgctcaactggctgcagcaagtccacctgaggactcagccttggaggccagagcaacgccggcccagcaaggctgcctctcttctcccagcactgctgtttgatccaaggcaccgtgagggtccaggcaggtggcccaagggagggaagggaaggttcccaggaatgcacagcctgagctggagacaggggagagctaacagggctggtagaaatgacccatcagcagtcgctgtgacggcacgaaaactcctgctgcgggagcagcctctcagggcacagcagctgaagtctctctggtggaaggtcccgcctgaaagagcagggggacaggcccatcagccctgaggagcagccacccccggcccagccccagaccaggcagcagggacctcccttcctctgaggtccccacctcagaatcaggctgatggggtgctgccctcccagctggtctgagggcacctcggcatgaagccctccccctgctcccctcctggctcccatctccaaggcctgaatgcattcgcatcttccggctctcaggagcaattccaactgccccatttatattcctaagtagaggacttgttaatatggagcctgcctctggggaagtgggaatgtgctgggtgagagatgacaaatcacagcccaacagcctggctgagagcactgatactcacctacatctcattcatcagcccctgaccctcctaccacataggccaagggggcagccctggaggagccactgtgggctccaagaagcacaggcattggtgggtggtggcagggggatctgtcctgccaggaggctgggggagggcccagcagcaagggggagcccagtaagtggatatgggtgaggcccaaaccagagcaatccctggaacaaaacttccactcctggctccagtgagagagcgaaaggcccagaacaccatcagtttcatcttgagccacaccagtccctgcctggagaagtatttggtcagtctagtgggccaaagcagggccagggtggttcctgttctggctccagcctggaaccacatgcacacacgcatgcacacacatgcacacacacacacactcacggcccaacccagatgcagggcagggcacgcagccagcctggccaggtgctaccttggtgagctcagtgcccagtcccaggtagggcgggtgtgcagcgtgagtaatggcaggcgaggaatgcacccgaatcctgataagggagaataataacttgtcaaagatatatatgatgtgtgtttgttttcccaacggaatatctatggggctaattcatcaagccagcgggctggctggagacccagggagggagggaggagagaggaggtgcacacaacggggcagccactcaggcagttgctgtggccctccggcctccaagggacccacaggcgggaacaccagggccctggaaggcactgaaatgggccctgcccagcagggctccccgcctctcagtgctcctccagggaacttttgggtctggaattcacaggaggcttctcacctgtttaggaatttcactgttctcttgtgtgctccttctctcatccactcttccttccttcctgctgcaccgtctgtgcaaagcccacccggtttgagaagccgaaaggtgatcagaaaacaccaccccttctggagaggtcagcagaagctgctcttcaggcagaacagagccaagaaggcagctcctacctcagccatcttcttctcatctatgccctgccaagagtgcagctccaagagggcagatccaagagggcagctcctacctgggccatcttctcctcatctatgccccaccaagagggcagctccaagagggcagagccaagagggcaactcctacctgggctatcttctcctcatctatgcccccctatgctcccccaccatctccctccccccacactcccataccccaatcctcctaggcagaatgggagagagaaagaaagaaggcaggagggcccattcgccttgcccgggtcatttcaaagatgctgaaggcagaaaaccctcctggaaacacagagtgcctgcaggaggctccacctgccacagatgtgcagaggggcggggcccaccccctcacacccaccccctcaccccctcaccccctcaccagagaagactcctcatctgtctctgccttagtgatcacccatgggatgagggcttcctttctaaccccttctctgccttgcaataagaaaccttgagttcgtgtgcaccctcccggcaggagttcggcctgtccctcagcccctgcatcccaagcccccagctagcctgggtacagccagggaccagtccccagaaggggaaccccaaaatcatggtcttgaaggaagggtccccaataagcctcctcaggagccacctccagaccctgccctcatgcttcccgtcctgcaggccgggatgggcatcttcccagctgcaccctcacccccagggcctcggtgtggcatctgactcacagaaccatcacccagctctgtgttccaccacacaccactgacagtgactccctcacctgggttggctccaagttggcattcagcatcctcctgtacccattcattcaacaaaggatggagcccctagtatgcaccaggctcattcttggcactggggacatgcctatgaagacaacagatgaggagccctgccgctgtggagctgatattgttagaatgctgaaatacttccacgccgattgctaaacacctatcccacccagcacttctcgcccctacctccccacggcccagcacctaaaggtgaacccctgtcacagctcagggggcttctaggaccctgcccagctccatgcctggtgtccatcctgatgagccagcgctggcgccacagtgctgttaaagattttgactctcacccctggatggcatatcggtagcccatcctgcaggaattaaatgagagcttctctgtgcaacagtcagcattggcttcctcccttcctttcctccttcctgccctcttcccctcctcccttcctttcctccttctttctctccttccttcactccctcttcccctccttccttctctccttccatccttgtcttttccattcctttcttctttgcttccttccctccctctttctctacctctttctctccttctttccttctttccctctttcttttctttctgctttccctctctccttctttcccttctaccttcattctttcccccttctcttcctccttccctccttcccctcctcccttccctccttctctccttctttccttgccttcttcccttccttctttctctccctccttccctccttctcttcctccttctctccattcttcccttcctcccttcctccttctctcctttcttcccttcctcccttccttctttctctctccttcccttcctcccttctttctctctctccttccctccttctttccctgcttcccttcctcccttcctcccttccatcctcttcctcccctccctccttatctccctccttctttatttcccttcctcccttccctccttccttcttgtttgaggcccagggtctccctcttagctaccttaccctctccagaccttcagctctgggcacagatctgagagaccacctgtcagtgcccacagtctccctccctcccacacagagccatctcccggatcctgagggccaggaaatatggagagcaggctccaagagtgccaacttatcccccacctccccgccctctccactgctccctaatggacactgatagcccattcccctctctgcctcctctgtccctcttcccaacactcttggttggctgccctgtccatggagggcaggccccagggctggaggaggctgcagggcgctggcctagcccctcccagggtatgaggaaggggagaggaaaaagggggtgtgccccctgccagtgtagcctaaagctggagagcaattaacttggcattttcaaacaagggcagaggaagcgggagccacaggactgagtcagcacatcagagaggcggtcgccaagctggctcagctcattaacaggacagggctgagccaacgagaaacaaggtcagagagaaggggtgggagacccagatgagatgggctgggggaggacgagtcaggaaggcagcagcaggccccgcaccatccccgccctgcagccagcctggattccatcctgactgcccactgcccaagatccgccctcaccctccacgcccccacacaacctctgcccccacccaccaatcggcacacatttcccaagcacctgcttcaggactggagtaaacccctccaggacttgaccttccaggaagatgtgggccaaagccctggggcctaagaaagagcacagggctagagaggatggaggcagatgagggccaggagacttcatggaggaggtggtctttcagtagctacatttaaagtaaggttgcatatcctgcctttttcctaaaaggaaacaaagcagctgaatcctgctatgtgctgagtaccttaccaggtgctggaggcacgacccacatggcctatgatccttacctcatcagcctgcaaggttctctcacttgtagaggaggtgagaggcacagagaggctgagtgggaggtagggaggtaagtgactcactcaaacccatatagctagaaaagggcggggctgggatttacacctgggtccgtctgactccgaagcctatgttttgttttgttttgttttgttttgttttgttttgttttgttttgtttttgttttgttttgagacaaaaatctcactctgtcacccagagtctcactctgttgcccaggctggagtgcagtagtgtgatctcggctcactgcagcctccgcctcccgggttcaagcagttttcctgcctcagcctcctgagtagctgggactacagatgcccgccaccacgcctagctaatttgtgtatttttagtagagacagggtttcaccatgttggccaggatggtcttgatctcctgacctcgtgatctgcccgcctcggcctcccgaagtgctgggattacaggcatgggccaccatgcccggccagcctgtgttctttctaaggcagggctcctgcaggtaggatttggcaaggctgagaacaaggaagatccccagagaaggcagggtgtggggacaaggcccagatgtgagaataaattgagtgagttccagcaaccaggccaccagccaggctagaggtgaggctgagatgtctccagcagcctccagcagccccaggacagggcttcacactcagggggtcaatgaccaacgtaccacaacttgggaggatctcctgagccacacagtaaagcatccttgcagacaagaaccaagaatgcaccagaatatcacactgaaccacggcatcatgattgccaattctactggcctgcccgcctttcttttctccttccttctgtcttcccttcctttccctctttccttgattaattattgacccttgagagagggaccatctccaagaggctgtgtgtggctctctctggttctgatgttactgctcttttctaagtaaggatggtttaggcagaaggctcaaggcaggggccacaggctggggggaagtttagtgacagtcaagaactggacaaaatctctggagtaagccacaccataactgtgttggccataagacacgggctcccagttgggtagagtctggaggaggaagggattcccttgctcagctaaattcctggtctgaatttctcattagcatcaacctcagaagtcccctctttccagtctcatgatatggctgtccctatactcccatctcctcatctagatatagacagatcttcccttttcttcatagcctgctcaggtgaggttaaaacattctgcaaatcagttttattaaaaaaaaaaaaaaaaaccagccgggcgtcgtggctcatgcctgtaatcctagcactctgggagatagaggcaggtggatcacgaggacgggagatcgagaccatcctggctaacaccgtgaaaccccgtctctactaaaaatataaaaaattagccgggcatggtggcaggcgcctgtagtcccagctactcgggaggctgaggcaggagaatggcatgaacccaggaggtggagcttgcagtgagctgagatcgtgccactgcactccagcctgggcgacagagcaagactccatctcaaaaaaaaaaaaaaaaaaaaaaaaaaaggtacataaatgcaaaatcaatggacaggtatcccaacacgtttgtcgaatgatacaattattccactagatttcactagagtaagttcttggaggcaggagttttgactttttgtatgcatctgtatccctgatgcctagaaaagtgcctgccacatagtagatgctcaatacatctttgttgaatgaataaattcataaagaaggaatggatgcggccagttccagtggctcacacatgtaatcccaacactttgggaagccgagacaggcagatcacttgaggtcaggagttcaagaccagcctggccaacatggtgaaaccccaactctactaaaaatacaaaaattagccgggcatggtggcgtgcacatgtggtcccagctacttgggaggctgaggcatgagaatcacttgaacccaggaggtggaggctgcagtgagccaagatggtgccaccacactccagcctgagcaacagagccagactccatctcaaaaataaaaaataaaaaaatgggggatgaatggaaagaatacctgccctgcttggtgctaaacgtggctctccccttcaccaaagctcatttctttcattttcagctctatacatctccaacctgatgaggccacaggactccctgctgccctcagtatgacttacaaacaagccccacctcaaacccaccctccttcctttgcagattcctttctcaccccctccactctgcatcatacacccttcaccctgctgaccacaccaaccataccagcacttgctgccatcctcaatgacaactgccacctgctatataccaggcacagaggaaacactccttttgtggaatctacaaagggtgctaagcactctatgggaatcacctcatgcaatcttcacagtgctgtacgcaggtactaaccttgcacccattggccaggtgctgtggctcacacctgtaatcccagcatttgggaggcagaggtgggtggatcaccttaggtcaggaattcaagaccagcttgaccaacatggtgaaaccccatctctactaaatacaaaaaaattagtcgggtgtgatggagggtgcctgtattcccagctacttgggaggctgaggcaggaaaatcgcttgaacccaggaggcggaggctgcagtgagccaagattgcaccattgcactccaggctgggcaacaagagtgaaattccacctcaaaaaaaataaaaaataaaaaataggctgggtgtggtggtgcacgcctgtcatcccagcactttgggaggccgaggcgggtggatcacctgaggtcaggagtttgcaaccagcctgactaacatggcgaaaccctgtctttactaaacacacaaaaaaaaattagccaggtatggtggcgcatgcctgtaatccaagctacttgggaggctgagacaggagaatcgcttgtatctgggaggcagaggttgcagtgagctgagatggcaccattgtactccagcctgggcaacaagagtgaaactccgtctccaaataaataaataaataaagaagattgcaccaattttagagacaaagaaactaggatgagagaggctcaaggttacacaaccggtatataccagactcagaccattaactgtttccaaaacccatgccatctacctctaagagtgatggtggacctctgactcccaccaggacagcttttaaggtcttcacgaagcatcacattcaagaatttccatgacattgaatttgcacttgccccaaagacattcattcaataaatcctgagcaccaactatgtgttcagtggatgtgtaaatggtggccatcagatccttgtcttggagtagtcatggtccttgtggtagacgtcgcctttgcctggggtctgtggtgctgacagcagtccttccatctctaatgctgcggtgtgtgcatcagtctagggaaaccctctctcctttggttttcctggacatgggctaaggtggcctgcagttctcagcttgcttgcagaactgacctgcccaacaggtcttttgctctaagaacaatcaaacacaagttaccttgcttcctagagagctctctgacaagccatcactcaagagttccccttgaagaaggtgttgtggggccctaacactacactcttgcaacataaaccacttcacacacttcaacagtgagaaacaccatctcctccaagcaaagcagcatggtgtcctaacggaagtgtccagcaggcatgggtcagagatgaacacatcattccacctgaaaggggcgaatgattctactttctgaaagttcctaagtgattactggtctaccctctcactttgcaaacaaggacacctgagacctgtcagagaaggttagagactcatcccacctcctaagagatggagctgggacatggacccgcttttctggtcccatgtcaagggccccttcccaggtcaagggctccttctcctatcacgacatgctcaatgtgacagggtcaggtcagcgcgggtgctggggtagagcagggtggggccaggcctgatgtcaagtaatagcatagcagccaccaaggcgccctggcagggttgtcttaacttcaaggaaattgcaagagaatgttgcttccctacacacctattctggcagctgactggctttgggcttgtctggatctgctgtgggcttgcagggtcctcatgcacccaggcccacagggtctttgtctgaaggaagggtcccatttctacagccaggccggcgtagaggccaggagggtgggaacagcccagcttgtctggaggggcccagagtcttgagcatcagagccctggggagcaagttgtctcctgcacccaggacaagggggtgcaatgacaccctgacacctcccctcttcttctccccaacccggcccccagcagagccagttgtcctcctccctagcccaggctgggggaagtttctcctgttagagttgaaaggagcctcttcagtgattaagccagacctgttcttcaagtcctccagccataatgagatttttgctgttcccaattagcttactttttgacaacattgtgccttctcttctgtcatttcctcctgccctgtctcagcccgttgaaatgcggcccatcttttaagacccatttcaaagctggcctcctccactgtccctgtgggcagtctctctcccagcccagagcctctggcccctccagacccacacatcattttctagtgtgtgctgtgacatttgtaaatgtctttttcctagcccagtgcctgccacaaagaaagctcaaaattagtttttaattgaataaataactccaacatactcattatgttacagatgaggaaactgcagctggaagaagctgagtggcttccccaaggtcccatagctagtcagtgccagaggcagctccaaaactcataacaattgtgatcccaccctgtcttctttccctgaccccataactcctcttactacctgcatcgagccagaggccacaagctcaggatcagtgattttttaattgccatatgtatcacacatacagaagaagatataaatatataagtacagttaaaaggacaacaatcagggtcaggtgcggtggctcatgcctgtaatcccagcactctgggaggctgaggcaggcggatcacctgaggtcaggagttcaagactagcctggccaacatggtgagactccaactctactaaaaatacaaaaattagccaggcatggtggcaggcgcctgtaatcccagctacttgggaggctgagccaggagaatgccttaaacccaggaggtggaggttgcagtgagccgagatcatgtcattgcactccagcctaggccacagaacgagactccatctcaaaaaaaaaaaaaaacaaacaaacaaaaaggataacaatcagtcacctatctgtgtctccaccacctggttaagacatgcagtgttactggtgcctgggaagctcccggtgtgcccttgctcccccgctgtgcccctcctgcattgccctggagttaaccactctgctaacttttgtgtgaatcattcccttgctttgctttatggctgtgccacttttatgtgtctccctaacaatgtatcaccttttgcttacacagctaggtttgtgcttgctattctgtttttcaaaaccacacaggatctgtgatcgctgcagtgcttaacactgttacgtttaagtcttcccagtgcagtgaactctgagcagatgcctgttataaaaccaggccacaaacacatgtacagagtcctcccatcagatctcacgcgctctctcctaaaagccactttattttaggcactgaattaatgatatacaaatgacatgcacagtgatgtggaattagcatatgtcttggattttttttcaggaagagattttgtatgtgtgtggaaaagtcaactgctcaggccctttccaaacggtttgttttgatcccagttgtctgacaacggggacctgcccttgtgtttggaggcagaaaagagcccccaggagcgtgtgaggagaagcaggctcagagggtcccccaggcccctcttcccttcccccacagccagctttcaccacggtggctttggcccacagctgccctagcccagggacccgatggcaggcagaagcagacctactttggtttccatggtaaccgcgggagtgcgccgcagccaacaaggcagctggtttgaagggtgttgatctctctgcagaccagcaaggcagaaccactagggaccagaggtggcaaccgagccagaaggagccacaggagctgggtatgcaaagttcacggggacctgtctgaagagcccaaccgctcttccccaaccctctgccacccatccacccaaacagaggcactcgctgagcagagcacatccaggctccactgtgaacacaactcagacccgcattcacaccaaatacatcccagcttcacatctgtggacccattttcaccaaggagacacatgaaagtggcacagccataacacaaaggaggggaatgattcacacaaaagttaggagagtggttaactcaggggcaatgaaggaagggtcatagttgggggttggggtggcacagggagcttccaaggcactaacaacattcgatgacaaaaatacagacccctggggctgggtgcggtggctcatgcctgtaatcccagcaatttgggaggcagaggtgggggcatcacttgaggtcaggagttccagaccagcctggccaacatagtgaaaccccgtctctactaaaattacaaaaattatctgggcgtgatggcttgagcctgtactcccagctactcgagaggctgaggcagtagaattgcttgaacctgagaggtggaggttgcagtgagccgagatcgcgccatggcactccagcctgggcaacagagccagactctgtctcaaaaaaaaaaaaaaaaaaaaaagactcctgcatataaatgcttattcacacatagtatataagattgacacccagaaagatccacattcaccccaatcaccttatctatacgcacccccctactgtacagacactgctcaggtggggcatgtactccattcaccgcatgcatgcacagacccatatctccctgacacacctatgcccacctgtgtactcacagggacacccccagacacatacccaaaatgcagatcacaacctccaaatgttacaactcagaagctgaggagcccaagctttctgaaacgactcaaaaacaagattgtgcttccattcagtgctggaaccaaatcactaaaccctaacaaagaccccccaggcttgttgcctcgtaaaccaggcccatcatggagggaggcctttcttcttctctgtttatttactcagagcagttttttctatcctccataaatgccaaaaggacaaaaatgtgtcactcagacttgaaataaaaacgcttatgatagccttacagagacacacactcctctttaagacgcccatgtgtggtgcccaccatgagcatgccccacgaggtgcgccacccaccaccccacaagacaaggacaagatgccttctgggtactgctctaggaaggcaggaaatgttgtaagaagcacggagtatcttgctaggccgggggtcagctcctgacctggccgggacacctcacagccatagactccatccacataggcccttgagaacaggaggtcacagagacacttgtggaggacatttggttgagaatctcttgaagcacatttgaagattcgtggcattattttcaatattgtcttaataatcacttttttttttttttgagacggagtctcgctcttgtcacccaggctggagtgcagtggcgcaatctcggctcattgcaacctccatctctccagctcaagtgattctcctgcctcagcctcccgagtagctgggattacaggcacccaccaccatgcccagctcatttttgcatttttagtagagaaggggtttcaccacactagccaggctggtctcgaactcctgacctcaggtgatctgcccacctccgcctcccaaagtgctgggattacaggcatgagccactgtgcccagccgatcacttcttaatgtgcagaaattgaaaggtgtatgtagcatgtacacatgtctgtatgcttattataataatgaccatatttattgggcacaaaaggtcaatacatgttagctattgttattattgtaattttacatggttaatgaaaataatgtagaagtagggggttgttaagatgagcttcctttatttcctagggttttgattcaataaactcttttcagttttagcagtagcaatattgcattgtgctgtattttacaaaacaatttcacgtacactatctcctttcaatcctggagcagctcctgggtgagggaatgatgctgggggagggagcaggtcatagatgagtaagacccagacccaggccttcgagagctcacaagctagtgaggaagggttccaggagcagctttgaaaccataccacgaggcctcaggttgtcacaaaggacctgccaaaggcagtgaagcacaggaaagggagtcattcgttgctcgggaagaatcaggaagggctggataatcaaagaaagcttcacggaagaagtcccactggagccaggcctagaagcataagtagattgaggcaagccaagttctgggctggaaaagggcactgaggtcccaggcacagctgcagaacagaagttggtgggcctaggtagcctgacttgaggggctggggcaggagcagggggaaataaagctgtgaaggtagactgaggcgggattcggaaaggccttgcaccagaggccaaagcatctggccccagcaaatgaccaagtgtttgaaacagccagtcttgtgctccagagaaacacctcacataccctaaggttagtggggatttaacccgagcataaaccagtaggattaaatcatgacatacacacagagaacacctttttttttaaactagattctttgatcccatagaactacccaactcttcttgtccctaccatgacttgtgggtatctgaccctactgttcatggaattttagattttcctgcttgaaagggaagggacggccaggcgcagtggctcatgactataatcccagcactttgggaggccgaggcaggtagttcacctaaggtcaggagttccagaccagcctggccaacatagtgaaaccccatctctactaataatacaaaaaattagtcaggcatggtggcaggcacccgaaatcccagctacttgggaggctgaggcaggggaatcgcttgaacccgggaggcggaggttgcagtgagccgagattgcgccactgcactccagcctgggcaacaaaagcgaaactccgtctcaaaaaaaaaaagaagaaagaaaagaaaagaaaagaaaaaaagaaagggaagggactttctctgtctaaatgtcactcctgggtcaggctgctgtgtcctcttttcccaacgctggtgattagaaacttcttgcttctctgccatggtggtgggcatggtgatgtggggtacagctgggagcctcaggtccacacgggagatttaagattgcaccctctcaggaacaaagccagagcccccgtccaaacccctacacctagctcaggccctgacccgtagaaggttctccataaatgtctgctgaactgccctgcgttgctgggtcacgcgaggaaaatggaattaagagtccgctgacccggagggctggttccggcgcactattgactggctccagggccttgagccggggatttaacctctcggcttctcgatttcctcgctggcaaaatgaatctgataccgccctgaccgcccttgcttagcaggggtgagtctcactagaggctgaaggcgtgagaaaggcacagagcgctgtccaggcagggagccactcgggctgccacctcccgcgcccgctggagaccgtaagccaggagagctggctcagccgtcagcaattacctgcgccccgaacacaacacctgcgctccacttccgcacaggcagatggtgcaatctggccgcgccgcaccctcccgcaccccacccgcggcggccttgccgtgacagcgctcgcgccaggtgtcggtgtgcaggctggtccgggacgctgcgactgcagccggcaggaacccgcgcgaggggaaaggggcgctgggaccaggccatgggatgcccaaggcacccctctcaagtccaagggaataaggccagcttctcctggattcttaaaacccctctgaaaggagagcagggagcaggtatcagctccctgcgttccacgtggagagactggggctcagagagacgaggtggcctgaggatggacacacacatattaagtgatgggggcggagggaagcccaagtctctaactccgggtccaccattcctccccgggctggcactgctctgactgcacagaccagctgactcgtcttgggcaagggtggaattcttccttttgcccagggctggctttgcctccttccaccccgtggccttgccactcctgtgccacccagcctcctcccaaacaccacgcccatctcacataccctaaggttagtggggatctgagccaagcataaacctgtaggattaaatcatgacatacacacaaagaacacttttttttccttttttttttttttttttgagacggagtctcgctctgtcgcccaggctggagtgcagtggcgcgatctcggctcactgcaggctacgcctcccggattcacgccattctcctgcctcagcctcccgagtagctgggactgcaggcgcctgccaccacgcccggctaattttttgtatttttagtagagacggcgtttcactgtgttagccaggatggtccccatctcctgacctagtgatctgcccccctcggcctcccaaagtgctgggattacaggcatgagccatcgcgcccggcaaaagaacacctttttttaaaagtagattcttcagttccattgaactacccaactcttcttgttccccaagaatcgtggggagctgaccctactgctcatggaattttaggttctcctgcttgaaagggaagggacttctgctgtctaaatgtcacccgagtcaagctgctatgtcctctttgcagcctgtaatcacctatgctggcaattagaaactccttgcttctctttcactgaaatccatcagtctcctgaaggacccagtcgtccctattggagccacacaacaaatccactctgcctttttctgcaccatccagcctgtgttcggaggcagctctgtctcttcccaaccaagggccttccttcacccgttcctcagaagccatgcttgcgagttcctttctctgtctgctcatgtccttcagagctcagcacaaacctgggttttgaccatgtgtcaggcagtgtgctcagtgcacggcctcctgacaaccacctccagagacgaacactaccgttagccccattttacagatgaggaggctgagaagtggaagaacttagtaggagttacacagcaagcagcagagccgatgctgcttctccccgctgtgccttgtgacccccaaggagagctgttctctcacccagcagttccattgaaggacaaggccactgtgcttggagtcaaaacatctggctttgcactccactgtgccatttatttctatttattttattattatttatttatttattgagacagcgtctcactctgtcacccaggctggcatccagtggaacaatctcagctcactgccacctccatctcttggattcgagtgatttgcctgcctcagcttcctgagtagctgagattacaggtgcccaccaccaagctgggctaatttttgtattttagaagagatggggtttcaccatgttggtcgggctagtctcgaactcctgacctcaaatgatctgcctacctcggcctcccaaagtgctgggattataggcacctggcccccactgtgccatttattattataggcacgcctggcccccactgtagcatttattattgtgtgacccaggcaagccacatgtctcagtctcctggtctgtgaaatggggattattatagtatcaccttccaggctgttttggaggctaggacgcatgtctgcgtgacctcaggactggtactccacattagctcccacttcccctcccaactggctcacaggagctagagcaaatgaggagattcatgctgcaccctatggggctcgagcacctcccaggttagggagccaggttcaagcttccaggtcccccacctggcgtggagtcactctctaaaatgatttgtcaagtgacaagcaaaaatatattaccaatttaagagtgtgatttgcctgcaactttttaatcctcgggctgttgttgaatagattaaagtgtctgctttgatccatgcatttagatggaaacataaatatagccatcacttattctcccggccgccaggatgggtgtcctgctgcatcactccgcttcccacccagccaggctaatgcatgagaatgtcctttttgtcattcacatccctcttgcatttcaccactgactcttctgctccggccagcacccctcagccctgcctaatttgaccacggctcacgctgggagatcatcaccacggaaagggtgggggcagtcccgcagggcttcccagctgcccgatgctgcaaacttcccccagcttggcagagccctgcaagaataaatctctggagaaatagattttgaagaggaatttggtacatagatcttctgtcagcggagcagactccggctcagctgtttttcaagttcgctgcttatccagagatacatctatttttacatggatctctggcgagatttcctcttccctcacagggtaggaggcctttgagggagcccaagggctggcagcggtggtagccatggggacacggggcagggggagccagggaggggctggtgcagtcctgggcttcctccacctgcagcatcctccctcggcccttctgctgagcaatgggaccggcctccctgagcctctatcactgcactggcccctctgcgccccctccacccacccaaaggccccagccatctccgtgacccccaagcctgaagtcccctgaggaggccaagggctgggctgagctgtggacaagtgttgggcgtggacacatacaaatgtgcacactggagggtccccaccatgtgcccacaaagactggcagggcctgcccactgccccaggttcatcctggacctacctgtggagctgctgcaaacagtaggagccagctctgagctgtgccagaggagaaatggctggcaggggtgccaagcagggtgctctggcaggcaattaggccccagacaatggcccgcaaatgtcagaagtggcgggaaggctggaattcactgaggccttgggcatatggaggagcacatggaagggcacagggatgaccatgtgccgatggagccaaaagccatggagctgatgctttcctgctccccatagagccctctggcaggctggacacccttatgcttcctcttcccaagtcccctcgaaaaaatcccctcactccaggaagctctgtgctgtgaggcccagccccccaagataatcagggaagagaagatagtcccaggataggaatgaccgcacagtgactacatctgctgcccggcctggctctgtccctgcccagctctatccctgccccttccccacaggccggcctccacctccagagggttctgtttccaagatgcccagaggtccagacccagccagtcctgcccaagtacccaagccctgggggcagacttccagccaggaagtagcattgggccagggtacaaacctccacctcgtagccagaccagcaggtcctccatgggctcagcactacccagcaatgatcatggatccacccttggtctcttccccctgaagcttccagttccattctcagcctcatcagcccattcccctgtgagagcctcgtccctgaaattgtatcgcctctctcttcttccagctgtgccagtctcttcctctaccctgctttccaatgccccacgcccgccccttctctccctacatgctgacacacagttcctgtgggccctgttgagccttttatgtgttcttagtccttctctccctccttccttggcccctgcactcagaaatgcacattcccatcactaccaaccatcccatcaccagctcatggcctttgtacaccctcctgccgggcctctgctcttcagctctccctggcctcacagatgggacctcgcctggctcctctccttcctgggcctgctctctctctctttactcttcttcctctttctaccttttctttggtcatcccctatggctcttgcccaattttctttctaccctctctccccaagccccaaaacattgctgccatgtgaatgtctcacacatttgtatcaccaggtgtgacatttctggtgtcctcaactgctcctaagatagttccaggttggcaggaactctcctgttatccctaagtcatcctgtctgcaacaaatgcatcatctaccctcaataaccagctccttggctgggcgcagtggctcacgcctataatgctaacactttgggaggccgaggcaggcagatcacttgaggtcaggagttcgaaaccagcctggccaatgtagtgaaacctcatctccactaaaaatataaaataattagctggacatggtggcgggcacctgtaatcccagctacttgggagtttgagacaggagaattgtttgaacccaggaggtggaggttgcagtgagccgagatcgtgccactgcactccagcctgggcgacagagcgagactccatctcaaaaaataataaaaataaataaataaataaataaccagctcctcctcctagagtgacaagtgaggttttttctcttgtttcctcaccggatcctaggtttactcctcctttcccctaactctcctgcccctcaccaacgcacccatgtaaccaatcatcatcctctagttgtctttgaaatgactcagcacctgcccaagccattccattctcattacaccccaggttctagcccttatttccattcatcaggactatggcaggtgctgcctaatctgccctgcctcatacagtaggcaatactgcctctcccgcaaaagtccatgccctaatcctggaacctatgaatacgttacatgacatagcaaagagggttttgcagatgtaattaaggttaccaaccttaaaatacagagcttagcctggattatccaggtgggaacacctaatcacatgagcccttaaaggcaaagaattttctccagctgaaatcagagatgaagcaaaagacaaagtgccaaaggaaatgtggcagaggccgggcacagtagctcacacctgtaatcccagcacttcaggaggccgaggtgggtggatcacctgaggtcagaagttcgagaccagcctgaccaacatggagaaaccccatctctactaaaaatacaaaaattagctgggtatggtggcgcatgcctgtaatcacagctactcaggaggctgaggcaggagaatcacttgaactctggaggcggaggttgcgatgagctgagatcgcgccattgcactctggcctgggcaacaagactaaaacgccatctcaaaaaaaaaaaaaggaaagaaagaaatgtggcagaagggaaagccagagagcttgcaagcatgagaagaatttgatgcactgatgctggctctgagatgtaggggcccatgtgcaagaagtagaagaggcctctaggcaataagggtggctccagcttgcagccagcaagaaaatgggatctcagtcctacaaccacaaggaatctgaatgaatttggaagcagattcttcccaaagcctcctcataagagcccagccagctgacatcctgatttcagtcctgtataatctagagtggagaaaccagtcaagccaacctggacttctgacctgcagaactgttaagatagtacatttgtgttattctcatctgctaattttgtggtaatttgttgcagcagcaatagaacacgaattgtcttcgttcattcctgctactgtaacaaaaatgctttgggctaatttttttttttttttaccaattcctccattacagactgggtcatttataaacaacagaaatgtattgctcacagtcttggaggctaggaaattgaagatcaaggcaccaacagatctggtgtctgatgaaggcctgttcctcatagatggcaccttctctgtgtcctcacgtggcagaaggggcaaagggcaaacaggatacatcaggcctttttctaagggcactaatcccatttatggtggcagagccctcctgagctaatcatctcccaaaggccccacctcttcataccatcactttgggagttaagttccagcatatgaattttggggacacccatactcagaccataacactaatacaccttaccatcatccattccgcaaactgctgctataagtcaccttgcacccccggacctgtcagaactcccagctgcataccatgtatgccccaaaccctcagcctggcattcaagggagtcagcctccagattttctttttagctcatctgccccagaaaccgccacttaaaatgcactggccaccttcacatcctccagaattgcctccagcgtcccacctccaggtctgtgctcatgctatgctctcatctggaattccttctccttcccaccccctcccccaacctctccatcaatccaaatccgccctctgttaaagcctcctgtgagccccctcctcccagaatcccccctgagccctccagcctccagaggcctctctcccctctggtctcgctgcctcacccacttagctctcggtgcacacagctttgtgttagattctgtttctcctcaagacaatctaatagcaagatccacagcttttacttctcttatgtcctccacgatgtctagcgcagttctggatatagagcaggggcaggagagcaacagaaagaggttgagctacaaataaaatgaacctgcttccagccagtgccctgtggagcactgggtcctagatgtgacaatctgagggcccccatccggccagggcctggctgccagaggccaggagagaaggcagaggcctcaggccaggaggctccactgagtgtggagagggggaaaggggcaagaacaatttcaaaccacatagcagctccctgagaaggataaggggcctctgaaccaggccagaaaccaacctgagccaggagcactgggccgagagcacatccaggtcagacacaagaagttcagagcaggagcggacagaagccgatggaaataggcaagctaggctcagagagcagggcggatcagcctacctatctggcagtgagagggacaatgtgggctctcacacaaagcgacagacacccatgaggatgagggcaaggctaagcgggggtgggggagcaaagagagaagagattaagaaggcagggaaagggagggctggagcgggagggtgagagaagacagagaaagggtgtggggaggagaggagaggcggggatttctcccttgacagccaccgtggaaataccacaatccctagatgactcctagcccaccagggttaaggtgaggtgagaagatggcaacaccccacccccctggccaccacaactaagaaattatgtagagtaattaatcaaaagctaatgagaaatgtgttttctctcccagcctagccccacatcatattcttattagctgaggttattacaatagtaatcatgcatgctccaggtgcaaattgggttttgtgctccactgccaccaatttagaaaaccattaatggcaagataaagcccccatggctcccgccaggctgagccgaatcaacctcctgcaggttccttgctcccagggccgcatgcccattgtccagggggcgctcttctgagcatcccaggaatcaggaggcctgcaggcaggagacaaacactgagggtgggtgggacaggggctgggcctggggtggaagatcttagacctctctctctctctctctgtccacacacacacacacaccggtgtagttgctagggcagagatagctccatgaaacaaagtataaagccaggtctgcctgggaggtccaaccttcccaattttctcttgagcccttcccccttgtgaacctgccctctggaaagggttaactaaatctgtggttcccaaacacaggtacacaaccaggggctgcccttgataaagtttccactagtaaaaagaagggcaatgtagtacatttttcacaaagctaaatgtactcaattttatagatgttctttttcttttttcttttctttttttttaagatggcgtttcactctgttgcccaggctggagtgcaaaggcgcagtctcggctcactgcaacctccgcctcacgggttcaagtgattctcctgcctcagcctcctgagtagctgggattataggcgtgcgccaccatgccaggctaatttttgtatttttagtagagatggggtttcaccatgttggccaggctggtcttagactcctgacctcaagtgatccgcccaccttggcctcccaaaatgctgggattacaggtgagccaacgcacccggcctagacgttcttttgtgtacttagagagcattgtgatagtatatagatgttcttaattctgaaattgtccttcctattttgtttgtggttttatatccatacatatacttgtgtgtgtgtgtgtgtgtgtgtgtgtgtgtgtgtgtgtaaggtatatatataaccttaccttattactcaggactcattcagctgcagggaatggatttaaaattatattgtaaaattggagatgtattggttcacataactagaaagaacatgggaaaagcagaagtcagatggtgttgtcaggcctctctccccttctccagctctctttgcattgtccttcttctgtcttactaaatttgagcttcctccctggggcagcgtcatggaaagaatggcccctgggctagcatggccaaaggctgctctggggtacattgtcactgcttaagatctcagagaagagagagctttgttctccctccacacccatggaaaagttcagggcagggctccgacggtctcaccttgggccatatatacattctaaggccaatcactgtgggattggcatgttggccagatctgagtcataggattactcctgagacaaggtaacagctctgcccttctgccccactagaatagggcaacagtcagtgctctagaggaggcaggaatatggtcattgaaaaacaggggtaagggatcccgggcaaagaccacagacatccactatacccagaaaattaaaataagaagaagaaagtcttgggagctcctgggtcaaacactgagccaccacgaaatgtcagagactattttgcccatgcaaatctcccaggattcacatagaagaaagttacattacactaaccaaagcaatgaggtgccaatggtaagttctcagcaaactcactagttgagctgaatatcagagggcctgtctgtgacagcagaacatattggtgattcctccaacccattccagattattctgcacagaaaaccaaagtgtcgatctagaagatgttcatagccatagtgcgatgagagtaagcagagtggtggagagcaatttctttacagaggaaacattccaggggcccaaagacctcatggaaatccagtcaagacaatatttccagaatactaagcccttgggcaaaatgacctccccatggtcccacagagtcagcatgcctatggctcatccagtcaatagatcagaagtatgctcagaacatccttctcttaaggggtgctggtttggttgtttctatcatttattattatttagtagtttgaacctgttacctgcataagtctccccaattaataaactgcccccataggcctgactttgaagtctgtctctattttttttttttttaagacggagtgcagtggcctgatcacagctcactgcagcctcaacttcctaggctcaagtggtcctttcatctcagcctcccgagtagctaagactataggtgcgcaccaccatgcccagctaatttttgggttttatttttttgtttctttgtttgtttgtttttgtgacggagtctcgctctgtcgcccaggctggagtcccgagtagctaagactacaggtgcacaccaccatgcctggctaatttttgggttttgtttgtttgtatgtttgtttgttttttgagacagagtcttgctctgtcacccaggctggagtacagtgacactatctcggctcactgcaacctccgcctcccaagttcaagtgattctcctgcctcagcaccccgagtagctaggactacatgtgcacgccaccacgcctggctaatttttggatttttttagtacagattgggtttcaccatattggccaggctactctcgaactcctgacctcatgatctgcccgcctcagcctcccaaagtgctgatattataggcgtgagccactgtgcccagcctctaatttttgtatttttagtggagacaaggtttcaccatgttgcccaggctggtgtctccacttcttactggctatttggctttgagaaaaactagttggcctccctgaccctcaattccttcatctgtaaaatgggaatatacctccatgcaccttcataaactggcctgagaacacccaggaggcccagagacactcttacattgtctggattcacttcactgagcacttactaagtatcaggcactgtgtaaggcagtgtgtgtgaagtgaggacttaggtggaggtctccctaagaatggtggcgagaaaagacccatgcccaacatgcatgatgcaaaagagagcgggatacatgcataagcaaggcatgaaccaagcgctgtgggcatttagggaaagaaggtattgcttccagctagtggatagggcagatttggtggaggaggcttcttctctggtctggaaggacaggtgaaatgtggtgatgaagaaggtagggcattccacagaggcaacagcccacactgagatctggagatgagaatactaagaaggcggggagagtacctcccctgaatctggagaaggaaggcagcagttggaagggtcctctcttctgggccatccgcttcctcctccactaccatatagctctaccctctccactgtgtgttcatgggtgatgttaggtgggcacagccaagggatggcatggaagaggggttatctcagggcctgtcctagagaagcttgggcctaggacaccctcaacaggaccatacatgtaccacccccgttctgccacctccctttatctgcctctccagcttggccaaggttcagtggtgctaattagcagcagttagctcagctcccccatccggcccctccgccagggcagggacgtgactgatcactgaggtttcctttctctcctgcagggaagacacagcaggaagctagaggcagggggcaagaggaaggagaagcagctccaggagttagctgaggtggataatagagagggaatggactttgtttggactaaacattgtcataggcttaaagagctgaaggcttctctagctcctgcttgggcaggacttctgataataagaactcctagcaagaaagtgcttgtaaaacccctctcctacactgtctcattagtttagtccccaaacagccatagaagacaggcattatcattatattatcattattattgttattattacttaatgtctttcttccttggtcaatctaagatccacaaggggcagggatcatgtcaaccttgtcacgctgtgtatcctcagtgccacataccgtgcccagcatagaggtgacattcaataaatagttgctgggtgggtgggtggatggatggaaggatggatagatggaataatggatggacagaaaggcaggtggatgaaggataaattatcccattttacaaattaagaaactaaggaccagagagaaaaagtgacttacccaagactaatcagacagcgagtgacagagcagcacccagtcccagttcacagcctccccatcgggcctgctcgcaatactcaaactgtctctcttctttgatttcttgaacacaatccaccaagaaaggtccacccttctgaagatctgattctcatccttcttccagcagctggtcagaagccaagctcctgccaactcggctcccataaaaagagcaggatcccgagagcctagtgaccagggactagagacacagaggccctttctgatcactggtctggaagaatctggctgccaactggtgaggtaaaggtagacagcgacagccagagtgcaagtgcccatggaagagctggcaccgacggccctgtgtgagcagcacagcactaggaatcacacagatgccagttcaaagccccagcacttgcccttccacaagcacctgcctctgcaacgtcttcccttctttcctccacctccatgcccctcactcccaacttctccaagcccagtctccttattgatagcatggagtcatgacggctctcacacacattcctctgaaggttgaattcgaggaggtgatgggtcctttcacacccaagtctggtgattttctcacagcagcctccctgccccacctcctgaccccgcccaccaccctaagggatggaagttcttcgtgcctggttctgttcctacctctgcccccagtgccacatcagagccctctcccctttggctctgtgttctgaggcagcagcctgcttaccttcgcagtcccaggatcagtcctccgtctccagacaaaacctctcccacagagggttctgtcttcctaggaggccccctcagatttcccacatagaccctgggcgggccatctggctcccactgtccctgttgccctctcttcctgtctggtttttctaaagcccacatgtctttgcccggaccgggcaggaatcctctacctcaggcccaggagcccaaagcaggcctcattgcattggggtttggaggcgcacctgcacattttccaggaaagggatctgtagctagagggaacctccctagaaagcttgagcttcactgcctggagaccccctcccaccttccactctgccatgaaagacagctcaggtttcatccactgtaactcagtgtgaattttgccctttcaggtgccctgttaacatgattcctcccacctggcctgacacctatgtggatttcaagggcataaggctctgccacttaaatcgcctcaacacccctgtcccttcccccgactgtggtcctcagcacaggacatggccttactgctccaccacgtgcttagtattcaagccatgcgctgccaccatgcttcccaccatgtctcctccaaagcagagccttccgcggtgtgccctgcaaggtcctagtgggtatccttgatgagaactagattctgtacacagtggatgctgcatcaatactgtggccacttagaggttagagggtgtattagtcagggttctctagagggacagacctaatggaatagatatatatataaaggagagtttgagtattaacatattaactcacatgatcacaaggtcccacaataggccatctgaaggctgaggagcaaggagagccagtccgagttccaaaactgaagaacatggagtccagtgttcgagggcaggaagcatccagcacggcagaaagatgtaggccagggggctaggccagtctctcttttcacatttttctgcctgcttatattctagttgcactggcagctgattagatgctgattagatgcccacccagatgaagggtgggtctgcctttcccagcccactgactcaaatgttaatctcctttggcaacacagttacaaacacacgcaggatcaatactttgtatccttcaagccaatcaagttgacactcagtattaaccatcacagagggcctatggttacagcagatggaaatggggaccctggtaaaagtggggatgctgtagaatcctggagttaacctctgaaagagatccaaagaggtcatctgattcaaaaaaattacttctttagtcccttccatgtacctaacaccggagacacaaagatagacaaggcatggtccactgagatgaaattagtgttattcctgttgtacagaagaggcaactgaagccaggtaaaggttaatgtctgtctaacttaccagcagctggtaagtaaaggggaggaactagataatactcaagtgccctggcttctttggttgattcaagggttcaaaatatgcccccagtgtagctgccagccttggggccagcctctgtgtcctgctccagatgtggcagaatgactgggagggttgcctgcgagtgggcagactctagcactatcaagtctctgttttgcctgaggcacatacagggctcctggcagaggagagtgggcgagaagctgggaagccacagcctgtgaatgcaaatgaggctattgcataattaattaacatcaaacagtttcattaagagatggagctgtgcggcggtttgtcttgaaaaaaaattgaaacaacagaaatgggacaagagaatggaggttccaaccacctggacctaactcagaagcgaacaattctaaccactgagggtggcgagggtggcttcagcccccaaatcttacatgtgggctttctggagctcctgttgtccctcctggcacctccatccaggcctcctccaggagctgaggtttggggaaggatggtgggcactgccaggcggagctcagggacccacagcagcagagtgggagctcactgggaacagaaatccctagctttgaacagtggctttgcccagggagggtgcagacaccctagacacactccaagactcatgcgctcaggctccaaaatggtctcaaagcactgtgggacagaaagaagccacttggaaaaaccaaatcagggctctatttatctctaaatctccatttctcctccccttcccaccccaacacccactctttcactctaaaatcccctgtcctctaagaaaaagggcaggggaacagggatctccttgccacgccttctaggagttaatcccacaaggaaggagcctccttgggaaccaggccatagggagtggccccccagttgcctgggctaagatcccatgggcaagggaggtcacctcttagaagaaatcctatcaacccttcatgacctggctcccgcttctctttccagctgcctcctcattctccctgtgtttcatccctatcaaggcactgcccattccccagcagccacagcctctcatgcttcctgccatccctcctgccttcaggccttcctacactccatcttagcagcctagggagctcctcctgtttcatcagtgcccagtttaaatacccctcctctggaaaacctgccctgactgcccacaccctacaagattaggtattttttttcccctacgctctgcacagtttgtgttgtaattatttgtttacttcactgagacaatgagctccttgaaggcaggaaccattatctttcttcagctttgtatcactaagacctgggctagactttaaaagtctgtctaacgaatacatatttgaactaaaaagatcacagatacctcgtctagatgcctgactcttgacaaatgtctaaactgttcagaatgagacatttattcccttcctgactgtatctccaatccctgcgattgagaagcagtggggatgggagacgtgaccctcagcagggtgagtttctaggatcgtgagcccaaaggccccgggtagttcctaacagggaggtgcctcgggctgagcagctgctgctgctccatggcaaaggcttgcggtgctggagagagccacaggctctcttccccaggtcgggggcccaggtgacccatccagttgttgtgcaggaatatggaggggctgaagggatcccagtacctctggacttccacagcagccgggccccttagagcatgccacacagccagccacagccctgcctgcccaccacaagggcctcccacccagcatcctctcctctcctgcccaccctctcctgctcccccaaacctgctgacccctggtggctttagccttccttgagagagccagaagggagagcatccattttaaattaacaaggttattagcagttaattacctgaggtatcattgtaattgaaaagaaaaagagagaagagaagctcataaacccaaccctttcttttcaccatccctggggtggtgcgggtgaccccggccccctccccacaatagggccctgcacacaccattgtcctttctttctccatgttcctccacctgcccccacttcacagggatattgaggagagggaaccagacccaaggagagcaagccacccgccccgcaggcacttcagggatgctgagacacacttggagtccataaatgcagagagatttatctcatattggggtgtgcagggaggaggcacaaatctgaagcctttagtcaatatttttagtgatttttttttcccctagattgtcctgttattctacaagttagtatggctggcatctgtcagcattaatgatgtttagtcccaaattcactgcaaccagagatcacagaccatctcccctccctcctccccactgccacccacccctgccctgaggacactgggctgcagggaggggaaggggtgcagagagaacacagaagacccctccctcaggctggccatgtgaactccagcacttgctgaagagctcctgaggcaaggatgccacatgccaacagttcttgggttcgtgtcctgtcactgagacttcacagaaggagccccagactcacggagtccgtgaagtaacccacctataaccctcacagcagcctcccattctccccaaactcttccctgcctagggtacaccagaaggaggagcataacccaagagagccaagaatccccccaaaaaaaatctcccccaaaggcaagcagtaggtgcaggtggcccacaccccctggccagtggccttagcagcactgctgggtgtctggtgtggagggcagtgtgggggctggacgggtgagcccgagtaggaaggcagcacccccagctccttcatgcctctgagatgccctgactcctgccatacccagccaccctccctgtcctccttccccctgcccccttttcctttcctctgtaaggccctggctccctcgcttaggccaagtcctctctcctctgctacctactttcctgggcagcactcagcccctcagtagtcagcattgtcaggagcagacccctcacctccctctcaaccttctggaagcaacaaggacagacagcaaagctggggaagggcagagcgcacagaaagcccacacataatcgcatatgtgcgccagtgtgattgtatgaagcatcatgtacataacagaaaatggcattctcatgttagccttttcaattgagcatttaccatgtgacaggtaagtaacattattagccacattttataaatggagaaatcagggttcagagaccctaagtgatatgtccaagaatgagatagagaaggacatgaacctaggcagtctgtctccaaactgcctaacccctccattaatatgccttccaacaatgtctgccgtggtgggggtgggggtgagggtggggaggagatggtcaggagtcaaggtgcgtttcaactttcccctccccactccgtgtgggaggctgctgctcgacacagcaccagagagagcccttcctcttctccctgacaggctgaggaacaaggggcagagtccttgctagggaggccaagccaccgggcaccgtctccccgaccagggccctcacccagggcgctggacctcatcctccctgtccagctccctgcccttccgtccacactcccaagggcaaagggaccccgccgggtcagggaaaggaaagaaccagccttgctcccctgtttccccacctgcagagtggctccatcgccccacctgctgagtcagcgctgttcagagtcccctggcactagcaaggtcacccatgccagggaaggcagccagtgggagagcagcagcgagtgtgggaaaggggcagaaaggcggatgtacaacccaggacctggagtttgaggttgtgcccagggctgagggcaggcccaggagggagcccagaaccctgaggccggccctggaactgggtcatctgagccggtgggtgggtctggtgagccactggatgtggaatgtggaagctgagtaggcatgtgaaactggaggggatggatctgacccctgcagtccccagagagccaagacgttccgggaaccacagcttctctccaaagaaaccaggacagctcaaccagtcctaacccctttcctttctttctcaggaatgaatacgcctgcaatccaaaggagaaaacaaagtagggagggaaggaaggagcctagagcccgctgcccaccctcccccgcccctaccctgtgcatctctggccctgggatttgccttctctgggtctctgcaggctccggacaagcagggatgtcagacctgacagagctgcccttctgatcactccctgccacttactgcctttggaaaaaaattactccactctctgggtaacagtttctgagtctataaaatagggataccacccaccttgcagtttattgcacaaataaatgcctaagccacggctatcactcaacaaatgttattcccactcctttgccttccctaccagcctcccaaagcaggaaagcccaggtgtcttgcaggaggagtaggcaaagaacctctcttcattcctggtgggcaggacagcagattctcctctaagcacatcagtggcattggtggagataacttgagaagtaatggcatctactggaaatcttgcaggaatagtggaatgttgatgccatgtgttggagcattcttgggaacatgctggaacgttcttgggggaacaccaggtgctcctgggtacacaatgtgatatcactagaagcccactgtgaggtatgggagcaacctggcactactgggagctcactgggaattactggagtgttcctgggattctgtgggaagtagctatgaatgccagtagcctgatagggattccatcaaagagatattggggcaatactgataatgctgagttgctggagacatattagaaagtgaccaggagctctctggagagcaaaagcacatggactttcctagggcactgtgagaactgcagagggcataatggagacactggggaccactagggactcctggtggggtcttcatgggtcccaccaagtgctgcactctgggctgtttactcttaatgaggggcacaggtgggtgggggtgcagccctcccgggggagccagaggcaggcccacactgccctggaagaaagagccactgcccttcaactgttcggcaaccacaaatgtgtgcttcccaggggtggcggcagcctcagaggaatgggaagctggtttagaaagtcgctctgaggagggaagcagttccaccttactgctaggagccctgcctggcatcagtcccctcaaactcagaccccaggccttatctccacccccgaggtgaggggacagcctgaagtagtgcgattcaggggtctcagcaacaacacaccgccctccgagtagcctcagagcgtgggcactggggaggggtctagaaaggatttacagccagtatctgcctgttaggactcagcagagaagagccttcttccccatggcacagaatagaggtagcaacaacccaagtccaatgccatagggtcaaatgtgggttcttccaacctgcccagagcctgtgggaatgaatgtagacacagctgaataactgagaagtgcatctcagaaagtccgcaagcaggcgcccgctaaccaaaatgttgaaaggtagaaggtcagggtcaagcttcaggatagggtcaagcctcctttcaaaagatctaggtatggtcagagtgagaaataaaacaggcaaggcagatgaagcgccaaattcagcatgttcaatatcaaatattcaatagcagatattcaattcccactccgtcccaggcaactaaacccagggtggtcattcccaggattcccaaagcaacaccatcatcatctctccttcttccctagatccctcttctcaaagaagagcattgctccatgccagaaacccaggtgtcacccaagacgccccctcggtcaccctcacagtcactgagatgctgcatcctgccttttctgactcatgacaaagctctctcctcttcccgtgactcttgagccacacctgatggctgcagttcatcgtctttcatacagacagcagcagctgcctctgggtggggaccctgcctccagccttgcccatctccacactgctgccaaaacgatctttctaaaacacagtgttagtcctgcctgccaccccaacaaagtcctttcttacctgctcagagcccacaaaatcgtattgaaattccagggaacaaaaggcctccaactctaccactccccagtgcaacctgtcctcctgccatcccaaatcccttgccagtctccacacttctattctcctccctcctccgggcctctgcgcgtgctgttcctttatctgcctcccaacagggctcgcgttccttgagaccatctgcagctttgcatccccagcacttgacgcgtagaagtgaagtcttgatggaataaatgaactgatgaagatgggaaagtgaaagattccatgagattgtagcattttcccagttataacaatgaggaaacagagaggtgatatagcttgtccaaggtaaacacagaatcagtaccataccccatcaccctttgctgcctcagcagagccccagagaaaccaaaacaaaagaaaaacagaataagaacccaggaggggttcagggtagcatagggcaggagtcaggagcgggcaaagagaggagatggagaagggagtttgttgaaggttggcagctatggctaaacagttcacagtgaagggagagccttcagagtccaggaagctttagccagaagtcagaggggtggacttgcagtcccaataggaaagaactttcctcctccaggaatcagaaagggactagagaaacccaggaaccagagtgaagacatgaggctggcagagagggggtgggaagaggggcactagtggctgtggtgacaaggctgtgtgcaggttattaaccctgggataactgcgtgagtcctgaaacagaaataaacctttctcacctccaaaccctcaccaggaaaaaaaaattaattttacaccacagtctcaggaagagaaatttagggacacacaggctgggcctttggcctgtgaaaacctcagcttcttagccccgttaggaaaatctgggctcttagagagaaggtaaagacttggataatgctattctctctatttctcacctccaaccctcttttctgagtcctctacatctttcaaaggccagattcccaccttggccctgtccagaagccttcccaactgccagaatttccagcatccactgttcctctgaagagcaaaagctcttcaccaggctcttcacctcccagcttattctgtggtcttctctggacaaggaagaccatctccctaaggtccatggtgactgggggtggagcagggagatggatttcccatcatcagccacctttccttgagcctagacccagtcccatcccctcctgctcagagttcagggctcggggactggcagggggaagctgtactgtggctggctggtatgttttgtcaagaacatatcagctgcttccctatttgggcaggaggaatccaggagggctgcatgccctggaaagcacctggtgctgctgggcccaaagaactcggcctcctctgtcccctgccttgcagcagccatgcccacccaagccaaagtgactcctaagcattccctgctgcggggcgcttggatgcaggttgaacatggctaagggcaagtcacttggctcaggacactgacttagtttctatgtgcccagcagagtcagggaaacttggacccaaggcaaccctgaggccccaggcagcatcatatacctgtctatcctccctgggacctttcagcattggggacgtgccctgtgtgtcgcttcactaaaccctgaggaatatgcctggctgaatcaggatgtgcccacagttcctcacccaggggcctcctcaccaacacccctgacccacacctgaggacttaaatgacagaggtagcagcgggcaaaaggccagtggaaggcggcagagaagctttgcacagcacctgctcctctatggtgtccagcctttccccaaccccaacccacccctcctcctgtgcagccagctccagccccagccacagagcaataaggaggaactggagaaaaaccgaggatccagcacagaccgcccaggccctggccaccaactcctccacccctggcagcacggagccccatcatcaggcgctaattaaatccccctaatgaggaaataaggatgcaggagccagctccgccatggcctccccggcccaccgctctcgcctctccatcggacttatcactcgtcacaggatgtttacaataatttttaatttgtgcaattattaatcacttttctatctgcctcatttgcataataattagtcatctcactgtttggcatgcctgtgaatgacagtgttttaaattgaattaagattttaatattctattttcctgctttcttccccctccacacgctaatcaaagtcagatttggcagcgagagagagggtggggaggaggttggcaggctctggacttggcccgctctgcgctcccgagaactgtgctaggaggagggcgtgcctgtagaaggtgacagcaatcccctctcacccaaatcctggctcttgaggggttaacccagccttggctaattgagtagaggtaatgagtgagaagtgggcaaaggcaactggggagggagggaatcacactggctcagtggcaccagagaccaagaaaagcactttcatttattttttttccaaataggctgctttttacaatgggaagttggaaagcatattacaggtctgtaattgatccccggttactagtctaggttaactttgatggctcagagtcccccaggtagaaaaacgcaggctggcgcagcctaaaacccatttctattcttcagatgtactgagaaaacaaatctctgcagttaagtttgattccccttccccctctccacacaccaacaaggccctctgcccaggctggacacctaacagacatgtaccagggggtgtcagatttccactgacaaggggccaggagcaaaggcagactgccctctgtcggggcagctgtgggtttatggatctcttgccctccagccctctcctgaccaccccaggaattcagctctagcctagaaaacgccctgctccatcccgtctcccgctgctgctgcctcgcgtgttgccatggcaatccctgtggctgcctgggatacccactgctgctccagaattctctgcttaagcagggcagctctcccgcagcctgtgtgagacaccgccctttgccatggtatgatcaccagcacgtagcctggaaagcctgatactggcctctcccttcaggtgagcagggagagaagatgggagagaggggctggtactgggcaagcaactacaggtcaggccacaacagcttgcggggccagactccagctcagcaggtcatgcttcccctggccaggggagcggagggaccccatcctggtacagcaaccccttcctcccacaaggatcaaggtctcccaactgcaagaggggtcaagggagggaaagtctcccacatggggaagaggaaatgaggtctttctgccagagttagaactgggtgagaggaaggagggctagaagattccaggagcccttccccttcacaggactccaaggctggtctgaattcccccctgcaagtcaggcagagaaactgtcaggcattccttgggtcccctctggccagggcatcctggggccgacccatgagtcctcctgccaatgtatccaggaaggccaataatccacccagaaaggcaccagcctcagagctggcagtgctaggaaactgcttgcccagtctttgcctgaaggggcaggaacaagaagtgtcagaattcaggaaaggcacagtccaatccaggatgatggggagtttctgagaaggtaggccctgggactttgggctgtgtctcccacccagactagaggaagcaggcggctttcttatcccattgtgcgccaggcccaggtgagcaaatctggtacaatcactactcaggggaccttagccctgtacgacaaccaacttcacccaccacagtcccagcatggcaaaaggagctttttagatagtgaggcacataacaagtgccgcagcagcctctgctggccgccttagccttccacacctgacgcacggccgaaaacgccggcggaccctcggaactatgcttaccatgagtccccgctggcccgggacaattctggtctacagctgttgtctctgcataattactaatagcaagcacacacacccttcactctcagaagcatcccagtttggacaataaattcagtggcctctaatcgcagccaagcgcaggatcccagcaagccaagcgagaaggtggagagactgaacatggagatgaaaagccttctctctggcctcaaccagggatagctgctccctttcagtcatcaccaaaggaggaaattcagagtccccagccctgggccaagacagatgcatctgggtagtcacacctgagggaagagggaaagcaggtatgcgggccggggcggaactaggcggaaggaggagaaagaaggaagaaagaagagcaggcgcagctggagggtaggaagcatgaaggaagcagaacgctatgactccatgtgtccagcaggtggctacactgagcggtctgtatcggtccatccccattgcagccgggcagccccatccagcttgccttgtaaggctcggggtgtggcttcctgtccttctgcaaagcccacctaagtcacaaagcccctctttcccctttaccctacttttcattcgcttttctccgaatgactccctagcctgaattacaaaatcacgaagacatttcacaaacccccatgccctcaccccgcacaaccccgagagacaagaaagagacgccagagcagtgggctccggggtagtgggattcctggatcgcttcctcctgggctggtgcctgcttgatgcagggctcctcagaaaccccctggtatctgcccacctgggttgggagtccctgagtacagaggtatagggaccactgtggttttttgtggtgtggaagtgaggtcatagaaatcagggaatttctatatgtctgtcattcagagaagttaatgcaaattagctgcaaagtaaaaaacaaatgtacactatttacatcagaagtcagcagttatggcatttgggggatcaggacagcagcaacagtccacactccacagggcctcatgaggtagtgagaagagggagccccaggctggtgcggatgggttttcctgcactgctgcccacccctgattccccagtcccaagtcactccaggtgaagcaatggccatatgtgtgggagggaggggaagtcacatcctgcactcaggcagcttgcagtctggttgatggcctttaggccccagtcccatgcttcctcccaccatggccccccagcctaatgccaagattctccccaggctggggccaaagtgcgattttatccccctttttcccaagtaggagaggattattgtgaaaaggaaaaataaggatcacagaatccttgggaagatttcaaagatgccctacctacatctgcatatcactaataaatagctgctgagttctggaagtttacacttgcccagttcttacctgcagtggaacctcaacctagcattcagtttaattcaacaaattaaatgtactgagtgtcttgtacaggccgggctttgtgccggatgctgaagactgtggtctctgccttgaataagccctaagtctggccgggggagaaaaacacgtcaaaaacactgtaatttgaagagactcacattagagtcaggtaggtacaagtacaataggagcaagtctgaagaggaagcatttgattctgccactctgcgggtagcacgggggccagggggaactccacaaaggaagtgacatttgagctggacccttaagggtgaataaggatttgctagggagaggaagaccagcgcagaagcaggagcttggaaaaaagcacagaggcctcaaagagtggtgcaaagtccaaaggctgtagggaagaggtcgatgaaccaagggcctcgaggcggaggagactggacacatcttgtagacagggcttcatcctgaatctgcttcccacacgacaaagcagtggaccttcctgttctcaggggatccttgtcaatactgggatcatcatgcttccccaccctgtttccaagaaagcagcaggctcctgtggctgggcctaggttggctggcagagcccctccaggaatatctgacaggagagttcatgtgctaattaagcatgcatctgatattgcagacacgacaatcaattagcatagctgattagacacctccacgaatgagctgtggtggctcctgaatgccctgaacccactctggcccactctcactcagagcaaccgcccccgactcactcattcatttgaagaaagagcagaggctttggtagagctgtggtctttagcctcagtttcttcacctacaacatggaaatattagcattaaccttgttgggttgttgtgagattaatatatggagagtacctaattttagtgcctaagttagtacttaataaatgatagctattagttctggggtgtaataccttggctttggagctagggatttgaaaatgaataagaaatagtttctggccataggaactcccaacgcacaaaatagtatgataaatgctgtcctcaaagtgccatgaaaactcagaaaatggctgaattggtaagcagatcctgtcctgggagcagtagcaagagttcaaattctcagttcctaagtataactgggcagacagggcccttctagcccctgccacaaagcccgggggtctcctagcacctcagatgagtgcttgaatagtagttttgtctttgccaacaacttttttttttttgagacagagtcttactctgtcaccctggctggagtgcagtggctcaatcacagctcactgcagcctcaacctcccagactcaagtgatccttccacctcagcctctcaagtagctggggctacaggtgggtgccaccatgcccagctaattttttaacttattgtagagacaaggtctcactatgttgcccaggctggtctcaaactcctgggctcaagcaacctacccacctcagcctcccaaagcactaggatcacatgcatgagccactgcccccagcccacactttctctttaattcatattaaaagacttttcaaattgactcagaagctaagtcctctccagcatgaggccatgttggccgggctcatctgagcctcaggagtataaccgggcccaagttgtaacccccattccggcctcctcctctcctgcaccaagaaaaaccagaacaaagcttagcatcctaccactttcatgctgagaaagcatagaagaacaagaaagtaggatttctagaggttaaaggtaactatactgagtccaaaacaccaactgcacaaataaagagatggatgcaacatggctccatctcctttctcacgatatgtgtaaaggagacacgggagcttctgacgatagtgcagtgggaatccgtggtgtgatgtggtcaccatgaaagctaatccaggccggccatggtagctcacacctgtaatcccagcactttgggaagccgaggcgggtggatcacctgaggtcaggagtttgaaaccagcctggccaacatggtgaaaccccatctctactaaaaaatataaaaattagccgggcgtggtggtaggtgcctgtaatcccagctacacagggggctgagccaagataatggcttgaacctgggaggcagaggttgcagtgagctgagattgtgccattgcactccagcctgggcaacaagagtgagactccatctcaaaaaaaaaaaaaaaaaaaaaaaaaaaaaaaaagaaagctaatccaatcttaaatacactgattaaaatagaatatctatctaggccttttttcagacatctctctctccttcacaaggaactgctctcctctctgctttcttctgtctattaaacgttccactccttaacccactaaaaaaattaattaattagttaattaaatagaatatctagctgagtgtggtggctcatgcctgtaatcccaacattttggcaggctgaggtgagagggagcccaggagttcgagaccagcctgggcaacatagcgtgacccccatctctacaaaatatttaaaatttagccaggcatggtggtgcacacctatagtctcagctgctcaggaggctgaggcaagaaggatctcttgagcccaggagtttgaggttacactatacatataaacacacacatacaaacacgcataatgtctacactgagggaagtgatacccattgtactctgatcagcacactttgaacattacggcccagctcactccaactggaatgagttcagagaagtcagtgtgagactcgaaatcatgcattaaaaaggatggttgaagaaactgggggaaaaaaaaagtcagatgggcccagcagctttcttctaatggcaacattatggctcttctagggtcctgcatccttttcctcctgcctctccctctggtgtcagcctctggcacaggttgtcacgcttggttctgctgttgaactgagggtagaggagaaggatgaggccctctaggggaggtgtccatgaacaccattaaaccttctgtgtgtgctcatatgtctatcacagcactgttcacaatagcaaaaatatagaatcaacctcaatctaagtggccatcaatggatgattggataaagaaactgtagtatatatacacaatggaatactattcggccataaaaaaagaatgaaatcatggtcttttgcagcaacatggatggaactggaagccattatcttaagtgaaaccaaatcagacacagaaagacatatattgcatgtcctctcttgtaagtgggggctaaataatgcgtacaccctgggcacggtggctcatacctgtaatcccaacactttgggaggctgaggcaggtaggtcacctgaggtcaggagttcaagaccagccaggccaacaacgcaaaaccctgtctctaataaaagtattaaaaaaaaaaaaattagccaggcatggtggtgtttgcttgtaatcccagctactcgggaggctgaggcaagagaatcgcttgaacccaggaggtggagggtgcagtgagctgagatcgcgccactgcactccagcctgggtgactaagtgggactctgtctcaaaaaataataataatgtgtacacatggacataagagcatggaatgatagacaatggagacttggaagggtgagagggtgggaggggggtgaatgatgagaaattacttcatgggccttatgtacattatgcaagtgatggatatcctaaaagccctgaattcaccactacacaagctgtgcatggaacaaaattgcacctctattccatacatttatacaaataagaatataataatttcaaaaataaaactccgtgtatgaagattaatttcctactaccttattatgtaaaagattgtctgcttcctttcctgtataagttttaatgcaagactctcctcctattagcttaatgctgtgggcccaggaagggaaacaggtagggcacagggagaaaaatttatcccaacacatctaaaattgtgtcagatagaaaggagttagtcttttttttatataagccccaagttggataattcagacaaatggtgaagccatggggaaagacaactggaaaaaagctagagttgctcaggaatggaatacatatgttcaaatgtgagtggaacggcacatcacataaatgtgttttgccaggggatcctggcactggggtgagtgtgaggattagctcttgtcgaaggctctttccaactttgattctaggattaatcgaattaacactgcatttccatggtactagaggggaacagcagttgagctagtgaactgatggaaatacttacacactaattggtatggggaaggtggaataactagaagccctttaaggtatcttccaactctgagattcttattttgtgattccagattctgaaagggagccactgtagagctactggcagatctacacagctgacaagatgcagctcacccctctgtctcaggtctcaggacaacacctggtgtgtgcacgtgggtggggggtgggtgtgggaagcagagatgagggcaggaaaagatagacatctgcagggccagagcttgggcacacacacacacacacacacacacacacacacacacacggtggagatccagagttggacccttcccttagctgctggccacagtcatctattgttggggacacagctgcctctacctcctctcccaaaaccagtgcaggcttgaggcaacctaagacaccaaacctcagaaccaaagtccatttgccaaagcataggtgccccctcaaaagctgggggacagaagatggtgctgagcacagaagctactgccagcatgaccagaaggtatcacttaaagtggcatccttcagccatctctgtgtgctctgagactgtggataagagtcctctagtcacccactacctggcatccccctctcactcccctccctgtccccagagctcctgctctctgcttccctccctttaatgcagggtggataggcagagaacacaggacgcttcctgccctgggccctgctcagacctcagtggttcaaacacagccctccccacagagttctcactacctgctccccattatgaccacagcctctctgcatcacccacaggtaacatggcccttggcagactgctttctccatcccacaggactcccacacacctcaccccactctgcctcctccactttatactggccaaaaacgtgactttcttaacaagccaaaaagctgctcatcctctcccaatatcccacccttgaactttgaaggctgagtcaagagttttacttctgtcaaaacacagccagtgcagagggccaaccttcttccctcccactgaggaactggaggggcttcctcaaggtctcatggacacagccttgcagctttggaagcagagagagaacaaaacccctgactcaattctcttcctcttttgctcctagagactgttctttttcctgccccttaggagacacagacaccgtagcaaccgcactaagcccagcggtaatgtgttttcctatatggagttccacccacctatgcaggagtccaccactgactatcttcatcataagccaccctgcccccaaccagcactatgctcaaaggcaaaagaaacaaccaaacaaacatgaaatgctggtgaaaactgcttttgaaattccacatgcccttaaatgttaaatgcagagaactcctcacccctccccacccccaccactagttcttatgtccccagcttcaaataaattcaaactgggtcctgtctggacaccaccaccagcacccacctctcccctgacaaggggcaatgggtaatagaaggctaccatgagacaggcaagaatcactggaacaagccaatcacttctcccccgcctctagacaccccctctccaggggacagaagatccccacctgtttgactactcttcttcaaatagtacatccctcaatcccacccagcaagagacactggctctccaaacacagccagagaactgtgaccctggtgttcaggtaaagccaggaataagacaagagaaggatcaacagagactgggacatgtgccactgaggcagcagacatgctctttaagtatctattttaagaaactatttattaagcacctactacatgccagacactatgctagataactttatttcagatcctctcaataaccagaaagggaggtattaccctgattttacaaataaggaaattgtgtggccaggtgcagtggctcacgcctgtaatcccagcactttgggaggccaaggtgggtggatcacctgaggtcaggagttcgagaccagcctggccaacatggtgaaaccccgtctctattaaaaatacaaaaattagccgggcatggtggcaggagcctgtaatcccagctactcaggaggctgaggcaggagaatcacttgaacccgggaggcggaggttgcagtgagctgagattgcgccactgcactccagcctgagggacaagagcgagactctgtatcaaaaaaaaaaacaaaaaataaataaataaggaaactgtggctcagagaagttaagtaacttgataggaggtaacatggactactttttgatgacctctcactctaggagactgaccaccactgacttcccctactaagcccaattaatgaagggaaggtcagaaggaccccccctcgccccccctcaaccccccacaaactgaacttcccactggggggagcagcagaagggagctgcttttcagcagttggaagcccaggaggaaatagccccaggagatgttaaataccacctgaagccccttggcatggctccatcctgcagcattatttttaccccgggcagcaaacatatccagcatgtgcagaaggaaactgcccccggctggcagcccactacttaatctgcatgaagagctgagctggccaaagcaggagacggccatcctggctggcaacagcactgtcaaatttgatggggacacagtgaccagggtaaagtgcccaagctctctgtcaacaagtaatcagcatgaaggtcctataacttcaggatgtatgggggaaaacaaggaagagtttatcctgctgggatatcccaaccccccttttcttgggagacccagaaatgtggctctccctaatctacaaccattcacagactgatctctccctgacaacagaggtaatgtaagtacgcactgaacatacacgtttgacacacagtaagtacttaatgaaagagagcaattaaaacaataatttttttcccagacaggcattcctctcttcccagaggtcttgtctaccacctcccaagcccctggcaaaaagagacaaggggccaggcgcagtggctcacgcctataatcccaacactttgggaggcaaggtgggcggatcacctgagatcaggagtttgagaccagcctgaccaacatggtgaaacccggtctctactgaaaatacaaaaatcagctgggtgtggtggcgcacatctgtaatcccagctactggggaggctgaggcagaagaattgcctgaacccaggaggcagaggttacagtgagctgagatcgcgccactgtactccagcctgggtgacagaatgaaactgtctcaaaacacacacacacacacacacacacacacacacacacgagtcaagggcacgtgcccctctaacacacttggttaggatcttcaaagccgagttccaaactgaaactaccagcaagcagttcttccaggactggggaactcagcttcaagtacactaggacctccttgcagaggctatgagaacccctggtaagaactgctctggacaggaaacagtcccttggactgccccctcacctcttaccttgctactggagtgaagataggtgggggtgacaactgcagggagaggaatctgttgtttaaattctgactctttcccaactcagagcgattttgagcaagttaacctctctgcacaattgcttcctctcctactaaaaggaaaataaagaaaacaggccctgtttactaagcactagagattgcatttttacgtgtgacaggataaagtcacacactttgtaattccttagctgacagagggcgctggatgtgatatgcggagggaaagactgactcctttttcagcagactgctctctgtcccctcccaagggggtgggttcacaggtactgcctgagtatcaacctaccaccaagatcgcccacgtgcccttgttttctgaaagggtgaagctgtataaggccaagatcaacaccatcaagtttgaatcattcaggagagataaaggagagactgagtcattccagtctattactacgtctattactactattatattctatctgagccagagtgtctgctcagtgattcttcttttttgttgtttttacattttttaaattttatttatttcattgagatggggtctcattgtccaggctggtcctgaactcctgtgcttaagtgatcctcccacttgacctcttgagtagctggaattacaggaatgcactaccattcccggcctgttttaatatttttaaattcagatataattatcataccataaagttcacccttttaaaatgtacaattcagaggtttttcacattgctcatggcttcttaagtctaaacttgaaagtggaggaggcgcaagaaaggagatttgattaaaaggaaaaaaaaaatcttccacgtagagaaaggtttccaaagcccaagtaagggagattctggtcaaaacctaaatactaggtctctctcttgaaaatcttttccatattggaaacaggattatgttctagatctaaggcctactattattaagtgtgtatagacccagggctccgctttcgccagtctagaaaaggcatatcacactgccctctagtagacagcctaggaaatgacagtcagctagggactggacaggcttgcgatctctgccctacaagatgtgctgtgttctcacacttacaggcagagaaattggagggggtggagtttttaaatgttcactaatgcctactaaataaacatagagctcacctgaaacagaatctaactgctttccctacaccttaatctctgcttaaaaataaataatacattcctgcgcatgcctgtaatctcagctactcggaagactgaggcagaattgcttgaacccaggaggtggaggtcgcagtgagccgagatcgtgccactgcactccagcctaagcgacagagcgagactcggtctcaaaaaaataaaaaatgaataaataaataaataatacattcctttgttaagggaaaaaaagtgatttcagatttctaaagcctctgagcctcttaagagtgaggtgttcctaagaaacagcgtgagggtcccacaaaaatgaagttaaaacccgaacccatacagaaacaaaacctagctgtgcagaaggggtgtgacaatgagctaggagttgaatgcctcctctgccaccttgggaaggcgagacagtaggatcacagcccacaagtttcaagcatgccatagcactccagcctgggcaacacagcaagatctgagctgtaaaaataaataaagtacttccatctcataaatgctgattctcgacacaattccagtttacattttatctccctacctaagcccttctctgacaatcactggccagagttagggaagagacatccctaacttggtagtgaccccaactgatactcccttcgggattttcaggtctcaaaactatttaaaaatctatgtatgtctcaaatggctgggggatggacagcctttctttacaagtctgagaagtatataatgtggcaaagataatatgttatgtgtccaacaacatccatttatcccttcttcctgatgcatattatatgcctcgggctcctttgcattaagagggagccttgtgactaggttcttaccaacagaatatgagtagaagtgtgtgccgcttctagagctagccggtaacatctgccaagcaatccttcacgttctgctcaactcactaaaatggtaatgcccaacacaaccttggaagccatagtgaagctggcatcagcctgatccctaaacaacttcatagagtatctcactcctactttctcaacctgaaacgacctgcatgttacacgagtgagcaggggggaaacacatgtctatttggagtctgctttagcagtttagtctaccctaactaatatgggtactaaatgtcaattccatgaaaccagaccttgcttctggagctgcacttagggcttcaggtgcacagaactgagttatcacaggcctgagttcatgatacacgatcactttcatccatgcaaagccctctttgcttccctttccccgcttcattctccattctagtctcattctgttccctcccacaaacctattctactgattaaggtgtatatcctccttataaaataatatcacttcatgtgtttatatagctgatttttgctttaaatttcactgttccttattttttcacttgaagtctaccatttcacgaaattcctaacagcttgcatttgacttaaaaaaaaaactccattatatgcatataccacattttacttatcaatttccttagtgatggacatctaagttttttccaaattcttgccacccaaactatacatagaaaaacatccttgtatctactcctcaaggatttatgcaaatttctccgaaggatatagccaggagtggaactactttgaagtatgtacataaagtattagttatctgttgctgtataacaattgttatggttataactgtaactgctgttgcttacctaccctaaatgcaaacttccttccctaaatgcttgagcagcttaaaacaataacaacccatagaatgagaaaagtatttgcaaatcatgtatctagtaaaggacttataaccaagatatatataaagaaccctttacgtaagagagtgcctgtgtatgtgtatatataaccaataacccaaatgaaaaatgggcaaaggatttgaataaagatttctccaaaagatatataaagatgctcaacatcactagccaccaggaaaatgcaaatcaaaaccataatgatataccacctcccacccatcaggatggctataatcaaaaagacaaataataagtgttggcaagcatgtggagaaattggaacgcgcatacatttctttggaataagtttggcagttcctcaaaaagttaaacatggagttacatatgacccagcaatttcactcctaggaatatatccacccctaggaatataaaaaagaaaatatacatccatacaaaaacttatacatgaattgttcacagcagcattattcataatacccaaacagtggaaacaactcgaatgcccatcaaatgatgcataaataaaatgtggtatatccgcacaagggaatattattcagccttaaaaaggaatgtagggctgatacatattacaacatggatgaaccttgaaaacattatgctaagcacaaaaagccagacacaaaaggccaaatattatatgacagtctcactcatatcttattaatatatgaaagtccagaacgggcaaactatacaggcagaaagtagattagtgtttgcctaaggctggagaagttaggggaaagtggggagtgactgctaatgggtacaaggtttcttgtacccacaagatgataaaaatgttttaaaattaaatgtggtgatggttgcataactctgtgatatattacaagccactgaatcatacaccttaagtgggtgaattgtgtagtatgtaaattatatctcaataaagcagtttttaaaaaatactaaacatggccaggcgcagtggctcatgcctgtaatcccagcactttgggaggccgaggtgggcagatcacgaggtcaggagttcaagaccagcctggccaacatagtgaaaccccacctctactaaaaatacaaaaattagctgggcatgggcacctgtagtcccagctactcgggtggctgaggcaggagaattgcttgaacccgggaggcagaggttgtggtgagccaagatcacaccactgcactccagcctgggaaacagagtaagactccacctcaaataaataaataaatactaaacatttattatctcagagtttctttggttcaagaatctggagctggatgttctgggtcaggatctctcacgaggtcgatcagggctgcaagcctgagggagggcttgagtagagctggcggatgcacttccaaggtgattcactcctacagaaggcaatttggtgctggctgttggtgagaggcctcagagcttctctacctgggcctctccagagggctgcttgagtgtcctcatgatatggaagctggcatcctccagagcaaggatccaagatagcacaaggcagatattttaataccttttatgacctaccttcgtaagtcacacatttctagtacatcctattggttacacaggtcaaccttatttattgtgggaggggactatacaagggtttatataccagagggcagagatcattaggggccatcgtggaagctggctgccctacttgatgataatgatgacaatgataataataacagctaataattctgtgacactactgtgtgccaggcattgttctaagcttacaataaacctatgaggtaggtactattatgtctatttcacagacgaaaaaactaaggcatagagaagttaactggcttaccaaaggttacacagctagcaaacgacatagctgggattcaaattcaggcagtatagctccagagccacactattaaaaactgcaatatcgctccctaggtattacttgatttcagtaagtttcattcatttgttctccaaaatgaatacaccagctgaaatattccatgtagccgggcacagtggttcatgcctgtaaccccagcactttgggaggacaaggcgggcggatcacctgaggtcaggagtacgagatcagcctggccaacatggtgaaaccccatctctactaaaaaaacaaaaattgtgtagcgcatgcctacagtcctggctactcaggaggctgaggtgggaggattgcttgaacctgggaggcagaggcaccactgcactccagcctggatgacagagtaagactctgtctttttaaaaaaaaaaaaaaaaagaaagaaaggaaaagagaaaagaaaagaagagaaaatattccatgagttctgattccccatcagatcagtctcttgcttatttttgccaaactaagatgtaaggtagaaactcagtgttttaattagcgtatctgtaattactagtgaggtaatatacttatgagccactctggttttctctttagattttacctattcatatttttgcatatttttatttcatctgtctttttcttcatgatttgcagaagctctttctatattctatcccttgtatatgcaatccttgtcagttttagacactgcaaatattttctcctaatccgtatccatctttagctttgactatgggatgctttgctaaatagaaacctttaattacaaagtaatcaaagctatcaaatcttatgcattgtgctttgggatcttatttaagaaatttatctttaccccaaggcacaaaaacatttgccatttgttcctactagctgtatatcacgttatctttcatttaggtctttaatcactttgggatttttgttttatatggtatgagggttcaactttatttttgtccatataataagccaattttctgagcactattatccatctcttccctactaacttgtgacactatctttatcatacaccatgtctccaaatatctgtgtgtctattcctgagtctagtttagtactaattcctgttttctcagaggaaggatctatcactaagaaagtttttactcacactgctttctagattagtgaaaaattcaaccaccaccccccaaatccccacaggttcaatattagcctgtattcttcccaaaacagaatacccagttaagaagataattttaaaaaaataaatacatgtttatttaaaaaagaaaaagaaaaaccctaccaagaacaaaccctggtcaatgagaaatcaatgcttcctctgaaagccagcaacagccggtgctgtcacacccaagaagtacaggtacctcagtccaaacatcaggtctcgaatattcttctgtggtcaaaactggcattcaacaagttgctggtctgtgtgggctccaattattagcacagacaactgttaccactggatatctcgctgcctatgcccactaccacagcccagccacccccacagcctcaggaaagttacatatcctcaacactccatttgtaggcaagttcctccactgccttcttgctggcaagcctggcaaagcgcttctgttcaaatccattggatctgcaatcaaaagagacatactattcagctagaaccctgaaaggggcatttgtttcaaaagaaagggaagagttcacaatataatgaaaaggggggaaagtaaggagtcatatgaaaatattttaggcatggccgggcacggcggctcacgcctgtaatcccagcactttgggaggccaaggcgggtagatcacgaggtcaggcattcaagaccagcctgcctaatatggtgaaaccctgtctctactaacaatacaaaaattagccaggtgcagtggcaggtgcctgtaatccagctattcgggaggctgacgcaggagaatcgcttgaacctggacagcagaggttgcagtgagcggagatcgtgccactgcactccagcctgggtgacagagactctgtctcaaaaaaaaaaaaaaaaaaaaagaaagaaagaaacaaaaaagaaaagaaaatatttaaggcatatgcaatagaatcaaagggacaaaatatatcattcatccttttcttagtccttgttcacacccttcccccactctgacagctatttcaaacgtttgccactctaaaagcctggttctctctcagctgatgtccacatcttatattttatccattcattacacaaacatttattgaattttcattatatactaggtaccatggtagacactacatgaaaatgagtatgacacagcacctgtcctgatgaactcccagactagtggaagagagagacatttaaacaaataaattaaaagaacagcataaactctggtagaaatacgcatggggtgtcatggaaacagaatgggtatcttaatcagcttgggggaggtatgataaaaaggtgacatgagggttgggcaagaatgatcagtaaaggctctgtgttaactacagcactggggatggaagggccagaaagggtctggaggtcatttcagaacagaatgagcaacaagaacaaaggcacggaaataagaagtggcctggtatgtgcagcaaaccaaaggcaaactggtatggctggaacctgaagtatgacaaagggaacagccatgagtcaaagttggaaaggcgcagaggccaatgcataatgagctgcgtaggccatggtaaaaagcttagatttcatccagaaacgatgggtttaaagcaagaacttaaactgcatttcaaagagatcactctggaggggatctggggcaggaaaatcactgcaatggtccaggcaacagatgatgaaggcaatgataaagagggacggaagagagaagacacaggaggcaaaattagtaagactaattagcagcactaattgattaggtacacaaggacaaagaaggaggaggcaagttagagagcacaagagtaggagcaggcttacagtagaagctgatgagttcagctttgaatacaatgcatttgaaatctctcaagtctaaatcaatagagaaatccaacaaacagctaaatacaccagaccaagatgcaaatactgatttggaaatcatgtacatataggtcatagttgaaaacatgactaggtaagaatcagccagagggagcacatagagtgagaacagctaaaaattatggatggagccctgggaaagacttaagaggtgcacagaggaagaggagtttgcaaaggtggccaagaatgatcagagaaaagaaccaggagtagggtgtcatggaaaacaatacaggggtgaatttcaaggaggtagtgagtggacctcaaatccctttaattaccatgcattctcttggtcttcttatctaaacttcttaaaaagcctgtattcactatttgtttcctcacttttcattcactccttaatacattagaacctggccattgtttcactacacaacggaactagccctttcaggtcatcactgacattccttgttgccaaatccaatgactcctccttcctcttccccaaatcagcaaacaggtcccaccagctcacccctgaccacatccccacttcctattctcttactaaccatccttactaccactgcctgcaagtcgtagttcagacactcattactttcagcctgagctactgcaaaagccttgtatctgttctacttccaatcttgtacctttcaaatccttcatattactgctataatggatttgtctatctaaaatgcagagctgtttttaatccttccgtgtctcccctttacctctagggtgaagaccaagctcctcagataggcttccagggccttctgtgatcacggtctgccaacctctctcatccatctcacgctttatgctatccaacaacagcaaattacttagggacccccaccacctggtaacaccatggtgtctcatagccttatgactctgcacatataggaccctcttcctttaatatccttcctttccttcttatcttggctggttaccaacatcccttaaaactcagctcccacatttcatccgttaggaagcacttcctgatcactcacatcctcctaaggctcaacttactcttcctttgtgctcccaaaacatcttgaaaatcttctatagtaacactaaccaaacagcgttgaaactgtctgtcttctattctagattgaaagtgagctcctgggctcaggggctatctctctttaatcatggaatccctagtacctactacctagctgcttacacttataacatgtatgctaagactttcccttaagggatgagtggagtgagtaacagagggctttaagaagggaagcttggccggacatggtggctcacgcctgtaatcccagcactttgggaggccgaggcaggtgaatcacctgagatgagaagttcgagaccagcctggccaacatggtgaaaccctgtctctactaaaaatacaaaaattagctgggcgtggtgctcacgcctgtaatcccagctactcgggaggctgaggcaagagaattgcttgaacctaggaggcggaggttccagtgagccaagatcgtgccattttgcactccagcctgagcaacaagagcgaaattccgtctcaaaaaaaaaagaagggaagcttattataaatggcatcctctccaaccttagaagcatggatggtattccaaagcaccaaggaaaccactgttttttaccttggaaataaggtcttaagagagttacactaatatgataatacaaaggacatatgaataacaaacaccaaatcctaagcagaatcagaaaacaaattgcaggagaactcacagtggaaagagctttggaccagagaatcaggaacgcagagttctaattccagctttctcagggaaattgcatgactctaggcaaactgcttatttattgggcctcagtttctcttttttttgagacggagtcttgctctgttgcccaggctggagtgcagtggcacgatctcggctcactgcaagctccgcttcccgggttcacgccattctcctgcctcagccttccgagcagctgggactacaggcgcccgccaccacgcccagctaattttttgtattttttttagtagagacgaggtttcaccatgttagccaggatggtctcaatctcctgacctcgtgatctgcccgcctcggcctcccaaagtgctgagattataggcatgagccaccgcacccggccccgtttctctttcaattaagagaggctgggtaattatcttatgggtttttccaacagatactatatatctgttccggaaatattcccttgcagcaggccgaaaagagacaaaactagaaaagatgatgaaagatgaataacaaaaagaaagcaagggtgacaaagggaaataa

SEQ ID NO: 1357 - DNA, 20001 bp, Homo sapiens
ggaaaaaagccagtcacaaaagactacatgttgtaaaatctcatttgtataaaatgtccagaaaagacaaataggtagagacagaaagtagactggtggctgcctagggctattgaggggaggggaggttgattggggagaaatagtgaataactgctaatgggtgtggggtttctttgtgggatgatgaaaaaagttctaaacttagtttgtggtgatagttgtacaaatctgtgaatatactaaaaaccattcaattgtagtgaatgttatggtatgtgaattatatctcaataaagatatttctaaaatcagggattttataactgagaaagaagggaagaataaagttgcagaggagacttgcagcctctgccacaccaaggacgaaaaggtttcaagagtgaagaattaatggcttcccaccatggcagactgagctgagctgaggctgtgttttcaatgcttttctatctctactcttttttttttttttttttttttgagacagagccttgctctgtcaccaggccatacagtggtgtgatctcggctcactgcaactaccgcctcccgggttcaagcgattctcttccctcagcctcccaagtagctgggagtgcacaccaccacacccagcgaatttttgtatttttaatagagatggagtttcaccatgttggccaggctgatctcaaactcctgaccccaagtgatccgcccacctaggcctcccaaagtgctgggattacaggtgtgagccatccccctggcctctatctctactcctaaaagaaccatttctgaccacttaacacccattagaatgttattttaaaaaataaaataaaagccaaaaatagcaagtgtgggtgaagatgtggagaagctggaccgcttgtacgctgctgctggaaaggtaaaatggtgcagctatggtggagaacaatacggcagtccctcaaaaaatttaatctagaattaccttatgacccagcaattccacctctgggcatatatccaaaagataaaagcagggactggagcagatatttgtatgctcgtgttcctagtagtattatccacaataaccagggggtggaaacaacccaaatgtccattgacagatgaatgaataaacaaaatgtggtatatacagacaacaaaatatcacttagccttaaataatgacaatcgggggccaggcatagtggctcacgcctgtaatcccagcactttgggaggccgagacgggcagatcacttgaggccggaagtgcaagaccagcctggccaatatggtaaaaccccgtctctactaaaaatacaaaaattagccaggtgtggtggtgcatgcctgtcattccagctacttgggaggctgaggcacgagaattgcttgaacctggaaggcagaggctgcagtgaactgagattgtgctactgccctccagcctgggtgacagagcgagactgtgtctcaaaaaaaaaaaaaaagaaaagaaaagaaaaggaaatctgacacatgctataacgtggatgacccttgaagacatgatgctaagtgaaacaagccagtcgtagaacgacacatactgtgattctgaggtatccagaatagtcagatttgtagagacagaaagtataattctggtttctaggagaagtgaggaaggagaaggtattggttaataggtacaagtttctgtttgggaagattaaaagtttctggagctagatagtggtgcacaacagtgtaaatgtatttagtgctactgggctatatacttagctacaatgtacaatagctacaatggtaatttttatgttatgtatattttgccacaatttaaaaaggaatttctcatactctaatggttttttgctgataacccaaacttaaagagcctgtgctgtaaaatacaactgcgctggattgtctttttgcaaatagcattatcagtgccctttctaaggtcttttatgagatgcagaggggacacttggaactattaatacattttctagaatcccttctctatatgagcctaggttagagtcagccagcgtgagacggaagaggagaggccattatgtttcaatgccggttgcagacagaagcatggacaggcttggagtttaaagcagcttctgggtgaccttcccaggaatcacatgcattgatattgcaggcataataaggcgagcttcccatttgtagccacttactaatgagcgtttgagagtcactccttctgaactgcaaaccaaggtggtcactcctccagcccttccaagagttggataaacctttaattttttgttttaaagcctttcatacttgaaatacgtggaatggcttttgtttttctgactgaacctggattgatacaatgggtagatgcaacacacactcatgcttccctgtttggtggcatcttatagtttcagtgttgaacatgttttgagttggttggaggtatatgtatatgtgtatgtggtatgtgctttgtgtgtggaaccatttgaaataattatagccaacatgacacttcactctgaatacttcaacatacattgtgaaaaataaggactcttttacaaaagaaaaaaacattatcatacctttgaaaattaacacaattccttaatatcatctaacatatcctacatattcagattttccccaaaatgctttcatagttgtttttctctctctgtaaattcaagctctaacacatctcatctggttgttatcccactttagtttttaaatttagaaccgttctccccaaccccaccatttgtttgttttcatgacattgatttttttttggaagagtgcaaggaggacatcttgtaaaatgtcccacattctggatttgagtgattactttctcatgattagattaaggttaaacatttttggcaaaaatactaggtgatatctggccattcttactgtatcctagctggaggttgcactctatttagtgatgttaagtttgatcactccgttaaagtgataacaaccagatttctccatggctagtaaagtttggttttttacgttattgataagtaatttgtggagcaatactttgaagccatgtgagcatcccattctgcaacaatttttcacccaatggttttagcattcattgatgatccttgcctgaatcgaatattatcctgagagttgccagatagtgatttttaaaaaattctaggccaggtgcagtagctcatgcctgtaatcccagctctttggaaggctgagatgagaggatcacttgaacccaggaatttgagaccagccttggcaacatggcaaaacctgtctctacaaaaaaaaaaaaaaaaaaaaaaaaaaaactaaaaataaaatacaaaaattagcctagcatggtggcacacatgcttgtagtcccagccactcaggaggctgaggtgggaggatcaccagagcctgggaggttgaggctgcagtgagccgtgatcaagccactgcactccagcctgggccacagagttgcccaaaacaaaatgaaaacttaaagaattccatcattccagctacatttattatccgatttcttctgtaagtaagagcttttagggaacttgttcttaaatccagagactttgaacagattccttccaggtgaacttgtttgtgctgccctttccttgactgtcgttttgtatcacagtgtttgcggatagctgcatttttaagagagttgcccctctattttgttttgtgtttttgttttttaatacacaagaattgctgactcattctggatgtgtagtaagaaggattttaaaatgtagattggtaaaggttagcaggtaccttattccttactgctcagcagcagcacttttgccttaaacacatggattaagcaagtgtatgggtctcaaatagacacttgatatgcaccaagtgagaagatcttctagagtctttcttttgtgacctgttctttaaagcaacattatgacttctccttctgaacagtaagtatttttttttttttttttttttttttggcagagtctcactctgtcacccagggtggctggagtacagtgctgtgatctcggctctcggcaacccagtcacttgggttcaagcgattctcctgcctcagcctcctgagtagctgggattacaggcgtgtgccaccgtgcctggctaatttttgtatttttagtagagatgggggttattccatgttggccaggctggtcttgaactcctgacctcaggtgatccacccacttcggactcccaaagctcccaaagtactgggattacaggtgtgagccaccacacccgggccaagtaaatcttgttacaaattgttctccttcagtcttgtcttctaagaactcagatgtaaactgtgaggtagcagtctttacttggtgttcctggactccatctcagaacgcaccaaaaacatctatatgattgtggagccactctacattgtttctactgctatcaccagaccttaatggaggtgtgggttttttaaaaatcaatatacatctcaaatacatttcagaaagaaaggtgtttatgcttaacgcagtgttaaaactatcccagcaagaaagtagtaacctgtgtaagcatttttttgtttctttgcttgtttgtttatttgtttttgagacaggatctcactttgtcacccaggctagagtgcagtggcatgatcacagttcactgcagcctcaacctcccaggctcaagcaatcctccagcctctgcctcaagcaatcctccagcctctgcctcccaagaatctgtagtttctgggactacaggagtgtcccacaacacccagctgattttttatttttttggtagagaaaggatctcactatgttgcccaggctggccttgaactcctgggctcaagcaatcctcctgcctcagcctcccaaagcactgggattacaggcatgaaccaccatgcctggccttttgtttgttttgaaataagttctatttgtcaaaaagaaagagaattaaatagaacatctataagtgaaaaaaatatagtcattataatataaaacacatttagctacagttggagagagaattagtaagctagaaggtagatctgagaaaatcacacagaaagaatcacagaaataaaaaggaggatattgaccaggcacggtggctcatgcctgtaatcccagcactttgggaggccgaggcgggtgatattggccaggcatggtggctcatgcctataatcccagcactttgggaggccgaggtgggtggatcacctgaggtcaggagtttcagaccagcctggccaatatggtgaaaccccgtctctactaaaaatacaaaaattagccgggcgtggtggtgcatgcctgtaatcccagctacttgggagactgaggcaggagaatagcttgaacctgggaggcagagtttgccgtgagccaagatcatgcaattgcactccgtcctgggccacagagcaaaactctgtctcaaaaaaattaaatataaaaaggagggtatgaatagacggtaagagacatggaggacagaatgggaggtccaatatatgcctgtaggatttccacgaagagaacacagggactgtggaagaggcaatattcaaaagatgatggctgagaaatttcaaacattgaagcaagatgtgaccggaatcctcaggtacaggaagcatcctgagtcttggtaggaaaaattaacacacaaccaaatgaggacacatcgcaggaatctgcagaacactgaaggcaatggatatcttaaaatcaaccaaagagaaagactaatgatctacacacgaagcatgattaaaccggcaactgatttatcatcaatgtaccttctaaagactgaaaggaaattaatggccaaccaagacttatactcaggtgaactattatttgagaggaagaagttaatttcagagaaagagagtttaccactcacagatcctcactgaaaagaactactaaaaatctgaaaaggaaacagaacccagaaaaaaggaataggatagaaggagacatggggagcaatgaaattagtaaacgtttaggtaaatccaaaaaacattagtgaaaatacacacacacacacttatgagactagttttcactaaaaattggtcaaatagtggcaatttcatatagttctacctaacaaaaatgtatttacacatagtttagtttgtgggggttttgtttgcttgtttgtttgtttgttttttgagacagggtctcaccgttgcccaggatggagtgcagtggtgtaatcactgcagcctcgaccaccctgggctcagatgatcctcccacctcagtcttctgagtagctaggaccacaggcatacaccaccatgcccagctaatttttatatttttttgtagggacgggggtctcgctatgtttcccaggctggtctcgaactcatgggctcaagcgagctgcccgcctcggcctcaaaagtgttgggattacaggtgtaagccaccctacacctggccaagtttatctcatttcctactgtactcccagtgcctagaccagtgcttatcacatggtagggagggctcaaaaacatctattgatgaagggactactttggaggaggtgttaaaagtaatgaggaactaaaatatcagaccgaagcaacctggaaatgggaaaggagagatcaaagtgaaagcattcagcagcctttgcattattcgggaggaagatagggatattgattatctatagactttgttaggtcagacaagaatattaaaattttaaggataacccataaaacgaatagaaagaatggataacttttaaactagtatatggggaagagagactaaagagcatccgattgacttctagtaacggacggtggattaattgcatgcattagcctctgctgttctctgaaatctcaataacgtggcattgaagtgcactttttacaaaatgcataaacccaaagggaaaatagaaaaggagacaaaaataacaacatttgggaagctggaaagcttccaaatgatcaaacggtggtgacaggcacacctgacatgaattttgaagcagcagtggagaaagccaagaaggcccctgattttcactactaaactctccaaatgctctgacattagtgtcaacattcttctggaagagtgggtggcagtgggactagaaatatggcagttggtcgagagtctgtttgagaagcagctgttctcttcaactctacttggctgggtacccccaaagcagcagaaaaccagatgcttattctctctgaaaagggtaaaagagtgggactccggcctggagaaaactaggtattgttgggggccagggtttttgtgctaagaaaaattaaggaaaactttatacattaaattttgaggctgggcacagtggctcatgcctgtaatcccaacactttgagaaggcaaggcaggaggatcgcttgagcccaggagttcgataccagcctgggcaatgtagcgagacccagtctctgcaaagaatacaaaaattagccaggtatggtggcacctgtggtcctagctactcaggaggctgaggcagaaggattacttgagcccacgagttagagaccgcagtgagccatgatcatgctactgctctctagcctgggcgacagaatgagaccccatctcaaaaataaatttttttaaaagactcctcagttcaccatctttccccatattgaaaatggaacaacattctccctgagaaatttggctggcccaaggaaataggcctaaagaaactgacttttgggggttccctgctctccagatggtccctcctaaattgaaccatggactcaggatttcacatcagcttcttctaatttatgcagctttcttctaatttactgtggggttttttcggtgttttttgttttgttttgttttttgagacagggtcttgctctgtcatccagctggagtgcagtggtgtgatcatagctcactgcagcctcaaactcctgggctcaagtgatcctcccacctcagcctcctaagtagctggggctacaggcatgaccaccacacctggctaactttttaattttttgtagaggtgggggtcttgacatgttgctcaggctggtcttgaaatcctggcctcaagcgatccccctgcctcagcctcccaaagtgctgggatttcaagcatgtgccactgtgcctggctaagaatacttaaaggtgaagtgagaagttcacatgatgtcatatcaggaggtacacaatggctacttgtcccactaatagcaatccttagttttttcacttcgtgaggtggtcactagcagacctcttggttggaaagataggttatttccctttgtaattaacaagtaacagaattgggatactttggcatcttaaaataccttggcaacctgatgaacatagcatacattcaagatttttgcctgaattaattattacattagaagagttgcagaatgagaatgttctaattctactatttcttttatatatttcagctgatgttattctatgaagaaaagctccctcatcagtgaagatgaactgcacttctttctaaagaggcaatgtcagacgggcacggtggcctataatcctagcactttgggaggccgaggagggtggatcacctgaggtcaggagttcgagaccaacctggccaacatggtaaaaccctgtctctacttaaaatacaaaaattagccgggcatggtggcacatgcctgtaatcctagctacatgggaggctgaggcagaagaatcgcttgaacctgagaggcagaggttgcagtgagctaagattgtaccactgcactccaggctgggtgacagagtgagactctgtctcaaaaaaaaacaaaacaaaacgaaacaaaaaaacagttgacagtagttgtttttgtagagtgaaaaatagaggtgggggttgagatactgctgctattttaaactaacttgtagatctgtttgactcttttttaaaaaacaattttttggagagatgaagccttgctatgtagcccgggctgctctcaaacccctggcctcaagtgatccccctgtctcgacctcccaaagtgctggggttacagacataagtcaccacacctggctctgtttgactctttatgtgcagtttgaactttttaactgaattttttaaaaggtgtgaaattagtctttaaaggaacacaaaaccaacagagaagcaagcaggaagatacaagaagcaaagaaatatcatagtaaaatgaaaatacaaaataatatgacataaataaaacagtaatcactatcaaattaaatagattaagtgagcccacaaggcattgtctctgggactagtccgctgggtcgaagtcctgccacttattggttctgtgacctttggcaaattaacttctctgtgattccatttctttcttttgttttctttctttcgtttttttttttgagacagagtctcactctgtcactcaggctgggtgcagtggtgcaatcaccaatcacaacttactgcagcctccacctcctgggcccacgcgatcctctcacctcagtctcctgagtccctgggaacacagacatgtgccaccctgccaagctaatttttaaattttttgtagcgattgggtctcactatattgcctaggctggtctcagactcctgagctcaagtgatcctcccgccttggcctcccaaagtgctgggattacaggcatgagccactgcacccagcctcaaactctgtaaaaggggaataatgataatacttgcctcatagggcttgtgggaaataatgctttattactgtaggttaaaaagcacacaaacatgcttgacacagtaggtgctacatcagtttactattgttgttgttttcagattggattttataaaaactctacttatttgcaatttataagaggcatacctaaaatataatgtcagagaaaggttaaaaagtggagccagggaaggaatttaagaagacataccagaccaatagtaatcaaaagaaagcaggtatgcaatgtaacatcagaacaaataagctttgcttatttggattgatagggatagataggattgatagggataaagcagatcattatttaatgatcaaagaagaaatttggctgggcgtggtggctcacacctgtaatcccagcgctttgggaggccggggcagggggatggatcacaaggtcaggagtttgagaccagcctgaccaaagtggtgaaaccctgtctctactaaaaatacaaaaaattatccgggtgtggtggtgcatgcctgtagtcccagctactcaggaggctgaggcaggaaaatcatttgaaccggggaggcagaggttgcagtgaactgagatcgcaccactgcactccagcctgggtgacagaataagactctgtctcaaaaaaaaagaaaaaagaagaagaagaataaattcactgggaagataaaacaattctgaacctgacaacatagtctcaaaatacgtaaagcaaaaagccactgagtcccaaagagaacttgacaaatttggtaggagattttaataccatttcctcaaactgatggaatcacagaaaaaaaatataagaacaagtcagcaaacttgatatggaaagaacagcatccccacctgagagtcagcagcctccatgcaggaggaccgaggggaagccagggagcagggcagcctgagccaaggccaagcccagttgaggacaggaagtggaaggaggcacctaggaaggctgaagatgcagaggagtgtgttccagaggcagtgggaaaactgggagggaatagttctcgggatgttggatagagagaataagcaaagaacaatgcaggaagaagagtggggtgggaggccgtgaccttgctagagagccttatgttttgggctatgaccagggctgacagaagtgtgaggcatggcgggttcagaagagagatcaatgatgcatcgcacatctctaaagctgatgaaggcagcaattggcactgaggccaacctggttgggactcagagaggtgggacacatattgtgtgccaggcaccctgccacatcttggagagaataagacacaaaccctcatctagtgggttggggaaatgatgcagggctcagtgtggctagcgcgttggggtgggaagcagcctgggcacgcccacaaggctctctgccttccagaatctggcccagttgggtttgaaaagatttaatgacaatgagctctctatggacctaccttgtgcccagtatttacctttcttatctgtaacgctcaagtcaatactctaaggtaggaattgttatcctcattttatttacagagaaactggagttcagagagattcttgcccaaggtcttgccctgggccaattccaggtctatctaactccaaagtccatgctcagtacactgtctcctgcttgggagcaaagagaggactttgctcctaagaccagacccataccacaaagagcctcaacacttaactactgggagaaaacaccgtcctaagtaaaaagccaggtgctcttccccttaccccagggggtttaggatttgggagaaagaggcctgatggaatataggggtaccaggtccatgtgttaactgatctgggtacaagaacagtaactcaaggccagccagggaaagaacagccaagccgaggcacagctgccaagtcatcacctctcgttccttgtcccaccatgccttgtctcagcacgaacataaccccctcagtttccctcttctcctgtctcctgcataggcagaaccagttctgagtgatagccaggacagcaggtcctcgggtcctcaggcttgccactacaacctgtttaccctgcgcagaccatgatccatcaggtcgagaaatgccccactgctagatgtttgtgtcaaaaatgcctgccggtggtgcaacagctgggtgggaccagtgacgtggacttgagtgccacaaaatgtaccgaacacattctgagtcaacatagtgatggtgtgccaactccagataaagattttcattattatttgtttgggttttgtttatatgtactcctcttcatcaccaaagatttgaggctacagaaaatgaaaattgaaatggtaataaaagagaggggcttgcagagaggaccacaggatggggaaaatagaaataatcgcagaaaatcatgacccgatgaagagcacaatcatagaagcactaacagatgacaaggttgccagatcttcaccattggttttgggtttcgtgaaaacccgcgaagagagggattcagtcaattacatattttttttccttctttcttttatttttattttttattttttcttgaaatggagtctcattccgtcaccaaggctggagtgcagtggtgcaatcttggctcactgcagccttcacctcctgaggttcaagccattctcctgattcagcttcctgaatagctgggactacaggcatgaaccaccatgcctggctaatttttgtatttttagtagagactgtcacacgcgagacagggtttcaccatgtttgccaggctcttgaactactgacctcaagtgacccgcccaccgcagcctcccaaagtcctggaattacaggcatgagccaccgtgcctggcttgttttaattttttattataaacaacactgtgatgaacatccacatagctaaatgcatgcattccatgatcattttcttaagataatttttttcttattatttgtgtatttatttatttatttttgagacggagtcttgctctgtcacccaggcaagagtgcagtggcacaatctcggcttactgcaacctccacctcccaggttcaaacaattctcctgcctcagcctcttaagtagctgggatacaggcacaagccaccaagcccagctaattttgtatttttagtagagacagagtttcgccatgttggccaggctggtcgccaactcctgacctcaggcaatcgcctgcctcggcctcccaaagtgctgggattacaggcgtgagccacctcacctggccttaagatacatttttgaagggaagaacattttctgtccaagtacattcctgttcacaaacccttttccataacactggagacttcctggggaggttggaaccaatggcttagactccaaaggaatgaatgtaccataaagctttcagcaatcttctgtcaatgctacttgtatagacttccagacaaacattgaagattgaatgcatgcatctaatttcacttttttttcctgaaatcctcctgaaactataatgaagaaatgtttgggaaaagatgtagccaggcactgtggcttatgcctgtaatcctagcactttgggaggccaaggtgggcagatcgcttgagtccaggagtttgagactagcctgggcaacatggcgaaaccctgtctctactgaaaaaatacaaaaaatcagccaggcatggcagacctgtagttccagctactcagggggctgaggtgtgaggatcacttgagcctgggaggtagaagctgccgtgagccctgattgtgccactgaactccagcctgggcgacagagtgagaccctgtctcaaaaaacaaaaaaaaaaaaaaaaaaaaaagagacgggatcgggaaaaggaagaaaagaccacagcacaattttggatgttagaaagcaaatggaccagttgtgactgatttagccggccttgggaatgctggtcatgagctggcagtgagaaaagatgagttccagcctgacttacaccgctggattctcaaaaggcgaagagatgatagtagggctcctgccagcccacgctgcacctgtgtgtgcaatagaaacagcctcccctttctcaagacactctacagccgtctgccagaaatttgacatgataaatatacaaatctgtcatgtctaccctgtgagggaggtggcctcagaatgatacagtgcacagcttgcacagccatatatgactgtcctgaattgggacaccagtttctactgaaagtagaggtgacggaggaggctgtcataaaacatgaaagattggttgaaactatttaaggagcagttagagctttagcttccctgtctcaccttagtagaagactggaagtttattctcttgaacgtcaggcagagttgagggcaggagacctgtactagcaagaggattaaatcaaagtataccctctgaaatgctgaatcaccctcctgcttcttccacttggccccagggacactgtattcaggcctttaccctccaggcagaagagtgaaagacatttcttaggggaatatgtccagctcaagaggtaagacccaaagattttcacaatggggttccccagctaaacatctcagtggatcaccctgcagtgacattcatagtcaataagtactacgcacgtattggagcttcaaatcacctttaaaatctcccattcttttcttttttctttttgagacagagtctcgctctgtcacccaggctggagtgcagtggtgcgatctcggctcactgcaagctctgcctcccgggttcacgccattctcctgcctcagcctcctgagtaactgggactacaggcacctgccaccacgcctggctaattttttgcatatttagtagagacagagtttcaccatgttagccaggatggtctcgatctcctgacctcgtgatccacccaccttggcctcccaaagtgctgggattacaggcgtgagccaccgctcccagcccaaatctcccactcttaaacttaagcaaccaaggattaccagtcatttgaggaaagattctaacatgaaagatagagacccaaaacaaacaaatatttaaaaaggaagttagagaaaactgagaatatacagaaagaagaacattgaaaaatgccattaataacatcagagaatgaaaagattacattgattaaacaagaacaggatagtataaaaagaccttcacagaataacaataacaaaaactcttagaaattaaaaaaaagatagtagaaataaaaactgaatagagagtaaagaaatagttcagaaagggagagcatgtagagattgaagtaagaacaaagataagaaaatgagaggatccacgccgggcgcagtggctcacgcctgtaatcccagcactttgggatttaatataaatatattaaatattttaaataatataattttaaataatataaatatattaaatatattaaatatttaaatatattaaatatttaaatctttttgtcttgctgagttgtatgagatatatatatatttatatataaatatagatataaatacatataaatataaaaatatatatatatctcatacaactcagcaagacaaaaagatttattaaattcattcagtcaacaaatatttattgaatacctactaagttctagtcatcatgctaggcactgactgttcaagaataaacatagacaagacttctgccctttcagaaaccagccaagattcttcaacccaaggcagctgtgaagtataacacatctctggctcaattttctccatatggtttggggttccatgaatgagtctgtgggaagatttcctgtacgtagaatgcatgtataaaggaataattattctatggttcgaaagagaaaaaaagtaagatcaaagtgtagaagctatgttaagaaagattccagtttaatgatttttgaaagagcagtaaaaataagaccaagatgtggaagctgtattgagaaagatccaatttaattctaataatctttaacagaattgcccaaagatagaatgaattgttttgagagatggtacagttagctgtcagtgggagtgttcaatactaagcaagattcactcgctcaaccattgagtgatgaccacatgcaggcactgtgctaggctctctgtattttcagtaagctattgttgtacaacaaagcaccctaaaacagtgtcttagaacaacagtaaatgtttatgatctctcacaaagtctgtgggtcagcagcttggctgtgtgtttctggttcagagtctgtcatgaggttgcatctgaaggcttggctgaggctggaggatctgtttccaaggtgaatcactttacatggctggcaagttggtgctagctgtttggaaggggcttcagttcccccctgtgttgacctcttcacagggctgcttgcacgtcctcccaacatggcagctatcttccctcagaatgagtgatccaagagaaatcaaggtaggtgccacaatgccctttatgatctagacttagaagtgaaataccatgacatagcctattgatcacacatcagccaccattgtgagggctagctaccacatcctgcaaatacaatgatgaacaaacaaatggtgtgcctgagctcgagggctgttagcctagagttaagatcattccttaaatgatatcaaaggaattagggctgagagacaaggttgttccctccaaccctaatgccctgtgatcttatgattccaggtcctaggtcttttgttcccatatcaccaatccattatctcagaaccagcagctcaccaaaccctcgctcctcagatgtgggccattcgggggtttttattgtgcccctgcattgtcagctacttgtcatcacacagcaagatagcatgactccaccctgcacgctctcagacaggagacaagggagtgcccaaataaccctaagcttgttgtttctgtccccaggacatacctcagcctcctcctgggagcacagggcatactatgataacagcaggaggacacggcgtccccatgcaggagctgcttttgatcctgccaggacaatccctcaagagcagcaaggccctgtatgtacaggaagagagtggccctcagatcacttccctttgccctaatcagggccacgtagtacaccagagacctcaggggtagtgaccctggatgttctcagaggacttctgacctttgaacttggggatgggcataggagtgtggctagcatctcagcctggcccaaaccagtgctggtcagcatgcctttgaggcactaacccaggcccacagaggagtcatctacttccaagtcacctgaggagccagtggtgaccagggagataatggcctgaaattgtgctggctctgagggactgttgggtaagctaatgtgggctgggctggagttcaaacacacctccctggtgcccacagggacctcccagcacacgctctcctatgggtctcaatgattcagtctttcctggtggcatagactgtagcctggagaagctctggggaatatttcttttcttacttatttctggttttaaaagtactactctcaggatgactattgttaaaaacaaaataaaacaaaaccaaaaaataacagaaaacaacaagcgttggagaggctgtgaagaaattggaaccctgggcgtcaccagtgggaatgtgaaatggtgccactactataaaaaaacagtttggcggttcctccaaaatttaaatatagaattaccgtgtgacccagcaattccacttctggatatttgctcagaagaattgagagcaaggactggaaagatatgtgtacacccccattcatagcggcagttttcacaattgcttaatggatagagttttctgtttggggtgatgaaaagattttcagaaatagtggtggcggtggttgcacaacattgtaaatgtaattaatgccactgacttgaacacctataaatagtttaaatggtaaattttatgttataaaagtaatactaaagtggtggcatttttttcttttcttcttcttcttttttttttttttcttgagacagggtcttcctctgttgcccaggctggactgcagtggcatgatctcaactcaccccagcctcaacctcctgggctcaagcaatcctcccacctcagtctctcgagtagcttggaccacaggtgtgcaccaccacacttggctaatttttgtattttttgtagagacaagttttcgccatgttgccaggctggtctcgaactcctaggctcaagcaatccacctgtctcagcctcccaaagtgctgggattacaggtgtgagccaccacacctggcctaaaatggcatatttttttctttctcttcttttttttttttttggagacagagtctcactctgtcacccaggctggcagtggcatgatctcggctcactgaaatctccgtctcccgagttcaggcgattctcctgcctcagcctccctagtagctgagattgcaagcacgcaccacaaagcccagccaatttttgtatttttaatagaggagggggtttcgccatgttggccaggctggtcttgaactcctgacctcaagtgatccacccgccttggcctcccaaagcgctggtaaaaaaaaaaaaaaaaaaaaaaaaaaaaaaatcccattccaccacttgctaggtaatgtacctcaccattctgaagtgcctcttcctcatctattgtgtctttgatgtgatggtcgatcatgagaattatatgagccaatatggtaatataaggtggtttttaaaagcacctcacactaccagcattgcagtcagcaatgaattgccatccttgcattgaaaagctctacaaccgttgccactgggcatttcttattggccatcatttgtagggggctttcacctcctcatgtattccctgttttcccttctgtgacctcccctcctttcctactcttcattaccacctcaaatgccagtgcagggaatgcacggaacaattgactccatctctctgccttgtggtctctttccagccagttcctctgggtgtcctggtcaacagctagcatgcactgtcaatgacattctctctttcagaggtattctaggtctaactgttaagctaacaggattttcacttccttacacgttcacataccaatatgtatgtgtgttccttgaccgggttgtaaagtacataatagttgaaaccttgcttttttttttttcataaaatatcttggacatcttcccataaataaacagattccccaaaccaaaccagagtgttttgcttgaactcaggacctcatgagagatctgagaccagctgttagagaatctctgagaagggcaggtagaggctgttgcccaggtccccagtcagctcagccgctggagaggagcagaggactgactggccacagggggactaagtccacctgctagctcagaacaggaggaaggctgctttccttggaagatgggaccaaccctaatgaggactaataagtgtatctcagacaaaccaattgaccaactggaacaggccagagatgagggtgtgtcttccaaggcccaaagcaagagaaacatccctaagagggaaggggtgtgtggggtgtgtcaatcaaagtgatgtgtgtgtgtttgtttgtttttgagacagagtcttgctctttcacccaggctggagtgcaatggcctgatctcagctcactgcaacctccacctcctgggttcaagcaattttcctgcctcagcctcctgagtagctgggattacaggcgtgtgccaccacacctagttaatttttgtatttttagtagagacgggggtttcaccatgttggtcaggctggtctcgaactccctatctcaggtgattcacccacctcagtctcccaaagtgctgggattacaggcgtgatccatcacgcctggcctcaatcaaggtttttaattgctagccacagaaacctactctggaagacataatcagaagatgaacttactgacatatttccaggaattt

SEQ ID NO: 1358 - DNA, 20001 bp, Homo sapiens
ggtatttactgtatatcttaaaaaaatccaaaacatccacccacgatttttaaaaaatatgaatgacaaagttatagccatcaaataaagatgaagaaaaggtgagaacatgggagtgaacatccttctctggggctgggagatgcaatggtagtgttcccattcttcatgtctttagcagataaaaacaaaaaactggaagatgagaatattagtaggaagcaataaggaatgaggcaactcatttgagcagctagaaacagaatacccacctgtggctcagaaacaataatgtataattcatgtgcttccaatttgattgatgccaacctgaatcatgaacagcagctcaggatagttgttcctggatcagaagagaggtttcaagtcagaatgttgctatgttcactattgttcctgcactgtgagtaataaatcaccttattatcaccacaacccctacatcataatggtgactatatgttgcctattgacttctaacttatatatttattgttgctctggtaacattattatgcatctaataaatgttgtaacataatatatactttttacttttaaataaatgttaagacacaaaatccagacaccaagtttttctcttgtcttcagggttgggaggttacataattgttcaagtctattggtcaagcaggtgagggtagatgcaggtggtggaaataggtaggtggtatgtgcggagaaactaagatgaagccatgtaatttttttttttttttgagacagggtcttgctcgtcaccctggctggagttcagtggcacaattatgagtcactcaagccttgttctcctgggctcaagtgatcctcctgccttagcctccctagtagccggaactacaggtgtgcaccaccactcctggctatttttttttccagtagagacgaggtctcgctgtgttgcccaggcttgagttcctgaactcaagtgatcttcccacctcagcctcccaaagtactgggattacaggtatgtatgaaccaccatgcccagccatttgattctttaaaaagagtgaactgtggagtcagattctcatcacttatcatataagattttttaccttttttgtcatatcttccaatgaccttcttatatcttaagtaaactgaaaatgttaataccaacactcatactgaccaagacaggtatgacagaatcagtaaattgtctttactgctataaattttcatatgcccatttatatcaaaagtgaatgtgaaacagcaggacatcaaattactttggatttcctgtagccacacatgtgtagtttatgaaaaaacatgaattctgataatgctttaggtcatgtggagaaatgaggcttctaaaatagtgcttagaatcagtgagctaaatcattaactatcatctattcatgctgatatcttcttggtaagcaattttctattttttcccctagaggaaactgacttttgtccattgttccagctgttagagtgcacatctttcaattcaaatgcaaattgtatcaaaagtcttatacatgcttcttcatctaaatttgacaaggtttattaatagagaaatagactaccaaatacttatctttcagcaaggattatcaatattactaagttgtgtaacaaatgcattgaatattttattggctcactcataaatttttgacttttgataggataataaccgctctgtagaaagacattgctgtttctcatcagaagaagctaatcatttcctgaaaacggaaaatatgaacatagtaggtattcgtgttcattacaggaaaccctggttctatgtgacctccaagctaatttcagcagaaattcatcaaaagggttaaaaaccattcccttatttaggaaatgctctctttgctaaattcaaatttaatagtatgacataaataataacacaggcaaggaggaaagttgtgtaaagtatatcctagtgaaaatgagatctctggcatagctggactgtaggtgttccaagctattgattatttatatttgcttctcacatagggcgcaagactcatatcttacttctactcaattctgttagaaccagcttgaacaccacactcctttctggtagaaaagccagtgtcaaatgctggctctccttgatcatacaagtaattcagaagctgatatcatgggaaatggatgcccagcaggccaacctttttttttttttttttgagatggagtctcgctctgttgcccaggctggaatgcagaggtgcaatcttggctcactgcaagctccgcctcccgggttcacgccattctcctgcctcagcctcccgagtagctgggactacaggcgccagccacgaagcctggctaatattttttttttttttttttttgtatttttagtagagactgggtttcaccatgttagccaggatggtctcgatctcctgacgtcgtgatccacccgcctcggcctcccaaagtgctgggattacaagcgtgagccactgcgcccggccgcaggccaccatttctaagcagtgaggagtgctcaagtttggcagctcgtgcctgctgctatggctgtctttgctccttgctgccacatagccctgctataaaaaactggttctcgcccatctctccaatgatgctgtttgcactgcagtcaagtcttatattttattagcttatgctaaagggttcttctcttagaagaaggatacgtcaacaagggaagccctctccttttgcgcgtcattcaccccatgctgacatctaccataacctgtaatgcgccatcctttacaggcttcactactggcagccactttcctctaaagtcttactgcctgggagattctctgcccgtataaatttgggcctaataacatcttcaaccaccattcctccttcccagagatatcaccaaggaatctgctttcttttcaacctctgaaacacagagttctttctgcctcccttcctttgacaatacactatccacagagaaagttaacctttcttgatagtaaggaagatccagaattaaaagtagggaaagttctatttaccttggaagtaagcaagaagtggtccttttctttcttcatattctgccactgtcctcaaatactcagaaaataattaatacataatccttaatactatcatactctgatggaagtattatagatagcggtaacacaagttaagggccttgaagctggaataaagttagcaaattttgtaacaataagatcagtgtagctggggcaaagtaagcaagagggaagttagaagacaattttggagaaaaatgcatgagctagatttgtataacccaggagctacagggaaggggtttgaaattcaattgagtgttttgagctgaggcataatgtgatctcatgtgttgtttttaagataagtacttaagattgttattttgaaatatttcagacataaaaattatgcacaaagaattatacaatatttgtcttatattgttcaaggaataaaagagcaatatagttgatgtatcctgtacttttcttgatcatcatgatcatcatctttctattccattttcctcaaacactggtaactattattctaaatttggtggaggtaatttccattactttatactttcagagcatattaaatatttatgtatatggcattatactgtgcacattactttgtattttatcatataacaatcatccatgttgatatgagtagctttgggtcactgttttttgctgctatgtattattccaaacgatacagttgggtgtactctgtgtatgtagacccctgtgatattatttataatacccgggcaagatgttacatttaatgtcccagtgggtgtataccctgtgatattattcataatatcctagggggatgttataacttatgtcacagtgggtgtacaccatgtgtgtatgccttgtgatgttattcataatattctagggaatgtttctcctaatgtcacagtgggtatacacacatggtgtacacctagtgatattatttgtagtattttaggggaatgttactcctaatgttacagggcgtgtacgccctgtgatattatttgtaatatcctagaagggtgttactcctaatgtcataggtggtgtagattctgtgatattatttttaacatcctgggtggatgttacttctaatgtcaaagagggtgtacaccctgtgatattactggtaataccctcgggggatattactcctaacatcacaatgaatgaatacaccatgtacacgccatgcgtgtacacccactgtgatattattcataatatcctaggtaggtattacatctaatatcacagtgggtgtacaccatgtgtgtacacccactgtgatattgttcataatatccaagggagatattactcctaatatcaccgtaagtgtataccctgtgatattacttgtaatattctaggaaatatattattcttaacatcacagtgggtgcacaccctgtgatattattcatactatactagggggatggtactcctaatgtcacaatggttgtacatcctgtaatatttttggtaatatcttaaggaggattttactcctaatatcacgggggttgtatactcccgtgatattattcgtaatattctagaaggatgttttacctaatgtcacaggggatgtatgccctctgatatttttcataacatcctaggaggatgttattcttaatgtgtacacactgtggtattatttataatatcctagagagatgttaatttcactgtatgtgccccctgtgaaattattcataatatcctagaaggatgttactactaatgtcacagtgggtgtaccccctgtgatattattcataatatcataggaaaataggactcccaatagcacagtgggtgtgctctgtgtaatattattggtaatattctagaaaaatataacttctaatatcacaatgggtgtacaccctgtggtattattcctaatatcctagggagaaatcacttctaaaaccacagggagtgtacaccccgcatgtgatattgttcctaaagtccgtgggggaaaaatgacattactcccaatatcgcagggggtgtacaacccttctgctatattgttccttatatccagagggaaagaggatgatattactcccaatattacagagggtgtacaccgcccttgtgatattgttcctaatatccaggaggggagaggatgatattactcccaatatcgcaggggtggacacccattctgtgatatatttcctaatatccagtgggggagagaatgatattactccaaatagcacatgacgggtacacactttctgtgttattgttcataatatccccggaggagagggtgatattactcccaatatcgcagggggtgcacaacctccttgtgatattgttcctaatatccagaagaaaacacgatggtattactgccaataccacacacctgtgatattgtttctaatatctgggtagaggggagagatattatgcccaacatcgctgaaggtgtacagcccttttgtgatgtgtttcctaatatccgggggggaggggatgatcttacaatcaataacacaggggagtgtacacccccctgtgatattgttcctaatatcatgaggagcagaggacaatattgctcccaatttcacaggagttgcacacccgccctaagatattgtatttaatattcaaggggcagaggatgatattattcccaatatcgctgggtgtgtacatccccctgtgatattgtttttaacatcaaggggcagaggatgatatactcccagtatggcagggagtgtacacctcctctatgatattgttcctaatattcagcaggggagaggatgatattactcccaatattacagagggtgtacaccacccttgtgatattgttactaatatccagggggaagaggacgatattactccctacatcacagggagtgtacaccaaccctgtgacattgttcctaatatccttgaagggagagaatgatattactcccaatatcgcataggggtgtacacaccctatgtgatattatttttaatatccataaaaggagaggataacattagtcccaatatcgcatggggtgcacatcacccctgtgatacagtttttaatctccagggcaggagaggggatgattttactctcaatatcgcaaggtgtgtacacccctccctgcgatgttgttcctaatagccagggggtgagaggatgacattactcccaatatcgcaggggcagtacaccctcctgtgatactgttgctaatatgaagagggaaagaggataatattactcccaatatcacaaggggtgtacacacacccccccccgcgatattatttctaatattcagggtggacaaatatgatattactcccaatatcgcagaaggtgttcaccattctgggatattgttcctaatatccagggaaggagaggatgatatccctccccaaatcgcagtgtgtgtccgcctccctgtgatattgctcataatgtccggtgggggagataacattaatcccaatatcgtacatacgctgtgtgcataccccctgtgatatggttcataatatccagggaaggagagagtggtattactccctatatcgccaaaggtgtacttttccgtgtgatctgtgtaaaatccgggggtcgggggagagggtgatattactccccatttcttggggggtctacccccatgtgaaatagttcgtcatatccagggacgcagagggtgatattacacccaatatagtggggggtgttcactcccctgtgatctggtttgtaatatccatagaaggagagggtgacattactacccatattctggtgggtgtacaccttcctatgatttggttcctaacatccagaggggcagagaatgactttactccccttatctctgtgatctggttcataatatccagagcgggagagggtgatgttactccccatatcgcggggtgtgtatgcccctctgtgaactgattcgtaatatccagtggggagagggtgacataactgccatactgctgtgatctggctcgtaatatccagcgggggagaaggtgaaattactccctatacctcggggtttgttcacccccctgtgatctggttcataatatccagagagggaggcgtgacattactccccataccgtggggagtgtacaccccactgtgatctggtttgtaacatccacagaggaagaggttgaagttattgcccatatcccggggagtgtacacccccatgtgttctggttcccagtatccagaaggtgagagaatgaaactactccccttatcgcgggggcatgtacaaccccctgtgatctggttcgtaatattcagtgggggagagggtgacattactccccatatcgcgggaggtttacacactcctgtgatatactttgtaatatccagtgggggagagggtgatattactccccatatcgcggggggtatacaccccccgtgataaccatggggggagagtgtgattttactcagcacatcgaggtgggcatacgccctgctttgatatggttcataatatctggggggggaggggggggagaaggtgatattaatccccatattgtgggatgtatacacgaccctgcgatatggttcgtaatattgagggtaagagagggtgatattactcctcatatagcagggggtttaatccccctgtgaaatggttcctaatatccagatggggagaggttgatattactccccatatcgcagagggtgtacaccctacatgatatggtttgcaatatccagagtaggagaaagcgatattactccccatatcacgagggatgtacactgcacggtgatctagttcctaatatcacgaagtggagaaaatgatattacatccaatatcgcaggggttgtatacccccctgtgatattggccgtaatatccaagtgcagagaggatgatattactcttcacattgcagcgggtgtacccccccgtgtaatattgctcgtaatatccagggaggaagagaataatattactcttaatattgaagggggtgtacacccccctgtgatattgttctttatatccaggggaagagaggatattattcccaatatcacagggtttgtacaccctcctgtgatagtgttcgtaatatccagggtgtgagaggatgatattactcccaatatcacaggaggtgtacatccttctgtgataatgttcacaatatccagagacagaaaggatgattttacttcaaacattgcaggggtgtacacacccctttgatattgctcgtaatatccaaaggaagagatgatgatattatttctaatatcgctggaggtgtacaccaccctgagatgttgttggtaatatccagggactgaaaggatgatattactcccaacatcgcagagagtgtacgtacgcaccaccctgtgacgttgttcacaatatccaggctgggagaggatgaaattactcccaacattggaggaggtgtacacccttctgtgttactgtttataatatccagatagagagagagtaatattatttctaatatcactggaggtgtataccctccagtgatattattcttaacctccaggggagcagaggatgatattactcccattatcgcagggggtgtataccaaccttgtgatattgttcctaatatccaggtgaggatgatattactaacaatattgcaaggcgagtacacacccccaccatgatattgttcctaatatttagacaaggagaggataatattacttccattatcacagagggtgtataccaaccttgtgatattgttcctaatatcaagaggaaaaagtttgatgttaattgcaatactgctgggaatgtacacccaggcttgtgatttgtttctattgtgcagggagggagaggagaatattactcccattatcacagggggtgtataccttcttgagatactgtatataatatccaggaagaaagataatattactccctatagagaaaataaactgtgtgtacatcccccgtgatagggtttgtaatatccaggagaagagagtgatatttctcctcctatcgcggggatgcacacccctctttgatacggtttgtaatatccaggaggggagagggtgacattactccccctatcgcagggttgcacacccccctgtgatagggttcacaatatccagtgggggagagggtgatatactccccctatcgcggggggtgtacactcccctgtggtagggtttgtaatatccagggtggggagaaagtgatattactccccctatcgcggggcgtgcacagttcttcgtgatatcacacccccctttgtaattacacactcccctgtgatagggttcgtaatatccagtgggggagagggtgacatttctcgccctgttgaggggggtgcacacccccctgtgataggtttcataatatccagaggggcgagagggtgatattactccccctatcgtggggggtgtagactcccctatggtagagtttataatatccagggtggggagaaagtgatattactccccctattgcggggcatgtatagttctttgtaatacctaccttgcaattagaagtaacattttcctagaatattttaaataatttcacagggtgtacacctactctgccattagaagtaacatctcccctatgcaattacgaataatatcacaaggtgtacacccaccgtgacattaggagtaacatctcagtaggatattatgaatattatcaatggttgtaccctcattgtgacattaggtgtaacatctccgtaggatattacgaataatataactggaagtatacactgtatgatattaggagtaacatcttctttggatattatgaataatattaattaacaattacgataataattattaatatgatattattcataatttcctaggagaatgttattcctaatgtcacagtgtgtgtataccatgtgtgtacacctagtggtattattcatagtatcctagaaaaatgttactcctaatgtcacagtgtgtgtacagcatgtgtgcacagtctgtgatattatgcataacatcctagggggatgttacatgggtgtacattctatgatattatctttaatatcctcggggatgttacttttaacgtcacagtgggtgtataagatgtttgtatatcctgtgttattgttcataatatcatgggggatgttacttgtaatgtcacagtgagtgttaatacaaaatgtgtgtactcccagtgatactaattgtaatatcctagggagatgttactcctaaggtcacagtgggtgtacaccatatgtgtataccccctgtgatataatttgtaatatcttggtgagatgttatatttaatgtcaccgtgggtgtacagtctgtggtattatttgtaatatcctagggagatgtcatacctaatgtcacagtgagtgtacaccatgtgtgtacaccctgtgatattattcataatattctaaaaaaagttacttctaatgtcacagtgggtgtacattctgtgtgtacaccgtgtgatattgtatgtaatatcctaggggaatgttacccctaatgtcacagtgggtttacactctgtgtatatactctgtgatattatttgtaatatcccatggggacattactcctaatgtgacagttggtgtacaccatgtgtgttcaccctgtggtattattcgtaaaatcctaggggaatgttactcctaatttcacagtaagtgtacaccatgtgtatacaccttgtgatattattagtgaaattataaggggatgttacttctaatgtctcagtgggtgtacatcatatgtgtacaccctgtgataatattcattatattataggtggattttactcctaatatcacagtggttgcacagcctgtgtatacaacctgtgatattatttgtaataccctagggagatattccttctaatatcacagtgggtgtagaccctgtgatattattcgtaatatcctcgggagatattactcttaatatcacagtgggtgtacaactcttaatatcacagtgggtgatattagcagtaatatcctagttggatattacaccctatgtcacagtgtgtgtacaccctgtgatattatttgtaatatccttgggaaatgttactcctaatgtcacaggtgatgtgtaaccagtgatattattcgttatattctatgatgatgttactcctaatttcacaggggatgtacactctgatattaatcgtagttttctagggggatgttagttttaatttcaaagggagtatacacgctgtgatattattcttaatatcctagggggatgttaattctaatatcaccaggggtgtcctttctgttatattattcttactattctaggtggatattacttctaaagtcaaagaacgtgtacactccgtgatattactggtaatattttaggggaatgttcctcctaacatcacaatgagtgtacaccctgtgatattattcataatgtcctagggagatattactcttaatatcacagtgggtgtacaacctgtgatattagcagtaatatcctaggagaatattaccaccaatgtcacaatggatgtataccctgttatagtattctatagggatgttactcttaatgtcatgggggttgtactccctgtggtattattcataatatgttaccaggatgtttctcctaatgtcacagagggtgtaaaccttgtgaaattattcgtaatatccttaaaagatgttactcctcatgtcacagggggtgtacacactgatattattcataataccttaggaagatgttactgcgaatgccacagagggtgtacaccctgagatattattcataatattttggagggatgttacttctaatgtcacaaggtgtgtacacactgtgatattatttataatatcctaggggaattttactcgtaatataacagaggttgtacaccctgtgatattatttgtaatattataggggggtgttactactgtcagaaggagtttacgccctatgatgttattcccaatatcctaggaagatgttacttctaatgttacagagggtgtacaccctgtgatattattcctaatattttaaagggattttactcctaatctcacagagggtgtaccctccttgatgttcttcctaatatcctatggggatgttacacctgatatcacagggggtgcacaccttgtgatattattcgtaatatcctaggggaatgttattcctaatgtcacaggggtagtacagcatgtgtgtacacccctgtgacattcttagtaatatcctagtgggatgttacttttaatatcacaaggagtgtacgccttatgtgtacaccttctatgatgttattcgtaatatcctaaggggatgtcactcctaatatcatgggggtgtacaccatgtgtgtacacacgctgtgatattatttgtaatgtcctaagtggctgttacttataatgtcactaggggtgtcaccatgtttgtacaccccctgtgatatcatgcttaataacgtgtggggattatacctttaatgtcacagtggttgtataccatgactgtacaacccctgttatattgttcctattatgctaggaggatattatccctaacattttagtggatgttactcctataaaacaggggttgtacaccatgtgtgtactccccctgtcatattatttgtaacatcctagggggatgttattcctaatatcacagggaatgtccacgacatgtgcacacctcctgagatattatttgtaatatcctaacgtgacattactgctaatgtcacaggaggtgtactccatgtgtgtaccaccagtgatattatttgtaatatcctagggaaatgttactgttaatttcacagtgggttacacaatgtgtgtacacactgtgatataattcataatatcctagggggatattacttctaatgtcaccgtgagtgtataacatgtgtatacaccctgtaatattattgtaatattctatggaaatgttagttctaatgtgaaaatgggtgtacactgtgtgtctacagcctgtgatattattcgtattataatagggggatgttacttctaatgtcacagtgggtttacaccgtgtgatattatttgtaatattctagggggatattactcctaatatcacagtgggtgtacatgctgtgtacacactctgaaatattattcacaatatcttggcagatattactcctaatatcacagtggatgtcaactgtgggatattatttgtaatattctggggagacattactcttaatgttacagtgaatgtacaccttgggatattatttgtaatatcttgcagagatattaatactgatatcacgatgaatggacaccctgaaatattatttgtaatatcttggggagatattactcctaatatcacagtgggtgtacactctgagatgttatttgtaatatcctggggagatattactcctaatttcacagtgagtgtatacccaaatatattattgataatatcctggggagatattactcctaataccacagcaggtgtacaccctgggatattgttcataatatcctggggagttattactgcttatatcacagtgggtgtacacactgtgggtacaccctgggatattattagtaatattttgaggagatattagtctaatatcacaataagtgtacatcatatgtgtacacacggggaagtcgttcataatatctaggggagatattattctcgtaatattacattgggtgtacagcatgtacgtacaccctggatattatttgtaatatcctggggagatattactttcctaataccacagtggggtacaacatttgtgtacaatctgggatattattggtaatatcttgcagaaatattactcttctgatatcacagagggtgtacacacatggtgtgaataatatctggaatattattcataatattttggggagatcttgctctcctaatgtcacagtgcatgtagaacttgtttgtacatcctgggatattattcgtaatatcctggggagatattgctctcctaatatcaaagtaggtgttcaccatatttgtacaccctggaatattattcataatatcctggggagatattactctgctaatatcacagcaggcttacatgtgtgtacactcagggatattattcgtaagatcatgggaagatattactctcctaatataaaagtgagtgaacaccatttgtgtacaaccggggatattattcaaaatatcttggggagatattagtctcctaatatcacagtgtatgcataccatgtgtgtacaccctgggatattattcgtaatattctgaagacatattaccctcttaatatcacagtgtgcgatattacacccaatatccagagggtgtacactctttctttgatatcgttcctaatatccaggggggaagaaaataatattaatcctaatattgcaggggttgtacactccccttgtaatattgtttctaatatctaggggaagagagaatgatattacacaagatacctcagggggtgtacatctcccagtgatattgttcctaatatccagaggcagaggatgacattattcccaatatcacaggtggtgtgcaccctttctgtgatattgttcctaatgtccggggtggggggagtggatgatattatttcctatatcgcagaggatatacacccctcttgtgatatggttccaaatatccagggggtgagaggatgatattactcccaatatcgtaaggggtgtacacccccccttgtgatattgtttcttatatccatgaggggagaggatgatattactcccaatatcgcagttggtgtacaccccttctgtgatattgttcctaatatctacgagaggttaggataagattactttcagtattgcagtgggtttacacctttcttgtgatattgttcctaatatccaggggaggagacaatgatattacgtcaatatcatagaaaatgtacactcaccctgtgatattgtttctaatatttagagggagagataataatattactccgaagatcacagagggcatacaacccttgtgatattgtatctaatatccaggtggggtgaaaatgatattactcaaagcatcacagggcgagtacacccctcctgtgatattgttcctaatatccaggtggagagatgacattactaccaacatctcagggggtagaccccccccgtgatattgtttctaagatatagggggtgaaagtataatattactcccaatatatcaggtagtgtacacaccccctttgatattgttcctaataccctgtaggaaagaaaatgatattactcccaaagttgcgtggggtatacccaacccctgtgatattcttcctaatatccaggtggggagaaaatattacactcaatttcgcagggggtgtacacacccacagtgatattgtttataatctccagggggtagagcatgatcttactcttagtatcacaggggctgtacaccactcctgtgatattgttcctaatatcctgggtgggagaggatgttattactcccaatgtcacagggggtgtacactcaccctgtgatattgttcctaatatccagtggaggagaggatgatgttacttccaacattacagaaggtacacacacacacccgtgatatagttcttaatatccagtggggcagaggatgacattactctcaatattgcagggggtttacatccccactgtgatattgtccctaatatccgttggggaagaaaataatattagtaccaatatcgcagggggtgtacacccttcctttgatattgttcctaatatacagggaagaacagaatgatattactcccaatatcctatggggtgtacacaccccctgtgctattgttcctaatagccatggagagagtggatggtattacttcctatatcacaggaagtgtacaccacccctataatattgttcaaaatatccagggaaggagagtatgatgttactcagaatatcgcagggtgtgtatgccctctgtgatattgcttctaatatttagggggaaagagaatgatcccaatatcgcagtgggtgtacacccccccgtgatactgttcctaatttccagggggaaacaggatgatattattcccaatattgcagagtgtgtataccccctgtgattttttttctaatatccgaaggaaaagagaatgatattaccctcaatattgcagtgggtgtataccctctgtgatactgtttctaatatccaagggaggagaggataacattattccctatatcacaagaagtgtacacccccctgtgatatagttcctagtatccgaagtgggagaggatggtattactgccactatcacagggtgtgtacacccaccctgtgatattgttcctaacatccgggtggggggggagaaaatgatattactttcaatatcacagggtgtgtacaatccccccctccaagtgatattgttcctaatatccagagggtgagagaatgacattacttccaatatagcagtgaatgtacaccttttctgggatattgtgcctaatatcctggggcagaggatgatattactcccaatattgcaggagttgtacacctcccctgtgatattgttcctaatacctagcgggggagaggatgatattacattcaatatcgcaggcggtgtataccgccccctccccatgatattgttcctaatatctatggtaagagaggatgatgttactttcaatatcgctggtgctgtacactctttctgtgatattattcctaatatccaagggggagaccatgaccttattcccaatatcacaggagttgtacaccttccagtgatattgttcctaatatccatggggggagaaaatgatattattcaaaatatggtaggggttgtacagcccccatttcatattgttcctaatatccaggggtggagaggatgatatttctgccaatatcgcaggggttgtacatccaccttgtgatattggtactaatatcacggggaaagaaaatattacttccaatataacatgaagtgtacgaccaccctgtgatgtggctcctaatatccagtgggggagaggataatattacatccaatatcgccgagggtgtacaccccttctgtgatattgttcctaatatccggggtgggggtgaggattatattacccccaatattacagggggtgtgcaacctctctgtgatattttttcctaatatccaaggggaagattataatattacttacaatatcgcagggggtgtacactccccactgaaataattcttaatatccagggggtaagagaatgatattactcccaatatcgcttcaagtgtaaacccccctgtttttttttaatgaaactagggagaggatgatgttgctcccaatatcactaacgatgtacaccctctcttttatattgttcctaatatcctgaatgcaagagagtgacattactcccaatatcgcagaaggtgtacacctccccctgtcatattgtttctaatatccagggctggatagaatgatactcccaaaatcgcaaggggtgtactcctccctgagatattgtttctaatatgtgggggtggggggagaggattttgttacatccaacatcgctggtggtcgacagccccctacccctgcagcgatattgtttctaatatccagggggtgacaggatgacattactcccaatatcgcagagactgtacacttcacctgtaatattgttcctaatatccaggaagggagagaatgatattacttccaatatctcataggctgtacatccctcctgtgatatcgttccgaatatccatgaggaagaggatggtattactcccaatatcgcagaaggtgtacacattttctgtgatattgtagtgggggagaggataatattacttctaaaatcacagggggtgtacagcacccctgtaatattgttcgtatatccaagtgggtcagtttgatattactcccaatatcgcagaaggtgtacacccaccaggtgatatagtttataaaatccagggagggagaggatgttattactgccaatatctcagatggtgtacaaccaccccccccccaccccggtgatattgttcttaacattcaaatgcagggaggctgatattactcccaatatctcagggggtgtataccacccctgtgatgttgttcctaatgttcaaggggaaagaggataatattactcccaatattgcagggagtgtacactggccctgtgatatggtttctaatatccaggggtgagaggaggatattgctcccaatatcacagagggtttacatccccatgtgatttttaaaaaatattcagggacaaaaggatgctattactttcaatattgaacagggtatacatccttcatgacattgttcctaatatccagggagggagaaaatgatattacacccaatattgcagaggatggacaccccacttgtggtatcattcctaatattcagggataagaggataatattacttctaatatcacagggagtgtacaccccagctgtgatatggtttctaatatccagggaggatgaaggtgatattactcccattatcacagaaggtttacaccctcctgtaatactgtttttaatatttagaagaagagacgatcatatgacccccaatatttcagagggtgtacaccttttccatgatattgttcttaatttccagtggggaagagggtgatattactcccactattgcactattgcaggggttgcacacccttctgtaatatttttcttaatattcaaagatggagaggatgatattactcccaatatcacagggggtgtacaacccctgctgggtattgtttccaatgtccaggtggggagagaatcatattactcaaaatatcacagggggtgtacaccaatcctgtaatattgttcctaatatccaggttgagggaagatgatattactcccaatatcgcactcggtagacacccccctgtgatattgtttctaacatccagggaggagaagatattactcccaatatatcagggagtgtacaccccccctttgatattgttcctaatatcctgggggaagaaaattatattaccaccaatatctcatggggtgtacacctcccctgtgatattgttcctaacatgcggggggggggagatgatattacacccaatttcacaagaaatgtacaccctcacagtaatattgttcctaatctccagtggagagaggatgatattactttcaatattgcatggggtttacacccaccctgcgatattgttcctaatactcatggggggagagaatattactcccaatatcgcaatgggtgtacacccaccctgtgatattatttctaatatccagaaataaagaggataatatcacacccaatatcgccgggggtgtacaacccccctcccgtgatattgttcttaatatccaggtgggtgcaggatgatatcactcccaatatcgcaagaggtgtacacccctgctgtgattctttttaatttcaaaagggggagagaatgatatcactctcaatatctcaggggtgtacaccccccagttatacagtttttactatccagaggct

SEQ ID NO: 1359 - DNA, 40001 bp, Homo sapiens
taatttcacaaatcatgattgtttatattgtgcatgacagttttgtatcctttttttatttcttcctaagcatgtctctgtgtcttgcctgtcttcatgaacattatgattattattattttttagagatacgttctcattctgttacccaggttggagtgcagtggtgcaattgtagctcactgcagcctccagctcctgggcttgagcaattctcccacatccgcctgccaaagtgataggattataggcatgagccaccatgcctggccatgaaaaacaggcatgagccaccatgcctggccttgaaaaatatatatttttttgagacagggtctccctctgttgcccaggctgaagtgcagtgtcgtgatcatagctcactgtagccttgacctcctggacttaagcaatccttctacctcagcctcccaagtagttgggactacaggcgtgtaccaccatgtccagctagcttttttttttttttttttggtattttttgtagagatggggtttcactatgttgcccaagctggtcttgaactcttgggctgaagtgatccacctgccttggcttcccaaagtgctgggattacaggtgtcagcctggccacgaacaacatttttaatgtgtatgtcatatttcattgagcggtcatgtctggatttacataaccactctctggttggcagacattttggttgatgccagcttttctcttatggctatttgtgatgcatatctttgttcatgaatatttctccatctttttattttccttgagtttatggctctttcaatggttctatttgtgtttcctggcaaacatggataaatgccccagaaacttgctgggtgggtggcttcgtgaattttccctggaattaaaacttactttgcctcccataactgaattgactgtatgtcagagggaggacagtggctgggaggtaactctgactttcatgctttattaagtcctcacttgcctgcagcctcacttcttttaggtatgacctaattttcattgagttcttttgtctgcacggctaataacgacattatcctcaacgacaataataacagctactgttttaagagtttgttcaatagtgccaggtattgtccactgtctcattccatccttacaacagcccctctgaagtcactattttcaacattttgcagacgaggaaactgaggcacagaaaagttgagttcttttctcaaggtcagatagggaataggatttgcaccaagtttctctttatccaagagtttgacctctgaagcactgtattcctctccttgcccccatatttgctctcctagaaacatctgtaattaaaaaaaaatagaagaaaaggaggagattgataaagggatggaaggaagaaggaaccatcctttgcatttccctaatgtctagcggcagctctgcattaaaagccaggagacttgcgttcctcttctagccttactattcatttgctgtgtggccttgagcaaactacatcctatatccatgcctcagtttataatctacaaaattaaagggctggccatgcgcggtggctcatgcctgtaaccccagcactttgggaggctgaggtgggtggatcacttgaggtcaggagttcgagatcagcctgaccaacatggtgaaaccccatctttactaaaaatacaaaaattagccaggtggttgtggcagatgcctgtagtcccaactactcgtgaggccaagtcaggagaatcgcttgagcctaggaggtggaggttgcagtgagccgatattgtgccattgcactccagcctgaatgacagagcgagaccctgtctcaaaaaaataaataaatacataaattaaagggctaaattatagagtctttatggactctgagactcttaagattctctgattgaccctaggttggtgggaggggactcagaagtgattatcgctgcagaaaacggggaatccaaggctcaaggaagtctgcagtatcacaaaaactatcaggccctgttgggtctttcacgtgtaaatatctgagactttgtattttggggtctctttgggaatggatttaatgaaggttaaacacaaaagaatagagttaagaatatctggacaccacagggaacccaagagcaggagcaagggaaccagatgtttctgttcatatctacactcctggcaacatcatgcctctcactctgacaccgttctctacgctccagggccccggaagttgctgagttttcagatatttgagcctgaactaacacctccctacgcaatctaggagaaagaatctgattggtccagccagggtcacatggtctacttctgatccaattaactgtgtcaggctgggggtgtggtccaaacacaggggccacctctggaggggtggggcacctcaggcgtcattcctgggcgtgatggctcagaagtccagggacagaattgctccatggggcacacccttgatggtctcacagtgcggcaagagctcctgcagttgttattaaggatggagctttaaattacttacttccactttatgtgaagtggctttccccggaaggaatgaacaaaactgaggacgcctaggggagccaattattgtttgaggctttgaagtgtgcacgtgtgcagagggacggtgtattagggttctctagagggacaggattaataggatagatgtatatataaagggagtttattgaagagtattgactcacactatcacaaggtgaagtcccacgataggctgtctgcaagctgagaagcaagaaagccagtctgagtcccaaaacctcaaaagtaggaaagcccacagtgcagccttcagtcagcggtcaaaggctcgagagcccctggcaaaccgctagtgtaggtccaaaagtccaaaagctgaagaacttggagtccgatgttcgaaggcaggaagcatccagcaggggagaaagatgcaggctggaagactcagccagtgtagtccttccacgttcctctgcctgcttttatcctagccgtgggcagctgattagatggtgctcacccagactgagggtgggtaggcctctcctagttcagtgacacaaatgttatatccattggcaacaccctcacagacacacccaggaacaatactttgcatccttcaatccaagtcagtttcagtcaagttttctttgatgatttcccacatagtgatattcactaagggagacttcccagttgaaaacctggatggcctcatgactgcacattgaatcccgtttcttgaaaaggttacgctgggcgcggtggctcgcacctgtaatcccagcacttcgggagttcgagacaggtggatcacttgaggtcaggagttcgagaccagcctggccaacatggtgaaaccccgtctctactaaaaatacaaaaatttgccaggcgtggtggtgcatgcctgtagttccagctacttgggaggttgaggcaggagaatcgcttggactcgggaggcagagtttgcagtgagccaagatcctgcgccactgcactccagcctgggcaatagagtgaaactctgtctcaaagaaaaaaaaaagttggttaaaatggccaggcagtgcacttgtgtgccaaaaggaatgttctagagaatcaacacacctctaatcctgatgttgagattcaataaggaccaagagccctctagataagtagaactcaaactttagattgtttaggaactacccagggtgcttgttgatatgcagattcctggatcccccagaaattctgtgggaccaaggaggtggaggtgtggactggggatttttagcaggtgcctcaaggtaagtctgatgctggtagtctgatccatatgattacttttcatatgtaaaaagaagaaaaaaatccatgaaattcttacccaatgaaatctgatgtgtcatataaaggttgagctgcttcaggtgatgtagcaggtgaggagctcagagttctccccattctaccctgtgctgtgccctccacgcttgtattaataaagccactatttatttattagctgctggaggtattgcggacaaagtaatgaataaaataaaccaaattccagttctcatgggactcttctacctgcagggaaggcaggcaatacacaaattagctaatgagtaacttgcaggttgtgctaagtgctgtgaaggcaaatatagccgtggggaggggacagaaatactggaagggggatgtcaggccatctgaaaaggcatttgagtaaggacctggatgcagtgagggagtaaggcatgagaagatttgtgaggaaaatgttccaggaagaaggcatggcaagggtgaaggctatgaggctggaataagctaagagtattacaagaagaccaagcaggggaatgaagctagagggagtgtgcagacaggtgggtaggggccaggtcacttgcagccttgcctgtgactttgcacaggccctgtgcatagtaaggtgtttgtatttcattttaggaatgatggaaaccatgtcctcatgtaatcttcccaacgatcttatgaagaaggtcctactatttatggccattttacagttagggaaactgaggcatagagcgatgaagacattcacaacttctaagtgggaatatgaggatttggacctcagggtgacttcagaggctactgttcactaccacacaataccatctcctatatatctcaggagtttagcatcaaattctacatgatagatcccttatggagctgcagtagggtatagtgtgaaattattttggccacttgctagttgtctcttcttggattaggaatttacatttctgagctacgtaaaataagaaggctattttcccatctaattcattttattgggttttgatgaagaagaatacatgtgctttataaactataaaatgcaacataagtattgtgaatcatctccactgagtttgatttaacccttgtttcctttgagaaagtcaaaaatcccttctgatttgtggaaatttgaaacctcattgagtcaactcttgggtcaaagggaaatcacactgaaattatgaaatatttagagaaagaggtaataaaaatacatatcagtttctttaggatatagctagtgcagtgtgcaaaggcaagttcatagtcttaatacggttcttctgagagtgaaagtatcacatagtgatgacaatcatgagctctggaatcagacttggattgaaatctgaattttgccacttctgagctatgtgatcttggataattgcttaacctctctaagccttagagttagtccagtttcattatctgggaagtggcaatggtagtaacctacctgatagggttttgtgctggctgttccctctgcttgaaatgtttgtcttgtgtggttggctctcttatttcattcaggtttttgtacaacatcacagccccttatgctttatttttctttatctcatttatgacttcctgaccttatattgtgtatttattttttgtttgtttccttctatagaggtcatctatgtgagagtagagactttgtcttggtcattgctgaacctgtaggaactagagctgtgtttagtgcacggaaaatttacggcacatctgttgaatgaatgagtgggtgcatggtggggctgagcagaaggataagacaatggatataatcacttagcagagcacctcactcactgtgagccctcggtgaatgttggaggtttgttcttggcttccactccttcttacaaggtgatctcttcaaaaatctagattataatcttcttgaaggaaagaaaggtgcctttcacagttctgtgtttcctgctcatgctaggcacattgaggtggctgagtgaatgctttcattgagagaactgaggtatagggaagtgagattagcacctctatgatgtctatcattccttttattgctgggcacaatgaagttgctcaataaatatttgttgagcaaatgaatgaacaaaaacaatctttttatgcacagcattaaatggagtggactgtggaaatgtagatgtattagtctgttctcatgctgctaataaagacacacctgagactgagttatttataaatgaaaggaggtttaatgaactcacagttccatatggctggagaggcctcacaatcatggcggaaggtgaaagaggagcaaaggcatgtcttacatgaaagaaagtgcgtgcaggggaacaactgccatatatgaaaccatcagatcttgtgagacttattcactatcatgaaaatagcatgggaaaaaacctgctcccatgattcaattatctcccacggggtccctcccacgacatgtggggattatgggagctacaattcaagacgacatttgggtggagacacagccaaatcatatcaatatataaagtcaaattcaaagagatgctcaatgcctgggtgcattatttagatcctgcgagccctcctgcctcgctctttctctctctccactgcattctcagcagctgcactttgccttctccaaggccagttaagcccgttttctgggggtgtggggcctgtgggtgtagaactgaacccagatcccactctgcccttaccaagaagccagtggacataggaggcagatggtaacctggcaattagaccacagtgtgacatgtggagcagcacaggggtaccaggaacattctaaaggggctgtaattcagctgggggaatctggaaggctacttggaggtacagacacctaaagtgaaatctgaaggatggacagagattaaattaggggaggagaaaggagtgggattcttgggggaaggggggagagtgttccaggcagaggaacagcatatgcaaaggccttgaggcaggagaaacacagggtttctggtatggatggaggaagaagaccaggctggtagagggggcgattagtagaattatggagagatgaggctggagggggaagtgggggccaacccaggagggttggtacacccaaaactcctgcccaggcctcactactcactggcccaccttattcctgcctcttaactttgttctcaggcttcctcttacaaactgtgctttctctcctccttagggctaatcaaattcctggtgacttcagcccatttaactccccatccctagtatctgtcctcaactctgctcctgcaacaaataaaaacaacccttactctctcagttccaaccaccatggcctccttgctgttccttgaacatctctaagaacatgtcctgcctcaggacctttgcactggctgttccctcagcctggaatgctcttccctgggagatttgcctggctctcccatttccttcaattctcaacatacatgacccctcccctgaccaacctgtttaacattacacctcctctcactttctagccatctctggcttgcgttatttctttttaatcacaacaatgaacactttataaatccatttgttcattcgtctcttgtctgtctcccctgcccctgcaccatttgctccatgagggcagggaccctgtctgtatccctggtaagtggaacacagaagatgcataataaacatttgtggaatgaaaaatagtaaattgtggtggctcacgcctgtaatcccagcactttgagaagctgaggtgggcggatcacttgaggtcaggagttcaagaccagcttggccaacgtagtgaaattctatctctactaaaaatataaaaattatctgggcgtgatagtgcacacctgtaatcccagctacttgggaggctgaggcaggaggatcgcttgaacccaggatggggaggttgcagtgagctgagatcatgccactgtactccagcctgggtgacagagcaagactccatctcaaaaaaaaaaaaaaagtaaaggaaaaataataatagggccaggctctggactgcttgcatcatagactttaactgatttcatttacatgacactgatttcttcttctatgatttttacccattagtgctgagaaaagaggctcagagaggacaacggattcgcctagggtcacagagccagtgagtggcacagctggagtggcatttcagtgtggctgtttccactgagctcttgcagccaccagcctcggagaccaccctgctgaatgagggttccagtctcgactcaatcacctttcacccagtgaccttgagcaggtcctttctctctggtgttagaatcccataagccatagaataccagaaagcctgtgttgtttctgtaacccacaaagatagcacagcccctcctcattccatgagtcccccagtggggtggacatcagggctcagtgtcatggaaatggctcatggggtgactcagatttggctcaggctcagggctgcattgttttagagatgaaacagagcaccttaggaccgctggatgaatttgaatggcagttatattttgttcaacctaaagtgtgtttgaaataattttatttaatttctatgtttaaaaattgagaagtctcatgtaaaattccagatttccacttctcttaaaatctaaaactaatcccaggtagcaacacttaggtgatactgaggagcacctttaaaaaaaattagttaattaagagatgcggtctcactctgttgcccaggctggactgcaatcatagctcaacctcgaaaccttaggttcaagtgatcttcctgcctcagcctcccgagtagttggaaatacaggcacgtgccaccacacccagctaattttaaaaaagtgttttttagcttttgggtttttttggtagagatggagtctcactatattgcctagactggtcttgcactcctggcctcaagggatcctcccacctcagcctcctaagtagctggtaccacaggtgtatgccaccacacccagataattaatttttgaaaatagagatggggtcttgctgtgttgcccaggctggcgtcaaactcctgggctcaatgatcctcccacctcagcctcctgagtagctgggaccacaggtgtgtgccaccacacccagataattaaaaaaaatttttaggagataggattttactatgttacccaggctggtcttgatctcctggcctcaagcgatcctcccacctcagcctctcaaagtgctgggattgcaagtgtgtgtgagccactgcactggccctgcagagcgccattctatgggcatgtgcctccttgtttgctccctgtcccatgaggtcacttctctcatttagtggtccctgtagccatttgagttggagacctctggtgagttttattttatttgaactgaacttcagtaccagttaagcacaggctgtgacgtgctgaacttttcactttcagaatggcgtccagtaaatcaatcctgggtatgatgccatgccgggctgttcttacagatgctatgggaattgtgtggctccatttctgcactctgcattgttttggtgatttgtgctcggaaatgaaatcactgcttggatactgctagactgcagggacagataactcagtagaactcctcacctgcctttgaggcagtctgtgatgtattgtcatttatttcttttcatctgtggttttatgtttgtgtctgctacattctgaagtcttaattcagaagctcgagccaggtcatccagttaaaaacttcctggcaatcgtccctcagtatccccggggttggttctaggacccccttggataccaaaacctgtgggttctcaagtcgctgacatagaatggtgtagtattcgcatgtaacctatgcatgtcctctttgcatactttaaatcacttcgagattatttaaatacctaatacaatgtaaatgctatgtaaatagttgttatactgtattgttggttgggcatagtggctcacacctgtaatcctagcactttgggaggctgaggtgggtgcatcccttgaggccaggagttcaagaccagcctgggtaacatggcaaaaccctgcctctaccaaaaatacaaaaattagccagtctcataacctggtctcagaataaataaacaaatagattaaaattaaaataaaatagttgttatactgtattgttttaaaatagttattattattattattttttgagatggagtgtctgtcacccaggctggagtgcagtggtgtgatcttgtttcactgcaacttctgcctcccgggttcaagcggctcttctgcctcagcttcccaagtagctgggattacgggcacacgccaccatgcctggttaatttttgtatttttagtagagatggggtttcaccatgtcagccaggctgttctcgaactcctgacctcacgtgatctgcccgccttggccttccaaagtgctgggattataggcatgagccactgtccctggctgctgtattaatttttattttggaaaattttcgatctgtggttggttgaatccgtggatgcagaacctgcagatactgatggccgactgtatatcctgtttgtgtgctgacttgagtgtgtgtctcctctgtggcagagacaataatgttcctcaggtggtcccggcacttctccattcccagacccttgtagttaagcggggccacacgacttattcctgtcaatgggctatgagcagaaggggcatacatcacccccaggcctaagcctgggaaagcctgtgtgagttttctgtgttcttttttctgctgtatggagtctgaaggcctcatggtgaaaatgtggaatcagggtatcatttgaacttggtgttatggtctgaacattatgtctccctaactttatatgttgaaactccagccccaacattatgtgaggggatggggctttgggagatgattaggacctgagagtggtgcccttatgaatgggattagtgccctaataagaagagacaccagagagcttgctgcctctctctctctgctcatgtgaggatacaacgagaagacagtcatctgtaaaccagaaaggggatgctcaccggaacccaatctgctggtaccttgattgtgaacttctcagcctccagaattgtgagaaacaaatgtttgctgtttgagctgcccaaatttatgctaatttattatagctgccagagctgattaaaacacccggatttctgagttactagacctgcagcagactctatgagggaggagtaaacttttgttgtgttaagctggtgggattttggtgtgtttgttacacagcagaacctagtccatcctgaccgatacattctctattagaattgatgagtaggaactgcacatccatgtctagaaaagctcttgacagccagtgctcaagaaatattacagaatgaataaaagaacaattatggtttgtgttattagactctacatatacctactctttttctcatagatggtgcgttagattggaaggccaccttcctgtgaaggaagggagaaccaactcttattgagtgctgtctattgtgctaattattatccacatctaaagataaaatgagttccagggagattaggcagttatcctggggttatagagctatctaagagtggttctgctagaatgactcctacccatcttttcagttgtctataggtcttgactttaatgccacctcctcagggaagccttccttgatcactagactggattagttgtcactgttatatgctcccctaactcctggtacttcccccatataacacttacttcccttcagattttgagtgctctgagagtagatcctgtgtctgttttgctcaatgtggtatattcagcacctagtatagtacctggtacatagtaaatgctcaatatatgtttgttggttgaataaagacagtcaggaaacttagacttttgtttcggtactgcctctaatcagttgtgttattctggaccaatagttttatctctctgacttctagtattctcatttgtacaaaaagggtgcttgattaaatttgttctttttggctctagcattccacaattatttcattcacaaactaccctctcattccttctctgggcctacttttgggtcaccttctggcctcttattccgtctatattcctggaataattgacagaattgggaattgaagccaggcagtctaactacagagtccataattttaactgctcattccacccacatacccacccacccatctctgtttatgcagtcatctttcttccatccattcacacaatcatccatccatccttccatctatccatctcatcatctatctaataatccctccctccatttattcattcgagtatcttctgtccaaatatccatccatttttcagcaaatacttttgaagtgagtattccatgctaggacctgtgctggggtccttgggttccagcaaaaacaaaacagattctgttcctgccctcgtggagctctcagtctaattagttctggggaatttctctttagttgctattgatgtgggaggttgaaataatgtccaatgtgtgagctggagctctttggttgattttattgtattggtttttgtatcctcatggataatataatgctactttgttattattgttatgcataaaggtattgattaattaattcaccaatgttcattgagcactcgctatattccaggcattgtgttcgatgcatgcaagtcccaacttttccacaactctagagagcattactcacatggtattctatttgattctggagttgcacagcatagtggaaacaggcatttgtcactcttatgaaggagtccacagcctagcatagtaattaagagcttgggctctgggtctggacagcctggtcttgagtcccatttccacacttactggctatgtaattttgtcaaatcacttcacctctctgtgcttccatttttctcacctgtaaaataaggataataactgctaaattcagtgagtttttacatggctatgagttaattcatgaaaaagctctcagaatagtacttagcacctagtaaatgctcaataaaaagatcgatgagcagcttagatatatctcttacttggtggctttctttaatggtttttcagatggggaaactgagtcaagagcataacctagcctaacctgacatgataagctaaagccagagcctatgataatcaattagtgactatttactgatccagagggtatgtaatcatgcagcaaaatatttcccttagctgagatactccatttttgaatgtttgactactgacaacttccaagccctctccctcctccttccccttttgcctcatatctggataagccaataagaaatcctgtgcactaccttttttggcattggtggagaagttcacccacccacgcaggaccgtcattcaaccccacccccctaaccacaataaaaaccaaagccattgccactccctttgctcaagccattccagaccagcttgggtgttttccctgctcttctcagaaagaaacattatgtgagttaatgattatttccatactcttagtgcatatgtggcatcatcattcttgacatccaagccaattttgggtagagtattgatttccgtcctccctgggggcaaccacacgataccaatgctaactgagaatgaaatttggaagaaaaatggaagttctacttggcctgaaaaaaatgacccagctcctatgctgcagcaattccatttctctgacactactggagagactacatagacatgtgtgaagggaacagctccatagaccatgacacatctggtatgggctactcagccaccattaaaacagttatgtaggttggtatgtgtggacgaagggtgggttctcaaaacatcattgagtgagaaaagcaagatagataatttgttaaatatgttcatggtctcttcatttttttgtttcttatttttgagacaagacctcactctcttgcccaggctggagtgcagtggtatgatcatggctcactgcagccttgaattcctggactcaagtgaccctcctaccttagcctcctgagtagctgggaccacaggcatgtgccacaatgactggctaacttttaaagtttttgtcgagattgggtctcatgatgttgcctaggtcatatggtctctttacaattaacttttgtgtatggtgtaaggtagggagtcaaagttttggtttgtattagtatccacatggatatccaattgatccagcaccatttattcaaacaaccattattttccccttcctgtgctctcaaactgcagtaatgccttcattgtaaatcgggtgactggatgtgtgtggctccacttcaggacttagtattgttctatcagtcttttgtctattattttgttaatagcgccatatttttaataactatagctttgagtaagacttgaaatctgatagtttaagttttccacccttcttctatattgcttgatttttgttaggttgtttgcatatctatataaattttagaatcagctaataaatttcaataaaagtagaccctagatttttatttggattctagtgaatccgtaaaccatttgggggacaattaaaatcataatattaaatcttccaatccatggtcacgggacatttctccatttatgtaagttttctttaactcctttttgtaatgtttgtttttgtcagtgtagaggtcttgctcgtcttttgttaaatttattcataggttaaaaacatttttggattctgtggtaaatggcattgcattttacatttccttttttctactgtttgttgctagtgcagtataccaacagaaggaagacacattaaccttctcccacccaaactttttccatgacttaatatatctgcataaaatcataggaaaaagcttggaactgtacacaccaaactgacacagtggttatttttggggaggaggagagggaactgtgattgttgagaaaagacggtgttcaagagggaattgatctttatctgtcccgttttaattcttataaaaaagggaatgtttcaatgtattatttgtgtagttaaaaatctattaaaagaggccagttgcattggctgatgcttataatcccagcattttggggggctgaggcaggcagctcacttgagcccaggagtttaagaccagcccgggcaacatggtaaaaccccacctctactaaaaatgcaaaaaaattagccaggcatagtggtgtgtgcctgtagccccaaggctgggagtacagccttgggaggctgaggtgggatgatcacctgcgtctgggaggttgtggctaaagtgagatgtggttgtgccttggcgatgggagtgagaccctgtttcaaaaaaacaaacaaaaattctgttaaaagaaaaaagtaaatgacctatccccaatcctggctgggagtatgtatgtgattgatgactttggggagcccagaaacttccacttgtgtcaggaaggtgcatgaaacaagtttgtaattaaaagcatgaacatctggttgccctctgaagagagactgttaactgagactctatagaagtctcatagtctctatagaagtctcatatagaaggagcatagactggtcagcttatgtgtccagaactgtccagaaaagaggattcctagacctataggcaagagaagctgactcatgcatcaggcaaatccctagaatggagcgacccaacattatgattgtccaattgactgtgattccaggactacaaacaacttctgtaggtcgtttaggctgggttctcctagaagcagaccccaagacaaggattttgagtgcaagagtttatttggtgggtaattccatgaagcactagtagggcaccacagttgctgagggcaaccgtgctcaatcctgcagacgccttctgggaggctgggttgaacatactgccatgtcatgcatggtgtgcaaagttgtgtgcatgaggaagtattcttcattcacatcagtcatccatcagttgaggaaagctacaaggagtgttctctcattgacacttctgaccttctctatccactgacttagcatgcttgggaagccagagaacagacgttgtcaattcagtgtgcaaagaaaggtgttagggacatcagtagtgtgggctatagcttcctgaatatattcggaataggaagtaatgtgcttagtgaagaaggtgagtttttgtccccctgaatgatactggttttcaatggaatcaataaatcagccatctgatttatacatcatactcttatgagtttggctggtctgagtctagacagaccaccgccttttgagagtacttggtaaaattgaattccttagactgtaaaacccaagaaatcaagtgtggagactgaaaagtgaaaaattgcagcaggcaggggtcatgaataagtgaagtgggaggatgagggagataatgcacacaaagtactcagcacagcacctggcatgtcgtaagtgcttaataaaagttaccaatagcagcagcagcagcagcaactactatttctggggacagctttaagaagggtgtggaatctaagcataactcattgaaagggtgccaaaaaatttagggaactagccaggaagaggtttaaaacaaaagtctccttgcctaatactggcctcttgtatagaccttgtaattaggatgacagtcattttctattaattgcagactatgatttttttaggtgtgaggttaattggtaatatgggtgtgtaacatgttcccctcagatatcttagacaccagtaattaacctctttgttccgcagtgcagccattaatcatttgtctgctaggcattctgctgtcagcatcttgccacactgcctgctgcataggctttgacatattatcaggaccaacatggaagaatagaaaaatgagttgtagtgtgtgtgtagcaagaccaagttaactttcgattcatgtggccaagatggcagctggtttatccatgcagcaccacgaggctcagtgctgggtgcttataaggcttatgagggcctgtggggatgtttgcatcctagaaagaagttgtagcctctgaaatagaagaagaaaaccataaaactgaatttaaattaatacatgtttcatctcatgcctatacaatgcaacattgcatcaactactcaatggtgactcaacccccagttctctctatattttatgtggttacattttaatatttttataaattgaggtgagaacctctactgtcaagtgtccagggtttgtattgaccctgccctgggcacaggctactgattgcaatttgatttgtaggaatttggtttattcagaaggccccgaataaatgggttagttatagcttggaatatttttcaacttgctcacctgattttttggatgttctttgggacttaaaaattttaactgtaaaagaaaatgtatgcttgttgaaatagaataaatacaaccatgtagaaggcaaagtgttagtggtatcccaccacccttcccatctctaactgatattaaaaaaaagttaaatgcagtgtttcttaaactttcttaggggttggagagacctggcacatagctgtcccgattttgccccctgcatagtggttaataggcacatcatttctgccactaactatcccagtgacttcagataagtggcttcaccctctctcagcctcagccttctggagtgcatcacgggatgataacagtgtctgcctccggagttgctgtgaggactgagtgagtaactatgcatagagaattcagctttgtacccggtacaatttctatgctcaataagggcattatttcctaaccctgaaccctgagcctggtgaaaagagattgcataacatatattcctgagtcacagtggtgcaattttccagtgtttgcagatttagggcactcccttggggtataattagagtcagattttggaaaaggttgatccactcagtcatctgttttcttcttcttaatttaaatacagggcatactgcaaggtgctctccccaggttgtgctgaataattaatgccagctctgataatcctgcctgacttaaaaatggttcattattaccgataacaaccatgacaatttactgagagctcactgcctgccctaagtcctttttctgtcataaggtgtgaggttaagcagttgggattgtgagacagagatctgagttccatcctactctggtctcctccaagcagtatgtcttcagtcaaataacttcctctctctctgagccactgtttcctcaaccgtaaaatgggacactattagctactcactgctctgtctgagaccaccttggcctggacttcattgtccatatcactatcagcattttggtcaaaaccattcaacaagtctctaggaagttccaaactttcccacgtcttccttctttttttgaaccctctgaactgttccaacctctgcctgttgcccagttccaaagtcatttccacattttgggctatatttacagcagtgtcccactacctcagtaccaatttactatattagtccgtcctcatgctgctaataaagacatacccaagacttgataatttataaagaaaagaggtttaattgactcacagttccacatggctggggaggcctcaggaaacttacaatcatggtggaagtcacctcttcacaggacggcaggagagagaatgcatgcaagcaggggaaatgccagatgcttataaaaccattagatctcatgagaggcactcattatcacgagaacaacatggggggaaccgcccccatgattcaattacctccacctggtcctgcccttgacacgtggggattaccaggattataattcaaggtgagatttgggtggggacacagagccaaatcgtatcagtagctgtgttgaggattaaatgcacaattaatgcaaaactcctagcctgaagttggcaggctgcaagcacttgataaatgttaacttttattattatcttcatgttctttaacccttacagcagtcctttggggtaaataggaaaaatgtttggctcatttcctaggacatacctctgaaaaaacaggagccttcaacagttaattctatttccttttataatcttttgcacagtgtgtttgggaatggggatgtaaatttgccctatcaacaggaaagtggatttgtacattatattcatgccactgaaagtgagtgagccagggctctgtgaatcagcgtgggtgaatcccccaaaaaacgtgccaagaaaataaaatcaaattgcacaaaaaagtacatatagactattttttaacataaagtttaaaaatatgcacagcaactacataaagttagggataaacattatacaagtagattataaatagactgggcatagtggctcatgcctgtaatcccagcactttgggaggccgaggtgggcggatcacttgagcacaggagttcactaccagcctgggcaacatggcaaaaccacgtctctataaaaaacaaaaaaattagccaggtgtagtggcacacacctgtgtagactgtggtcccagcttcttgggaggctgaggtaggaggattgcttgagcctgggaggtccaggctgcagtgagctgtgatcatgccactgcacttcagcctgggtgacagagcgagactttgtctccaaaaaataaacaaaccagccaaataggtaataaaagtataaaaacagcatgaggctggagtaacacctacttcagaatagaggctccctctgcagaggcagaggtgggtattgctgaggcggggcacacaagagccttcagatagactggggatgtttacttcttaatctgctcctggggccatttattcttcttcacgcctttcaaaatatgtctcaagtaggtaatagtaatttaaaaacttgcaactcagccattgggagggttttgttggcctctttaaccaagtcctttaaccttctttaatccccattccttccactccttcatggtgcctttctaacaaagccctctgcctttctaacaaagccccctctaagaaagcctgccgcccaggctcaaaatggagcttgctggccgccaggatctcaatttgcatgttaaaggagtacctgctttatccatctgcgttttaattacagttcacctccctggcttaccatccaaacattcccagacacttgatgactgtttttgggggaggaagctagaggaaggagtgttctcatcactgcagaaaggaggccaaacttagtaggggcagggctaagacaagtcatggtatgtgtcaaggctcccctaccccaatccaaacatatttataaatgtgaagttttattaaaatgaatagtgtaaaattaaccaggcgtggtggtgcatgcctgtaatcccagctactcaggaggctgaagcgggaggattgcttgagcccagaaatttcgaggctgcagtgagttgtgatcacaccactgcactccagcctgggcgtcacacaatgggacgctattaaaagagagaaaaaaaaagagtaggagaaagagagtagcagaaaggaaatatcttttctttccatcttaggttcatggctggggctcctacagcaaaagacagattaacaagagaaaaaaatataaatgtatttaagttttaagtgatatgggagctattggaaagataaagacccaaagaaacagggaaatctgtgtatttttcctgtgatgagggtgtgatgggaaagtagatagtcatggagaagtatgattggacaaaaggggtatgatctaatggtaataaactgggggaacttaacaaggcctgtttgttcagactcctgtgtcttcagagattaggatgctcctttcccccaggtgtagggagagcatctgttgaatgactgtcttatgattgcttcaagggagaaggtgagagagaccttcctgcttcagctgttttctcaaatatcaaggtgctatattttggagtagtgtgtcctgagtcccattagtagcaaaagcactcttgaagatttactggaaagggatctcattccagaccccaagagcgagttcttgaatctagcacaagaaagaattctgggtgagtccacagtgcaaagcaaaagcaagtttattaagaaaggaaagcagttgaaaggacagctactccatagacagagtagggcgttcctgaaagtaagaggaggaacacacccaccctaggtataatgcttgtatatacataggataacaacaaaaacaaaaaaatcatgggaagatgtacaagggtttgtgataaagattcaattttcttaattactatattttgtaagaatcaatattattatctttaaagcaaaattaggaatgcttttgttctcaagatatcgggttaacaggacattcctcggcttgggactttttagtaacattatgaatctgttctcttaaccataaacatctacatgctagaaatacccaacaccctgggaaaacagcccagcaagtcccagtctcatttttcttcgccctcactcaagatggagtcactctggtttgaatgcctctgacaaagggaaagggatgtaatataacccagccccccagcatactgcctagttgaatgtgtgcttgtgtgtgtgttggttggtttgttggttgtggaaggcaggaggggacacattaaccaggcaactggttctggtcttctcttggcaattgctggccattttatctggaaccccaaggtaggcaaagttctaaataagtacattttgcaggtgactgaatcataagccattgaggtaatcaatctttatgtgcagaatatgaggttcagagaggttaagtgattttctcaagagcacacagctggtaaagtggcagagctgatacctgaagcctagatctgtctgaactcaagggattgtgtgcttatcaatttgctagtgtgttgctataacttttcaattttactgagggtgactttactggcaaccatttcaagaatcaccccctacccacctttaaaaattgtgttgctttctaaaagaggatacagaacaatttaacttttttccatgttataaaagtcagtcatctgtgctgagagttacactctcaggtgtgtttgaggggaaggtagggagggaaactagcatatattcagcaactacaacatgccaggcatttgctagacattttatgtattcctacttatgttccctatcctcactttttattcccattttacagatagagaaatggtgtctcactgtattagttttctattactaggtaacaaattaacccaacatgtagcagcttacatgttgggttaattatataagtgacatttacgatctcatgtactttctgaggatcagcatttcagtatagcttagctgagtgattctggctgaaggcctctcatgaggttgtagtcagaatgtagcaggggctgccaccctctgaaggcttgactgggctgaaaaatccacttccaggatggcacactcacatgattgttggctggaggtctctcagttccttgtctcgtggatctttccatagctctgcttaagtgacctcccaacatggcagctggccacccccagagtgagcaatctgagagaggcagagaccaagatggaaaccttccgtgacctagcgtctgaagttgtgtattgttaattctgctttattctgtttggtagaaggggaggagaattcaaggggctctaccttcaagggctttacctcttgaagtggggagtatcaaataatctgtagacattttaaaaccaccacactcaggacaggtgcagtggctcatgcctgtaatcccaacactttgggagaccaaggtgggcagatcacctgaggtcaggaattcaaggccagcctggccaatatgatgaaaccccatctctaccaaaaatacaaacattagccaggcatggtggcacacacctataaccccagctacgtgggaggctgaggcaggagaatggcttgaatccgggaggcagaggttgcagtgagctgagattgcaccactgcattccatcctggttggcagagcaagactccatctcaaacaaacaaacaaacaaacaaaaaacaaaaacaaaaaaatccaaacgaaaccgaacaaaacaaaaaacaaaaccaacaacaacaaaccactagactcagaagtgcagtaacctgccaaagcttatacaacttatgggtggtggaggttggacatgcccatagttctagctggctccatactcttcactgaactgtcatttctcctgaggaatggagcactctttgcccttgtattaaatagccctagcctgcaagcctttttatttagagttcctctcagctctttctatatctgcccagctttcatccattatatccaagcaagtctttctcccctaagccttttgtgacctaagtcagagttttccatctcctgtggaactgggaaacctagtaactactagcgtgcatcgtgtgtcaaccaagaggcagtgggctctgagtgaatatctggggttccccctttagccagtgggttttataacattttggagtgctcagaaagatttcttcctctcttcctgaaataattatatgggtctgttcaatttatcctttgtataactcttcctaactctccaaggtcattcatatggagtgtatcactcgattctcacaaaaattctgttaaaaaagtgggggcgagtgatataatcttctagatagctgaggtgttgagcagccacttatctatgtatctttcttctcttagtacctgcttggccctggctccttcccttccacaagctgtgactctatgtactgtgctacatgagctcacggtctcggagataatattttaatttgcatatgctcttgtgaaacgagaacaggtttgtgttaagatttgagttcaacttctagcatttactagaatttaccacttaccaactttactatttactcgctgtgggttagggttagggcaagtatattagtctagttctcatatgctataaagaactaccagagactgggcaatttataaagaaaatagggtttttgtttgtttgtttgtttttgttttttttgagatggagtctgtcaccaggctggagtgcagtggcgccatctcggctcactgtaatctctgcctcccagtctcaagcaattcttgtgcctcaacctcctgagtagctgggattacagtgcccgccactatggctggctaatttttggatttttagtggagatgggatttcaccatgttgaccaggctgatcttgaactcctgacctcaagtggagcaaataggcttaattggctagaattctgcaggctgaacaggaagcgtagatgcggagggctcaggaaacttacaatcatggtggaaggtgaaggggaagcagcatgtcttcaacaaggcaacaggagagagtgagagaagggggaggtgctaaacacttttgaacaaccaggtctcgtgagaactcactcagtatcatgagaacagcaagggggagctccacccccatgatccagtcacctcccaccaggcccctcctccaatgttgaggattacaattcaacatgagatttgggtggggacacagatccaaaccacatcagcaagcaacttcacttctttggatcttgcttttcgtatctgtaaaatggggataaaacagtacctacttcataggacctttaagggggggatcagataatacataaaaagtgattagctcaatgggtggcagagagtcaacacttaaaggcaccacacactgctacttatagatgccacttccctatgcaccaagatcccagcttgctgtgtgacttagggaagttgcttggcctcttggggctactttcatttgtaaaatgcatgggttcaattgcataatatcagaggttccttctggcttgaacaattcaccatcctcagattgtttatatagcacacccatactatttattttcaaaagtctattcatagtatcctacttgtaataattttagataatagttgcacagatttaatagaagccaggtgaattgttcagcattttttaaatgcaggaattgaacaatatatttatgtacataattacccgtttttttcctttgcaatctaaaagggcatattaaaaattgagcaatgatttctttctcctcctgttgggtcaaggaactggctaatgcagttttatgttaattggaagacacactaaatggcatagctaaaagaaagagaagtactcagttgtagaagtgctttttaatcacctacctgaatttgagcatctgaagggtttccagcaagttatgcggcccttgagggaatacttgttctgtcctcactacagagttgataaataaacgatttcttgagtgtggctcttggtgaaattctcaaacatcaatgaaccagatttgtcttagcttctctctgcaatttctcttcctcctaaatgccttgctgtgattttagcctggcctcttgtccattaaatgcactgttctttgctcgacatgtagttcattttatggcgaaccagaaggcagtttgctttgaagtcactttcccgctctaaaacctttagtggctctctgttccctctggcatcgaatacagactccttagcctagtacctggtcttaactttcctggaaagccaaaggggatgatttgctgttcccaacacatgcccagggactttaaaattttcctctatgcattcatttattctcttaccctcatcttttatatctttccctcctcctcctctttctttttcttttttttttttttgacggggagttgcgctctgtttcccaggctggagtgcagtggggcgatcttggcttactgcaatctctgcctgccgggttcaagtgattttccagcctcagcctcccgagtagctgggattacaggcacccgtcaccacatctggctattttttgtatttttagtagagatggggtttcaccatgttggccaggctggtcttgaactcctgaccccaggtgatccacccgctttggtctcccaaagtgctgggattacaggcatgagctatcccgcctggctgacattctcaagtagtgtcctgcccatggtagattcttagtaaatatttattgaattaaattagcaaattcatatattgtgctttgggggaacacttccattctcaaggttaattatttgtttcattaattaaggacttctgcttttaatcgagatgttgtcttgagatatttggggaaactggcttttcagatgccacgacttaagacctgagaaatgcaaaccttcttgtaagacgcaagcagctgatcattcccaagggcttgagcttctgtgttaaatgcacagtaagctgtgataaaaggggaggcagacacactattctttttgtgttttggaccaagccttcaaaatctgctttacacttacagcacatttcacattggatgctaacttttcatcagaaatatttgatctggatttctatttggttatatttacaactggcaaagtagattgacatcagtaagtcctaatcattctttaaaatgctccaggaactgaatcagatttgagttaaaaactaagattaaagtagatgaaaattaaataaaataaaaaattcacttttttagtcatactagccacgtttcaagtatacaataaatagccatgtgtggtttgtagtgatctcattggacgatgccagatctggatgtttcgtgagcaccatcttccccaaatcctcacagactgtttcttacataatgccaccaccagacaattgacctagaaggtagaagttcaagggttatccttgacttatacctctccccatctcaagtagctgggattacaagtgcacgccaccatgtctgagtattttattttatgtagagatggggtttagctatgttgccaaggctggtctcaaatgcctggcctcaagtgatcctcccatcttagcctcctcagtagctggaattagactgttcttcctaacatgcagatctgaccattcactcacattctctgctccagttgagtcttactgctgtcccttgagtttcctgtgaaatctctaggtctttgcacatgatattctgtctctctagaatcctatttcttctctccttccacctcctgcctattgtttggtttgccttcaccaagaagccgtcctggattccttccagtctgcactaggtgctccttcttggtgctctcacatctctgtgcttcccctcctctgctaccttctagcattgatgacagagcttgttgtgagactggatttggtctgtttgttcattgctgcatccccagtgcctagagtcagcacctgtcaacatgcatgaataaattacagacctgccccccaaaccaacctgtcatcttgatgcctattgttcaaaagcatctcagtgatgggaaacataaccagccccactttctggaaaatcaaccccagcacaagtctgacacgcagtgggccaatggtcctggtgtccatggtgacagagcagctaacgtagctcccaaagcatgccttgaaccactggaatagttgttccacttttgcagcctcgcttgaaatctatcaatggcttcctattgctttgagggtaaaactcagactcttcctacagcccacaagggacggagtgatctgaccgtgccctgctctcccatctcatcttttcctgcttcctttcttcatctctactctcccccggctctcttggctccagccacaccacactgatcgctctgtttccacctctgcatttgctgttccttctggctggtgcctctcctccttctggtttcagcttaaatggcttttcctttaagaaaccttccttgggtcggtgaggtggctcatgcctataatcccagcactttgggaggccaagcgaggcagatcacctgaggttgggagttcgaaaccagcctggctaacatggtgaaaccccgtctctactaaaaatacaaaaattagcttggcgtggtggtaggcgcctgtaattccagctacttaggaggctggggcaggagaatcgcttgaacccaggaggtggaggttgcagggagcagaggttgcactactgcactccagcctgggcaacagagtgagactctgtctcaattaaaaaaaaaaaaaaaaaaagccttccttgatctatctaaaggagcagctcacttagtccctctgcagtccattatcttatttgattatcttcaaagcacttaaacatgtctaaaattattattttatttatttatttatttttgagatggagtgtcactctgttgcccaggctggagtgcagtggcatgatcttggctcactgcaagctccgtctcctgggttcatgccattcccctgcctcagcctcccgagtagctaggactacaggcgcctgccgccacgcccagctaatgttctgtatcttatctttagtagagacagggtttcaccgtgttagccaggatggtctcgatctcctgaccttgtgatccacccaccttggcctcccaaactgctgggattataggtgtgagcccccgcacccacctgtctaaagttattttatgcatttactttcttagttacagttatttctccccatttgaatgtaaattctttgaggacaaagatttcgtcatcttgttcatggctgttttcccaaagcccagaacagtgctttaaacatagtaggtgctcaataaaacccttgttcaatgaatgaaccattagataattcagctttttagtaagcagaacacttccaagaaccagttataggtagatgtcaagcattctttctttcttaccttttagcttgttaatcagtttcactgatcaaatgcaatggtatcttttcattttcacaggagagagctggttcacagctccctggttttatgagtttagacaaatgaatgcagtcatgtaaccaccaccacgactgatggtgcagacacctgagcattctttttacttccctaggaaaggtgcaagaattttgccatgggaaagtcattcctgccactcttctggcaatgtgttagttccatccagatccctactcatcctacccagagcatcttggattgtttttttttcgggagtacaatggcacaatctcggcccactgcaacctccgcctcccgggttcaagggattctcctgcttcagcctcctgagtagctgagattacaggtgcgcaccaccacgcccagctaatttttgtatttttggtagagattgggagggggggttcaccatgttggtcaggctggtcttgaactcctgacttcaggttatccacctacctcagcctcccgaagtgctgggattacaggtatgagccactgtgcccagccagggctgttgttattttttacttcaatatttaattctagcaatagaaatactcttatgtaactagcattgtcctagccagcaagaaaaaaaaaaagggaaaaataattagagtcccttcaatgaaattagcagcctgcagtagggtaactgtccctcctactccttaatttaaatggatgtgcttatggctagcggctaaagcatttgtcaaatataggcacatccgccagaatttcagttgtcactaccacatttcctctgatcttgtgtggcattcttggaaccgtaatgaaatccgggctataaagactccagtgaagaaataaagtggaaacaaaacagccttttgccaacccacgctctgctttaaataaggagcaatgtctattgaataactcagccccgcctgtcaaaatattttttgggggggtgggctattcatttggaattactccaggaggcctttaattagagcctttactgcatttgcagtgctgaaatgagtccatgtgcttcttgcttgatcttccacatcacgactctggcttttgaaaggccctgttggtgtaattgaggttaagtgtagttactctgcttctgagaacacacacccctttaacgggcccgagaaacagggtagaaaacttgcaatggtttttcctcttgggaagttgttagcacctcacatttgctccgttaaacttttcacctgtgattggggttctcttttctgtccctggggttccctgaggagtgtctgggccctagaggatcctaggaagagtgtctgggccctaaagagggagttttgcctttttttttttttttttttttttgagacagggtctcactctgtcacccaggctggagtgcaatgacgtgatctcggctccctgcaacctcaacttcctgggctcaagtgatccccctgccccagcctcctgagcagctgggactacaggtgtgcactgccatgcccagctaatttttgtatttttcttttttttttgtagagactggagtttcatcagattgcccaagctggttttgaactcctgggctcaagcgatctgcctgcctcagcttcccaaagtgttgggattacaggtgtgagccacagcatccagcctgagttttactttttaaactctaggatatccaaggtgaagtccaaagagagcacccaggtataaacaagattattctggaagggctggcttgtggccagtttctacctttccgataataatgataatgatgatgatgatgataattcctgtctaatgagctctagttctacactgggtctgtgttaagccctttctctacataacctcatttaacctgcacaacagccctgtgaggtggatctaattattcccacttcacagatgaggaaactgagactcataaagggccaagtgcatggccaaggacacaaatctggtatgggtcattgttgagattgaagcccgggactttctaactctaaagcctgctgagtttgttgcggagtgggcttttggtgaatccccctgtgtaatggttggagagaccaggtcgttgccttcctggaaaggaggtgtcagggatattcttggtggcctcgcggttctaagaatggactctgcagttagacctggagatttggatcctggctctgcctctgaccagctatggttgatggagtaatggctcccaaagatgtccatgtcctaattctggagcccatggatatgttaccttccagcaaaagggactttgcagatgtgattaaggatcttgagatgtagagatgatcctggattatccaggtgagcccaatccatcacccagatccttataaaagggaagcagaacctgggcaacatagtgagaccctgtctttactaaaaacaaacaaaattagccaggtgtgatggtgcatgcctgtagacccagctacttggtggtgagggtgggggtctgatgggggaggatcttttgggcctatgagttcaagaccaggctggacaacatagcaagaccctgcctctgcaaaaaattaactagctggatgtggtggtacacgcctgtaatcccagctactcaggagactgaggcgagaggattgcttgagcccaggaggtggaggctgtagtgagttatgattgcaccactgcactctaggatgggtgacagagtgagatcctgtctctaaagaaaagcaagaagtagggtcagagataagaggagacatgatgatagcagagattgggctgatacgctttgaagttagaggaagggaccacgagccaaggaatgcttgtaaaccactacaagctgaaaaaggcaaagaaatggattctcccttcagagcttctagaaggaaccagctcccctggcaccttgacttgagcccagtgaaactgattttggacttctgacttccagaactgtaagagaataaatttgcattgttgaaatctcctaaatttgtggcaatttgtcacagcagcaatgggaaatagaacaccagatgtttgtccttggggtagtgaataaatctccctgagcctcaattccatcatctgtgaaatgggaataataatatcaatgcccacatcatagcgtgatagtggagataaaagttgatgcatataagatcctttgtggggctgggcatggtggctcactcctgtaatcccagcaccttgggaggctgaggcgggtagatcacttgagcccagaagtttgagaccagcctggacatcacggtgtaaccctgtctctattaaaaaaaaaaaaaagcaaaatacgggcatggtgatgcacacctgtagtcccagttacttgggaggctgaggtgagagaatctcctgagcccgggaagtccaggctgcagtgagcagagatcacatcactgtactctagcctgagggacaggagtgagaccctgcctcaaaaaaaaaaaaaaaaaaaaaaaaaaaaaggaagaaaaagatccaagatccattttgtattatgtgctgattgaatgttagatatcactactactagtactattattatctttagagttggagtcttgctttgtctcccaggctggagtgtggtggtgcgatcatggctcactgcagtcttgaactcttgggctcaagtgagcctcctctctcagcctcctgagttgctgggattacagggagcttctgtggctggctgtattattattaatgctaatatgaaaataagcatgaccatgaaagaaccccaaaacaaaaaccaacagaggaacaatttactgttgaactcatccacatcctctatgtggggttcttatactactttatactgggggcttatatattgatctgtgtattccctataatattccagcaccttgatgggatctggcacatagtaggtgctgcaaaaatacctaaggcatgacatgattaaagacagaaaatatgtgtttctgtgctatttttttttctgttagaagctttgttgttttgaggggagtcttgcagaccctcgcaaaactacagacctgttgtgtgaagatgggctggcttcctgcccccagccatctggtgaaccctggcaccacctccttggggcctccagtgattgttccccacacgcactgccagccctttctctcagcctcctggcacttggctccagctcctggctctggccactagagaggtggtctccatggtaacagttttggggggcattgagagggagcaaagaaggaaaaggtatcatgccagccagccagcccttgttagggacccactcataccagggtgcttgttcctgtacctccgctagagatctcggctgcagaaaggcaggtccaggagcaggtggagaggtgctggtgcttgtcttttggcgacttctttttgtaccttgccttctctttttgccctcttctgcacttgacgaccgtgtccaaggatctcagtgctttcaaagaaccatagttatccactgctgccaactgaaggctctggaaattcaagttggctgtcccatttactggtggggtgagctgtggagtaagttacttcacctccctgacctcagttttatcatctataaaatggggttttcataaacatgaagagaatctgtgaagcccttagaatgacgcctggcagctagtaagtgctcaataaggttttatctatattgtctgttgtttgagatgggggcactgaggtctggatcttgtccctaggaccctctgtggcatcaaccctcatcaactctattctccttgccaatgggagcagcttcttctctgggcttcttttctccagtcaaaacatatctgtctgttgtcttccatcctcagagccctgccgagcaactggtttatctctgataaatggatccattctttttttgtttttgttatttttgagacagaatcttgctctgtcactcaagctggagtgcagtggcatggtctcggctcactgcaacctccgcctcccgggttcaagcgattctcctgcctcagcctcccgaacagctgggattacaggcacctgccaccatgcctggctaatttttgtatttttagtagagacggggttttgccatgttggccaggctggtctcgaactcctgacctcaagtgatcctcctgcctcggcctcccaaagtgctgggattgcaggtgtgagccaccgcgcgcagtctggatccattcttgaatgttcatggctgagttggagacttttcaaaatgtttttgcatcttagaagagaattcccagagacaataataccttaattccaagacaaaatcttgggagagaaaaagtttccaggcaccaggcagtgggaggattaaaaaataacagaggtgtcactgaagctcagagaagttaagcaatgtgctcagggccacacagcaggttaagttgtgaagctgacatttgaacctaagtctgcttttcaatggacctcaaggaacattctcctttcctttctcacctgatctcttaagtatccacccagagtgatggacaggagtgatcagctgtcagatgccttaaaaccagtggccaaatgctgatccaacagctgaaatttgggagcctgcagcttcctggcagagacaaaggagactacagtctttctcagctcagctgggagaacagactttatcgagagcatcccttcctccctgggaaggtttgagaggcatttgtaatgcagattttgactctgggcaaggacccagctccccatcctcacctctggctgagccatttaaaaaaatacaagaagacagttttttccctcctgagccctgaggtctgaggctgaagtagatgagcttcctgcagcctaagctctttctctctccctgtttgaagcacatctctgctcccggtttgtcccctgctttccttagggagctggaggtgtcaggaagagaaaggggtgtaaagaataacaccggagactctggggtcagagatggcgagtgagcattcctgctggtccctgcatgtaattaagacttgcaaatccacgctgctgaggtgttggtggcagtataattaatcccaggctccttggggtggctcagcatccccaaatggccacccttgtcatttagccagcctcagtaggatgagcttggacaaaggctggttggattcaggttgctgtgggcatagctgagctcattcacttactcactcacccattcactcactcacctgttcatttattccccagatacttacaaagtaccttttataggctcaatatcagagagaaaaagtgaacagctgctgtcctccatggctcccagaacagtgaattctcctcaagtggcaagtgctgaaataacggaaggaacaaagtttaattgcaatgcagaggaggagtttttatttctgcctcggagacttcctggaggaagtggcacttgagttgtcttttttctttcttcttttgagacaggttcttgctctgttgcccaggctggactgcagtggcaccagcatggctcactgcagcctcgaccccctaggctcaagtgatcctcctgcttcagcctcctgagtagctgggaccacaggtgcgtgctaccacacccagcctgagttgtcttttttacctttaagaatgacaaaatcgttcatgcttattgtgataaatctaaataaggcagaagagtgtaaaggaaacacaaatcttctccttccttgatgtcagttctacctctggcatttatccttttggagtactttctacatttatgtatacacatatcccagatgtcagcttccaagtcttagtgtgatttgtgattttccctatgccaaccccccatgagaatctagcatgtctccgaattcttgcagaagaattcatcccatgcacacagcactggggagcaatgcagagcttatagaagccttcttagaggaggcagaggaagagattatactgtgaggcacccctaagtcaccccctgcccttggccttgtcactgcaggggcttcttctccctcagtctcacctgcttctcctcctgtcccaggtctcttccctaaatttcctgttgctattctgcagagcaattccacagtgcaccagatcctgcttcaatcgcaagcccagttcatcacaggctgcaactaacaaaggaccctccagtaaagatgaccctcccccttagaaggcagttttgggatcatatcttgctagttgggcaggtctgaggctcccaccctctctaagttgcttactgaaatgtttcttcctcacaagtacattgcccatttcaagaggaaccctggggaattaaatagtctccatcttgtaacgtagagactcatacatgtaattgtttttttaatcatatttatttattaccaaagtaggatcatactacacatattattttataatttgcctttgaaaatagctttattgagatataattcttataccatacaatttgtccatgtaaagcgagccactcaattattttagtatgttcacagggttgtatgactatctccacacgtaattttagaacattttggtctctcctaaaagaaacccattagcagtaactacacgttttccttgcccttcccttggtccctggcaacctctactttactttctgtttctttagatttgcctattctggacatttcatataaatggaataatataatatttgtccttttgcgactggcgtctttcacttagcatcgtgttttcaaggttcatctgtgttaaagcatgaatcggtgcttccttcccttttcagtttgaataacgtttcattagatgggtatatcacattttatttatctgttcctcagttgatagacatttgtgttgtttctactttttggctattataaataatgctgctgataacattggtgttcaagtttttgtgtagacatatgttttcagttctcttgggtatatacccaggaatggaattgccttatggtaattctgtgtgtgtgtgtgtgtgtgtgtgtgtgtgtgtgtgtgtgtgtgtgtgtgtgttttgagatggagttttgctcttgttgcccaggctgaagtgcaatggcacaacctcagcccattgcaacctctgcctcccaggttcaagtgattctcgtgcctcagcctcctgagtagctgggattacaggcatgctatcatgcccagctaattttgtatttttagtagagatggggtttcaccgtgttggccaggctggtctcgaactcctgacctcaagtgatctgcccaccttggcctcccaaagtgctaggattacaggcgtgagctaccgtgcctggcctaattctatgttaaatattttgagaaactgtgaaattatttttcaaagcaactgcaccatttgatgtttccaccagcagtgtatgagggttccactttcttcacatctttgccaacctttgttattgtctttttttttgattatagacatcctagtgagtatgaagtctgatttgctttttttgcttattaataaacatggacatatttccagatcaacaggtagtgacctacctaattctttttagtggcataataatattctattggataaatataccctactgattttatcaattccctttctgaattagtcagacttattttttccgagttaccaaaacagtccaacccaaactggcacaagctaaatagttcacataactaaaatgtctaggacacctcaagcttcaggtgtggcttgatccaagtagcaagtgaagtcaccaaaatcctttcttcacctccagactttgctttgtttgtgtgggcttcatttacagaataagctgcccctgtgatggtgtgatgattgccagcaacttctgttcaaatccttctgaaaataatgtttcccagtagttcctgcagtggttctgagattcactctgattggcttggctgaagtcatctgtttatccctaagccaacatgttttcatggtgctctatgcttggagctgagcatacaggcccatgcagatcacatggtccaagtagggatggggtagatatccaagtgaaaatcaggggcagttgctggaggaagaggtgtggatactgagcagattaattacaaatgctcattatactcactgagttttcactgggcttccaggacaccacattctcctggtcgtttccttccatctctaaacagcatcatgtcctaggactgagtccttccatccttctccacctacatttgacttaaagtgccctctcagtgtatatgatttcaaaatttgttgtttccagcctggcgggtcccctaagctctagacctgcacagctaactgcttagtcagtaccgccactaggatgaacttctcgtaggaacttcatatggaacttctcataggaagttcaaagttagcatgttcacatccaaactcctgatattcactctctcgacacagaccctgctccttccgtggtcttgccactgccattaactggccactccatccttcccattgctcagaccccaaacctggagtcatccttgattcctctccttctttcctactccacatccaattcatcaaccaatcctgtctgctccacatttaagccatatatagaatctgagcacttcttaccacctccattgccatcacccggggccaactcactgccagtagtctctggccctcctcagcctgttctgttttagttcccacatatcttcctattttttaacattattatttttttttttttgtagagatagggtcttgctatgttacctaggctggtcttgaactcctaggctcaagcaatccttgtgccttggcctccaaaagccttgggactatagacatgagccaccgtgcctggccaattaattccttcagtgactgtttactgagcagctacttaaaaaatatttgggttggaggagccaagatggccgaataggaacagctccggtctacagctcccagcgtgagcgacgcagaagacgggtgatttctgcatttccatctgaggtaccgggttcatctcactagggagtgccagacagtgggcgcaggccagtgggtgcgcgcaccgtgcgcgagccgaagcagggcgaggcattgcctcacctgggaagcgcaaggggtcagggagttccctttccgagtcaaagaaaggggtgacggacgcacctggaaaatcgggtcactcccacccgaatattgcgcttttcagaccggcttaaaaaacggcgcaccacgagactatatcccacacctggctcggagggtcctacgcccacggagtctctctgattgctagcacagcattctgagatcaaactgcaaggcggcagcgaggctgggggaggggcgcccgccattgcccaggcttgcttaggtaaacaaagcagccaggaagctcgaactgggtggagcccaccacagttcaaggaggcctgcctgccactgtaggcttcacctctgggggcagggcacagacaaacaaaaagacagcagtaacctctgcagacttaaatgtccctgtctgacagctttgaagagagcagtggttctcccagcatgcagctggagatctgagaacgggcagactgcctcctcaagtgggtccctgacccctgacccctgagcagcctaactgggaggcaccccccagcaggggcacactgacacctcacacggcagggtattccaacagacctgcagctgagggtcctgtctgttagaaggaaaaataacaaacagaaaggacatccacaccgaaaacccatctgtacatcaccatcatcaaagacgaaaagtagataaaaccacaaagatggggaaaaaacagaacagaaaaactggaaactctaaa

SEQ ID NO: 1360 - DNA, 71926 bp, Homo sapiens
acgtccttaaggtcccagaggctaaaagcaagagcttccctagtgtgcatagactccacttgtacataacaaatgaggcagttttgcctggagcttaacatacagaagagaaaacaaagtgaatccaggtacagtcagcaggaagatatgtaaagaagtcattataaattacatattatgtttccacagtgggctgcctgatgattcaaaaacattacttaaaaatctttcccttccctttcttttccgtttctgtgtattttttattaccctttctttttgcctttctcccttccttttatcttgaacatgagtctcttatgtaacacagcacctagcacatagtaggtgcttaataaatatttgttgaatgaataagtgaatgaaacaattcagtaggcacttcagagatgcaataaattagcttagaatgttatctccagttcagaagaactccaagcaggcagcaacaactattctttctttgatcaagaacagcgtttgggagaattcagatcaattttagggtagccggatcctcctatcacaacatttctttcttgatgaggtctgtacacaccctgcatctgaatcactcaaggtgcttattaaatacttacagttcttaggctcattcctggacctattgagtcagaacagtggcaggggcagggatttgcatttctaataagctcccggagtgtttcttgtgcatacccaaactgccctatataagcatagtttgttcactttgatcatttgtgctgcaatcctgggcctccctcctcctttctgctaaaagtttatttgtttcttccttaaagccttgagaagaaaaaaaaaagagcacatctctttggggacgactttcagttgaaaagaactgacaaaaagttgaaatgatagcaatgcaatataattttctcattctccctctgttcttgcagtgtgttgcattacttggcatagatgttttctggggggtataagctaatggaatttactcaagcacttcagaaacgagtggtgtgttttatatttctaataaagctttcctttccttgtggttgcaatggccacgaatttgcttcactggacttcaggttgttaaccaatgacaaatgactgctcttctgggcatctcattgggcgggctctgttatccagtgcaggtaggaggagtgataacccatactgcttgctggggagaatgctgcatctgtccactttttgctgcaatctctctttcctcgttccttgttctctgtacaatttttttctttttttgagacagagttttgttcttgttgcccaggctggagtgcaatggtgcgatctcagctcactacaacctctgcctcccgggttcaagcaattctcctgcctcagcctccagagtagctgggattacaggcatgcacctccatacctggctaattttgtatttttagtagagatggggtttctccatgttggtcaggttggtctcaaactcctgacctcaggtgatctgccctcctcagcctcccaaagtactgggatttcaggggtgagccaccatgcccggcctctgtacattttagttcttaggttaattttggttctgtcatctgaatgctgtatttaattggagttaaagaaaacacacacacgcatgcacgcacgcaggcacgcacgtaatccacccagaccaacattttctattcttcattattcataagtaagatttattagaaaggttgatttggatgaattgatgtgttatagatctagattctgttatgaacataggaaactgtccctttgtaggtcaaaaaatggtccaacgttggcaatttcttatgtttcaatctaatagaaaccgcataaattatccagatgtctatttttaaattgttattttaaatatacaaaatattaagacatacaaaaaggtgtaaagaataacataatgaacacccatgtactcaccatccagtttaagaactaagatgctactgaagcaatcacagccctgtccccaatcacatgtccctcatgccccgaccagaggtagcctgcattatgaatttggtgctcatttgtcccctacttgtgtgtgtgtgtgtgtatgtgtgtgtgtgtgtatgtgtatatatattttgtttgtttgttttgttttgtttttgagacagggtctcactctgttgcccagactggagtgcagtggtgtgatcatggctcatggcagcctcaaactcctgggctcatgtgatcctcccatctcagcctcctgagtagctgggactgtgtgccaccacacccagctcacttttttttcttcttcttcttcttcttcttcctcttcttcttcttcttcttcctcttcttcttcttcttcttcttcttcttcttcttcttctttcttcttctttcttcttcgtcgtctttgtcttcctcttcctcttcctcttcctcttcctcttcttcttcttcttcttcttcttctccttcttcttcttcttcttcttcttcttcttcttcttcttcttcttcttcttttatttttttgtagagaaagggtctcaccatgttgcccaggctggtctcgaactcctgggttcaagggatcctcatgccttggcctctcaaagtgctgggattataggcataagccaccatgcctgacatgtatttgtatatatataacctactgcatatagcctattgtattgtcttgcacatttctttatttaaataataaagtatacttatccttctgcaactagcttttttcactcaacatcaaggtcgagactcattcatgttgatctgtgtccctctagttcaatgttattttcaaaaaccaagtagctgaaaggatttgtagtaaaatcaacagtgtgtagaaaagagagcatatttcttttttacaatctttttcccgaccatcaagccaagcttggttcagtccatatttttggaaaatatttgtattgagagagattacacaagatttgcaggaaaaaaaaaagcagcctaacaataaacaatggagctgtgtggctgttttgagactcatgcttttgccagagtaagataatttcttggtacaaagtcagaaaagagtcccaccagctggcagtgtctggcatatggtggatgttcaataaatatttgttccttgaataaattaaaggggagaggcacccaatttgaaaggactcaagggatggtgtaagtgaggtctgagctaaaatcagttttgttctttgtttcgaattagttattgttacaggaggggaaggaggcttggatgagaaatgagagaattgaattcatgagaccaggcagctggcttcagtggctgagacgtgggttcagattctgacatttattaggcgaccatggccaagttgcctaatctcacggtgtgcctcagtttccccacctgtaaaatgggtgtaataggagggtaccccctcatgggataacatgaggcctataggtggttggtacatgaagtgtgtggcacatgttctggtctctaataagtgctcagaaaatgtcgttaagattctgtcccaatgtgtctatcccgtgggttcagaaggctggagagggcacgagcagcctcctagatattgcagacccctgggaacagccatcctttaggagggtgcctgtatctggaaggtggatcatctagtcacagcagtgcatcttgaggcagggctttaaatgtcaaagaaaatggtttaggatgtgattcatgaggcgaggagctgatgcacacaggaagatgtcagaagacatacaggttactgtgaaggactcagggtgcgtgcaggagccaggcctcgctctaatcaagcagaaccagcttgcacagtcatcagcgttagtgtgcctatgggagaacagaagaggcaaagccttgtttgcgttttgggtctacgtctctgggttgtgcagggctgaagggggatagctatattatttgcatattgctgaataagaggcatttgattgagttgcttgtgagaaagtataaaagcccaattatgttattttcaagtataggattttctctttccgtctttcctgggcagtaaagagagcctttaaattaattcagggcagactcataggttttgtctcatagggcacttggattgattggaatcgatggagtgacggttgaggatttaaggccacactcaggctctgcaggaaaagtactatggttgattagcaatgtctgccacaaggaaaggctagtaatggaatgcatgctgcatatcaaccatccacatattcatttaaagtatagccggtctatttttgcttctatactttgctcatgtttctttctctttttctaaaattacttcccttttcttctctgctgatccaaatccttttcctgcatctccatccaatttaagttccacctcctccaggaagccttctctgatatatctaatctacaccgatttctccttacaattcttagcgtttgtactatttaatgaatatttatattaacatcatttttccatctctccatatgcttttaccacatgaatcttctttctgaatttcaagcatatgaggtttgctcctgccttagtacctttgaaccagctcttccctctacctagagcaccctttctccaggtattcacttgcctagctccttctcatcattagctctctactgaaatgccacttccttgagaagccctccctgaaaccactccatataacccccagaccttctctctgtcctatcacattgttatattttcctcaaggtacttactgctgcttgataacttcttattgatttgtttgcttatttatgtattgccttttcctctacccctctccactcaaatgtaagcaccataagagccgggactctcactgttttcttctttataatattcctagcatctacaatggtgcctagcattagaaggtaaccaaataatagttgaatcaatgaaggtcttaggatattatttgcattatgtgaagactttaatttgtatgtaatgattaaacttttcttggctgtagatttttctcttcccaactacatggtgagctcacagtgggcagggaccagtcatataccccttggcattccagagcagctgtcatgatgttaccggaaaggggtcccaatccggaccccaagagagggttcttggatctttcccaagaaagaattcagagtaagcccatacagtaaagtgaaagcaagtttactaagaaagtaatggaataaaagaatagtcctgagggctgctggttacccatttttgtggttatttcttaattatatgctaaacaaggggtggattattcatgcgttttccaggaaaggggtgggcaattctcagaactgagggttcctcccatttttagactgtataggataatttcctgatattgccatggcatttgtaaactgttatggcactggtgggagtgtttcttagcatgctaatacattataattagtgtataatgagcagtgaggatgaccggaggttacttttgttgccatcttggttttggtaggttttggccgcctcccttaccgcgtgcagttttatcagcaaggtctttatgacctgtatcttgtgttgacctcctatctcatcttgtgacttagaatgcctaacctcctgggaatgcagcccagtaggtctcagccttatgttacccagcctctacacaagatggagtcactctggtttgaatgcctctgacgatggggtactcactaaatattactgaatgactgaatgaaggagcagaacagtatgttcagtgagcatccatttgtatgagttagagtcctggtttgcctgctttaacagtggcattcagaaagatacaaattcatttctttctcatgtaatagtctctagatacaggaggatggatgcctctgctatcttcacgtatcgcttctgtctctgggttcaaggcattggctctagttctggctctctagccaacaacacaaacgttctgttaaaggcacaagttggaagggcacatctcactttcacccgtgtctcattggccacaccaagtcacatgcccacacctaagtggaggctgggaaatgtagtctctggctaggcagccatgtttccagctaaaactttggattattattgaataggggaggaaagatgttgggggacaattagtggtcttttcccataacagttcaatttgatgaaaatttattattttttcctgtgctaagcatggcactggacactctggtgagcacaggtacacattgggcatattccctgtcctgtagaagtctatggcctagtggacaagacaagcaagtaactctaattcttggagctttgcctggagtaagagttgattaaatgaataatagcaaacatcaatcgctgtggacttactatgttggaaggcactttgtgttcttcgtcccatttaattcttataacggcctataacatagccccattttccagatgaggctcacagaagtattttaagatattttggatttgtggatggtataatcaattgaagggctaatctcaatttgtttagtttttatttatttctaaatttatagatagtaaaattcactctttacagtacacagttctatgagttttgacgaatgcatagtgacgtaaccactacctcaatcaagatacagaaccaccacccccatcccaaattctctcatgctgcctattctcctaccctcaacctctggcaaccgttgatctgttcttcattcctatagttttgccttttccagaatgtcatacacatgaaatattgtaatatacattaggttggtgcaaaagtaattacggtttttgccattacttttaattatatatactttctgtgttatatataatatatatgtaatatatccctttgaatctggcttctttcattttgcataatgcatttgagatacatcaatgtttttgtgtatattagtagctcattcctttttattgatcagtagtattccattgtggtttgtttattcattctctggtggaggaacattttggttgtttccagtttggggtaactgtaaataaagcagttacaaacatttgtgtactggttttgtgtgaatataggttttcatttttttttttttttgggtaataccaatgaataggattgcaggtttgcatggtaaacatatgtttaactttatcacaaattgccaaactgttttccatggtgggtgtaccatttgtatttcccccagcaatagatgagggttctagatgcttcatgtcctcgctaagtcttgtcattgtgttgttgttgatagtcactttaatagacatgtagtactgctacccatttagaaagcattttgaccctgctttgaagcatggctgtttttctcttctccaggcaacgttcgttctacataattcagcaccagcttagattctcactatcaaattgaaccctttcccctttgctatccacacaggtaagggtaagggggaatttatttttcctactaactgtgctggctagtgcagttcttagctttcccaaggaaggaatgacttgagaaataaatttattctagcccagggcttgagaaagatctgccttcaattagccagcagtatatgttgacctattcaaaccaaaccattatgactcaggttgcattaagttaaaaacatatttaaatccatatttggattatgaaagcaaatggaatacatcaagggctccatgaataagtaacattttcatattttcttaaaggacaaatgtagagagggaaagaaaaattttcttcccagggaattatgtctaaagtctataacaatgattcccaaatgggggatgggggtgggtgtggggtgcaaatcagagctgtcaaaattacttgtgatgaggagtgtttcattacacatgcatacacactctttctccccaggaggattctgacccttccatgggggagtgtgggccctttccttcagttgagaactattgccactgcgcgttgctgaggggagtagatcgtctactggccatgttggggcagaaagaaggtggagactcttctctaacattgtaattcaatgcaggggtggcaaagaaagcaacatgtgattctctcattccaacttcaatccattggtaatggctgcctgtagccctgcatagaggaagatggcagcctcttcaggcttagaaggaaggagagcaggaattgattggtgatgtttgccatgggcacaagccagctgatattcagatctgtgccatgtgtttgctgtccttgaaataagaatcttctaaagatctttggtttctttcttctcacagaatttatgattccaccttaatgttggtaaggcttcatcttggagatggtaataaatttgtaatgctctgtcaagtggttttcacctcccagaggtcatttggcaatgccattttttgttgtcacaaatggaggggtgctactggcatatggtgggtagaagaaagctgctaaatatcctacaatacacagggcattcccctaaaacaaaaaattatcatcttcatatgccaatagtgctgaggttaagaaaccttgctctatatcctccagtgtttcttaggattatctcctaaatatatatcttgagatctgacactggtagagaaatggggaagtcagacaggaatgagaaggcattcaataaaggacccattatcaaaccatccaccagagattaatcctgcaaggaaactctgagtcaatgtagaacgcatacctcagttatcccatctgagaggtgagggagctgggatatttatgcaccaattccccatggtcattacttgaaggctgttcccaaatgacattttgagagcaccatttattccccaataatagcgtgcattgtgctgtatgtaagagcttgtctaatggtcttccccagtagattgaacactccatgagggcagggaccatatctatcttgcttatcatcatagctccagcatgtagtagacattcaataaaggtttgtggaatgactaaatgactaacagcctctttgggataggcatacaagaatggcatgcaataaattagggcagttgactaatacattttgactatggggtaagaggttataacagagaagatgggagaagttgaccaatctgtgttcttacgtttgattaagggattgcccatcttgtcatactgatagaagccatattagatactgctgcagaactttgtatatgctgcatctcaccaccaccttgtttttctatctttattcattagtcttcctcctcacatatcacttgctttcttttctgagtcagtttaacttcgagcctatagtttttttcttttcttccttctccccattgcaccaaaataatgtgaagaaaaagacaagtcagaatttctgtccccacaacatatttcaggctcattctgcactcaggttgttttctgaatctctttgttatggcagagaagcagattgaagtttgagattgacaactgtctcctccccatgattggcagtgagacccttgtgtgtgtgtggtatgtgcacatgcacgtgtgctcatgcatccatgcatgtgtatgtgtgtctttggagatttcaggaggaactgattaaatcctgcaaagttcaatgtcagactgaatattttcatgtgaggtaatcaagctaggcatctgaacataatgatagatgacatgggggccaaccaatacatcttaggctatcagattgtggcaggcagatgatgttttccacatgttggtggccatattgtttctttgttctgtaaatattggtagctcttgctaaattaaaagaacaagattttccttccagttttaatgaagatttatgataaccaggagacagtaaattatggtgtttgtgtcagttagctattgctgtgtaacaaaccacctctaaatctcagtgacgtgcaacaaatgtttggttcttgctcataagtttgcaggttggctggagtgattctctttcatttgtctcttatccttttcctgggactagtaggccatacaaggcatgttcttttcttggtactggcaaaatttaaagaaggcaagcccaactgtgcaagcatattccaatcctatgcttgtgtcacatatgcaggtatcatattgagcaagtcagagcacatggttgagcctgaagtcaagaggtagggaagtacacttggtcttttgtgggaggaactcaaagttacatggcaaagggcatggttacaggaaaggatgaagaattggagcaatgtttcagtctatcacagtgtgtagagcttgggttatggagtcagaaagacctggatttaaacctttgctcctccatttactaattatgacttgaccaaatgacttagcctctttaaactttggtttctcatccatctgacaaatagttataataatggtatccacacttcagtattgttgagagggttaaatgaaatgatgcatgtaagctacctagcatagtttctggcacacggcaagtgttcaataaatttcagctaaaaacaaagctctaaatagtaggataagctcttccaggggtgtggatatgaactagacatctactcttgacattagccgccatgaaaattactcctccattgcccttcctggaatttcagggacctgaaggagttggtgaatctccaaatatgcctagcttaggtcacaagaaatgatctgaaaggatctgagccttggaaaaggaagaatgttaaactttaaattgatcagcagaaaaatatacaacagcatttactcaggatagcaatatttcagggaagcaaacagatggagggccagattgtgaatatatcagactccaaggaatctattagaaaacattaatgtacttgttatagttaaatattttaaatttgttgggctgacaattataagcaaaataatatccctttattaaaaaattaaagtagcctacagtattatagagcagtaagattagaaaatggatttttttttttttttggtggtgatctaccttccttagatatttcaactcaatggcaagagctgctaatctcagtagtgcatacttattggaacctactgtagcaatggtaattgcatttgagatatggccacattagatgttgtaatcccaagttacatatgacccaatgaaaagaaaatgataaggcagctggcaagtggagcttttaatacttcttatccagaagtttatgtctccaattttcatgcatttccaagttccattaacaaaagaaaaaaacctcttattaagtagaatagaaatggattttaaaagtaggagtgaatctccctttccccaaactcttttgagataaatctgtctgcacctatggtaatttgatgaatggactttataaaggtgaatagaatgtcagggctgaaagaggcagagaaattttccatccccactcctcctcatttacagaggagaagactcttcgccctggaaatggattgaaggttgattgggagagcttttgctcattaggcttggatttttatggctagctctcctacctcccatcatgcctcagagatcacatgagaattggttattggaattgtttcctttgggaaagaatgcatagctcttcagagatggtgtcctgatcaggttctgtaggtaggcatgagactaaatgggcatgggccaaatacaaattcttattcaggagtaaagaattctggttgtcaaaaggctttataagtaggtggtttaataatgtaaaagatatgatttcatctgtacattctaaggaatgttgtagaatactctactagttgcctaaactccatattcagtctacttcttcatcagtaatggactcctatgttgttggtgggcatcaatatactcagctgaaaattgtattttccaacttcacttgtggacatgagtggccagtgaaatgtaagtagaagtattgttggtgcttccaggaaatttctttaagggaggctgggccaaatgggagataggaaccctttggccatttccttttcttcagttcttccttcctgaaatgtagatgttgtggttggggctgcagcagctatgttgtcaccatgaagcaatcttgaagatgaaagccacatgttaaagttggcagagaagaaggctagaaacagcctgggttgctggtgactttgtggggctgccatagcagcctggtactctccacctctggactcattttatacaagaagtaaaataagctctattttgtttgagtattattttggtcctgttaatatgctgctaaattgaaccttaactgatatcagtgtcaaggagacacacttattagacactaagagaagaactatgaggatcagtagggaaaagggggagacagaggaaaaataataactttacaatttgccgaaattgttcatctatctcatttctctgatcttgtctgatgatgttggtatgtatatacagttggcccttgagcagtgtagggattaggggaactgacaactccctccccctgtacagtcaaaaatgtgtatataacttttggttcccccaaaacttaactactaatagcctactgttgactggaagccttaccgataacataaatagtcagctgacacatattttgtatatgatatgtattgtatactgtagtcttacaataaagtaagctagagaaaagaaaatgtaattaagaaaaccataaggaagagaaaatacatttctagtactatactgtattgatctatactgtaagtttacatagtctgtttacaagatgaatcatctgtctgaaacggtgggcaactgcagctgcagacctcaatccaagatacatatcctgcaactcgactttttcttgtaatgccatgacctttctctgcttcttgggagcacttccaacatcactaatggcattttgtatgggtcccatggagttattcaaggtttatggtattgcaccaaacatgatgaaaaatccacgagaaccgctagagatcactttttactatgatacacaatttactggagagatatactgttcacttggagatgattattgtcacatggcgttttaggtggatactctcaacacttgagctcactgaaatagcaatagaaggtggctacaaaattattacagtagtacagtatggacgacagttaatgttatgcagttatggtttaatattgcatatttacatatctctcaactgccagttgtgccatgtatgcattgtaagtatttgtgtgcagaagttttagtaagttctaaatttgtgtaatggatttgtgtatattttatggtaacaaatgataaaatactcaagtatctatgtatattttatgcaattatgacatacttaactttttcttaaatttttttgattttttttttttttttttttggagacaggatctatctagctctgtcatccaggctgtgcagtggtgcaatcgtggctcactgaagcctcatcctcgccggctcaagtgatcctcctgcctcagcctcctgaggagctgggaccacaggcacatgacaccatgcctggctaattaaaaataatttttttgtttggtaaagacagggtctcactatgttgcccaggctgcttttgaacttctgaactcaagcaatcttcctgccccaacctctgaaagtgctggacttacaggcatgagccactgtggctggccaatatttttttaatattttttggcagtttatcttcaagtttattcaaatggttgcagatctccaaaaaatttttccaatatatttattgaaaaaaagtcatgcataaatgaacctgcacagttcaaacccatgttgttcaagagtcaactgtatatatactgctatttctgctttacagatgaggaaacaggctcagcgatatcaaatgcttatttataggtttatagtcaccaaccaggttattgttgttcatcactgtgttctcagtgcctagcacagtgcctggcacatagcaagtaagcagtacatatgttttgatgaggctgagcacggtggctcacgcctgtaatcctagcactttgggaggctgagctgggtggatcacttgagctcaggagttcaagaccagcctggacaatatggtgaaaccctgtctctactaaaaatacaaaaattagccaggcgtggtgacacacgcctgtagtcccagctactagggaggctgaggcaggagaatcgtctgaacctgggaggtggaggttgcagtgagccaagattgtgccaccgcactccagcctggtgacagagcgagactctgcctaaaaaaaaaaattggctcatgcctgtaatcccggcactttgggaggccaatgtgggaagatcacctgaggtcaggagtttgagaccagcctggccaacatggtgaaaccccgtctctactaaaaatacaaaaattagccgggcatggtggcatacgcctgtaatcccagctacttgggaggctgaggcgggagaattgcttgaacctgagaggcggaggttgcagtgagctgagatcgtgccactgcactccagcctaggtgacagagcaagactttgtctcagaaaaaaaaaaaaaaaaaaaaaaaaaaaaacacgttttaatgaataaatgcatcttctgcttttgagggggcactttccccacgacctcattgtaccacttccctgacttcttgagaaagtggtggagaagaggggaagaggggagaaaggaaaggagcgtttgtgatgccaagtgggaaaaaggcccccatcagctttcttggagcctgagccattgttggttgagacagtgtgaatcgtggtagacaccagttgttttgctccttgcatcttttcatctttgctctagtaacatctcctcgattagccgcttgggggtgcttcaggtgacatctgctctgtcctctactcaggagtgggaaacaaatttagtgtgaccaatcagaggttggtgttcttctggccacggtgattggttcagggagagacccgtgatcagatcggagctacctgccatgtgatgactttaaaattattttaaaatttttatatatttagggaagatgagtgtagtttttgttgttgttgttgttgttgttgttgttgttgttgttgttgtttttgagacggagtcttgctctgttgcccaggctggagtgcggtgatgcgatctcggctcactgcaacctctgcctcccgggttcacgccattctcctgcctcagcctcacgagtagctgggactacaggcacccgccaccacgcccggctaatttgttgtgtatttagtacaggcagggtttcaccgtgtaagccaggatggtctcgatctcctgacctcgtgatccacccgccttggcctcccaaagtgctgggattgcaggcgtgagccaccgcacccagccttttttttcgggggggtggggggtgtactggggagtgggggatggagtcttactctgtttcccaggctgaaatgcagtggcacagtcttgactcactgcaacctccacctccctggttcaagtggttctcctgcctcgggctcctgagtagctgggattacaggtgtgtgccaccacacctagctaatttttgtgtttttagtagagacagggttttgccatgttggccaggctggtcttgaactcctgacctcaggtgatctgtccgcctcagcctcccaaagtgctgggattataggcatgaaggtgcgatttcttacatgcatatattatctggtggtgaagtctgggctttgagtgtacccagcacccaaatagtgaacactgtattcacccctctctaatgattcttgaaatatacctttattatgaaaatttgtaaaccaacaaaaagcagaaataatactacagggaacccccaaatacccatcacccagattcaataattataaaagtttggccatacttacttcatttttcccccttgtttctcttattcctaagatttttaaagcaaacccagatatttgccattttatctcaaagtattttagtttgcatctctaaaatataaaggcatttttctggctgggtgcagtggctcacgcctgtaatcctagcactttgggaggctgaggcaggcggatcacctgaggtcaggagttcgagaccagactggccaacatggtgaaaccctgtctctactaaaaatacaaaaattagatgggcgtggtggtgcatgcctgtaatcccagctacttgggaggctgaggcaggagaatcacttgcacccgggaggcagaggttgcagtgagccgagactgcgccactgcactgaagctggggcgacagagccagactccatctccaataaataaacaaataaataaataaataaataaaataaaaaagaaatgggaactaaggctttctcaggtaaggtgacaaatctagaaagaaatcagcgttcacctattatcttcactcttggctccctgagcagaattttagaccctagtatcaaattagacaattttaatatcaaagagacatatcgaagaggtgttgtgttttatcaatcccacgtgctgggattacaggtggcacatgcctgtaatctcagcgacctgggaggctgaggcaggagaattgctggaacctgagaggtggaagctgcagtgagctgagattgcatcactgccctccggcctgggcgacagagcaagactctgcctcaaaaaaaaaaaaaaaaatatatatatatatacatacacacacacacatacatacacacacagacacagacacacacacacacacacacacacacacacacagaccccccccccccacacacatatatatatataggcattttctaacatgaccactaccatgagacttttgctgaaactactgagaaaatgataggtgtttctttcccatggaaagaaacttaaacttaagttaaaacttaaacttggagggatagaaccctgaaaatactgggagcattgcatggagtcaaagaataaaatcaagtagtgaagtcagtctagggattagaaagaaaagaatcttgattatatagtttgtgttcctaggttaaaccttgcctgaagaccacattagtaacttaaatgaaaccacacagtgtctatttcacttaagccagtttgagcagggttcttttgttcacaaccaaagaatgtcttcactgatttagaaaccactatcttttctcctgggatgacgatttcttcccctacaatagcttgtcttgaagccagacctcagcccaatagtccagtatataaaaacccatgaatatgtaaagtagacctactgaagaagaggaaaaccaaattactccagaaaggcaccagttttctccttcatactcatgttcaagggggaaagcttgatgtgggttttccttcaaatgcaagtaagatcctttcaagggtgggtgctgtgtgtggatttttagtctattctaggtacacaattttccttctatgctgggaacaaaaggtgggaaagtggcaaatcatggaagcatggcaatttatcaccagtttccttttgtgttctcaagccactagactgggggaggaccctgccccaattttgtggggcaaagttggcagatcccagctttaatttctctttcatgttttcatagcatcttgaaatggcttttaagcttctatttttttttccaattcatcctttggcaggaggaccataacccttataatcatggacaggcatcaaatgaacgccctcaacttgcatgcaaaaatgttttgtgtgtgtttatataagcatttttctggctgtcatagctttcaataggaaaccaaaatgttctcagaactataaagacttaagaatcaatgccttctaggtggttattaagtattagactgttcccggtatttaaccttaaaagaatttaccacccaccttggaggtggcagagtgttactgacaaagccagtcccccaaaagatggggtctttccttgtttggtgtcatacaccaaacaaaacaaatacacaaaactgaaagagcatgtcaagcagtggtgactttattggatggctatggaattgagaagcaggagcatggctcacaaaccaacttcttaacaggggaggggtgagggggttaaaatataccatttctctaatgaaagtttgggatactagaagcaaggggagaaatattcatgtcttttctgggaatgggcagggaacttcccagaaccagagcgctgccttcctttttgtctttttatggcttcttctggtcattgtcatagtgattgtcaactgtcatggtgctagcgggagtggcttgggaacacaaaagtgtcacttagcatggaaatgagatgataatggagcctgagatctttttgaagtcatttggtcagcaattttggttctaaccagtcttagttggtctgattacaaagggaacttttttttttttttgagatagggttttgctctgtcacccaggctggagtgtggtgacacaatcatggctcactgcagccttgacctcccaggttcggtttccctcctatttggtggcacacacctgttgacccagctaggagactgaaatcctcctatctcagtcccctcgctgagtctacaggtaagtgtgtcatcaagcctggctaatttttgcatttttttgtagagacagggtttcaccatgttgcacaggctggtcttgaactcctgggctcaagcaatccacctgccttggcctcccaaagtgctaggattacaggcatgagccgctgcactcggcatacaaagggaatttttttttttatcgcaggtgtcttgtttcttaaagataagcagagttaggacagggtagaaattcaactatgtcacatagccattacactgggtaacaagaggaatccactaaagtcctaaatattgactagttgctttaatagagtggaggaaggtgaactgctaagcttgatacataactcgtaatccagttagctgcagttttacccataccactggctaaaaagccaaagggccttgctttccattgtgattctgctactcacatcctgcatggacatggacatgttatttagcctttctgtgtgttatatgttgaattattcccccaaccctgccaaattcataggctcaagtcctaacccctaatacctcagagtgtgaccttatttggaaatagcgttgcagatataattcattccagtaaggttatagctggagtatgatgggcccctaatccaatatgactgctgtccttataaaaagggggaaaactggacacgtacacacacacacacacatacacacacacacagaacaccatgtgaacatgaaggcagagattggggtgatacagcagaaaccaaggaatgccagtgatttctggcaaccaccagatggaacagatccttcccttacagctctcagaaggaagcaacctggccgacaccttggtcttggacttctagcttccgactgtgagacagtgcatttctgttgcgtaagccacccagtctgtggtagggtgatcctgcagcctgagcagaccaatgcactggttgaggtcaacacggagatgcaccattagacttgctgtccagctgcagggagtgcagccaactgatggtctccagctgttagccccatcaggggtagcctcagctgcagaaagccagcttgcccaaggtcatgcctttctctgggaagtcagtgtctgcatttgaaccaggtaggggtatgatataaaggcttggccatgtcagcccaatgctggaaaacctccagggactgtatttgctgcagagcttctcatggggttggctgaggctgtgcaaggccagcgcatccagcatctctctccgcccaatcctgcttcctccttggttcttttataagtgttgatccctaggaaacattttgcaccccaaactccattcagtgcttgcttttggagacccccaagtggtgacatggggttttaactttctcatctacaacccgtgaaaatacctggccgagacggtcagttaaccaacgtcattggaagcaggctctggccatttccatccccatgccactgaagaaggaaacaagagccattgaaagggcttctgatgccacagagcaaagaacatcccaggaaatgaggccagccctggccattgttccagggctggcttatagggcacactggggctcagatctctgtaatttaccagctcttgtaggctgctacagcctccctggtgactggctgaacagaaagggggacattgcattgctatgaaattctctgcaatttcctataagaaaagagctgagccgtgttccagagggatcctctctaggagctctgtgttagagttggctgtgttttgagatgctaaatattgtggataggaggagaatgaagtgttttacagtatgacaggtgggacgttctaagttctatagttcatttcatttgatggtgtgtgtgtgtgtgtgtggatcagagaaagagagagagtgggagaaagagagagaggagagagaaagagaaagagggagagaagaataagtcaatgaatacacgtataagtttccattctctgtttttgtgaagattcaatatgtggtatgttaggcagtccagaagtgacaatcattttatacatccttcaatgcatgctaataaatgccagtccacaaaatatatgacctattatgcagcttttgagcctcaataaatgtccagctctctatttctattaaatttagaggaaatgcctgtcttctaaaagcttaatcacctgtgaatgcctttgggagactttgtaacaaatggcaaatcagaagaagctttcttaatttcctttattccaatctgctctgttaaagaggccctcaacagcctcctgggttttttcctggcctgtgcagtttgtgccatctcgtccttcctctcacttctaatttagcagtttcagatactagtattatgtcaaacccatttgggggatttttcccttgatgactttctaattaaatcgtctacaaaaatgacatttaattatggagacaggtgttttgtttttcttttttggtcccaaagacagcaaatatttcaatcaaattggttcagtccttgtacatttttctctccctttctcttgcccagtgagatgccccacctccccaaaaaatccataaagaagctacataatttgtgtgttttcttgattcttttgacaggctttcagtgggctgggaagcctcgggctcatttctcaagttccagcttcgatcagataactatgtttgattaaacatccttttaaactcattatcagctcagcaatgacttctttcaaaatgacctttctgatgatctaatcgcaaacaagcgtttctggaggcatgaacttcagtgttctctgactggtgtccttggttcgtggtgggtcctgtggaggcttctcagaatgatgcccaagggaaaagctgggttctggggtgtcaggccactctctattaccttggctacttctgagagctggactcactttagagactcagtttggaggtggaggatgaacacgctcatttccaaagatttagaatctcaggctttgaagtccaacacacttgggctggcatccccgctctccatttgctagccatgtgatcttttgggccttgtatttcttacccgtaacatgggattaataattcctactttctggggttgtagtgagaatttgatgagtccatacatgtgaatgctctgggcaccctcattaacgcacgctaggttccccaagaaatggctttgtggggagatgaacgtgcaggatgtttaataaagagagctcttgggatccaccctagtgggaaggagaggaagggagcagaataaggtagtgggaaacattgagctgcagtgagggtccagtcattgcttcagctgaccccacagagccctggagctagaatggccctcgagaggtgtcctgagttggttcaatatggtcaggcctgtatactcagcatttgttgagtatgggccaccctgggaggtgtgtggctttgggtaaggtggctctgcagttgacatagtttgctcttccttgaaggtggatctagagtgtgtaactgtaaccatcaaaaccctcagtagatgttggctattgctgtcattaagaggattaaaaggtaattggactttgggaatgtttttctcttctgtaagatgcagaccactgtctgatttgaatattgcattacagttatcaatttagtcattcatttcacaaatatgcatcaagctgctcctgtaatgagctgggcactgtgctaggctctgggtcacctcccctggcactcatgtgtctcatgtttgagataagaacctcatgctctgcaagtttcaagcatgagcctgtgctacagacaaggaaacaagctccaaacacacctgcacagatttgcacacacacccgtacacacacacctgcacacatacctgcatatacacacatctgaacaaatactttcacacaaatacccacacacattcctgtgcatatacacccatactggcacgcacatatctgcacacacatacaccagcatcacacacacatacagcattaagagttggttgtgaggtgtgttaggccttcttggaagcagacacatagttaggggtgcaagaggcttactgggggttaatgcctgtgaaagataaaggggttgaagcaggagtgtgcaggggaagccttcagcttgtgatgcaggcttgaagtgttggcccacccaacagggagctcccatcaaaagacagcccaatgaagaagcctcgaattggtcagaagtgacgaggccttagtacccctgccatgcccagtcattgactggggctacctgaagagaaggtgtcttggttcaaatgctgcagcagatcccgaaggttctccttgcaatggaaggaaattctttcttaaaggaagatagaagcagcacttctctgaggctgccaagtgaggattaaagacaagcggatgtgcaaacaagaacccagcacagagtgggcatggcagatgcagagaaggatctggatgacttttcctttccttctaccttttcctcatgtggtttcataatttctagcaaagaataggagagtgtaaaaggtcatgcagctttaggtggctctggtaacaatagtattattactatgttaatctattgaatgtttattaagtgccaaccactgtactaaggaatttacatctgtggcctctacacagctctttgaattagatatcttattattctcattatacagatgaaaaaaacgaggtccaaagggggaagtcacttgcccaagtacagtcatgagctgcataatgatgttttggtcaaagatggacctcatatatgatggtggtcccataagattgtactaccatatttttagtgtacctttgctatgcttagatatgtttagatacacaaatgcttaccattgtgttacaattgcctacagtgttcaggacaataacatgctgtgcaggtttatagcctaaaagcaataggctctaccctataacctaagtgtgtagtcagctatacctctaggtttgtgtgaatacactctatgatgttcacacaatgaccaaattgcctgagagcacatttctcagaacatattcccatcattacgtgacgtgtgactgtacatggcgaatatcagtccaagtgttaccagaaaggggtcctaatccagaccccaagagagggttcttggatcttgcttaagaaagaattaagggtgagtccataaagcgaaagcaagtttattaagaaagtaaaggagtaaagaatggctactccataggcagagcagcagcttgggctgctggactcaggatatttatttcttgatcatatgctaaacaaggggtggattattcgtgagttttctgggaaaagggtgaggaattcccagaactgagggttcctctcctttttagaccatatagggtatctttctgactttgccatggcatctgtaaactgtcatgacactggtgggagtgtctcttagtatgctaatccattataattagtgtataatgaacagtgaggacaaccagaagtccctttcgtcaccatcttggttttggtggttttagctggcttctttactgtatgctgttttatcagcaaggacttcgtgacctgtatcttgtgttgacctcctatctcatcctgtgactcagaatgcctaacctcctgggagtgcagcttagtaggtctcaaccttattttacccagcccctattcaagatggagtcactctggttcgaacacctctgacacaagctcccaaaccgaaactcttctctgactgccatttgcagtcctgggtgtcacagagcagagataacagcctcgggaaaatcgcccaaggaagaaacacaatttaagagcttagtatcgattatcctggctgacagcaaaaatggccaatggccggattcactgggaggttaaactctgggaagctgtaaggcttgtaaattccactgggaccctaaagcactttgcagggaagtcaatagaaacaaaaggaaaaggcatggagagatgttggggagagaagcttagaaacttaattttgagtgtgtgagcctctaagaactcaaattaggtagtcttcttacctccctcattaaacctagcagaaaaaagcctcttccagataaaaatgtctagaaatgccccagggcagaggtttggaaacctgctgtgctcttgcctgctggagttaagatttcggagggaggacatgccttcgttactgccatgtcagcggaggctaattgttttttgaatctgtgcctggcagagcctgggatggagaatgacactttgcacttgagcctgccagagttaggcacccagaatttagggttcactagacgctgggacagagatggtgtggagcagcctggcttcatggtgtcctgaccttggtcttccccacctccccccaagcctttcttcagttctgacctgctcattgtccactctgctcaaataccttaagtggctcctcattgcttagaggatgaaatttaggctgctccatggacccactgggatctattcctaccctactttattactcatgctacacgattcccatttgagagaacattgttcccattgttccctgggaggacatcctgagacatgttctctaaacgtgccttgccctttactttcttcttgactttgcataggctgttccctctgcctggaatgcttttccccctcttctaaacccctacacatccttaaaagcccagctcaaatttgtcttgactttgactcatttacagtggggtttctcaaccttaccacgttttggacacttcttggttgtgggagctttcctgggcattgtaagatgttgtgtactacccctgacctctatgcacgagattctagtggcactacccccaccagttgtgacaactgaaactgcctccagacattgcccaatgtccctgagggacaaaaccacctctgtttgagaaccattgcttagccagtgtttagcagcttcttcattgtttacctgacaccttgtccaggggatcttgtctcactgtgttgtacttatttgccttctgactgtcccctcactggaccaaaagctccttcaggctgggactttgtcttcttcagcatcttgcattggcctggcacatagtaagtgctgcataaatatttggtgaacacatggagaaatgagacacggagtgtgagcactgcagctgtctagaaatgtgctatttcataaagccaagggcaattaacgacccttgggataagaacagtgaccacctcatgggactgtgcatattaaatgccttaaagatttaaagctgtcagaatagggctgacgcatactaggtgcttaatatatgtcagctactgttgttgttgttatttttctcactctggggctctctctttcagaaaggcttgcaatttgagggtaaccaatggcaggcagacatggataggtggacatagtgggggaatctctcttgaggctcaacatatgtaaatttaggctacttaaagaaaagtacttctggccgggcacagtggctcatgcctgtaatcccagcactttgggaggccaagatgggaggatcacttgagcccaggagttcaagaccagcctgggcaatatagtgagaccgagtctctacaaaaaatacaaaaattatctgggcatggtggtgcacacttgagatcctagctactcaggaggctgaggtggaaggatggcttgagcctgggaggtggaggttgcagtgagccgagattgtgctactgcactcctacctgggtgacagaatgagaccctgtctcaaaaaaaaaaaaaacaaaataaaaaaaaaacaaacaaaagctacttctttataaagtgagttgttaatagatattatgctaagggatgaatatacagacatagtggatgagattgaggactgtggaccagactgtttgagttggaatcttgagtccatggctcacttagcctcagtttccccacttgtaaaatggggataataatatgtaccttatagggttattatcaaggtggaatgaattcatgtatataaaacaacacatagtaagactctatgagtctatcaccatcattattattattatttttagatgtattcttgaatgatagctcccaaatggatcttccccaaagggaatctggaatattcgaggactgtttggatagcatagacatgccatgacttcccatttcaatcccagacagacatggctagttgatcctgcagtttttttcccctctgagccatagactcctcctccaggcagccaccactaatcaattacggtatgaacactgtttgcatcattatccttagggatcaccattaagtactgggggaaggtgcatagacccagggttaaggacgtgaagaagagtttccctggaccgagtccaataactggaaaaagactgggcctaaatccacacagagagctactaaaagtgttgtccatgaccggtgctggtccgtaaactgttgctggtctgtgaggagctaagtaccaaaattgttattagtgtcttactttcctgaggctgctttaataagttaccacaaactgggtggcttaaaacagcagaaatgtattcttacagttctgaagtctgaaatggagcagcagtgagggctgtgctccctctgagactttggagaagtccttcctggtttctttcagcttcttttggttcccagcaatccttggcattgctagtctcgtagctttgcctcaaatctctgcctttatcatcacgtatccttcttccttgtgtatatctctgtgtgttcattcctcttcttttatagttagttaattaattaatttttttttttagagacagggtctcactctgtcacccaggctggagtacagctgtgtgatctcagctcactgcagcctcaacctcctaggcccaagagatcctcccacctcagcctcccgagtagctgggactacaggcgtgcatcactctttccttttcttataaggacacacatttttgggtttatggcccaccctgatccagtatgtcctcatcttaactaatgacatctgcagataccttatttccaaataaggtcacattctgaaattcctggtggacatgcattttgcagggggtactacttaacccactaagggagtaagcactttctagaccacattttgagcagaatttagatggttctattctctgccatcaccactgcatgggtgtagaagggggcgggaagggtcccctggaaggtgagtggtggtgttttttgtttggggagctgcactacctccagctcaatcaaaaagagcagatgactcaccggatggttttgtgctgaacaaattaaacccgtcccatcacagcagagcagttcagccaactccatgctgaacttgtgcccatatcatacatttcataatcctaattgtggcttgcatttcccttttgccttccaaaccaaaggctcatcataacagatctgcaagccctgggagttgggtttgtttgcctaggtatttggttttctctcttttttcccctaatgaataattttctaatgaaagcaaagtagggtcgcagtatgaggtagatgcatgcacgaaggagaagaggccagaataaacagactttgcaggatctccaggtattccttcccagggagcagcttgtaactgttaatgaacttggataggtttgcttgaaagccaagaggtctctgagagaatgcccaggatagctttgaagatgtgattgaggaattcacatttcttctctgccaaccctgcctcctcaagaggacacccagcttgtaagtgaagtgatagttctgtgagttaaatgagaaatctgtaggttacataatgttgttgatggcaatggtaggaattaggtctattttttttgaacacctgcatgaactcaactgctctctaaattttagatcaactttgtgaagtgtataattctatcctccattttccagtggaggaaactgaggcttagggaggtgaagtcatttgcttaaaatcacacgaggagccgtcacctgagctggggttggaactcgtgcctgtggaaactcatgcccttatgcctgcccttaacagggaacaatgcccagaatttgagaaggtcatctggcctcccccatttccatatggaatgacaggtgtcaccttgaagaaatttagagttggctgttacattcttccatgaaaggagctgtggtttatttgcttttggattagacctgggttcaaattctggctaaggcacttaccagccgtcctggtcttggccttatttatctgtcctctgttcttttctgattacaggggccacatccctacagcccacatcttccacacttctttgtcacttggcttcctgctgggtttgtccagtgggaggcaatggcattacaggagaaggcagaaggaaggaaagaccaaggaatttcttcccctccctctctgcctctggaaggtttgttgactcttccaagtttccagcttctactgggtgacactggccccaaggctctaggaatcctaccttctcccttcatccccccccagccttgggtagtaaccactttctgctgttgctagtctctggctggcctcaccctcccttatagcctcagctccctccttacccatgtaaccaatcccctgcattaaattctctctgtcgtaaatacttgaaacagtttcggatttcttgatttgattttgaccgagacaccagctaagttgactgcttcttttagccttgatttccctatccgtaaaatggagataataatagtaccttctacctaaggtatttgtgaggatcaaatgagttaattttagttaaacccttggctcagtttctggcatataataaaaagttttcccagcttggagaccttaggcatgcatttcccgcaacaatttaagcagcataatgaattctatagttagccagagagctttattttgtttcacttttttgaaaagtgttggttctgggtatgcatattaatgaatatcaccagaaaaatacactccagtgactaagcctgggaacttagtctaacagcttttgcccttctctcttcctcctctctttcacctcaaggagtgggcaagccagcaccttttctcagcaccatgcatagccaagtggatgcagagaaaatgctgaactttcagaatttcttgaggttcctgaaagcctctgtgtcatcatgaaacagaagctcatcttacaaatctgtctttcatagaagcttcagttactgatgccaaatgtcaacatatcaaattgttggctaattttagccttatcaatgtcttgcagacatgtaattaacaccacagttcagcagcaattcaggcgcggagttccattttgcatcatgattttcgagaccttgaccattagtgctaaggttcaaagtctgaaagtgccatctccatatgggatgtctcctgttcctccacacctccacttgtccttttaaaatcagaatcaaaatggtccaagctcccatttcatgtattgtaggatgtccagtgccttcttggatatacctgggaatctcagagggcttttgcactcccagtcacttctcgtgtggaattctagatgggtccatgtggtggatggtgtcttgcctcctgaagctgttgtttcctcttcatcttactttaaacattgcccaccccctgcctcagaacatccccagatgttctggcaacttctgtgtagtaggcttttactgaaggcttgaaaatggctgagctggacaatggctcaaaacaaaacagaaaacaagttaaaatggaatagtcaacactgtacatttccttagcctctcccaccgtaggaattttctcatcaattgcctttcctgttgggctcccctgtgctgccatatggctggggcttttcacttcctccagctctcttatctcagcttctctcattttggattgctccttaatcttgtctagtgacccatcaatctccagactccaaattcacactacttttgtatagagggtaaaaacatttttgttctttccctcccactagaattccttgtagacatagagctgtctttgtttagaagaccgctttaatgagagtttggggagagagtgagctttcgacccccatgtcaccggtctcactccaaagcatcaaagacagtggaaggggatagagatgggaggagaagagaggcctcagaaagttggagagagagagctgtgtgagataaagtagcaaatgtaagaagccatgtctgctcatttctgcttgccagcctaatgtcagaagcctctgactctgtgatgacacccatctctctggaaacatgtgttgaagacaaaagaggatacagcacacaggccccccatgtcttttgcctgagtcactacattccttaaaagataagtgaccctagtccttgccttttcctacacataagatatcatctgatggggttagcgattgtgcctctataatctataaccagatgtactcttacatccaacttggatgtgattttgcacgtactaaacctctaccacctgtatataagcagtgcgctaaaatactgcaccagagcagtctgatagagctctctaaaggactgttcccaggctataggcttccttcagtccacagtcctcagtaagacttctgaataaagctaactttaattctttaagagcttgatttttttctctagttgacacctgggagagttgaaagtccaagcgagatcccaggagaaattttgggattggtgatgtttacagtgtccatcagccattgttcatgttgccatgatagatgtctcttctttgggccccctgtggaatattcagttaaagagaacattattaaggcattcttgctgtgggtagactcttccgggaaattggagaggaaatgttgtatacgaagttcatgtatctgaagaagcatccacagcagcaggagccacggcaccgagacggccatgaggaaatcagcttttgagacatgaggaaatgtagggacaagactgttctggaatgtgcagatatttaggagttgagctttgggacttcattaggcagtgagattgatgagagctgaggttccagcaggaaacagttggcattctcagactgggttatttgaggagaatttaactcagggctgttttcgaaacaatgaatacagtccagggaaaccaacaagaaatagtggaggatcctggggctgctgtcagggctgggggagaaagtcaggtttattgctgggtaaatgctgcacctgacatcccagcatggtgaggaccaaaggagcttggggtggcacatggcttgtgtattagcttcttatggctgctgtaataaattactacaaacttagttgcttgaactaatacatatgcattatcatcttatgactgtgaagatcagcagtccagaatgggcctcaaagggctaaaatcaaggtgttggcagggctgtgttcctcctggaagctctaggggaggagaatttgctttcctgccttttccagcttctagcggctgcacatattcctcagctccttgtccccatgcaatcctatccctccaacctcttgcttctgccatcccgtgtcctacttcctcttctgtagtcaaatctccctctgcctctgtcttattcagacacttgtgattacacttaaagttccctccagataatagagaatcatctctgcatcttgacatctgacaaatcccatcttgcaagttctctttggctgggtaaggtaacatagtcacaggttctggggattaggacgtagacctcttgggggtgggtggggaggagcagcagtattctgcctaccgcagcgtggaacactccaggctccgcatttgttcactgtggttcccacaggcagaccaaaccacatcacctttgctgcaggagcaactctagatgtgccactgggtatcaagcatcccacctgcaatatttgtttcccatcagagagatgcaggggtttttccatagagactacacttggagaaacccagctccacaccgtctggtgttgctcactctgcaagcatgtctgctccctggctactgtgtacgctgctaaaaacaaagccaacaaactcttctctgtatcctcccagcagcctcatggggaatcgcacagggtaggcgctcggtaaatgttgtggctcatcagtcttcttacaggactgttttgagtagttgggctggatgaagtacatcttgaataggagtttagggtttttttttccccccaagggcaatagggagtcactgaaggtgtcaagtaagagcatgacaagatttgtggcaagaaatggaaaaagatttgatgttccagtaagaggaggctttgggcaaatatgtggagataggatttttgaaaatacaggtttggggactgctaagatttcatggggtgatgtgggcaagattttcttctgatttgcctccatcaacactttataattgtgtacacacacgctttcaccctcaggctctgagcctgattatctttgtaacccccacagtgtagcactggcctggcacatagtaggcgttaattaaaattttggtgagtcatactgaacttggcaagccacttgaccttgactgttccaggcttcagttttctttctttctttctttttttccaagacagagtcttgctctgtagcccaggctggattgcagtggtgcgatctcggctcactgaaacctctgtctcccaggttcaagcaattctcatgccccagcctcccgagtagctgggattacaggcacctgctaccatgcctggctaatttttgtacttttagtagagacaaggtttcaccatgttggcctggctggtctcaaactcctgacctcaagtgatccacctgccttggcctcccaaagtgccaggattacatgcgtgagccaccatacccggccaggcttcagttttctatttgtaaaacaaaagagtgagactagagccctcacaactctgactccgtggtatttaaaatcctgcttcttttcatgggcagcatttatctggagacccatgtttcggaggggagttgggctggaaaactctgaggatttccgcagctctgggacttttagatttatagctgcttgtaacatttatcaagaatttgtgtgtgccagagactattctcaggccttgcagggggtcatctcatcaactctttgcaggagtcctataaagaaaggcactattagccccattctacagatgagggaactgaggctcagagagtcaagggggttgacaaggtcgcacagtcaggggagacagggctgggatttgaacacagttcccctgactccagaaaccagcctttactctgtgctctgatgtttggattcttctttcagttttgtttcgttttgttttaacctctaaacatctcaagcatgtgtatcccaggaaaaaagatattctcttacattgccacagttcagttttcaaaagcagggaatttaccatctctccaacattatcatctaatccacagcttattttcaaagtgtttcaactgtcccagtaatcttctctttattctctgtccaagatctaatccaggattgtgcattgtattgagttgtcatgtcttcttaacatttcctctggagcagttcttggcctttctttgtttcttgactttgacatctttgacgcttccaggccttcagtgtgagctttcctgatgcttctgtgtgtttagattcaggttgtgcatttttggcagggatgatgcagaaatgatctgaattctccccagtgcattttatctggaggcacctgctattggtttgtcttattcctggtgaagttgatcacttatggttaatacatttttccactgtaaagatacagtttccccctttgtaatgaataagagatttgtggggagatactttgaaactactaaatatattgctatttatcacactttcactcattggttttagcatcctttgagggttttctaactccatcattccttttgcagttcttagttggcttagagcttctcttcttcccaccctccatttattcattttattcacatttatgtatattgacatggactcatggagccattaaaatccatgtaagctgatttccctctggttgtttttgccaggtgagctattgcttcctcatttgttcccagtgtgaattcagctcatcttaccatttgaaaatccaaagacttcaactgcttggaaatcttcagttttagctagaaaggagcaaaatcacagacttctgccctaaggaggagggagaggagtgagtggggagtctgactgctcactccattcccatagctcatcttccagcaatggccatcctccagcagtggggtgcaccacagggtcaggggaggtggcttccaattctgtggtttcctggtggtggtcatttctgtatgtcagtctctctccttcctctgtttgtgattgtggaactgtagatgcctctttaagaggcaggagtgtttatgagcttccccgaggaaatccaggaaggtcatttcagactcatcttgcagttttctcttcttaaagagtgaatccagatgaggttaagtccccttgcaacctgttcttccttgtcagagtactacgtgtgtttcacatcttttttctttcctccttttcctccctttttccttcttaccttctttcatccctccctcttttcctttagcaaatgaatgctcttgaacacctactatgcgttcatccaccaacaagacaaacacaacctgctctcaagctctcctgtggcaaacatacattaaacaatgtcacaattaaatgcatgatcacacactttgataagtgctgcaacagaatgtcagaggagggacgtacatgctcatgtgacaaatgaagaagcagaggtacagactccacagccaccacccagagtcagggaaggtgtagaagccagacctccaaatacccaccctgccctccatcactcaacccaagccttaggtgttgagggaacaaacctcaccgagatctcaggtgggccaagcataaggctgctctcaggctaattaacgatgcccttcttttataggaaaaattgctggaagttgtaggagagcaaatatttaccttctccaccaaccaaagagtcagcttaagtaaaatgcgaacatctgtctcttgtgtaaaaaaagacctgtgcaggtgtagcatcagaggaaggtggctctgcaagacctgtctccttctctgccaggtctttcggccctgctctctgtctctgtctgtcttgggtctgtctccggcagtttctctgcctcgtgctctctgtgtctctgtttctgccagtcagctgcctctgtctcagtctctctctgtctcacctctctccccatctctttccccagcctcccgttctgtgtcccagccaggatcaattctttgaagtgtccctgggatgccaccttcttccaccctcccagccattgcaggtgttcttccactttctgggagtggttgtgtctgtgcccccttcccaaatttctgcctatgttattcatcctttaggtctgagtttaaatgtcaccttatattttgagaatcctaaactccacaagagcaaggatttttgtcttgtttccactgcttgctatggtctgcaggtttgtgtcctctccttcctcccacctaccataccactccccaccccaaattcctatgttgaaattctaaccttcaaggttatggtgttagggtagtgggacttttgggaggtggttaggtcatggactggagccctcatgagtgggattagtgctcttatgaaagaggcccaagagagaccccttgcccttccaccatgtgaggacacagtgaaaagacggccatttatgaaccaggaagtgggtcctcatcagacatcaaatctgctggtgctttgatcttggactttccagcctccagaactataagaaataaatttctgttatttttaaagctcttatggcatcctaaacagactaagacagtgctgtatctctagtgccttttaatgacatttctatgactataacttatttgctgattgaattaattgcatctagaacagtgcctggcacatagcaagtgctcggtcaatatttgttgaatgaatgagtaaatgaatcaatagtaggtctgttctgatctccctcgatctgggtctgtgcccccatagcaccctgccctaccactgtcatagttcttatctctattgtaatctcttagttgtggcttaggctgctgtaacaagacctcaacaatgatccgaaggcatcaggaatatagaagtttatttcttttatgtgaaacagtccagggtgactgctccaagtgaacaagtggtccttacagttattcatggacccattagcgtggactgacagcagctcttccatcctcaacgcctggcagccaggagccccttcttgcagcagaggttaaagagcatagagaagcagctggatttcgggggccaacctggaagagacacacatgccttcaactcacattctgatggagacaggtggctccatctaactgcaaggaaggctgggaaatgcagtccagcgtgtgccctggaagatggggagaaaagacttgcggggcagctggcagcctctgccacatctgggtgcctgcatgaattgctcactgggctgtaagtcctatgagggcagagaacatgtctgtgcagtcatccttgtgtctctagtgcctgatgcacagcctgactcattatagatccgtagttcccagacgtgtatggctatacattggaatcatgcggaatgtttaaaacatcctaatgtttggcttccaccaccaccccactcccccactgtttttttttgagacagcaccttactctcttgcccaggtggaagtgcaatgttgcaatcatagctcacagcagccttaaactcatggactcaagggatcctcctgcttcagcctcctgagtagctaggactactggcacatgccaccatgcttagctaatttttaaattttttgtagagatgggggccttactatattgctcgggctggtcttgaactcctggcctcaagtgatcctcccaccttggcatctcaaagtgttgggatgacaggtatgagccaccatgcctggcctgctcccactcttgaacattcttatataattgctatggtgtgggactttggcattgggatttttaagcttcctagatggtcctaatgtgtagaaagatttagggaccactgccattgaccctgaataaatgaatacatgcatgcctgaatgaccagatgtgccaccagatgttgacacactgtgccagaggctacgaactgatattttgggagatgacatgttttgtttgccttgtatggggcttaattttttttttttaattatgccaattcccaagatttaaaagctggaacatgccatatcatactttggacttttggtctctcttgaaaaatcagatgatctggcaacactgggatccttgaggatgctctcatgttcttctttatgttcactctccatcccttcacccatttgttgcctacctggaagctgaaaggcatttgcatatgattctctcatctgagtaaccttctgtgcattatctcaataatttcagctttttctagagtcaggagagagagagtgatgtgttgtcaaggccattctaggctgggcacttttcctgcctctgccttcaatccatttgatccaacagcccccagcccagcccactggaaacagaaatagattttgttgatttcgtcagtgttctgggatgtgggcagacaatgtagtgggatgagctctgaaccaggagtcagggtgtggggtgcttccctgggcttgcattaactgagtaatcttagagacaggacatttttccttcccagctctcatctgtaaaaggaggcaattgaactcaatcatctttcagttccctttctactctccgactctcagaattacatcccattttaaagattcagcgttttctcctttgagaagggtcatttctgaggtagaaatctgcctggtttatgactcgtccctgaaataaagatactgacacatcttttcctgatagaaatcagccatttgccagtgctgtatccaaccatgcaaagctatatggcaattaattaaatcagtaaataaattattgtcatacaaatcccattaacaggtgagaaaggagagattacatcttttagaagagagcttaaacattaatgtctgccttctttaaagaagagcttattttttatctctcaaccagactaatagtttgtttatagcaaatgctcccagaaagagatatattaaaaaccctgattcaccatgggctgaattagagttctctctttttgtttttgttttttttgtttttgaaggaacctcaccaaggagtccagatgtctgtatctgcaggaaagcatctctatgggatgcttaataatgcattcctgtctggtcactgttgaggtagttgtgcatgcaaagtggtttccaaacgaagggggcctcctttctccttcacactgaaggtgaaggagatagcttggaggtagatatggttctctcatcagcagggagagccactgcatgaacatctattataagccttacagcactgcaattttatctttgtagaatgtgcctaaactagacaaaggccacgagtaataatgcagtggactttgtagttgtctcactgtcttagtttgggttcctacgaaatagacccccaagtcagagatccaagtgtaagtggtttattgggaatgtggtcccaggaaacactaggaggggagtggggacatgagaaagtaagagaagggagacaaatagggtgagtcaccaacccagttactactgaggacaactggagcttaatcccactgggcaaacctgagagccactgtagaacatgcacctcagttgttccatctaaggagtgagggagctggggtatttatgcacctactctatcatcattggttgaaggttgctccttaggtatattaattccctgatacttctccttgacatgagtgagagtagagaggccaatagggtgcactgcaatggtaaggcccaagagatgggtggtatgtaagagaggatgctgctatgtccaatatccaactcccctcttgaaacatgccttaactttcgttccatgtctttcctatttagcttttggaggatgctgaatctactttcactccaggatctaggtctaaactaattgttataattctacccctggccacagttatgggttcagggggagcacatggacaagttaggccaatgaggagctaggggttctgagaaaactttctcattcttctgagagggcatctaaagtcagccttctctccccttgtatggacctggggaattaaagcacatagccttgggagttgtcggggaccatcttgaaaccatggagagacagatggaagaggaagccagcaccacagaagccagggaaaaggaaaaaaacctgaacgttggtctcaccagtgagctgctgaatcaagtcatccttgacacttggccttccttaggacttttggttatttgagccaatgaatcactttattatttaacctcattgttgagttttctgttccttgtaactgcatactcactacatgattcacacacacatgctcagcttgggcgagggaggtgaagtgaggatgtgggcttcatcatgcgatgttggtgggataatgaaatgatggaactatcctggaagtcatatgcatagcaggcagtacagtgctatgattgtgagtttgccctttggaagcagacagatccgtcttttgttcttggttctgctggtttgtagttgtgtgacgttgaaaggttacacacctcttttagcctcagtttacctgtctataaaatgaaggataataaaaataccagccttatagtattgttcagaggtaaaggagtgtgaggcctggcatgaagtccatgctcaacatatgctaatactaattattattccctttatggagagaaaatgtggtcacaaggatcagaagccttaagactgtgcataagagtcagataaatgcctaaaaatatatgtatgaggctgggcatggtagctcatgcctgtaatcccagcactttgggaggctgatgcaggaggattgcttgagcccaggagtttgaaccagcctaggcaacataggaagaccctgttcctattttttagaaaaggtttttaaataaaaatatatgtatgagaattttgtttgtaccactctttaaattggcaaaaaattggaagcagcataaatttttaaccaattatagtatggctatagtttaataacaggggttattaaaatgatgatgtgtatgataatattgtcatgcaaagatgctctttacatattgtaggacaaaatcagtaaatttaaatttaaagcagtaaataaacattagtgctgcttttgtaagatagggtgtgtaccccagtgttaagatttgctctctttggggacaggatgtggtattaggggtaagtttcaagcctttcttttcatgttatttaggtatttaattatacaataagcacatatgacctttgtaatcagaaaatcccaatcttttatattttcaaaacacaaacgaggtccaattctcctgacttgctaaattattaaatgcccctcagttttctaaatgtaagattcgttttcactatttcccacaaatggtatggctcatagaaaggattttttcataacctttgtttgtttctcattactagtaatatgtgtctgtaacaaaaaattcaattatagaaacttattacttagtttctgcatcttccaccctcaccttgttactcactcctaaattcaaaatgtgtgtatttttatcttttcaatgcataaacttatctcctgtgtttattttctatgtatatgctaatacgtatctcttgtatgtcttctgttcaaaaccacaatcattggtaaaccacttctttgacttaacctttcaacaaaacagaaatattacgttatatgagcaggcaagtctttttttttttttttttgagaaggcaagtctcaatttcaaaaaataattttaaaaaatttgcttcttcaaatcaataactagaatgtatacatatatttttctattaacatataattcatataagtaaaaaatacacaggtcaccaagtgcagaatttgatgagttttgataaatatgtatttttaaagaaaatagggccatgctttatagacttccttgcgacttgcttttttcattttgcaatatatcttgaacctctttcctcatctctcccattctcttaatagctgtacaggttcccatcattgagactgtatgatcatttatttccccaaccccttctagatgtacatttgggtggtgtccagttttcttttttttttttttttttttgctgttgtaaacagtgcagtgaatatccttgtacatctatctttgtgcccttgtgggataatttttcataggtggattgttattgatgtctaagcacgatcgattcagactgtttctcgtggaatgttcaagagatgtaatctctgtcctcagaaaggccccagctagacaaacaaacacgattccactcctgcttttccattatggccctgacctcagctttcatgtcaacccctcccaaaggtgagggattctgggcagagcccacttcattaatccccaagtttcaaattttgtacccacgtcaaatcctatccattcaatcagggcaattttggagtttgcattcatcaaaggaatgccagttctgtgctgggctcttctgggctatgagatactgtggtacacacaggggaggcaacaaataaggaaacaagtaatgcagaaaactcaggtgagccacttcctgaagccccacctggttaactgcagagggtgatgggtgctgatcctcagatgccctactttgcagttagccctaccagctctaactggaaatggggaaaatttctctctggtgaaaaataaagtattattcctgtttcttgcctgatctgcagagaagtatgctcctttctcttgttagacccaggaaggccctaagattgacgatttcacagaaataagtcccagatttttcagaggcaacaaagaatagtgaaaagagcaaggtctgggggttagaaagatgtaagtttgaatcctagttatgattggctgaacaatggtcctccaaagatgtctatgccctaatttctggaacctgtgaatatattatcttatgtggcagaagggactttgaagatgcgataaagttaaaggttttgaggtgggaagattatcatggattacaatgatctttatacaggagaggcaggagggtcagagttcatagcaggagaagtgacaatggcaagagaggccagagttatgtgccaccatgagtcaaggtgtgtaggtgtcctctagaagctggaaaagacgtggcaatgattctcccctagagcccacagaaggagtgcagcgctgacaatccatttggcttctgactgtcagaactgtaagataatacatctgtgttgtcttaagtcaccaagtttgtggtaatttgttatagcagaagtaggaaattaattcagcagcctgtccacttactgctgtgtgattctagacacactcttaaactctttgagcctcagtttatcatctgtaaaatgaacaccctcttctgtgtgtgtgtgtttttaaacaactggaaataaaacatctaaagcatctgccttagtgcctgtagtataataggtgccaagcaaataaacagaaggcattcttattatgtattattgataatttaattcctctacaccataaaagattgaagacataagaacacaaaccatgaaccatgaaccaatgacaaaatagaactggagatttatattcaatgaaaaaaataagtaagggtagaaattcggttcaaggaaaagaccacatgtgtaggcaatatggattttaggaattgttccacgtgagcttcaaatttggcactgagtttcctggctgccaaagtgaaaagggagatatgtcaagttttatacttttcaataacaaagagagggaagaatctaattacccaaggaaagcaaaacttttcttagtaccataagaaatatctccctatatttttcctttggcttgcttagtacaagtacagtcagctagttgtgtgattatctatttaaatctgtctcctcttactaaactaattattctcaaccttggcttcacactaaaaccacccaggaccttttaaaaataacaatgcccggttctgcttcaaactaattacatctgaatctctgggagtggagctgacatcagtattttttaaaagcttcccaggtggttctggtggcagccagggttgaaaaagcactttgctttattgttttctccctcaaggtagtaactggatctgcttattgacaactttatccccaacacctagcctagtgcctggcacttagtaggtcctcagtgggtctttttaattaattcttttggcacaggtagactattcacctgatttttaaaatatcaaaaggtatacagtggaatgtcttcctccttaccttttattcatctagttctcacttctccccagtcacctagtccagggggtcattgttatagtttattccaggataactttatgcaaagataagtaaaattgaatatatatatgtatatacacacacacacacacacacacacacacacacacacacacatacatatgcataccttgttaaatacacacatatgtgtccgtttaagtactgttgagttattggccctaatcctttactctctgatggtgttatacaggcacacccttaacagagctcatgctaggtagagtgttctttgcaccttgactttgggcttggtcatgtgacttgctttggccaattggatgttagctgataacgttgagagtcttgaaatgtttttgtgtgattgatcttgccctcttgagctccatgatccctcgtgagaagagcatgccctggttaactattatcccttcagcctggcccttgaatgaaaagggaggaacagactaaacagcacctgtagcttgcagctgagagaagagccgccctgctgagccctgccttttcatgagctcttatgaaaaattcctatctagttgctatcagcagagccccaactagctctcagatctatgagcatgagaataaacaattactttttaaaaaacttttgcagtgatttattaggcagcattactgggggaatgccatatcctttatgccttgttatttgctaatatgtcatgtaaatctttctaaatcagtaaatctcatcctatcttttaaaaaagtggtacatggggtagagagtcaaaggctggttaactgacacaaaagtactgccagataggagaaataagtgcgaagaaatatggggtgactataattaataacaatttattgtatagtctcaaataactaaaagagaggattttgaatgttcccaacacaaagaaatgataaatgtttgaggtgaggaatatgctgattacccctatttggtcattacacattgtatacatgtgtaatgtattattgacatcacacatcacgctttttttttttgagatggagtttcactcttgttgcccaggctggagtacaatggtgtaatctcactcaccacaacctccgcctccctggttcaaacaattctcctgcctcagcctccaaagtagctgggattacaggtatgcaccaccacgcccagctaattttgtatttttggtagagacagggtttcactttgttggtcaggctggtctcaaactcctgacctgaggtgatccacctgccttggcctcccaaagtgctgggattacaggcatgagcccacactttttaaaattaaaatttttttaccctacttgcaagctaaaatatcacactctacaccataaatatgtacaattatgatatctaaattaaacataataaaagcaaaaaactctatagaatactattgtttggatacactaatcacctattcaaagacatctaggttgttcccagtatctagctcttacacttcttcagtgaataaccctgcatctacatcattttgtgcaagtccaaacatttctttaggataaattcccagaagaggaattgctgtgtcaaaaaatatatgcattcataattttgatagatattgtcaaattacactgcataggaacactcctaccagtaatgtctgagaatacacagttccccacagccttgccagcaaaaagtattattaacctttccaatttttgcccacctgatggggaaaatactatttcagtgtagttttactttgcatttctcttatttgagtgagactgagcatcttttcaaatgcgtacgagccatgtgtgttttcttttctatgaactctctattcattacccttcagccatctttctcttagattgtctttttcttattgattccctcaatacatatttgctgaatagacaaatgaatgaaataaaatgaatttaaatagaggacactgaatactatggttcaacgtcccaaataaaactggaaagatgcaagaacagatttgacatggctgtggcttttcatcgcgttctttgataaaaagccaaagatctcacatttaaatgcctttcctgatggacagctctgcaagaggctgaggtaacaaggtccaagttagtagccttctgcggcaaagagctgagaatttccaggggctgtcatagacctcagtaggacattcaatgggagtggaggactactataattaacaatttattatatattctcaaataactaaaagagagaatcttgaatgttgcccaacacaaagaaatgataaaagtttgaggtgatgaatatgctgattaccccgatttggtcattacacgttgtatacatgtattgagatatcacacttttcaaaattaaaaaaaattttactcaacttgcaagctaaaatatcacactgtaccccataaatatgtgcaattatgatatatcaattaaacataataaaggcataaaactgtacagaactgatacagagccctctcccagggctaagaagacctcctttgttctctgagatgggtggtagagagtgggtctataggctttaggtaccagatgagcaggtggcaggttaacatcctactgggaacattaagaggtgaatctgggctctcacctggatggaaggtgtcacactcagcttgtgtacttttcagaagccaggcacgtgcctcactttctggccagagtgagctagtaacagcttgtgttctcattgtcttaaagacaatgttgccaccatcctgctgtggcagctgctctagtcccttgtatcactcatagaaatggcccagaattacccaccctcatgctggtgctgtatacctctcccctctgccctggagttttcctgttccaccaaggcatgaagtactgtagaatccagttgctccccactcatatgaaatccagaagtgtaggggagctggaggagagctcaatggaagatgagagctcgtggatattcctgcctctaaatgggtggttcaaagatgcagcttctctgaagacatctgcaataccaggcaactgaccagctccatcatccacttccttttgtctctttttttcctcactcttacttccctgggattgcattccccaatacagtgtcagtccagaatgcttttgcctgggctctattttctagagaacctctgttaagacagaaagtaaactcattttcctccagaggtgggggtttctaaacattccatatgtgacatccaggtcctaaaagcaaaatggcttgtgggatgaccgtgaggaaggtttaaaagaaaagcccactatttattgagcacctactatgtgagaactttatgctaaatgttccaattgctatttcatttaattctcacaatatccctatggatttttactaccataattttaccaataaatgagagtttggattttaagtcacttattcaagctagtcagtgattgagctgggctttcaacctagttctgctgagctccaaaccagtactcatgtgattcaaaagtcacacaaaatgctataatgcacttgaaaaaatgccttaacagaggaagtcacctaagtgtatctagttgtaggctctctcttctgttttataggtgtaacacagtattaatatgtgccttacagatgggtgtcccattgtgctttccaagttttccaagttttctaccaacccaggaggacagaaatatggcgcttcctggtcatgaataaatcctcttaataaaaagcagaaactaaagctcagagatcctagagggttttccaaaacccacacaacttgtggtcactggaaatagacctggactttttgtgccccagtttagtgatgtttctatagccccatcctgttttcaattgaacacatgtgtgattgcggtcactgccttagaaattgttttgaaagcatgcaacagtgagaattcaaacaaaacaaaacaccatagtgtaaaaaataagtcttgaatcctccattcgtgtgtgtttgtgtgtgtttgtgtgtgtgtgtgtatccttttggagttattctatgaacatactggcatatatgttaaataggacaccactgaaaacacacagaaggcaggtcattgtcccacaccttgcttggagatggttctatttcattgcatgacaattgcctctctggtctgaggagccttcgtttcctggtttggatgaaccataagtcattggactgatccgccactcagaacaatcaggttgtcttctgcctcctgttgtgcatttgtaattagagagtgctgcttgatgaatgagaggacaggagagtgaaggacttgcccaaggttgcacagcttaaggtggtaaagctgggatttgaacacagatctcctgaccctggtccaccttgttttctgctcacttcacaaaactgcaggagtatggtccctaactccaaaaggtgagattaaaggataggtgtggacaaatgaggaaccttgggccctcagtatcaggggctatgaaggggttgtctagcccctgcttctggtgtcttcctcagccattctaactctggcagggtcacagccaccactacatctcttctggtgcgtatgtccttctgctctgctccagcacagcagctcagcacaccccaggacacccctctagattccttccaatgacaggtaagtcattgatcagccctgagaaccagctgagagcaggatctatttaaagcagcatatgtttccaggtgctgagtcacgtcggctggaccagccggcccgaccagccggcctgtctgggcagtgcggatattcacggtacagcagccactgcagcctggcttagactttgacaaacctgaggaagctctgagctgaaacaccacatttaataagataaaacacacattgagccccacatcagtttctagattttaagcgtgggtattctcattacctccccactgaccaccattttttgttgtaatgatgatcaattagccaaaattgcgttcatggagacccagatttaaatcctagctctgctgcttactagctgtgtgaccttgggcaagtcagataacctccctgggcctcattgtcttcttttgtacaaccttgtagggcatagggagggacgaatatagtgatatataggaagtccatgtcatagcctgtagtatgtagtaaacatttagcaactgatagcaaattaaattaagtatgtgttcagcactatgctaggcatggtaggagaatatcaaatacagtgcagcatgatgctggctctcatgaaaagttgcaatctagttgttaaagaagatatacacttgtgaagttataatgaacatatatgaacagtgcaacattcagatagtctttgaggacctgctttggttcaggcaaggcactgactgaggctctgggcaagtataaatggctcctgagaggacatgtttactcagtggcatgggaatccaggtcaatgagcagctaattctgccagggacatttgggagaaacttctgaaaggaagaaaagatggcaaatccatggcatgggggacatcagtctccattctctgcgcatggcagccatcgataatcagtcacggctctctgcatccttctcaacacagtgatgaccctctgcatccttctcaacacaatgatgacccccgcccccaacccactgcattcctttcaacacaatgttccagacagccacaaccaatcaatcaacactgatatgatgaacactgtttgccatccttgaggttaaagttatttcaaggtgttgaaaggtgtccactgggtcatacaaataattagagctatgggtctcatggaagacaaatagtctggaggaaggtatgaggaaccttggaatctagttgcagcattgacacttatatgccctgtgaactcaggtcatgtaatctcttttatcctgctttctctaagtgattctgattcacagagttctaagacaaagggattccagtttgggtgctcaagaaggcttatcacaagaggtaagatttcaggaggctttgaagtatgggcataatttacatcaacagagagcaatgtgtgcatgcgtctgtgtgtgtattcacatgcacgtgcattctaagagtatgagggaatgtagtgggtaggcaatggataggtttcagaatctactctcctctaccatctccaaaaatgtaaagcaatccccctctttctgccagcaggcaacactatggtgtgagccctgttcattgggaactggagtgggctgtcaagatcacagtaccagtcaggagacagaatcatggaaaaagtgatgccgtccaggaaagactgggagtggggagaagtgttgcaagaggcggggctcctggcagctgcctgcttctccttcctcttgcattcaatttcccattcccctggacaggcagcccatttgtctgacttctcagcagggtcaggtcacccctgagcccacaaggacacccgctgatggacaaaagtgctgtttgccatgtagacctgtgacccacagctgtgcctctgaggggctgtcttgcatgatgaaaccaggggcaaaaccacagacagtctggctatagagtaaatgcttgacatttggactcccttttctgtttacttttctcattccacctataagtcaacggaccacttggcagaatggtttggactccacaaactgcttgggttcaaattctggctctggcatttccaaaatgcaatcataggcaagtaatgcaaactctctgagccatagtttcctcatcaataaaataggggcgatgataatagcacttacttcatagagagatgtgtggaatcagtggaaagtatctatgcaaacacaatgcagcgtctgtcataaatgttcaataagtattcactatattacattatctgttatagttttcccacttttaccttgtatttccccaactagattataagctacctgagggatggaaccatctcttttgtactccccaaagtctgggcacaatactgagtgtggaggtacccagaacttttgccaatcatttaatgtaaaaatagtaagttgtagaactttctattgcttggaggaagtttagcctcctccatttaaggctcagggatctttaggttcacattgaccttcccagactaatttcctatttctttttacagaaacctacccttcaggcacatcaaactatttgtggttccctgaatacaccaccctctttcctgcttctccttgcaaaccccattttctctgccttcccccaatcttatcattcaagtctttttaaaattagaaatgacataaatcaaacataaagtggctgaagcagaaaaaaatgtctatttgttcaaataactgaagaatctagtgttactggcctcagatatggctggatccagggactcatattataccatcaggactttttgtttttgttagatcaatttccctttgtgttggcttcattcttaagtatagtcattcttgctaggggcaaggtgatcaactgttctgatatacctccatccattgtagcaacaccaggagaaagagaactcctttttatttaaggttccagagagagtctgagatgtcctctcactggaccagttttagtcatgtgctcatcctccatccaatcactgtggccaggaagaaggaatatgctgatcggacagatttgggtcatgtgaccatcctctaggcaatcagagggactgagagtgggtcaaaggtcattccccaaggaatgttgggtactgagcagataaaaacaacaggtgctccacacagatggcaaacgcttttcatcctctaagatgaaactctgatgtcatctcagtgaggactgtaaaccatatactgtcgtgctattagcccacaattcatagaattttaagtaactctccctctaggaaggagctgtgtattattagtgttgggctctgggcatctagcacagtgcctaggacatggtgtgcattcaataaatgctcaccgaatgaatgtgtccatgacaagagtcaaactctgtaaaatacttgaagagatttattctgagccaaatatgagtgaccaatgtcccatgacacagccctcaggagatcctgagaacatgtgcccaaggtgtttgggctacaacttggctttatacattttagggagacataagatatcaatcgatacatgtgagatgtacattggttaggtcaagaaaggtgggacaatttgaagtgagggcttccaggtcataggtggattcaaagattttccaacaattggttgagaaagttattatctaaagacctggaatcaatagaaagaaatgtctgggttaagatataggattgtggagacccaagttttattatgcagatgaagcttccaggtagtaggcttcagagagaatagattgtaaatgtttcttatcagcttttctgttagtcttaatgtctgtgttggtcagctgtgcctgaatttcaagagggaggagggtataatgaagcatgtcaaacctgcccttcccaccatggcctgaactagtttttcaggttaactttggaatgcccttagctgcgagaagggttcactcaggtggttgaggggcttcggattttatttttggtttatgaatgaatgaagcaagtgtgtggtggtctggggctgtgttccctcaggtccactgctgtccgtcccctgtcctgttatcatgggggaggacaaccctttaggcagcatttccaggctctccatcttctgcctaagggcagccagtagaagaccttggcaggatatttgagggcaaaaggaagagagaacctgggacatttccaggttccttacctctcactactttccccatgtagaacctggaaggtttgctaaaaatcactggcatgaggcagattaacaggagaaaaggcatacaaatttatttaattcaggagccttcagaatgaagacccagcccctcaatgaggtacaggagcttatgtaccaacttgagattaagaaagaatgcaggctcagagaatggccaaaaacgagttaaggtagtaagtcaggttttagtggaaagacaggttataggagtgagagaagaggaggcttgactagcaaaggtggtcttgttatgtagctaaaacctcacaggtgtcaaacctcagagggaataggtggtaaatgtttctttcagacctttgaaggtataagactcagttaatctttcctagatcctgactagggaagatctggattaatgtagattctttacagatttccccaacaaaagacagctttgcaggtcctttctagtctgctggccctgtggcagccatttcaaaatatgtcaaagcaatatattttagggtaaaatatttttatttatttcatctacccctctccaccttccctgcctctctctacctgaggtattattattattattattatttttttgcaatggctatatctcgacagtttcagcttttaccttatggctctggcccctgggctctggcattacctccttctccctctgtctacccagacaattatggcctcttgctgtagctaatctctgggtgacctcaccatcccctcttagcttctgagctttttcatccccccataaccaatttcctgcattaaatttcatctgtttgaaatacttaacgtgatgtctattttcctggttggtgtctgactgatattaacttgttcctcaaactattaggagcaagctgcttctgtataattgtctgagccataaagggactttgttttgcttgtaaagaaatttttcagctgctggtgtgagagaggaatgccacctcttcctgaagactctgtattcactaaaagttctccattcatcaaacactcctgctgcgtgtctgcatggtcccagctggtcgtggggagcatatatgtggggagtcaagagatattgatcatgggagtggtggggaggaaggtgcaatgtttcagtcatggtgattgtgtgtgtgtgtgtgtgtgtgtgtgtgtgtgtgtgtgtaagattgctattttatgcccaaattccagttttccagaagaaaggcaggctgcctaaattttggctctgacaagttacaagagacttgtgagttatttttgcccacaacaagggtagatttggttaagtaaagaccccacagttccccactatacctcacagaacacagcatgaacaagcaatgaaggaaagcccaaactgtggtccttagtgcctatcagacctgagctgaagtcctggatttgttccatattacattgtggtcttgcataagggccttagcatttctgagccttgatttccttatctgtaaaatggagtgaattatagcatccactccatggaatgaaatgactcaatgcatgtaaaatgttcaatgtactgcttcatgcaattttccatataaaccttccataaatactggcttaaaaataactgaaatcttcacactgaggctggaccataggcctttgcaggactggaaccacacctcgctcatcttagtacccattgattgggcaattatggaaattgatttagctccaaggagcagcggcccattcatattagctgagataaaaatagaggttgttgcaggaaaccaggaaaaccttttagaactcaatggcaggaactatggctgggcttcattgcaactcagaagtcatactgtcaccatggacccttccccatacacatgctctcagtgcttctctgcttcattttattctctttagatagatgccatctctccatgaatctgcttgtatttgatccttcatggcacccccaaatgccagctcttgctccccaagcctacacaagaggcagatcatctagaagatgagagcccaaagttggactcagattgcctgggttcacatttcggcactgccacttcctagctgtgtgaagttgaactcgttccatactcatgttgtatggatggcaacaccaaatacctcattttccttatctgtgaacttagaacagtaatagcacctgcctcatagggatattgtgagataaatgagtaaatatgtgtgaagtgcttataactgcctggtacataggaagtactcaagaaaggctagtgattattacatgactctccagctcacctcaacccctggtcttaggctggttcccaggtgtagaccctgaaacgtgaaaattattgattaaggagtgttcccatgggagactggcagggggaatagagaaaagggatcacaagggaaggaaaggaggccaagcaggaggtgttaccaagccatcctaaggaaggcaagcttggcttaaacctgcagaagccactctagatactacagtcatgcctgggtgttgtcctcattaggaggtgagggagctggagtatttattcctacgcctgtcagtcatggtttaagggaactcccagacatgttaggctctctgtgtcatcctgagaggcagccagtgtcacaacgatgataaagggatccaaggggatgagtctgcatggagctctgagagcatttgttgctcctccctatggagcagcatagctcagtctttatatccaaaattcaaacccccagcagcagaaatatgactggacccaggtgagtggggtgaccacctctttcccaaacatgtgtggctggggccccagagcacacacaaaggcgcgtttcaaggagggctataggtgaaacagggttaatgagaaattgctgaggaggatggttgacgtcccaaggatgtagatgctccacagaaatgtctgttggcagaatgctgtgtacccagtgccgtgccaggctcctcactcatgcaaagatggcaaagacaggggccccacagcttcctctttgatataatatcaagatagtggttttcccagtggcccagagaactttttaagggcagggaccatgtcttattgaccaccatatctagtccacagtagaggcataatatttgttgagctgagctgatgtttttgaggtcagctgtggggagggcaatgctattggcatcctctcctaccccttattgtcctcctcctcaatctcaccctctggcagatccactctcacccgtcttatctggcatcacccaggatgagaagggcccgccagggaagcaagtggatgctggcgtggaacctacactgaactgcatggcgtggcattcgggtctcagacacagctctgcctgactctgtatgaaatcagggcctccgtttccccagtccagtgagggtctggctaggagctttagtgatgccactattcaataaggcagttaacaaaacagtccagtgggctagcactgctgtcagacttctacattcaaatcccagcccttcccctctctggtttgtccttgggcaagtgacttgacctctctgtgtgacagttcccttatatgaaaactgggtatgacaataatagtatcatcctcacaggactttggtgggaatttaagaagatggggcatattattcagccatcaaaagaactgaagcacgaatatgtgctacatcacgatgaaccttaaaaaaaatcatgctaagtgaaagaaacctgctgcaaaaggccacatgttacatgattttatttgtataaaatttccagaagaggcaaatccatagagacagaaagtagattagtggttgccaggggctgtgaggagaatggggagtcactgctaatggatatggggtctcttttggggatgatacaatgctctggaattagacagtggtaacggttgtacaatcttgtaaatatactgaaaacaattgaattgtacactctaaaatgatgaatgttatggtttgtgaattatgtgtcaatttaaaaaatagaaataaaagatatggtatgcaaagcccctgactcacggtaaccgcatgataaaccatctttcccttggattattgcagtgacctcaatggttccccctcctctccccttgctccccatcagaacattcagtggtgtgtgagttcatgtcactcctgctctctaaactcttccatggcttccatcttggagtaaaagcccaagtcattacagtggcctattgcactctacaccacctggctcttggcttcctctctcatcttctgggattctccccttgtcctctctgctccagccatgttggcctcttgctgctcctcacacctatgccaggcacgtctctgcctcagggcctttgcacttgcattccctccaccttaaacacacttcccttagagctatgctggccttgttcttttgcctccttcaggtgtttgctcaaacatcatctcattgagactttccctgaccactcactatatttaaaatagagggctggatacagtggctaatgcctataatctcagccatctgggaggctgaagtgggaggactgcttgaagccaggagttggagtccagcctgggaaacttagcaaggccccatctctacaaaaatacaaaagttagctgggcatggtgacacacttctgtaattctagctactcaagaggctaaggagggaaggtcatttgagcccagggatttgcggctgcagtgagccatgattgctccactgcactccagcctgggtaacaaagcaagaccccgtctcaaaaaaatgaaatagcatatatgaaaaacaaaaaaaccttcctactctagtacaccctattcaccttcccagattattgtttcctgttattcttatgtttaatgccagcttcgtgttcgtgttagccccatgaccacaggatttctgtatcttgttcatgactgtattcctagtacctagcacagtgcctggcacagtcagtattcaatattttttgactgaataaataaatgttagctgttatgataacctataataaactttctgagactttcaatcttttcatttccctctcatgggtttctcttgcagattttaacttgacgcctctttgaggcttctttcttccttccagtttatctccattgggtgctggttttagaggcaaacgtttttcttgtggtgtaattatgaagttgctctagaaaatagtttcatctcacgttgaagtaaactctcttttttaaaataacaagaccagaacccgctactgaattcttcactgttatgaaattagttttctaaagctgacgtggaagttaatttgtgtattgctgtcagttggaaggctttgaagttaattgtcttagctaaccttgtagagatctaaccatgttacgtttagcgcataaaaacatttatctcctcattggtgtctggtgggactgaaagtcccgccttattctctcttgagtaggagaatataatttttgttgatttcaaaattaagatgaggaactaattggtagtggaaagaactcttagattgggaggcagattctagactttagattctaaaaatagctgttaagttcactgaccatatggactggggtcaggctattctttctgaaccctttaatgaagggtacattctgatataatttgtgatcacacaagtaatacagaaatacattcttataaaaaatgagatttacaaataaggctaacatcatctttgaccacaactccctggtgtccctgaagtatcctgtcatatgatagatttatatatttccagatgatttgtatgcatttgtatattaacttacagtattgttttgtgaatgcatttcttcaaagactgtacagatactatcagattgtatcacaacttgccttcttcacccaacattgtgtcttggagttctttccacattaatacatatgtatttctgatattgttaaatagcttcatggcatcccataatacagatgtatcatgacttatttagtcattttgttgttattgaatgtttaggctattttcagtttttccctattacagaccaggttgtaatgaacatctttgttccagcctcccctcaggcagacactgagaaatggagtggctgtctcagaattctgtcattcttttatttatttatttatttattttagaatttctttttgtttctttctttcttttttgtttgttttgttttgttttttgagacaggttttggctctgtcactcatgctggagtgcagtggcgagatcttggctcactacaacttctgcctccctggctcaagtgatcttcccatctcagcctcctgagtagctgggactacaggcgtgcaccaccatgcctggctaatttttgtttttggtagaaatgaggttttgccttgttgcccaggttagactcgaactcccgagctcatgtgatccacctgccttggcctcctaaagtgttgcagttgctaggctcatgcctggcaattctgtcattcttaaagtagaggacttaaacaagttaaactttaaatcatttccagtaattaccctgctataactggggtcccatgtggcccagtctttgttccatcttcattcaaagaaacaacagtttggcagaaaatataattgaacacaattgcatgtttcacttgaatgcttgggatacccccaacggtagtgtggtggtatggcttggggcaggggtcagagttagaagtacattattttcagtgaatgtgtttgtttgttgctttcaggtattattttgattattttgatttcaaataaaattgtgtttctccttgttgagattggcaggccagttttgtgtctatgttattttaaattatgcatatacacacagacaggaaaggtacaagtggttgcaaattaaaggagtagaaagaatacaaggttaaacccttcccccacatctgttccctaattttcttgctagagacactgtctacttccagtctcgtatgtgtcctgttgcctatttaagtgaatctgcttaaatacaaatggtagcatactgaacatatattttggacacttgtcttttaaattttttaattatggaaaaattcaaacatgcacaggagtagagaggatagtatgataaatccctctgtacttcccatttggtctcaagaattatcagtatatggcttttgctttttcaactatatgaaacactttggatcttgttccaattcagttcatttaaacttgcctcatttattttcacagttgcttagtattctataataaagatgttccataattcatttacccagtcccctttagatggacatttatattgcttcccttcttatgtcactacaaacaatgctgcaataaatatacttttatatccatctttgggcatatgtttgaataaatctgtgagaaattcctggaaatagaattgctgagtcaaagagatgtgtatttaaaatattgatataagtactgccaaatagcctattgatggaattttattaattttcactctcactaagagtatccaagatggctcacttcttcatatgcttaccaacacaatgtgttatcgcatttctaatctttaaaatacactctcctagttttgtttctaaatagacatgaaatctatttagtaagttgtaaaatcctacctatctaggggatagaagtcagcatagaatagaaaatatcaaagaacatcactttataagaaaatacaaagaacatgacttacttgagggcaagtgtagttttgtgaaactttggcttcagtcatacatttgtttaagtgtatgtataaactggattattacatagaaataaatttttactgtgagtcttggtctaaagagtttgaaaacattgccctacaatgatgacagctactttctagaatattcttctctcattttcacttctcattctaaaataaaaaagaaaattccttaagccctctcttacttgcccttccctctttcccttatgccccgggttttatcctgtgagaaaaatgttctgatgcaaatccatgtcagtccctcttccggcaagtcacccaattcctcctcacttcctgctggaatcagagctggcacagagggcctcagggatgagttgctgatgacattattttacaaagggggcactatttacatttagggcagcactggtctccaaggcgaggggttgtcctgtacataacagagcatttagaatccttggtcccagacacaaaatgccgggagcaacctctaagtcgctgcaataatggaaatgcccactccttacctttctaagtgcccccaagggggctgtatcatccccagtagaaagcctggctgctggtgcctgggggtggtagaaacaatagctaaggttgtactctaaatgacttttgtaccaatcacctttctttaagtcttatatcacatgtcaagtacttagagaagtggttggtgcgtggtaagcgctcaataattattagtgattattatttattagtagtagtattgtcatttggggcatcattctcttaggcttgcacagaaattaattaattaattatttaatttatatatatattttccataagttattggggtacaggtggtatttgattacataagtacgttctttagtggtgatttgtgagattttggttcactcatctcccgagcagtatacactgcaccatatttgtagtcttttatccctcaccccctcccactcttcccctcaagtatccaaagtccattgtatcattcttatgcctttgtgtcctcagagcttagctcccacatatcagtgagaacatatgatgtttggttttccattgctgagttccttcactgagaataatagtctccaatctcatccaggtcactgcaaatgctgttaattcattcctttttatggctgcatagtattccatcatatatatattatatatatatggtctatatatgtagtgtgtgtatataaatatatatataccacagtttctttagccacttgttgattgatgggcatttgggttggttccatgattttgctattgtgaattgggcttacacagaaatttaaatgggaggagaaaatggataaccccatcccttttgttgaaggatggggttttgccaaagagaaagagaagtaaaacttaatgacagtggatttggttccttggtgcagaaaagatcccccctccttttccattacagggcctgaccccagctttgaaatgtgaagttttgattgctaatacaaattgaatttatttgtttttttttctcactttcagcaatgtcatctttttttaaaaaaataagtataggctgatgaaacatatttaaatagagagattaaattagttttcatttgctactttgaaatgttttaatcccctgaagagaatgattaaagctctttgcagagggtaggggtgtattttttttaagttgatgtttatatgcaacattccatttttgcacttcctggtgttggcggatagaatgatttcattgcctacctcaccaatgggccacaatgagaggtgggggtgggagcaggactgaagctgctgctgggaaggaaaaatcaagtaacaagaatgctttgtaaagaaaggcagtaggggccaggcatggtggctcacacctgtaatcccagcactttgggaggccgaggcaggcggatcacctgagctcaggagttcgagaccagcctggccaacatggtggcacccctgtctctactaaaagtataaaaattaactgggcatagaggctcatgcctgtaatcccagctactacttgggaggctgaggcaggacaatcgcttgagcccgggaggcggaggttgcagtgagccgagatcacgccactgcactccagcctgggcaaaaaaaaaaaaaagaaaaagagaaaggtagaagtaaaggatgccaagaaacaagaagatggacatagcatatcctgacaaaggaacaagccatgctgtgcaataataataaatatacacacacagatatatagagaggtatatctatgtatgtatatgtacagagatagatattttggattaaaattttacaaataaaagcaaagaggttggaacgaatggggaattctctcaggcatcaaagttaagtttccagattgtcactgacacataatgtattatgctgattaaatgtaactaaaatatttatggaaagagaacattaaaccttatccagctgccagtgtcctggatatagatgagagcactagattgagagtctggagaactgggttcacccgctggagcttcctttccctggtttgtgactctctcaagacaccaagtttcttagcctcacatcctcattataataggtccacttcttactttgaaaggtttgggttggtgagaatgaaaatcctttgttggcagccttaaaaaggaacgagatcatgtcctttgcacatggatgaagctggaagccattatcctcagcaaactaatgcaggaacagaaaaccaaacaccacatgttctcacttaacaagtgggagctgaacaacgagaacacatggacacagggaggggaacaacacacactggagcaggtcggggggtgaggtagggggcggagagcagtaggaaaaatagcagtaggaaaaatagtaggaaaaataggaaaaattgcatgctgggcttaatatctaggtgatgggatgatctgtgcagcaaaccagcatggcacatgtttacctatgtaacaaacctgcccagcctacacatgtaccccagaacttaaaataaaaatgaaaaaaagaaaatccttcaaagaatataaaattgtctataagaacatggcatatgggaacaacacacactggggcctgttgaggggtggggttaaggggaggcagagtattaggaaggatggttaatgcatgctgggcttaatacctaggtgatgggttgataggtgcagtaaaccattatggcccatgtttacctatgtaacaaagctgtacatcctgcacatgtaccccagaactaaaaacaaaaacaaaaaatcaaaaaaaagtttggaaaaaaccacaggctattgaataaaacaaatatgaataccaaaaaaagggaacataacatatgtttaagtgtaataataagcaaatgctaaggatccattcatccaccaagaatttgctgtgcatgtaccatgtgccaggcactgtgttaggtcctgggaatccagggatgactactttgagggatatagaaagacagtgctagatgtgtatgtcagtagagagagattagaattcaactactctaagacctttatattgtcttggatgagggtacagaaattgattcattttagattaagtcacataagcatattaaaaatagaaggtaagttctgaaagaataggaaaagaatataacttctaaactagcagtgggagaaatagaagacaggaaaggcaggggagggaaccatggacaaggcagagtaaacagaaaatacaaaatcagatgacagaatgaacttcaaatatagcagtaatcatagatgcaaatggtctaaactcaccagctaaaagataaagataaaaaatggggcagtggtggtagggggaaatccagctatagctaacacataaaatacagagaaaggttgcaaagaaacatggtccttttccaggggtagattataattgtgtcaaacacatcttttatctctacttacatttccccctttctctggggactttatactaaagcagggattatgttaaattgactgagtagaagtcaggggtgagggagaaatgaaaggaaagaggatttattgagtcaggtactgtgctgggtggtttttaaaagggaagaaactggcataggttagaaatgtacattctggtatagcttattggtcaaatgcccagaccgtggtgtcagacagacctggacttggtttccaaatcatttaatcattcatttactcatttaactaatatttattgaatatctactatgagtgaagaagtctgctaagaagtcactttaatttctctatgacttagtttcctcattgtatcagttatctattgctacaatagtgctgtgtaagaaaccactacaaaaaacccccccatagcttataacaataaacacgctcttattgctcactagtctataggttggctgggcagtcatgctgatctgggaggaacttggctatcttgctcagcttgatgataggttggtgagtctctgggaactggctggtctaagatggccctggttaggaagccttggttctatcttatgtggcttctcatcttccagcaggctagcttggatttattgttatggtagaggcagggatgagagagagagagaaagagaaagaaagagaaagtgcaaagccggctgggcacaatggctcacgcctgtaatcccagcactttgggaggctgaggtgggaggatcacaaggttaggaggtcaagaccatcctggctaacatggtgaaaccccgtctctactgaaaatacaaaaaattagctgggcgtggtggtgggcgcctgtagtctcagctactcgggaggctgaggcaggagaatggtgtgaacctgggagatggagcttgcagtgagccgagatcatgccactgtactccagcctgggcgacagagtgagactccatctcaaaaaaaaaaaaaaaaaaaaaaaaaaaaaaaaaaaaaagaaagtgcaaggcctcttaaagtctaggctcatagcactctattggccaaaggaagcacaggtcaaattcagttcaaagggtggagaagttaactccatctcttgatgggcagagctacaaaattacattgcaatgtgaagtcacgttgcaaggggcatgggtacagggaaaggaagaattaaggccatttttgcaaccaatctaccacactcatctatttatgcagagataatattagcacctacttcttagagttattgtgagaattcagttggatcatgcatataaagcagtgatttcgagtcaggtttacaggaggcactcagcaaatattagcccttgctgctgctgctgttgtgatcatcagtgttaatattattattaatttgggtcctcctcatccctgtgcatctgctcaatgcagttcagaggttcaaatcccctagtagcttctgcttctgcatgccttattgtttttcctcttaataaaagagcaagtctgttgatagaaaacttccttgattttgtgaatgcagacgccactgtgtgttagcctcctttggccattagctgtcaaggcagcaaggcagcgatctatttaaagaacacgtaggtgcctctgctttttgccatcaaaactgtgccagagatggagatacctctgaagtaggggctgaagggtcctgacatgagacaggacctctgtttgccatctgcatttactcaagaaagggtagttaattgcctagtgaagttggtttccttatgttaattaatgatgctagcagctgaacatgaataggatattgtttatttttacttccaaaggagagagattgaggcttgagtcagaaatgcagcacaggctgcaattttgctaaattctatagtcttgctcacaataccgcagcaggatggctgcttttttggctgagctaggataaaaggtagtgctgggccttggctttgttggagcttctgtttattgacaaggaaagaatctccaaaatgctttttgtcatgtaggataaacctcaacagtggtgaatgcataggcctgacatcagcttctcttccatatgggaggcaccagcatttacagaaagaattcacatttggggagaagagcgtaacaaatttattgacagaaattcccaccaatcttaatttttttaaaagaagggaaacaccttcttctgagttccatccccaaacacaagaagagccagagatgaaatgtgttagtgattcatcaaaaaacagattttagtttcccttatttttagaagtagctatctaggtattgggttctgtcaaatgagagagagattatatttggaaatcctaattatggagaggctttctttaaaaagcagcctaaagccaaactggctcccactgatgcttctttagttgtttcttttttctctttaatccttctgacaccctgaaagtagttcacacatagaattaaaagaatccattttgcccatcctcgatgtttacttgactttgtagttccagaagccataatctcattctctggccatcactttgaagaataatgtcaggaaatgtatgaatttaattttttttagttggaacacaatttgaataggctaaagcaaagcaaaacaacaacaacaaaaggcaggggaacgttttgttttacattatggaaaagtgtgggggcttcaggcatggctggattcaggtgctcatataatggcgtcaggaatcagtttcttacattgctctctctcttttgcataggcgtcaacttcaggctggaggatacaaagaagcctcttggcagccccaggcttacattgtagcaacttagcaaccctgatgaaaatgatatgcctctttcctaagaatgcctgcaaaagtttcagataggaatctcattggcttgcattgagccacatgcacttctttgcactaatcattgtggccaggggatgagatagatgaattaattaggcatggacatgtgctaactcctggagtatagggaggcatcagctccacccaaacctccacctgaaaggactgactgtggggaagaggtggtttaccagaaggacaatcaggaacagggaatgcatgcttacctggcaaaggtagcagaaagtctttgggagaatgtgctagtctgggtcctccaggaaacagacaccaagacaggaatagatgtgctaggatttgattaggagaaaggctgatgggagaaaatagggaggtggccagagaaggcataaggagccactggacccccaagtgaaggggagagggaaagaaggctgggagcgagtgtcctagactctcatgcagcctaaaggcgcttcagcaaggtgtcgaggagtcctccagccaaagtctctgtcggaggagtcccatgtctcccagggacaggccagttttagtatccctgcagcattccattattggctgggagctgcccatgggaagcatggcctcatttgcactgatggatttgagagtgcagcagctggggccttcagtcaattaagcttcctgtagctgcgggtctgcaaagtactttctcatggccactatataataactcatattcatacagtatcatatagattaaaaagtgtttttgtagctgtcagcttagtttaataatatgatcatcacccccttccattgtacagatggagaaggtgaggtagggctgattatgatttatccaaggcggctttgctagttagtgaagaagtagactcacactctgaccaccatctccatacccatcacacctccactgtatggagggttgaataatgtccccctaaaatccatgtctacccagaacctcagaatgtgaccttatttagaaatagagtccttgcagatataaacactcaggttaaggtgaggtcatcctggattaggatgagccctaaatccaatatgattggtgtcatcatacgaagagagaaatggacacagacataaaagagacagagggaagaaggccatggggtgatggaggcagtgattggagtgaagcagccacaagccaagaaactgcaaggactgtcggccactgccagaagctgggagattggcctggaacagattcgtccccagagtcttcagagcgaacacggccctgctgaggtcttcagtgaaaatggcaaaattttccttcagtatctctttctatattccttgtctgttcttccttttctcccctttatgtaaccagcactctcataatgcctctcttttgggggctcatgttggcctcatctttaaaaaattttattgattgagggggtacatgggcaggtttgttacatggatgtattgcattatggttaggtttgggcttctagtgtagccatcacccaaatagtaaaaactgtaccccatgggtaatttttcaatcctcgcccctcccaccctccctgcttttggaggccccagtgcctgttctttccctctggaggcctcatttttgtgaaaacatctcatgtcccctaggttttctcttcttccttcaaaacttacctgtcctgtatccattctctcaaatctctttcacctgttagggataagccgataaacgtaatcttgcaaactagaaaggagtatttcttccagataacattggcattttcatgacgatttttattaccttcagattcaacaggcatttgttgaacacatgctatttgctgagctccatatgggccgtttcatgtgttttaatcctgttttatccttacaaacatctagacaggtagacactcttcttccattttaccaatgaagatggagtgtctcagaacctctgcttcctttccctgcagctccctatgcgggtatcagaatggccaacaaggagacgcgattttgtgttttgataccctgaaagactgacttaagaatgacatgaaacttcctatgaaattatcctctggtagccgggcatggtggctcaagctgaaatcccagcactttgggaggctgaggcgggtggatcacctgaggtcaagagtttgagaccagcctggccaacatggtgaaaccctgtctctactattaaaataaatcaataaataagccaggcctggtggcacatgcctgtagtcccagctactggggaggctgaggcaggagaatcgtttgaacccaggagaaggaggttgtagtgagcccagatcatgccattgcactccagcctgggctacagagtgagactccatctcaaaaaaacaaaacaaaacaaacaaaaaaaccaaaacaacaacaacaacaacaacaaaacaaaaaaaaatatcctctggaacttacctggttcccttggaaaaccaacaggcatttccaagtgcagccagacttgtgtcccttgggattttctctctgttcatttactttgctggaaagggctcgcaagaggttcttgggtttgtcgtctgattgaacacgactgttccacgtggctgcgactttagaaccatcagctctggggcagaagacttgcagctgatctcctccctgcaaccatcacttcccatttttttgcccaagcctcctcttctgtgtggttcgggaccatgagagagcccctgggtgaatggggggcctgaatttctctctattcagtttctttgtagtttcctgggtgtggtggtattggtggaggatcagtgagctattggcgttggcccagagtaagaacctctcacccaggaaataaatggctcataaaatggtgcccttttcatccattcattcattcattcactcaatcattcgttcattcatcaactatttatttggtatttattctgtgccaggctatcatgttagatacacaagaaagacatggcttctgtcctcaaggaatcgctatagccagcaattctggcattgatcttctaggatgatgatctagtccaggtcttcctgttcaaagagagaagcatctagaaaacatggagtttcttgcagaatcccttagttactgacatattccattgctgataactaaacatgcaattcagggtggtcagttgtctctcccactttcccacgctggggatcatgatggaaggatacaggctattatggaagctgaattatgtgcaatgggggcagagaagaggaggatccaaccatattgggagcagttcgggatgggtcctggggagagtggacagatactctgttcctgtcccatgcaggcccttcagcatttattcaatacaacgcaatgcttaagagcatgggctctgacatcagacaaatgtgagctaagcccctgcttgattacctgctaatgcatgaggctcagtcttctcatctgagaaatggggattaattttaggatctattttccagggtaactctgagtattaaacaatatcctgaatgtaaagaacttagctgaagtcttgggaatttgttgttatcatccttcacaaactctggggagactaccaggaatcagaaaagaggagcttcaatctggactggtgtaatcagggaggtctccttggaggaagtgaccttttggtctctaagcttggcaagaa

SEQ ID NO: 1361 - DNA, 91824 bp, Homo sapiens
tggccgcttatcttggaaatgtgagtaagaaatagaagagccttggcaatccttgtattttctctaaaattatttgtaatatggagaaacatcaatatgttagtaatatttaaggaaaagacaaccaataaatagtaatttcagatattgaaattaatagaaacagatttaaggaagctattatataaccggggaggtaatggaaaatatgcttataatgaatgaacaaattagatgtcacagcagaacaataaaaaaatcaaaaagtaccaaaataaatttctagaattgagaaacacaataactgaaacaaataattcagagtatgaatttaatagcacattggagaagagtgaaggaaatgtcagttaatttatagtagaccaataagattaattcaaaatagtcatcagggaaaataaaattaaatagaaaaataaatgaggcaagccttagggacctagaaggtgatataaaaatctaatgcaatggaattaaatgaagcagaaggaagaatgaagtaaagcagagaaaaatttgaagatatagcaattaaaattatccaattgtttgaaagcatagttcataaaacagattcataaatgactatattaaaattaagaatttaatttttcagaagaaagcctaagatggagaacactatctataaattggtaaaattttgttaagtaaacttgagacaaaaaaataaaaataaaataaaattcctttcaaataagagaaaacataaattgtccatagtttatgaaaatgtattcaaactcatttttaattagaaccacaaaattgtaaataaaaaacacaatggctccatttcatacttaacaggataacaaaatctgatgtcagttcaatgaatttctgtttcagggagacctatttacatttgatttttttttttttttttgagacaaagtctcactccgttgcccaggctgaagtgcagtggcgcgagctcggttcagtgcaaactccgcctcccgagttcaagagattctcctgcctcagcctcctgagtagctgggattataggcagtgccaccacttccggatgatctttgtattttttgtagaggtagggtttcaccgttttggccaggctcgcctcaaactcctgacctcaggtgatctgcccatctcggcctcccaaagtgctgcgattgcaggcatgtgccactgtgcccaaccaatgatgttttaagtaaaattcaggattataaatttagaagacagaggaatgcgaccaggaagggccatctttgggggcttcttagttactggtgaaattaagagggatggtgttataaaagggagatgtacaaaaattaatataagaaagcatatcatgtagctcaataaaaacataatttaaattcctagtatttatagctttgaacaaagtttaaatgtctgtataataaaatttaaatcatggcagtaatgtgtgcttttaagctatgtggtagatttaagagaaaaaaaccaatttattatttattattgatatacctaggggaatttcattaagtttttacaatgcttaagtaataattatttgaaaaacaatgtaatgatttttaaattttttatgtaataatttggtgggtaatattttaataattgaatttttaattatttaatacagtcataaagccctgcgttaaccaagactaaaatcagtaataattctctgtgtcaaaaaatagcctttcagttatgtaaggattctgtcaatccccagatgtagaaaattcacctcaaatacattttctggaaactagcctctgccccaggtttttacaaacgggttagtttccctcccaggtcgtgctattcaaatgctcttacttttttttttttttttttttaattaacagtcctaactcgtcaagagaataatgccttttactttattagtgaatttacttcactgaaactcatacatttatgtacagaaagctaagctcaaaatacagaagttacaaccacaatcaacatatggatcaccagaccaattactggaccctcatagtgagggttcctttatctagctcttaatctaacatggccagggaaccatcataatgctgggcagagtaatcctaaaccaccactgacacctttgtagtctttcagtgcacaaaatacactgcattgctttgaagcttgcttgaattttgatttcctattactatgaacatttttcagactagaaggcttcagatgtcattctgtccacattttagagtttttagagtaaacagacaacctaggtccatgtggtgcagcatcttacaagataggttaaattcttcagaaattcaattaccttaaaataagtaacttatttattaacttatttataaataattacatcttatcttccaaaatgaaatattaaaagtttaaaagaaactgataaaatattagatacttcaaattttttaatatttttctatggtcgaataattgttttaatgttattttatacaaaaactaatttcaaaaatatatattctaaaataaaaattgtatttatctctatataaagataagaataatgttattatctgagcattaaggtgacactgaagtggtagtacacattattgccaacacttagaaaactgtgtctactatgttccactgaagtttacgttcattttttcatcacgaaataaatactttgtttaatgttaaatgttttgtaagaccttaaaataaaaactagaagattatatttaaagttccaattttcaaatgaacaaatcttctgaaattgttattttgaatgcatagattgaaaaaataagattaacagttattctgtttgaaaatctgatgaggctgatatgcagttgctagcctctaattttaactaggatgttccttctcataaagcaaactcaataaaatctactgcttcatttttttgtatgcgcaagaaaagttggatttttaaatgaggaaaaataattggcaggaagcatccaaaagaaaacgtatgctttatgtttcaaatcattgtttatggcacaatcttcttaaaatcacaactttattttgaagtaggtgttgcttcagcttaagcaagtttgtgttttacaaagatagtggtattacgatgaacttaggtttgcatggtgaatgttcacaaatactatgtgaagttttatacttattatgactttgagaaacaaatttgatgcataattttaaaataaatacatgtatttgtgttttttcttttgactgttaatccaattattgcaaaattgcaaagccttaacgataaagcaaaaacatcttcaaccgtatgataaatgataaaaccactaaaacgaaaatctttggatgaaccaccttcactctatggtcaggatgctcacttctattttctcacatatgtatccagcacagataagtaataatttctcaactttcctattggcacacctcctggtgacctgattatttcactcatctgaaagtccatatagcatgaagcaaggaataagtggctgtatggctgtcaagtatatctgcaaaacgaaaaggagagaactgtctaatggtacttcaatttaattaaaaagcatcctacatgctgtccttgaagtgaatggagtactaactgcatctggaaaaggataaaggatacgagaaggtagacaattcacctctgatcatctatcaggtgtggcaacgtgctaataaactctgctcactgcaactgtgtctcacgtaccattatatgaatttatggcggaaattagaagcccagtgaaaacgttttcccagctccatttattgaagagactttccccaatatatgatcttggcaccatatcccagtttatttcattcacgtattagaagaatttcccattaatgttttaaagtctataaaaaatactacacaagatgtcaagtattctatctttcattgtgaactatttaaatcagattatcattaagctttatcattaaagctttcagttatttttacttcagacatgcaaaatgctaataaatttgaagtaaacgaaggcataatttcatctgtataattattgcttaataaaaatctatatatctgaatagaaaatcaaacagaaagacacatattcagaaattaatatatttactatttaaaggtatcttttcaaaaatttaggagtactatctacaggttaatatctagatttttagtttgactctgactttttattctccgtctatataaaaagagctttgtgtacttaggcataatttcttccttcctcgaggtctttagcagaggtttggtactagaaagacatcaacgcatgaaagcataagtactttaatttttttcccatggcaatgcccaactgaaagaaagttaagagaatgtaataatacctacagatcattgaacagatgtacacacacacacacacacacatacacacacacacagaattgtcgccttttcattaaaaaaaaaagtaagaagccaatgttagaagtttaatatatgaagaaaagatgaagaaaagaaaaagaaagactgaacatgaaagaatctgaagctatttttgtatatcttaggacatattttgaaaagagtggtatagcaacatccactatcaaatacaaaatgattttgagttgcaagtaatcttagaaagaaaaaaatatattatgtataagactgaccacaatggtttgagtagcacagcttactatgaagttgattcatagtaaggaatcaagttccatgatattaagtgaactaaacttcaaaggtttaagcttcaaaatccaatctattgaagctgtggacattgggtaacatttcacaagagcagatttttactagaatgtttttcagaatttcaatcttttcttcagaaagttcaacatctttggtagtaaactaaagaaaataagcggcattcaattttgtgtttaataatttatatgccaattgtatgaatctttgagtatcattcttaaaaggtaacatcaaaatatattagtaaagattatacattttctgcataaattataaattgttattttgacatttaatgcctgcaactatgtatttcttcataaaataacactttaaatatgatttcctagaaatggatttataaaaggactaatctgagccttaataaataaatgacataatggtttgtgagattaacatcctgtgaacttgaggaatatatcttttattttagttttattattttatttttaatgattaaaatctagtatatatcatagaatgtaagtaattgaataaatatttgttaagcagattattgaatcaacaaatgtatgttacttagtatgtagcccttaacactaaatgttcaaaaatgccaatatcagtttatgatagaattttaatatttaaaaagaagatgatttggctgagttggcacaagtaagggactcataattatttctgaaattatatctcctccattgttattgtcaagataacttttctcttacaagattatgcttagtgaaatttattttcatttttcttactttcaaaaaatgttgtcaaatgtatgtctgtctccacattaagtatatcataatactgatggtataaaacaaacacacacaaaactgataatctacatagcaactttacacataatttcataataaacttttcaaaataaagtataagcaaatcatatttaatttaaatgatatctaatttcattcatagtatagtgagtagttatattacagtaaaaaagatataatttcactattcagttatatatttctgtccctgagacattcaattatgagttatttgagaacatttcattcacagaggttggcctctaagactaaggaattggtaaatactgatgaatattttctccattaagatggagagccatcaaggcaaaagtttgttttattttactattctttagttttccacagaacgtatatttgagaaatatttgttaagtgaatgaaaaatcattaattatggtgagcactataaagagatgtcagtgatgaaatgaccacaggatttgatcttggaagttctcagtgacaaagatgagaataatttcaatcgagttttgaaaatagaagcctagaaagattatcttcaaaaaaggaggttagcctaagaagacaaaaataataaataacaactttaatacattttcttctaaactgatacaacccaaaaatatttcaaggccgggcgcggtggctcatgcctgtaatccctgcactttgggaggcggaggtgggcggatcacgaggtaagagatagagaccatccccgccaacatggtgaaaccccgtctctactaaaaatacaaaaattaactgggcgtggtggcgagcgcctgtagtcccagctgctcgggaggctgaggcagaattgcttgaacccgggaggcggaggttgcagtgagccgagatcgaaccactgcactccagcctgacaacagagcaagactccgtctcaaaaaaattaaattaaattaaattaaattaaaattaaaataatatttcactcatatatctaactccaagaatattccttattccttctgcatagtgtacatttaaaataaatgtttgaaaactactaattcatcaacatatacatttcggagtgttacaacatcaacatttcggagtgttacaagctattctcttcaaattatcgtaattaattataaatgtgtaatagtattcccatttcacttctaatgaagtgggaattaatctccatttttgctaatggcattggaggaacgaatcaaatgaattgcttattttatgttttaagcaacctattcctagtgatgcatattgtattcctagagttttcaaatcccttcattcataattatattgttattctcatacttgttaagaagtatttatattgtattacacagttttgtctgttgtaaaacagacatcatataaaaatatttacgtataatctctctatgtctgcattttctatttctgtgtatttatattctcttattatatttactgagtctgtcttttcacttttttcctttattatgatgcacattttttagtatcatatatgtagactaaaaagaaaaaagcagaattaaggccatgcattcttttttagtgtatctggtgacattttctaataattttattatgtaatataatacatttatctgttattataaatgctgtatagtatttttatccagtagctttttatttttcaatcattaagaactcatttttaattattttgcattaaaatggggaaaagtgagctgtaaaatatatccatcaaaaaatattgagatttcttttgtagagctatgtattttttttttacatattccattacatggatatatacgtatttatctggctttacacagtccaacattacattaaaaaatagacattttaattttacaatcttgaactccagaggctttattatgtaacaaaaaattgtggcattataaagcaatcaattaatagactattatctggtgtctatgaaaagattactaacagcataagtaaactatcatctttccagtaatatcattctcctctggaaacacctggtgcaaaaatataattaccattaatgaatctcagggaatatgctaaatttaaattgaagtaatcaaattttcttgctcagttgataatatgtactagtcaagcatcaagtatgtaaaaattttgtttttcaaaattgcaataacctcaaatatacacaagagcataagcagagtaatacatgcacatttttttgttttggttttggagcttacatttttgctattttattgacttagtggcagaggatattcagatgataatattgaaaatttttaaataactaaaagctattttagtaccttaattcctatccaaaaaatttagtagtcagcaatgtaccttgagcacaaaatcaataatgaactagcacaccaagtaatatttatgtatattcacaatacataattccattaacatttgtttcaaggatattttaagtaacattgattttgtttcttattgaatcacattatcaagtttaccaaaataaagatattgcacatttcagctgataagaacagtagtcaaataattatatgatgacagtatttaggctcatttataaatgaggtattaatgttcaccttcaactgtgttggatgggtcaagaataatgaaaactgagactttgccatcagtctaagagtagtggatgttactgatgaccttcctaagagagtatcagtggagtgctgcaagtgccagcttcattcgtattggtagaaaaaaagattaagagaaaagatagaggaaatgagcttagatggcacctcgaagatttttgtactgtggttttggttgttgctttttgtttgcaaagggaaggagaaaaaaaatacagtaaagaaaggtgaagactgttcatgagtttatttatttttaaaattgaaaaaaaaacttcttattgaatatgtgaaagcttccaatagaatgaagaaaatgatgatacaagagaggaactgaaaaattgtcaacatgcttgagttacttaaggaggatacaatttttatatacaaatggcattaaatactcttgtagaaatatagagaaacatggagaaaatagtaacaggagaaaagtcaaagtatgggcttaggtgcaggtgggcagatgctgtgaatggagcacgcagaggtcatctccttgttttatttctaagggaaatggagagcaatgtcaaagtggaagctcagaatgtgcaacagcttggtggaaattaaaggaaaaaagaaaatcccttaaacatatccagaagagtgggataataaaaagaagtagggtagtaaagggaagtagggcagttaaggggctagagacattttagtaaagcattaaggagcacacttaggtcaattagtatgaatttaaattggctccattactatggctttgtattgtactctggctgtaattagctatgtgggttcagacatgaaacaacctgagactggatttttgtttggtcagagtagcaaaatgaagttaaaggagacaagggagtgaaggatatgtgcaaggttctgataggcttctagattcaggtgttgctacatcgaattaagtgacctggagccatagcatgtgatgtccagagactggagtgagtaggatcaaaattatagatgccaagatatttccagtattatttacatgactacaattaacaagaaaattttgacaggaatggtgttgaagagagtgggagtcgagccaatgctgaaatctgttgtaatatctacataaaaggaataaactcatatttcttccaaactactttgctggtattaatattagcaagctcaattctctaaatactgtggtaaatgtactatgctttgacggtacattactatactattgactgattatttatagttccctcgtagtaatgcagtgagataaaaggggaaataatggtgttttttcccctttttctttggagaaacaaggtcctttttcctgttttttttttttttttttttttttttttagaactgagacatgagttttccttgggatgtttgaggaccattctgccattgacatcccagagtttagttccttctcgacattctcgacatcccagagtatagtttcttcactgggattggtatacaaatgttaaacaaacaaaaagcaacagctaacaagcagctaatagggattcctcatgcactctccagctgacaggatttatttttgccagctttgtagttggaaaagacgggtttcttccggaggctttgctgcctgtgcctattaagcaattccaggactcaggcccatccttgggccaaaggtttaaaaaagaaacaaaagaagacaaaataaatcgcctcagtgctgtacaggtctttcttgaggttttgaatcccctttcaatccacgtgcttttgtttatttttcagagtccttggatagctgtttttatatattctgtcaagaactttccattgtaatctgtgggaaaactagaattgaataggtccatctttaacagcactagcgttccaaggttgcactatttaattgataaaaatgaacttatgttcaaaggaaaaaataaccacaaccaatagtagaagggcaattgagttttcttcgagaaaaaatttgctgataaaatgaaaatttatcatatagatagcatatctattatagatagcatattaaagaattaaaatttgtttttggcctataatttcaggttaaattataaatatatattttcattattgtgagttattaaaaataatatgtataatctctgacatttagataatctaaaagttgtttttgttagttttgtgtaattagttgtatgcaagaatggaatacttttttctgaaatatattttattagatagtaaatgcatgttctcttttgctcattataatactttataagattaaaaactaaggtaaaataaaattgaagtagctcataatcattcctatggaataaataataaaacactcatgagaaaaaaattaccatgtgccaagtaaaattctatgacagcctcagtaggaaagaaaggaacatcatactctttatgaaataaaatttcttcttatgtgatgtcctgaaatttatttgttttggcacctaataatgttgtaatctatttcttgactgaaatatggtagccatctaatttaagtaaaaactgccaacactgaacattgagcatttagtttctacttgaaaccatgccagataatgtgtatgtggtgtgtgtgtgtatccgcacatacaaaaagagaatcatttgatattgtatcagaaatgtccaagtgtgcaagccaaagataaacagtacagtgacaaaatttctgtatcattcaatgtcatatgccttggctgcagcatcccattaaaaggcatataaattattgtccagttttacatcaatggttggaaataaattacttgcacatctcttgtggattaagttatctctatgcctacatataaatcatgctgaaagaaaccaaattacccccaaatgcacatagacccatattcttcattcataataacacacatttcatctacagacatttaatagtgtagtgcagttaatatgttttaaagatgaccctataacactcaggattattaactacaacaaatctgaacagcaattcaaggttgctagtttcttgtcagtatagtagatcattttaattcaagatatacctgatacatttcagctgctccctgcttttgaaagccatttcctctactccctcctttcaggaccaataaaagaaaaagagtcagactgttcgggtaactttaaattagttactccaactctagagtgtttaaatctatcctggtttaaatatattttcagctgcttaaaacttatcttctactacatgttccaactttaaaactcacagagttagttttgggaaggcattataggattttttttttaaagtaactcagccgtgattttgcaactgaatttcgatcagaactgccataattgaactaaatattgcagagaaagtattaaacaaatacaaaaattttgaaaatgatgcattcattttaagttacatcaaagacaaataaattaaatgtttccaaatatatttgcatttgtcaaaattggaataaaaaagctatggaaatagcatttatagaactgcttaaataataacgctaataaagataaatagaaataataataaaaataaaaatatgaccttaattgagtaaaggctactattaccagtagaagttttggtgaagagaagacatactgcaatccaaacatattccaccctatacataatggtgatttttgcaaatcacatgcaatcagaagaattcattacatcataagaaaaagaattgaaatgttaattttgactcatacacactataaaactcatccaatactaacgttactaaaaattcaattactacagagaatcaccagatagaggcaaaacattcttttcttagagaagtccaagcatctctgatgctcatatttcccatatttcccaccaaaaaaaaaatgtagccttttgctccagaattatggtccattattgttttggattaaggcaaacagttttgagcagaaataatactaaaatcaatttaaaatttaatatattttttactttctgctaagagatcaagttggggatcattatcatgtttagaagtagatttttgggggtcattcattacatcatacagaggttcccaatagaggtgaataggctacagcttgtgtttaactctttatttcccagttttgatacaatattagtatgacaactacaatctacatgtggatttggttaggacaaaagcacaggaaaagtggtgggttcaataaagtagaatagaggtaataaaacaaatggttattctccaataaaagcagtggaaaggggaaatttaaagtatatattctattatttatatcagtgttacactaaatatgtaataatgcattacaaataggaaggatgcaactatgaaaatctggtcatgttcaaaaatgcatacacatacttatgtgacaagtaaggcatatgtattttaggtgacaactttcttcctcataaatgtccacatttatcttcttaagaagatcttacttcaataaagaaagagtttaccaaaaaaatcatagaagaaaatactgtattgaagatgggaaattgtaaacaaaaacacagaattttctatgcttaatatgcatctcataatacaaataagtggcaatttcaaagacatagagttaggttggtgtggaaaacttcagattattaaaaaccacaatgcaaatagaataaaggaaatgataatttccataagaacagattgctaaatgctttatattaattattgagatgttaatacagattctgtaatgtttggataatatacgcattgggaattcattatttacttgttatttattgtcttacatatgctagctacagaaattatacaaaccttcaaaatttggctatttattctggtcatataggaggttatttaaatgaatctttttttatgtgtttgtgtgtgtgtatacacgtatataatatagatatacatgatagatatacatcttaacatacattttgtctctaactatacacagtctgtttcacaagttcaaagatgtgtcttttcacattttaacaattttgaaaaatttccgtattgtaaaatgctattagaatatacctaccagccattacaaggaagaacaagttgtgaggaagaatacgaccttgttggattactagacacaatctgctctcaaatgtaaggaataattgttcatgttatatagagagattttaaaacaataatgataatgactaaaagtgagtctgtttcctgttatcatcatgtacaggtaattctaaacagtcagtgataaaatattacttgctgaaaaaatagacactctgccaaaaaaaaaactgctctttaaagatttatggatgtatttctaatatttaaattattttaaaatttagtatcttttgtaaatcaatttaattatgaacgttattatcatcaaattggaaatgcagatgaaactataatctccagaaacaatactaatcattgaggctgtaagagacagaaattatcagtgtccaattgttgataattaagtaaaccaatgaaatcacaagtgaagaacactaacattcaaattcttattttgacatttagaaaaaagtgaggttcttcaaaataagtatgagcttgcacaaagagtaaaaacatgttacgttatagcacttcttattctttttcattataaaaatagctattataaattcatgtatttctccaatagctaacgtgaaaatttcttttgttgcttaacaagctgtttataataaatgtaacaataggtaattaaattgtctcttggtctcacatctctcaattttacacagaaaaaaaataatataaagactgactatgagaagtttacggctttatgtctctaagacacctttgtacataaaattaattttcgaccaaacaatatattataaagcatgacaacatcattatttgtattgttgcagtggcttatataggcaaacttcgtaaaaaaaattattgtgtatcttcatataatgacacctgtgtaatacataatgcaacaccctctatatgaagaaatactttcttataatgggaacaaaacatatatataacttctaaaagtgagtcataagttctcaaagaataaataatatttccaagggattaaaatggtaaaatctaacagagataattgaacattcaagggcatttccacatatcttctgagcaaagaaatgcaatcaaacaccaccatttccccagatcttaactctagataaactccttgatgctaacttgagcaatcagaataaacaagtaaactgaaatgaaataaaataaagagcgtaacagttaatgctaagggtctcatttgtttgttttaaatattcaaatactatcttttatataaaaaaaccaaaataaggaaaaactccatagatagaagaaaataaaccatcaaatcataaataatatttatatatgattttttaaatgtttattatatttgtttattttcattgatacatattagatgttcatattttgggggtacatgtgacaatttggtacatttacataatcaaatcagggtaactgggatatccatcaccttaaatatttataatttctttaggaacattcaaattattctcttctctattttgaagtctacaaacaactatgttaactatagtcaccccactaatcctcaagttttatttcttctgtgtaagagtatatatttacctattaattaacctttctttatctatttcctccactcttctccacccctcctggcctctggtaaccagtaatttctctcttcaggagatacacttcttaaatcttccacatatgagtaagaacatgcaatatttgtcttcttgtgcttggtttatttcacttaccataatgacctccagatccatccatgttactacagatgataggattttattatatgttatggctgaattatattccattgtgtatatatgccacattttctttatccattcactcactgatggacacagattgagtccatattttgcctttcatgaatagtgctgcaaaaacacaggcacgcaggtatctctttgatatgtagatttcctttttttgaatatacccccggcagcagaagtgttcttttaaaaattcaaggcccggcgcggtggctcaagcctgtaatcccagcactttgggaggctgaggcgggcggatcacaaggtcagaagattaagaccatcctggctaacatggtgaaaccccattgacactatattctattgatatctggactttggtattaaaatctaacaatatgaaattttataccttgagcattcatattaattctcataaattaataccatatacagacataccttattgaattttgcttcattttactgcacttcacagatactgtgatttttatacaaataaaaggcttgtgtcaagcctgaatcatacaggactatcagaattatttttccaacagcacatgctcacttcatgtttctgtgtcacattttggtaattctcacaatgttttaaacttttaaaataattattattataattattatcgtgatctgtgatcagtaatctttgctgttacttttgtaatagttttggggtgccacaaatcatgctcatataaatggccagcaaacttgatgcataaatgctgtgtgtgttctgactgctccctcaacgggccatttccccgtctctctccctctcctcaggcctcccttttccctaagacacaacaattgaaagcaggccaattaagaactcttcgctggcctctaagtgttcatataaaagagtcacatgtctctcactttaaataaaaaactagaaataattaagcttagtgagaaaggcatgttgaaagctgagacaggcctgaaagctggacctcttgtgccagttagcaaagttctgaattcaaaataaaagttttgaaggaaattacaagtgctacttcagtgaacatatgaacgatgagaagccaaaacagccttgttgatcatatggagaaattttagcggtctgaagagatcaaatcagccacctaatccagggcaattcctgacttcaagtctctgaaggctgagtgagatgaggaagctgctgaagagaaattgaggctagtagagagttggttcttgtcgtttaacaaacggagctatttccagaacataacagtgcaaggtgaagcagcaagtgctggtgtagcagctgcagcagattatccagaagatctagctaagataatttttgaaggtggctacaccaaacaatacattttcaatgtagtagaaacaaccttctattggaaaaagataccatcaaggacttccatagctagagaggacaagtcaattcctggcttcaaagctttaaaagacaggtgggtgtggtggcacaggcctgttgtcccagagggttgaggtagaaacactgcttgagcacaagtgttcaagtccagcctgtgcaccattgcaagaccccatccattaaaaaaaagtattcaaagaacaggcttcaaaggacaaatgactcttacaagggactaatgcagctggggaacttaggtggaagccaatgctcatttatcattctgaatagtctagggtccttaagatttatcctaaattgactctgcctatgccctagaaatggaacaacaaagtctggataacaacatatccaattacaacatggcttattgaatattttaaactcgctgtagaaacctactttacaagaaaaaaaatttcttttaaattattattgctcattgacaatgcactcaagagctctgatgaagaggtacaatgagatgaatgttgttttcttgcctgctaacacaacacctttcctgcagcccatggatcaaggagtaattttgacattgaagtcttattagttaagaaatatagtttgtaaggctataactgctatagataatgattcctctgatgaatctgggaaagtaaattgaaagaaattagtgtgactcactttcttgcaatatttgcttttttgcaagttgtctggaagtgcacctgcaatatcttttaagctatcttctgtctatctatctatatcagtcgttctaactaatatatatatataatatttatgcatgtgatagcagtgtaaatataagtagattaattcaacaaaccctctctagaaggctttaatcttcttagattctgttctgttttcctaaacaccaaaatttatcttccaaattccagttctctaacaataagaagacatttttcacatttctttagtaacactttcaggaatctgacaaaatgtagtacatgatctagtaatatcttcaatattttagttttacaggaatttggttctttcgacccatagtttcagaacatttttttaatggcatgtgctaaagatacatttcaacctctggtttttctgtatttactgaattatagttgagaaaaataggttaagaaaaaaaaagaaagtattaaagttggagtgggttgttgaatcaggcatatcacaggctatcccagaacaggaccaacactttaggaaagtgggtgatttacactgaagaaagtcataagtgctaaatctgttactatttacctcagctatctgtcctctttttaaaaaggtttgcttgagtgtgaggcatgcttatgttgccaatggttgttctctatccaggttagttggcttctttttgactgtgttttcctttgaatttaattttttcttctctacattcatagattttaaaaatagaaactgtgattaatagaattgtaatgctttaaatttttttctctgtggtggtggtgttagtagaggtgtgttgcttgcatgtacgcatgattttctaaaatgagtttacaatgatatatgttacccattactgactgagtagctatcttggtttgcagatcaatggtcccagtatcatagtgcttttgttcatgtaaccttcattttacttaataatggcaccaaagtgcaagagtagtgatgctggaaatgtgactatgccaaagacaacttgcaaagtggttcctttaagtgaggaggtgtaacttaccgacttaatatggaaaggaaaacaattacctactcatgttgctaatatctacagtaagagtgaattttatatctgtgaaactgtgaatgttaagaatatatttgtcctcaaggtctcctatacatgcagtggatttaacgtaccatatgatccagcaatcccattattggatatatattcaaaggaaatgaaatcagtctgcaaatccaagtatgttacagcactattcacaatagccaatatatggagtcaacctgaatgcccatctcatgattaatgaataaaggaaacattatatatatatatatatggaatatatatatacacatagtataatacaatggattatagttcaactgtaaaacaggataaaatcttgtaacttgtggcaacatggatggatgaacctagaccacattatgttaagtgaaataagccaggtacaaagagacaaacactgcataatctcactcacatgtaaaatctaaaaaagtcaatttcataaaaatagagagtagaatagtgattatagtgattaccagaggctggggagtgtaggggtgttgggggaactgaataaggttgaccaatgaatacaatgttacagctagaaaggaagactaagctttggtgttctattacacaggaggatgactatagcaaataacaatgtattttatatttcaaaacagctagaagagattttgaatgtttctacgaaagaaataataaatttttaaagcaatggatatgatatgacctcaatttcatcattatactatgtatatgtgcattaccacatcacattgtaccccatgaatatgtacaattattatgtgttaattataaaaacattaaatatattttattaaaaaaacataattaagaattagcatgaacaggcactgacctttttgtggtgactttacacgtagctatctggacccatacaagaagaataatgaggttcacattagcatatccttattttaaagaatcatctaatattaatcatatttatgtccttgaaagtaaattataaaaataaactataagttttaaatatggatctttgtgaattcctaacagaataaactaatgtaaattaatgtaatcaaataaatttagtaaaactgatgcctccaaatacatactaaaatttgaaaaaagtcataattttagctttcagcctttggatcagagaaggccaaggtgcatccttatttgattgcccaatatctagcttcatgtgacacctcccgcctccacaatgtcgcctaaattcaaccacaatgagttcaaagtcacataactgaagtactctggtgacaaagctggtgcagcatctgccctggcccccaagatcagccccctgggtctaccttcagcaaagattggcaataatatcaccaaggcaacccatgactgggagggtccgaggattacagtgaaactgaccatttagaaccgacaagcccagattgagggggtgctttttgcctctggcctgatcatcgaatccctgaaggaactgctaggagaaagaaacagaacatcaaacatagtgaaaagatcacttttgatgagattgtcaacatttcccaacacatgcattgctgatctttagccagagagtcttctaaaaccattaaagatattctcggtactacccagaatgtgggctacaccactgttgctgccacctttatggtatcatagattgcataaacagaggtatgtgcaatgccaaggtatgtgcaatgcccagatagtaagatataagggaaatatctcaacaaaggttcacttgacaaccaaaataaaacgaaaattaattgtataatcataatttaaaatgggaaagaaatcttagttaaaatatatccagtagagttttaattaaaaattataaagttcataatctcaagcattagttggcttgatttgccttgtatataactgttatcctcagacctttccactcactggttgctttggtgatattatcaccaccctttctttgctaaaggtagacagagggggctgaccttgggggctcaagcagttgctgtaccaagaccgtatcatttagaaacagatacagccttcttatggaaatttttaccacatactctaattttagtgtccagttttgttagtttataattatatataaatatttaaacataattgtattggtccgttctcacgttgctaaaaaagacacacctgagactcagtaatttacaaaggaaagaggtttgactcacacctagcatggctggagaggcctcaggaagcctacgatcgtggcagaagataaagtaaaaacgtccttcttcatggggtggcagcaaggagaagtgcagagtgaagggaggaggggaaaatcctttgtaaaaccatcaggtcttgtgagaactcactcactatcacaagaacagcatggaggtaactgcccccatgattcaattacctcccaccaggtccctcccactacacatgaggattatgggaactataattcaaaatgaaatttgggtgggaacacagccaagccatatcaataatattagtttataagtaaacgttccttatgtgaagaaaaaagttttacctgaaaatactattattttagatgtcattgatgccttaaaatttagatgtgtacaagcttattgttgtttatgaattataatcttgtttctacctattcagtaaatttaacaaatctctatattagttcaaatatattttgacttcctctcatatttaagttattattaagaaattcaaacaacatttgaaattgaatcaatactgtatctataaaacatatttgaaaaaatctgagatttatatattttatatttttatattaacttatttcccatttctaaatttttttttcctgaggaaaatggaatttgtcacagtttccttttaaaccaatgatgtccttgctaggttaggaggttccttgaaaaatagtagtcattatgtggtccataaaatatacatctcactgatgctcacatattcgttccaaagacaagataaaatgtatctactgataggtaggcatgctgatatttcttaagttctgaagaataattgggatgtcttcccagaatacaaaaatgagagaagggtgccactgacaaaaataactatattccagtcaactggagtaattagagctaggcagacagacaagggaagtaaggctcataggtaggcaatggactaaatctttaatggagttttagcaaacatgagttttggcttttggctttgagaaagagcaaaggaaactaatgaactaagttaaaactgaatgtgatgtgatcatagtttcataaaagcactgtttttcccactctatggaaaattttaaaatgggtgcactaaaaacatatgtaagtctgttaggaagatttttcttaatgctccgagtgggaggtgaagatagacccaactggaacagtattgggagagatctctaattttaggaatctacagaccaaggtagatttctcataattactctttaattcatgttttaagtgcacaaatattactgagtagcatctctcaatttgacaacaacagagtatcaaaatatatttttaccaggttgtgcagtgtggttcatacctgcaatcccagtgctgtggagggctaaggctggaggattgcttcaggccagtagtttgagactgatctgcacaacatagcaaggcatgtttatacaacaacaacagcaacaacaacagcgacaacaacaagccgggcatagtggcacacatctgtagtcctagctactggggaagctgaaggaggagaatcacttgagcccagaagttcaaggctgcagtgagctatgatcacaccactgcactacagtctgggtgacgaagcaagacactgtctttaaaacaaacaagcaaacaaaaaaaaaaaccttaacatttgaaagcaaaagccaatagatatgccttatagtacagtcatgtaaattacggcatgtgaggtaaaatttgtgacaataatcttttccttaaaagacaaactgaaagttgcagtgatctttatctccaggatttatactggtactctggaaaaatacagcaaagaaaattaataaatcaggtattgtttagtagaatagtcttatcttccaatgataagtaaaagctatataattatctctacttatgtgtataattttgccaactgttttaaacatttgatttaatcttttattttaaatgaaataactacaagttgtttagtattctagtgctgtacactggctacttttttgaaatactcgaaaaagcttttcactctggaatcaatttttaaattgccattaaaatttttcctttcttttcacctagtgccttatcatggtgaaagtgtagagagggaagaagcatatcaaagaccaaatgaccttgttcatagaattggtttttctaatctccaaggtgtaaccccttgcttaaactcacaactttcttctttctcatataaacaattgatttatttttttctataaaacatatctaaaaacacatattcaatgatcaaagctcctcactttgaaaatattcttcgtttttattccaggttatctaatatttatggtgatttcttacctatattatgtctacctttggggaaaatatcagaatttatttgatgaactaaaagtttactgatgattgattatatgaacatttagtaaaattgtggcattttatcaattttatgtactacctctaagcaaggtatttatgtttcttgaaaatgaaaaaaatcataattcttaaaagcaccttcagcatcgttgttggcttatatcacatttagtaataatattaatatttttaaaagcatacttataaagtgttgttttttagaatgaatgtcagactatatccatatgcactcttttgtttgtatgccatgatattttaattcttactactttgcttgtgcctatgttttttccatagacataactgggtacttcagagtctgatggaaggactcttttgtttgtattaatgcttgtattccacaggtagatgtgataatatgtgacaattttacactcacctttcttattaaaagtacaatactttactatatttgacccaattatttaatattacatattgcttccatgtgacaaaaatattttgcaactttttatccttaacttcatcaatatctcatattacagagtattttactcaacttaaaaaataattttgacttttctttctgtttgttcttaatcctttttaaagtgacggccaactacccagcactttgggaggctgaggcgggtggatcacgaggtcgggagatccagaccatcctggctaacacggtaaaaccccgtctctactaaaagtacaaaaattagccgggcgtggtggcgggcacctgtagtcccagctactcgggaggctgaggcaggagaatggcggaggcggagcttgcagtgagccgagatcgcgccactgcactccagcctgggggacagagcaagactccgtctcaaaaaaaaaaaaaaaaaaaaaaaaaaaaaaatagtgagacactaatatttcttaaagtacccacaggatatctttctgatctaagagggacttctgcagctttaaatgataaacctattgaccgttttatctttagagtgtatttctttgcatcattttactttcctcccttcttcccccaacaaatacactgaaaattataattaagtaaataatgttcctttcagaatcatcaagtagtgtgattgaatgtgtaaagaaagagatgtaatcctatcacaaaatctttgccaggatctcctcctctccagctttctgtcttaccattttgttgtcaattgcagtgctctttctgttgtttattttattgttattcataccaatcatcactttatcatgtaccttaatttacttatttgttgtgaatattgcttatttcctgcctgtatcaatgtgagtgtaagtgtcaaggggttgcaatgccttagttgctttattcatttgtctagcatacagattgtgttttatgctcaatatttattgaattaataaaagcattagtgctccttaaaccttcatcaactatgcctctgatgatcaaccccataatgtgcctgtcatacctattcacgtatgaatttaaaaatgagcaatattcagtctcaagctagggatctattaaacaatacagaattagttgtagcttaactaccacacacattaattgagtcaattacagaccaaactgaactaataaaaatttttaaactcatagataaatgctgatacttcaaaataaaattagagaggaaaatgttactgttatttatggagcttatatcaaatatgtaaacaaattttaaaagtaattaaaatttaaccaaaaacaacagggttttatggagtactgtgctggagaaaggggagtccactaagagggaaggttgacactcaatacctctcagagagggacatgtaatcaggcaattaaaatggcatagtgtaaccatttgagatcacatatgtaagtagggccaagtttataatctgttatagatcctggtaaaaaaaaatgtcgatattattctaagactacaagtagcataaccagcacacttagcatctgttttgtttgtttgttttttccactcaagagaactctctattgagctctttctttgattttccagttatagaatactaagtatctctcattctcttcaaacatgtgaatctcagttttactctcagttttaccgactctcaattcacgcaaaaaaatagacatcaaaagaaaaaaacacttaaaatatttccaccatcctaggtttaacatctgggtgacaaaataatctatatagcaaaccctcatgacacaagtttacttatgtaataaacctgctaaagtacccctgaacttaaaaataaaacataaaaaaaggaaaaaaaaagtgtttccacccaaaattacaaataaaatgtgaatttgcagttattcatataaaataatatagtttacaatattaacataatgttacaataaatattatgcctatccttcgtatttaatacactcctggccttgcagagttctgcactatgaactatttgtcctcatttttctaaatgtcatttttggaaaaatcacattatcacctgtatgctgagctagttatctcaatttaatcaatgcatcagttgtcattctcattacaaccactttgaagacttttaaatcaaccaatcatgaaagcctaactctctcttagaaatcttttcaattttagaatccacgttagaacttccaatactgtattttgggacctatgtattacaaaggaaagcatgtaaatgtaagttgaatgagccccatatatagctcaagactgctacaatggatattttgcatatttcctgaaatatccatagcaaatactattttattagatgctcaggaggttcagctgaacaaaccactttccatgagacattgctcttatatctctctttatcttcatcttagaagacacttaccttttaaatatatcacaccatggggacaaattgtgagggaaatacttgcttttttctattccagttaatcctgaagaaacatccctctatgttttctttgttgtaaaatttgaatatttctactactcttcttatattattattctataaggtatttgctgagatacttctcaccacgttttattgtgagatcatggaatgtggaagctgggtcttaactcatctccatattcagagtacctgttgagtgtttggttcatgatgaacaagtaaacattgaacaacagcattttaaacacattatctgaaattatattgcacagtgttaagcccagcttgcttggtccataattacccagaagcactaaaaatgtcttaatcctccagcttgtgaaataatagctaatatttttgcatgcttaagttttattccatacatgcatcctaggaattttgttaattatatctaacatgaattgtgcattttattgaaatacgtcgaatacatgttgttcattttgttgaaatatattaaaggaattattatcagaatattcagatgccaaccaatcacaataaaagttgttgagttgacctattaacagttactcaatccatgtctttgtggaacttgttgaacatcaacacttccataaagtatacataatgatataaagaaaaaacttatagttaatagtatttctatttaaatatttcagtcttaatgacattatataattctacatgatattgaaaatggggaagtcatgagtcttttccaaagtagttatactcccttgctgtccttgcttaatccaatgcatgctaattttttttttattgtggtaaaacacacatagcatggaatttagcatttaaacattttaagtgtacaatgcagtagtgttaactatatgcacatcatgtacaacagacctcccaaaatttttcatcttacaacactgagattctatagccattgaagagtgagtgctatttatttttaaaggagaacaatgtcatctcaaaggcctgcatagaaaattgttttctccaatattcaattattatgttagcaatagttatttttcatctggtactattaaccatcccatattatagcaacaggaattaagaactgtcattcaacatcaaaatgtgatttcttaggacttttactatttaataattattatgctaaataactattaatactataaggtaaataataactaactatatatagaaaataaaaagaaattattgttaatgactagcaagtagttaataaatgtaataacactttaaatatatttgctataaagtttgtaaaatttgatatttaattaaagatagatgcctctggatgtccaacaagatagtaaagtttttaaaattttttaaggtattcccattaaatatattatttttttttaaaaaagagaatgtttgcaaaactgtatagtcaaagtgatacttttctgctaatttttattgatgtcagaagagattatagaaggcatgagtccatttttaggggtaatcagtggatggaatgagctctatcaagctttcatttttggtccagggatcttgcagtataaaaactgtgaagaaaatgatgatatttataaaatcgttatgaaatatttactgcctggaatagtttccctaaacagatatatgaataccagaaaatatgttttgcagatcccaaataacgggattggctttcattaaatgtactaccaaaaaacaatctacttatcttgtataaaataatttttaatgttgagaccaaaaataaaagtaattatcatagctaggtcaactgtcattattttttctgtgataaacaatgtatattcatatatttctccttatttcacatacttacatatttccatttcagttaaattaatttaatgagcaaactaatatacttttatgcccataaatcaagacatgaatataaatgcctgtaaattcatacacataagtgtttctatacatgcaacaataatgtatatattattttaacatacaaagttgcattagtgtatatgtatgtgtatatagttaatatatatgatttatattcatattatgtatgtttatgcatatgccactatatagcatcccataaatatatacaattattatttgacaattaccaataaaataaaataaatatttgtcaaaaaagatattcactgggtgatgtgtgtgtgtttgttattattacaacaagaaaagtacagcgtaaataataaaggatacattgtgatgtctgattcctaactttgatacttcctgtagggccttggaaaaggtattatatctatttgttgtttccattttctcatccaaaaagatgaagatgataataacggcttaccatagtatttgttctgagaagtaattgagctatgccgcattagttcttagtaaactgactgccaaataaaacctatttaatacatacgtttttactattattttagtctttttcatatgttgaatgtaatcagtaatatcaatatttggcttacatgatgctttaactaaatagtgtttatataataaataagaattttttgttgcttctcattaaatgaaacaataaaaccatctatttctaattggtttacattttaaaaactaaataatatgtagacagtgttagaaatatttatatgtactagcatataatttccaaatcctaatatctcttagcaatattttcaaaacctatacattttctaaaatagataagtatttctttcttctaaaatggcatgtttacaaaatgtcataatagttatttatattagtattctattaatgtcttctgccatcacataattttaactattcaaactatttaacttaagaacatagaactatatttgtgtgtttttaaaatttctgcttctttgtcttaaaatctataagacataaatgtttgaactctttataggacattttattatcttccagatttctaatatattttataatattacttgtttagcaacttcagggaaatacaaaggtagtaattaaacttgtcataaatttaagtgcattgagatctttctattgttactccatcacgtaggtgtataaatgacagtaacttttcttacatgtagtgaccataagaattacagaaccctacaagttgtagaatcaatgtgaaatgttggaaccaatgtccctttgggcctaattttcctttctacttcccctttcccctgacttcatacctaccctagactatgacatttacaaggaacttgtgaaaagtgtccaaataccacaaacataacacaaataatgagctatatatacagaaagtttttacttgttttgcaggtgtcatgggactctagaaacatggtcacatcgaagtgaatatactaaaccactagttcatcatgctgcattgcacgaagacaagcattttaagtctattgcttttcatcatttagatgtgcagtcattgttggtggtattgtcaagagattagcaaaaataattatgagtgagatcattttaatttcttctttctttccattttcagcttttctttgtaaaaatgggttagctttgtgagaaaattagtaagaaccagtaatgtggatgctactacagatgttaccatttggcatgaaggttgaggagaggcatggccacaggattgataatgtgtggggttgccataacaaagtaccacagactgtgtagctcaggagggcataaatcccagatcaagttgtcagtggaggtggttctttcagaagcctctatccttggcttgcaagatgaccatcttttccatgtgccttcacacagtcttccctctgcgtgtgtctacatcctattctcctcttcttataaggaccccagtcatattggaggagggccctaacctaatgaccccattttagcttaattagctcttcagagggattggatttccacacatgaatttagggggaggcgggtagacacctgtgaaaaccaacattggcttatcctcctgtatgtaaggctgaagttaaattactcattgagcaaaacattgctacttagagcaaaaagatttgaaagggtgcttcacgactaacaacctgtgagagtgggaaaactaagactgagtttagaaagtcagaaagggagaaacttttagtttaattccaggaataggagcagaaagtaaaaacccattaggaattatactataaattaaaaatataaatactgcaagactgacagaagagtctagagaagattacaaatacttcacattttctgtgaaattataactaattttcaattattgtaataaggtaaatataatcataataaataagcttgaaatttatatttcataacctataatttaagctttcagaaaggttaataaaggacttctttcagagtagatagaaagttcaggattcagagaatccttacagaagtcaaaaatacctcagagaacagtggctccggtggtcacataagaaccaagagtacagggataagtagcttacacaattgttagtttataaactcccctctgttaaaacaaaaataagtcatctgtcatacttatctttaaatctcccattgagaaacgtgaacacttataagcaattctcaatgtggataaaacaatttttgaacagcaaaatgccacaaaagatttatgagacaatggattgtttctgatccatctttttataatcagttgaaaataactaaaggattaaacaatttaatagaatgtgaatatctgtaatgaaaatggtaataaataagaaaattcattgttataatattatgtatatataacttaattagcataatagatgtgttatactgtatcactcttcttttctaacgctttgttgcaatagtttgaaactggtaaaaagtaaggactccagaactctgttgtctaagttccgccccccgtccatcacttaagagctataagaactcagtcatgttactcagcctctgtgttttaggtgtaaatggaggatatattggcaataactacttcacaatgttttatgaaaattatctctctgtgatctcaacacattctgctcaaagaaaaacttgttcatgtccaaatttagctatttcctccaagaatgttcttctggacctaaagtgtgacctccaaagctcagttaagtgtactcctctctgtggtcatcacaatatcatttatcttataaggcatttatcagattaaattgcaattccctagcaaactgagaggttgaggaaagcaagtattgtggctatgtggaatagttttctatctccagtgatttgcactgtctgacacatgataggcaatcaataaatatgtgctgaataatgtaatgagtttttaaaatacatctttaaagaataacctgggagcctgaaggaaacaattcattttccagaatcaaatgatatatatatatgtataaagtatctgaggagcaagttttattattgtctttccctcaagctggagatattaatagctattttattattctactaaagagaaaacttcttggtcagagaaaataatatcattacagaatttggtttactgaccgtgacttgaagataaataatggaagggcgttaactaattcaaatacaaatgcattgtaaagaaatatacctgtaattatattctagagatgcaattgtcatttatatttatatgtaaatggataagtaggtttaaaatagaactcttgatttttgccaatgttggtaactattgcaaatattaaaaaaaaaaaaagaaacctgtcatttaactagaatgtaacaaatacagccccatgaatcagaaacctagcctaccactttgttgctagtagatactgatcatgattacctcagtggcttttaaaatattttaatagaggcaatcatttttaaaagacaatttttgtatattttggagcagttttagagtcaaagcaaaactgagcagaaagtatggagagttctcatacacgtactgcccccgtcacgcatggatagcctccctggatagcaacatctctcaccagagtggtacatttgttataatcaacgaagctacggttgacatatcagtattatccaaagttcatagtttacatgaggattcactgttggtgtacattctctgattttttttaacaaacgtgataatatgtatctaccattaaacagaatattttctgtatgactgccctaaaaatcccctgtgttcagcctattcatctcttcctcctgcaaactcctgggaactacataattttttactgtgtgcatatttttgcacttgactgagagtcttgcgtttttaacagagttgaaatttttaatttcaatgaaatttggcttaacaattattattatttttttttcgatacagggcctcactctgtcgcccagacttaagtgcagtggcgtgatctccactcactgcaacctctgtctcctgggttcgaacctcaaactcctgcatagctgggatcacaggcatgtgccaccatgtccagctaaattttgtattttattagagatagagtttattagagacagagttgttggacaggctggtctcaaactctgacctcaagtgatccaccgcctcagcctcctaaagtgctgtgattacagacaagagccactgcacctggccctatttctttctttttaattttttttaattttaatttttgtgggtaaataataggtgtatatatttatgggatacatgagatgttttgacacaggcatgaaatgtgaaataaacacagcatgaagaatggagtgtccttccccttaagcatttatccattgagctacaaacaatccaattacaatctttattttaaaatgtacagttactattgactataatcatcctgttgtgctatcaaataataggtcttatttattattcctattttttgcacctattaatcatccccacctcccctcactctcagccttgtgtgaccaaataacccaaatatgtcattttggactttagggaacctaatatcctgctaaatcttaaacactgacagcaattaaggtctcgtcctcaggcacagtagaagatgccaatcaaaagaaactgcattcctgagacagggggccagcaatgaaagctattcaactcaaggctcaggcactatggcagaagaggtgggcatgtgagattgtaagagccgatattgagagataaaataagttcagtttctctataaattaatcattaatgtcaaaggcatgcttatatcagaccagcgtatgggcccctttgtcagattaacaagactttcttgaagaattagctaaatccttaatagaggttataaaggttataaaaggcttatggaagttttatcttatggtagaaattaaaatttatagattctttacaatttcattggcttcaggctgtttttgttaaggcttattgtttggaaaattaagtctcctctcaaagaataaaggtttttgcctttttttaaaaaaaaatccttgagttatcactttggttaaatgaatgacttattttacaatgacctgggatcctattttgtgatatcaagtgttttaaacctttgatatttgataaactttccaaaatcaaattataaattatgtctttttctgaactaattaattctttaagatattaggttccctaaactccaaaaatgatatatttaatttattttatataaaaattatacaggaagcattgtcaaataggaaattttctttgttttttggagggctgtatttgtataaatatgttattggtatgtgtttcaaaattatggaaaactcctgtaattctgatatgccttagtgtacattatcagtaataattatgattgctatgttaaattattgtgtgccacagatgtgaaaaatttccttttcaatgtgtctttcactatggctgccctaaaactttttgacattcatgtacaattgtattgttttggtcctcttcagaaggtggttttataatcacttgtgaaactctgacaggtgttcttgaatgcaggtttctgataactttggagattgtggcatcagaatagagaaaatactttcaggtgtcatgggagctgaaatgttcattgataaatgtttcctagtgccatattgtgataatttcctttactgatctgctttctgacactatagcttacattttcagtattatttttattttattttattttattttattttattttattttattttattttattttagtcagagagtctcactgtgtcacccaggctggagtgcagtgggtgatcttgtcactgcaacctccacctccctggttcaaatgattctcctgcctcagcctcctgagtagctgggaatacagtcacaagccaccacacctggctaatttttgtattattagtagagacagggtttcgccatgttggctagggtggtctcgaaactctggacctcagatcatccaccagcctcagcctcccaaagtgctgggattacaggtgtaagccactatgcctggcccccctttttaatataaatttatataaatgatattctacagtattaatctttttttgtccagcttctgtcacctatcataaatattttccaaatcatacatgttgttgctgtgtagtatttcattttatgaatatatatttgtttcttcattagcctgtttattgtcattttggctttatttccagttgttactattaaaaagatatgttaatattcatgtgcaggtcattgtagttgcatttatttctctaataggagtggaaagactaggatatattataggtaggtggtacagattgttaaaaaaaactgtcaaaatgttttaaaagtctttggaatattttatatttccatcagctgtatatgaaagttccaattcctcaacattctcactaatgcctgatatggtattcaaatcatttatttatgttaattttgcctcatgtaatcttattgaactcagttattagttggagaaacttttttatagattccattgcatttctgtgtattagacaattagatatttctatgtattagataatttctctgtattagataatgtcagttccatataaagattcttattacttccttcgcaatctgaaggcaatttagtttttttcttcccctattgaattggctaaaactcagtacaacattaaacagaagtagcaaagagagatgtcattgtcatactctttaactttaaggaaaaacattctctttcatcaattaagtaagctattaaccttaagatttttgtatatttctttttatagggaggttacattccttttatacacagcttgttcaactctcttttctttttagcttgttgatatgatgagttatatagattgatttcaaatgttaaagcaagcttacattactggaataaataccaaatattcattaaaaaatttcagttttttgttggattttatttgctaaaatttcatttaaaatatttacatatacactcatgagatagatacttttttgaaaatggtgtctttggttttcttataagcataattttgatttcgtagtaagaacacccaaaatccatcgttttaatattctgatggagtttgcacagaattgttttgtcttttatgtagaaattcaatttttaatagacataaagccaccttacctaatcttaattctatgaatgtaattagtttgtatctttaaataaatttaatatttttttattttgtctaaatgataaaatgtatttccataaatgtttcccaatatttcttcaacatccttttaatatctggggaagtctagtgatacaaaattttatttctgctaagttatttattcctaataaatttaaacagaaaattataactttttagatttttttgaggaagtaacttttggttttaacaacttttctttattgatttctgctttctagttcattgatttctgttcatagctttactaactttggaagactatctcttttttgtttctctattgctcatgagaattactttctcctagtttcttaaactggatgctgatgtcatttattttcgatcttctttaattcttatacagaaacttaggatacaaattactgcttcagctgcatcccacagtttttaatgttgtgttttcattttttattcagttcaatatgctatttaaacttccccttgatttctttattttatatatgtgttatttggatatgttatttggtttccaaatatttgaaaatgttccattgtttctgttatctatttccatttaattctattgtaaatttgaatatttaaaaatgtaagacatattgtatgtacgagatatgatatggcctatgatggtaagttctatgggaactttacactattctgctattgctgtgtggaaggatataaatataaatcaggtcaatttggtttttagtgttgttcaagccttttatatctttattgattttctgtctacttgttctgtcaattaataaaatagtagtgtcaaaaactaaaaggcatttatggatacacctaatttcggtactctctgcttttgcttactttaggcaatccttactttgcacatttcctgaaggttcaaatcatgatttagttaaataatgccagtcacttgacaactaagatttagattagttttttcatatgccattgtatcctgctgtgttaaatttttttgccagctctgaattatttatagctattatttcttcacaaattttttattctcttcattctcttcttctgacattctgaccagatgtataaatattttatcgttctcagtatgttttctgtctttcaaaatagccatctccatttcttcattcatccataatttcttaatccctccctttgagtgcataattatttttttcaagacatactttacctgctgttaaaacatttattatgtctctctttagtttcagtaagtatatatttttttctccaaactttatcattactgttttatctcttgagagttttttatttgtttgttagattgcatcattatttttaaaaatatttcacacatacactttacttcttaaaactaaacgcctgtagtttggagtctaaatctgttttgtgctgtgtcgttaactctctctaatgtcgatgtatcttcttacagtgtgtttttgagcatgttactttctgttttaatgcagtagatttagtccttcactacagaagatttactctggaaaagagttgcttcgaaatgtgtcagtagctagcaaatgccaccaatctagggccttctcatttaaaacctagcctggaatatcaagctgggctgaaattttactatataaataaataatccagtatttaatgatagtgttgcaaaattctatcatctgaacaatacagatacttaaagtagatgaaatttaattttacatcttttcacagttttttcgtatccttttttttttagagtattttccagtattttatgacaaaagaaaagcctcaaagatgtgtcatatccaaaatctagatttattcttttagtcaggttgacccttagagcatttatcttccataatgatagaggaaaaaaccctcattgatatatctcaagtcaattattggctaccttattattcaatttttattaactacaaggaataataactaggaagagtatgttgtcatgtaaaaacatttttataatgcaaaaatagggatatgtttgttaatttatgttatgtatctattccataacattactttttaaaatttgttctgaacataaatttattaactttcagtttggaagtggatcacattaaaaccccctaccatattgtataaagaacttccgcatagttcttgtgacttagatattttaaatcattttaattgacacattatagtcatcattaaggtgtaaaaaagcacttgttaactcagttttaagtatccacaaaatatcattgtgtcaagacttacaattgtcttttgtattcaatgtcatctttctcaattaaaattatataacttttgttgttcaggtttatcattgtttctaattatgctggacattgtatttttatacttagattacaatttatattataaatctgaaaaatacctttgttagaaaacagatatgttgtttccattttatgaagtacaattattgaccctacagagctttgaaaatttaattacactaacttacacataagtttatctttctcagaaaatagggaaaagttttatggtacaggtgtttcttttctttttctgtaacctaaagaaccaaaaacagaaacatatcttcattgattacaatcagtattttatgaagcaccactctaattatcttagtatgctaagcttattatcacttctcggccttttggctaagatcaagtgtgtgctaagcttattatcttcttgaaacacagacgatgttaaaattggagtcagggatatttttcattgttattgattttgagatggcataaaactggttgaaatcctttatttcagtgattctaactcagtggtttttaaactgaatgtacatatgaatcaaaagttgtgcttagcaaaggggcagatcccaaaataccacgatcacaaaacctttattcaatgactgggtggaggtatggaatgtatatttttaaatgggagattattataaagataatctttcagataactagttactcatttctagtttgtcaatatccttttagtttaacaatcagcactagaaatactctactttagatattgtgttagaatttttttatacagtgtaaatcatgcaaggtagatgttttatccttatgaagaaacatatttatttttggagagatagaaatttctgaacagcaatgcagatattaactgagattacagagaaaaggtgtctctagaatttcctttcttctgatcagggttatacattcaatgttacaatatacatataactcttctttttttgatgcaaggatgaaagtattagaagtaatcacatgcctaacattacccaataagtaaattttaatatgggggatttaaatattaatttattgaataccttaaatataaggatttttttctctctaatatccaagtatttgttaacaaagtttacattcgcaaggaagattactgtggtaaggccactctatgtcctgttcttaaacattcaagtagaaaattttttgatacacgtttctttatcacagaattctcttcagaatcagagaaagtataatgatttttcatgtggaatatacgatttttgtttccatttgcttgttggctaatactgtttgattaaaacagtactttacctgggacataacagagctcatcctaccaaatctttgtgaaggcaaaagtcctaagctttgaggcgaactaataactatatctggttattactaatagttagacataaaaggaagtcaaccatcttcagcagatgtcggtatgtataaacatcttcaaaggacatctttatcatattattataatatgctatatgttagaagctcaattaaatcagatctctatgaaaatccctaatatttttgaacagataaaatatggattagggatctcagacattgaaagcaacctactagtaggcaacttatttctatctcttagattctacaaattaatcagttttatatacagttacagtttgaaaatgtgggcacaaagcacatgacaattactaattcccctctcacagtctgcccataaacatctatgtctccattgttttaaggccttgaccaagaattaccagtaaggcacctcaagaccaagatagactgtagggttggagcagaatattcccaaagttgacaggtatgtaaatacaccccaagagaaaatgaaaaatcaccatacatgttcattattttaaaataccatttgctttaatatagcctggaaaccatgccaattaaaggatgattctgatccaataattctttgatggatttaggaatttgcatttttaaacagtatttaaatccaggtggccctaacattggttaaaaaaaaaaaaatgaaccttgtttttaaatttggatacatattggactcatctgaggtaaataaaaaatgcaaatgctaaacctactctcaaaaatctaacttcattattctgttggaggattatgctacagtatattttaaatatgctaaagcatatttaaaagcatatttagagaagccgaaagtgcagactgtttggagaatttgatactttcttaaccagcaaatgctgcatctacccttgtttcatagctctctgatagcagttacaagccttacagatttctgctgttatctcattttctttgaaaaacatgcttataaatcacacacactgacgtgtaaaggtactatgaaataaatcaggaaaattgggttgtaatcagagttctgcactttgtagaagtcagcctttcagtgtctcattttcttcatatgtaaaaaaaaaattagcagtgggatgaaatggttcctgtgatgcttggaaaaaatatatctgtaatgaaaggccattaaaccaattgagttatcttttatccttgaaatatatcattatctcattattatattaaatgtatagacagtgccaaatgactattgttaaaaatcaaaatacacctgtgtcattcaagaaagtaaattttaacaaacactttaaatatgcttccctgcagtctcgatacccacattaatctttttgtaaaagaagctggctcatatgctttatgcagtttcctaaagtggatgaatgctaaaggataaataaagctagaaattacaaaaggtaatattacaaatctaggaacagaaaaaagcttaaagaaatttacaaggaaggactggtttaaataagttaataacttggaatacttctataatgtaaaataccttcctttatatcatccaaatttccagatgtgtcatgataaataattatactacagcagtatgattgttattataagtacaccatttattcaaccaaatcatcaggcaaatctttcataaagtaattaagtgctgtttttgattatttctctttgaaaggtaaggaatggtgaaaacatatgaacacatttgaagagagcaaaagaatacctcttcagaagagaacagtgtttccgattgttatatttagatataataagaaacagaagcaatagagcaaattagactccagcccacgctactggtggaacaaacaagtcaggagggagctgggatgctagcagaaaaagcaggctagaaaacttcattaggaaaggaggagcattaacctattccttgattttctttttaaagtttctggaatggaacagatagaaccattgtgtttaccgtaatcgcagaagtactttacctgggacaaaacacagctcatcctaccaaatctttgtgaaggcaaaagtcctaagctttgaggagaactaataactatgtcttcttattattaatggttagacataaaagaaagtcgaccatcttcagcagatgtggtgttaactgaagaaatcggtcaacttacactagcaaagtgagacatgtgtttaatagttgtctgcattttctattgtgtaatggggtagagaactatggttttattcatgttaaagagaaaaaaataaagttatatctgtggagtatttttctccctccccccctcccttcccctcccctcccttcccctcccctctccccttccccctcccctcccctcccctcccctctcctctcctctcttttcttttctcttttcataaagctacattttggcctgatttcccatgaccctaggcttctctgactcatgcagtttctatcctccatgtgttagaacttcccctgaaattacttatacatacatgctaacaaaatacccttcataacaatcaactgaatgaaaagaagtgtttactttcacacagaactgattttattagttagtgaatattgttaaaggaattgcaggttggcatttgaggaattcatgtcatatcacatgtagcaaaagtaacaccagaacaagccaaaacagaagttaaaagtaaaacatggtctctcttccccagtaattattacaataatgactgatatggtttggctcaaatctcaacttgaattgtagttcccataatccccacatatcatggggggaccctgtgggaggtaattgaatcatgtgggtggttaccttcatgctgttcatgtgatactgagtgagttcttacaagatctgatggttttacaaggggctttacccccatttcgctctgcacttctccttgttgctgccacgtgaagaaggatgtgtttgcttccccttctgccatgattgtaagtttcctgaggcttccccagccctgcggaactgtgagtcaattaaacctctttcctttataaattacacagtctcgggtatatccttatagcagcgtgagagagaactaatacaatgatttcagaaactgaacttgaaacttgttttggctaccttctactttttaattcagtgcctggttttacttttccctggataaaacaaattcttttctgttttttatgctaagtaacttggttattctcaaggactatgcaaaatgtgcatatgtgaaacctctaatgcactgggaaaaaaagggagtaatatggagagcattccatataacaagattcttcccacttaacacacattttgttcctgttacattagaaataatagtaaagatagaaaacaacacatactagcattaacagactcctgttccagcactcattctaaaataaaagagctttaacctaaagagttagtctttacctagacacaattggacaatacagtgcatgttgtgtgaaactggattataactcattagctcattcaagcagagaaactcatagttgatacctaagatgactatgttccaccaaataattcaagaaactaagtgtggtataaaattattattgtgataaccgaaacctagactcaaaaataattacttgttataaaatgttaaattttgcaggaaatgaatttaatattgaaattaagttttctataaaacagtatccaacatattttacaatttgggtgttttgatcaatcagacaaaatgatggttggcatggagttaaaatacaatttctcatcagtttcaatatgtgtacaataggaaccactgaaaaataaaatatactgatcataatataaacatcttttgatgattcagtgtatctaaaaccttcaatgtaagatgaagtttatcaatattacagcactaatgaaatatccatgtttataaacctttttattgaagaaaattggcaaaaggtgtatttgaaatttattttgattgttattattcaaggagagtttgcaataatgaggcagatattaaaatataattgaaattctggattttttaaattattcagaaattaataatacatttatttttactatatattttaatattgaatcttccttgaattaaatttattagtgatattaccacaatgcatttgatagttattggaataatttcccttttattcttatatctaccacatactcatgattatgatagtacactggggttactctcaaggaaagtaatatctggcgataatttagttgaatttgcaatactatcagtgagatacacgatttgatgaaaataagaggagagggatgttcccattgccctcgctctgtcagtttggtagttcttgcagagttagaccagctacagtattcaccagttttgctaccagtaaaaaattgcttgatttggaaaagagagtggaaaaaccagattcccctgggctttgtcagaaacagttgcattatcagtgtcaaatgaatttggaaggctaaagtctaagcacgcttgaggttgcaattttggttggggcaagcaataggctgacagactaatgagaattttagcaggaaaatgagggcaatgaaacaaccacagcagccttgttaagctcatgcgtaccctggctgtctgcatgcaaactcagaagagaacaaaaaatgacctagcaattaacacatgctttcaaatatgaggttttatgcacatgcacaggaggcatggagtgaacctgggagaaagtgaatctagggcagaattgtaaaccacctaaggttgtttggtttttggagttttcatagttatcaactactacacagatacatggacaaaagatggaggccatactcaaaatgatccctaggtaatgcagaccagaagctacgcttaggaaagagcaggcttaaaacagacacacacacacacacacacacacacacacacacacacacacacacacacacaccaaaactaaaatagatatcagtggctatcacagtgcagacagtctgtatagaactattctgacaaattgctaaataaggaagaaaacaaatcaaatagcaacagcaacagcagcatcacctaatgagaatcagaatccatagttttaatacacattatcaaaaatactcacttttcaacaagaacaaaggtattggatgtgcaaagaaacaggagatttgtaacatactcaaagaaaaaaaaagataatggaaactgccaaggcagggaggacataagtggctattataaatatagatgaggaaataagggatataatggtttaaaatataataaaataacattgaaaatgggagtttttaagaaaaaaattttgaaaatgaaccaatgaaaattatgtctttgaaaagcaaaatatatttaaaaagccaaagcatttttgaaatgacagaaaaatcagtgagcctaatgattgatgtatataaattgttctagttgaagaacagaaaaataaaaccaagatgcctagagaattgagactagagaattaagaaaaactatcaagtatgccaacataaaagtaatgagataatcaagagatgagaaatgaaagaaaaatatttcaataaacaatggccccaaattctgaaatttaatgaagaacattagtccataagtccaagaaacttaagaaactctaagtaggataaacagaaagcaattcacatcaagactacacacaccagagtcaaatttctgaaaactgtaaacaaaataatattttgtactatgaaagaaaaaaatggacacatctagcaaaagaacacaataataagattgataagtgatttcttatttttaaaataatgaaggccaaaatgtataataagatatattcaaaatgtaactgtataaatatttcattcacaagacagaaagaaccatactaaattaaacaaaaaacaaaaacaagttccaagtttctgagatctaaaagggatataatttagattaaaagacacaaataggccaggtgtggtggctcacacctgtaatcccagcactttgggaggccgaggcgggtggatcaccaaaggtcaggagtttgagaccagcctgctcaacatagtgaaaccccgtctctattgaaaacacaaaaattagccaagtgtgatggtgggcgcctgtagtcccagctacttgagaggctaaggcaagagaatctcttgaacccaggaggcagagattgcagtgagccgagatcatgccactgcactccagtctgggtgacacagtgagagtttgtctcaaaaataaataaaaaataaaataaaagacacaattagattaaaagcaaaaggatagagaaatatatactatgcaaacaatagaagagctacaatgactacactattctcaggaaaaaaatagattttaatataagaatattattagggacaaagaaggatgctttataatgataaaatcataaattcatcagaaagttatagcaattataaacatttactcaatgtacagcagagtcacaaagcacatgaagtaatactaacagaattaaagggacaaagagacaatttaacaataataagcatttcaatattccattctcaataatggacagaacagctagatagaaatttagcaagggtctgggagacttaagcagcactatttaacagacatttggagaaaactcaacatactaaaaactgaataaacaattttctgagcacacatgggagactctccagtacaggttatatactggaccatgaaacaagtctttatacattttaaaagtttgaaataataccaaacatactgtcaggcatatatagaattagaagggatcgaaatcatgggtagtactaaaccctatatatattttgatttttcctatacacatacctacaataaagtgtaattgatgcttaggcacaacaagagatttacaacaataatttataataaaatagaacaattataagagcatactataataaaatttatgtgaatgtgatctctctctctctccctctctctctctctctctctctctctgaaaatcatattttcagtccaacaactgtggaaagcataaccatacatgggggaactactgtaccatataatccagcaattccactattgggtctatattcaaaggaaattaaatcagtatattgaagagatatcttcactgctatcttcattacagcactatttacaatagccaaggtgtggaaacaacataagtgtccaccagggatgaatgagtttttaaaaatgtagtatatagacgcaatgtaatacgatttagcccaaaaaaagaagagatgcctatcatttgcagcaacataaatgaacctggaggaatttatgctatgtgaaataagccaaagagtcaaacctgtggaagtagagaatagaacggtggttttcaggggtaagtagtgggtacaggaatactgggtaggtgttgattaaggaataatgaattgacattagataggaggaataagtccaagcgatctattataaaacatactacatatagttaataagattggactgtatatttgaacattgccaagacattaaattttaaatattctccccctcaaaatagtgataaatatgtgaggtaatgcatacattagttagctagatttagccatctcacaatgtatacatatttaataacagcatgttatacagaataaaaatatataatttctatttgccaattaaaaaataaataaaagaaatctgaaaaagggcaaactaaacacaaaataagcagaagtagtaataaaaattagagcaaaaattaataaagtagaaaacaaaatataaagagaaaacaacgaatgcaaatatagttctttgaaatgatttttaaaaagtaggtaaatatttagctaaactgaccatgtagaaaaagaaagaaaacaaaaattaccaaaattagaaatgtgagagaagatatacaaaaatttaaaaggctaataaaagaacattgttaattactggtttcatccattaatacagtacaaatatttaaatgtcaaaaattaaaatttgtataatacatataatgtatatatgaataattatgttttgttttttagacttttatttgtttcgttgactgcgtgcactttgggttttgcaatttttctatgttggcctcatgtatatgtatctgtattaatatattatttctattgggcatagtatgtatatggtcatacatataaacgttcatacatgatttcactatattttaaggaagtaaactcttggcaatttgttgcaatattttttctcagactgattattattggctttataaacacatttaggttttattagacacacatattttcaggatttatttgcattccattttaccaatctttttgtttaaaatatttgtattttatgtcaagtaccaaagactttcctaggtcacacttgaaagtatacattatctttttttattaatattaatatgtttgtgtctaacacattacatctttactacttttagaatttatggacatattaatattttcaagatttactgctttgcttttggttttcattccttgcttgtctctctcccctgtccccctgctttttttattcctagtctaatttactgattggcttctggccaattcacttttttgcctattctagtaaagtacttaaattagtcaaatcattaaatttacctgggtgggcaaatatagtacatctaaaatgcagatttataatgtttagacacactgaacaaaaatacatagactgattccctccttagatgcttcctcaatttattctttgatcaaaattatgttctgcatctcagatgtttctcaattccctaggtttttcattaaaaaattaacatatatatgtagatatatgtacatatacagattgatatattttcacataagaaatcatctttcttatttttaagaccaactcatgcataattaaaattcaccattaggaaaattattataaatttactaatctaaacataattaaagtcattatgaaagctagcagtatcctatgccatgtaatgagaaacaattttggttttcctttccatttggtgactaatgttaataattcatttatttttaatttgtacagctttttccctttggctctgacatttttagttactaattaggaattaatgtaaggtgtgtggggacttaataaggactttcataatgttgatgaatacatatttgctaggaaattagttaatattattctagccacagtgtgaatacaatctgcgtaatccacacattgccctcatgtagacacagtcctgatacttgtttccattgtttctttaaaactcagtgaatctgtgttatcaaagataatttattttcaagttacacacaataccacacttcagaaattaaatagatgagtgagcatcactgttcaggtagttcttcagatggcaattttaaaaattttttgtgggtacagagtaggtgtatgtattttgtgggtacatgagatgttttgatacagtcatgaaatatgaaataagaacatcatggagaatgggttatccgtctcctcaagcatttattctttgatttcagatggcaatattttaaagaattgaatcaagatttttttagagtaccgtatatttttcaaaatagcatttataactaatatagtctccacaaacattaacttatcacctttaaatgtatagcctctaattagctatcatgttagcataaatgtgattttcttctattttaatataaattgattttccttaaaacagaaccttatgttactactttattttaaaattaagaaatataaaaattgttcatgttttaataaaatttctgaatacttatgagtaacttaatttgatagtgattaaagttcgaaaaaagccatttcatatttgcactttatacatttatgaattcatacaaatttaaaatagtgttgttttattgctcttatagttttagatcactaaagatcatctacataaaaagaaatgtatatttattaaattacattttattgtcctacttaatttgtaaacagaaaatgaaacctgagagtatgtctcagtatatgatttggatttgtcatgatggtgactggtatgctttaacaaacagaatctaactcctacttattgggaagtagggcaaccacacttcaagatttaatcattttaattataatattattttagcaacattcgttcacttgaaaaaatggataattgtatacgtttggagatattaatgcatatacaagggtttgtgttttatatcagtttacatatataaatcaatattttataatatctctatttgagtgcctatgtgtgtttttgtgcatgtgtgtgtgttgcgtgcaaacttatatttgtattaggcagctatagtcatctgggaagcctcccagaagacatattaaatattccttaataaataagtatgagaaaatcctttgaggggatctttatatgccttcaaaattcttgaaaaaaaggaagaatccactgaaaattatgccaattagaataataattaaagtgactggaacttctctttttcttactttcatttagaatgatgcaaactattatcaaaagtagccattttattcagtgccatatgattttgtacataagatatgttgttatgcacagcgactcccatgctatactataaacaaggttattgagtttgcatactgaatgtcataatgcatgtgcctttggctttggaatttctttttacactaaactcaaagtattaagatcactacactttgaaaaatatataagatttcattttttaaaaaagaagcaaatgcaataggtaaagtgaaacaaccctgataatctcagtacaaatgtcattggccaagaaaatgcagagcaaatgatatgtcaacaaatccactgaaaaagattttcttttaagaaaatccagagactttactcaggtaaatagttacaagctagggagaagcagccgctatacaaaacaaagagagaacaaagagaggggttacaagagagaggttaccttttacagagaaatgttccacccaggttttcactccggttcacttatgcaaatacaggatgcaacctgcttaattatcattggttaatgctttctgagttctgattggtcaaaacttgctgatttctgagtgactgattcaggtcaaagtctattggctaattcagggacataaacagaaaaggacagttataaaaatctccaagttaaccaagtggggggattttccagaaatgcagagcagtgtgttacctctagtcaacaaatgattgctttgctcatttaggcccagttaatcacttaggatctatcttgaaaaattggctctttgagggttcacaggaataacaattaaatctacaaagaaattaaaactggctagggatgtagaatgatcatgcttcatagttttaatcttttctttttttgtctaggcataattattagaagagtctctcttactttcaaaagtgtgctagtttgaaagacatgttctgtgattctcctatatattctgtgacccaaaatatctgagacaggtctcagtcaatttagaaagtttattttgccagggttaatgatgtgccagtgatacatcttcagaaggtcctgatgacatgtgctgaaggtggtcagggtacagcttgcttttatacattttagggtgacatgagacatcaatcaatatgtataaaaagtgcattggttggtctggtagggcaggacaactcaaactgggggcttccaggttagaagtacataagcgacaaaaggttgcacttttgagttcttgatcagccttccactgaatacacaatttagggtgactcaaggagtctgcatttttacataaaccatagggcagaggaaggaatcagctatgcatttgtctcaggtgagcctcagagggatgaatttgagttctgtctgtccttttttcacaaggaatttccttgggtgaattgtgagggaggtatgtagcttatcattgtagctatcttgtttagaaataaaataggagccaggtttgcctgacatagttgccagcttgacttttcccttggcttagtaatttgggagtccaaagatttattttcctttcacagctgttatcaccaatttctggataataaaataaatagtaattagcctcataatgtactatgtttactgttctagtattcagacatttatttcagagatttatttcagagattaggtttttccatatttatttagagagtcattttcattctacaattataattgtttttcttcttacatgaaggctgtatattgaaggagattatggtaggatagacaagagttggataaacacagtcactgaaaatgacctctggttaaaatgaatgttggaaaaaatttttaaatcattttgataaacttttaattcacctttatagctagtaaaattgagaagtccacagtgcttacaaagatttccaaagaatgttaaggaatgactagaaattatattgtattatatggagtaaatttaacattgttagggagaaaaaaaatctggggcatgcatctttcttcagggacttagtagaaaacattatcttattagaaatgtggttgataaagaaattaacatataggtggaaaaataaagttagatggtattaaaattaaatatggtagagtaaaagagatttgtacatatctatagccttctgagaaagaaggaattaatacaattaggtgtaaagattgcctccaaacaggagagagccttcctactgtgacatggagaaaaggatgagagaacaggcatggttatataaattgtgtaattgcaacacagtgggttttaggaaatttacgtaggtaatgttttctattttgtctagaaaatgagaagccaggcattctgtttttatgaaagaatataagtttaataagatagtgccaaaaataggaataattgttcaagggtacgaaaggaaactggtaattgagaacaagtaaaccaattaatgggtggattgaaataaacttttatgttggttttagataattacagtaaatgttagcatgctttgggactggctacatagaattgactattttcctaaaagcagaaattatttttcttgattagtcaataaaacctcatgttcctgaagtaatatgtgaataaattttatatcatccatgttaaatggtaatagttaaaaagttgtaaaaacatgaacacaattttaaaattatttttctctttttgctatgttggaatagtcctatataatacttgtacattgttaatataggtattaattgttttgccttaagatctgaggaaaaaaattagttattttttaaaaattatctgctgctacaatataatatattagatccaatttaaactgcatctgcctttaaacatagcttgtttatttgaaagctttttctttactgctgtcattttgtattaggaggggaggtgcattaatttaagagcaaatccttttgttctgtcgctttcatgctccacgtccaaaatctcaacctgtggattacaacgatttccccctccctcagaatgttttcttgtaacacaaaaaaggaaatgcaaatgaaattcgaaatgtctagctgtttaaaaaccaaaaagaaacagtttgcttcagctcaaaacatatgtgttgtccttgagtgaggattagggcaattaattttggttgtttcccttacctgaaaaatcaatcaagcagtgatgatatcatcaggtacatcaaaggttttaaagaaaacacagtaagcaagacttaattattgcactcacacacagggggtgcactctaggagcctaaactataaggcagattaattttctttccctatagcaattgctatagcaacaaaatcaaattgtatgttagaacaaaaatctacaaacttttagggcaaacagttgatacattgcacttgcaatttttagcatgaaaggatagccacccaaacaaagtgttgaatgattagttccacaaaaggtctagtttaatgtacattgaatagatctctgattgttttaaaaggggagaatcttggaaatatctttgttaatgtgcatcatgcaagtcattgctgaggatagtatttcttctatataacagagtacaataaaaccttctctccagagttaatgagattttgtagacaggactttttaagtaaggagttctcctcttataaaaagcttagtctagcaaaatagagtaattcaaattttactttgtattttatgacgattttggcttttataatttttatgtatgcaatatataaaattaattgaagcaagaatgtctgttatatgattcattttatgtgatgcagttatacatataaataatagactattgtaatatggcacaatggaaattctctagcatatttgtagagatgaaaaattagtattattgccattttatgtaatatatttctaatttctcttacttttatacataattgttgttaaaatgttaaatatataatttttatattgatacatttttaggacaaaaattgaattttgtagtaataagcagtcttggtgtctgtgcttttgggtcaaaactgatggactttggaaaccaactatgtttgaataatataggttctctcttaatgaaagctcttttcactgacaataaatggttgcatcttaaaaaaggttctcattaaatataaataaataagaattttgcatgtagtattttattagataattgataaaattttcaaataattgcatgtgatttgttataagtagccagatctgacttttcaaacatttatatatttctttcattcttcctatagacttcaatttttctttctttgggataaccttcacattgtatagcacttacatagtttgaattaaattcatcccacttcagatctaaggggggccctcattagcctacgaaaataactattaatccacaatccttgtcacccaggcaatccatggtttgttcctgaacagagcaactagattagataagaatgcctgtatctatttgatgccatttcagcaaataccaggatttctggtattcgttattttttaaaattactgattggataaaatcattgtccttcataccccgccccctgttttcatggatgagcaaagaagtaatgcctctgtcttggttataccttgtaataagtatgggctcgctactgaataaagctgccatatttacaaagtgtagatagaaaacagtaacaccctgggaaatgaaagcattgaatcattcagaacatttcagaagcctggaaagtttttaagcttttcaaatatcttaattctaagtgttttagcaacatgtgccagtaaatcctacttatttaatgtcatttgagttaggttttgtgttatttaaaatgtataatcctcactaatatagactgttcttaactattgattaaattctccaatttaaaattttaaaaaacccttagactccatatgtcatcatgacatgctatatacaaataaagcaagaatacataaaattgaacacttgactaacacttaacatttatttatttcaaagtgactaccttctaagaatatttttagattataaagaagttagattattgaaataaactgcaggcacaaaacattttactcgttgcaaattggtatgaccactcagcaactctactattggcaagagtattaacacatttaaatgtatgctttaatttgtttataaaatcagcttgtcaacaaaattacattaggtaaatgccaaactataccccgtccaattttgccactctcagagaaatacgctattaataatctgaaaaaaagtaccagatgatttaaaatgcacatatgaattgttattaatattagagcttattatatgcaggtagttttaggcactgtgactacctatgagtaaaacagacagtagttcttgccttattggaactcactagccactaataattcagatatttaaaaatgagcaacattgcatgtaattatgtaatgacatagtgctttaaagaagagactggtaacataaagaacataattagtcgcttctctggaagatgggagtcaaggctttttcctgaagatattatctaggcagcaatctgtgtgataaatagtcattagagtcatggagtaggtgtggaggagtataacgggcagagatcaacatggtggggacacttgtgttaacaaaaagagaataatagcttcccttaatcaggaaaatgaaagaaagtaattaaagagagagcttagtaagtagttaccaagagagttgtgcaaaatgagacctgagaagtgggcaggaggcagatcatataaaggctcacagcttccttagttgtttttgcattttcttacaaatccaccataaatttattaaaagactttaagcaattgggtgctgaggatcaagtaaaaacatgaagtcattcattagcctattggttagtaagtagatttaaagagattagcagataaagaaaaaaaaaaaatcccaaacccaacccaaacaaaaacctgttaaaaggcttcttacaaggcattaatcaagtgccatagcttaaaataagtactggtggttgaacagaaattaaatgtgtgtgtgtgtgtgtgtgtgtgtgtgtgtgtgtgtggtgaaaacacagctaagtagaattgctgagtcacatgatatgtgtatgtataactttattaaaaattgacaaactattttcctgatgtggtgattggttcaatattagatgagagagagagatttgaagatgaaatttctgtttctgcaatgtaactttgggtagcagatagtgttcttttctgagtgagagaagagaggagcaagttcataaatggggagtgtagattgaaaattgggagttcatatgttctatttgaatgattatgagacacatcagtcccgtaacacccagagatgttaaacaggtaatttgatatttaggtatggaatttagaaactatatctcagaggaatttggagacagcctttatgttacttaggtaataaactcatatcactactttacactatggttaatattatttttctaattaacgtacagtaaaattgactttatgatataattgtataaatttttacatgtgtgtaatttcattaaccaccaccataatcaagatagagaaagaacggtttcctcatctgaaaggcactctcttgttatcccttagtagccacacacttgccctattcctaattcctgacaggcactgatctgctatgtcattatggttttctctgtttcagaaaatcatataaatggaatcacaataagtaaccttttgaaactagcttcttatacttagcctttaatgtccatccaagctgttgtcgtctacatcaacagaacctgtcttaggcaagtgtcttggtgcatctaaagctaaatataccttttttaactctattacttcattgtatgaattcactgcagtttatccatttaccatctgagggacacttgagttgtttccaacttttcaatcttgtaaacataacttctgaaaacacttgtgtgcaagtttttctataaacacaacttttcaattctctagggtgaatctgacaagtagaattgctgagtcacatgatatgtgtatgtataactttattaaaaatttgcaaaccattttcctgagttgctgtaagtgttgccacccagtaagctctgtgtgtaagttccatttcctttgcatcctcactagcacttgatactatcacagttcttatttttaagcccttctaataactgtgttgcagaatcgcactgtgaatttacttccctagtggagaaatgcatttctttgccttccacatatacacacaccttctttgattaaggtctgttcacgtgctttgcctcgactcttcccagcattttcccattggattgctagttagttcttcaccatttatttttgagtcatcttaatttttggtgggtgcaagttccttttcagatatgtaacaggaaaataattttatccactctaaagcttatctcttcattcttttaatagattcttcacataaaaaggtttaaatttttggtcaattttaatttatatatttgtgatttatgatttgtctattgatgtcatgtttatgaattctttgcctaacctctgatcataaaaaagtctcctatgatctcttctaacatttttataattttatgttttatctttatatctattatttttgtggttgatttttgtaaaaagtatgagagtgctattaagtttcaaatgcatacacatagatgtccacttgttccaacatcatgctgttattaaaggtgaccacctcagtagtcttttgttttcaaaccttggtcataaatcaatagtcatctttgagtggcagtctcagaaatctttgttttgttctattgatctatatgtctctcccttcatcaatactacgctatcttgtttagtgtagcattatattccgttataaattcaaatagttataaattcttttattttaaaactactttgctattttagtatctctgcttttctattaaataagttagaatcagcttgcctgtacttacaatgtaatcctgcttggattttggttgatattgtgtttaagtctgtagaccaatttgagaggattgacgtctttactatgttgaatatttgaatcaatcaataagctcagactctctacaaatttatatcttttatttatttcttttattattttaaaaatgtacttaagtatttttaaaaataaaactttttaactatttaagttggctggctcaaatggtatttttaggctggattctcattggtcactgttagtatataggaatattattaatatgtgtacgttaaattgttgaactggttttctataattttaatgaacttattagttctgggagtttctttctatatttctagtgttttctttgtagctaatattttctataaatagaaacagtttttttcttcctttccaattgttatgtgttttacttatttttcttgtcattttatacacttgaagtttcagtatatcagtataacattgaatagtattgatgtgaggaattggttcatttaatctaagttgtcaaatacatttgcatagagctgtctgtaacattccttctattctatgtttttaagatggggtctcactatgttacccaggctgaagtgcagtggcttttcacaagaacagtcccactcctgatcattatgagagttttgacttgctctgctttcaatctgaggcttcactccttcttaggcaacctggtggtatattaatgtcaaatttagaacagacattggatcagcatagagcattacaggccagaactcctggactccaaccattctcctcctgcctcaatcccccaaatagttggggttacaggcatgtgctgccactcccgattccttaaaatacttttaactcttatgatgcctgtagtgacatcctcactatcattcttgatattggttatgtgtatatttctttttcagtcagtctttctagaagtttatcaaatttattcataaaataaccatttagtttcattcatttttctctactgctttctgttttcaatttcatcaatttccgtgtcttgtttgtcttcctcttttcttcttttggtatttctttaggttgaatataacatcactcttaggagaccttttatcttttcttttataatcacttaatggtatatattttcctcaaaatcatagtttagcagaattctacagtttgatatgttgggtttttattttcatccaattcaaaatattttctaatttgccttagaaatgttcctttttgaactgttaataatttagaagtgggttatataattccaagtaattagcttattttcatctttcctgaatgtcatttatgaataagtttgtgtctctcaccaaatatagggtgtttttagcccttaattgcttaacctttttttttgcaacacatttctttctccttcttggagttcagtgaaactaaagttagatattttgttattgccccacatgtctctaatgctctaattatttttcaatcttttgtctctctacttgttgaaattttttcttttaaatacttttaagcaactattacctaattatctcaattctgtgttacgcaacctgttagatatttttatacttattatattttcagttctattttatatacgtatatctttgtgctgagattattttcctctgtatttacttcaagagtcttctccagtaatattttgacatttttataaatagctatgtttaagctatttataaaattccaacatcagcattgtcttgtcattcatgtctgctgattttcttttgtgatatatgtaaagattttcttggttcttgttttggtatgcatttttggttttaccatgtgcacttagaatattgtgatatgaggttctgatccttatttagtttctatggaaaatgttgacatttttgttttatcaggcagtctacatggttgtatttagctggcactttctttccagggttttctgatgtttggtttcaatgtttaagtttcaaaaactttgaagtgctattctgacctattccacatgtgcatcagtcagtagctactttggggactgagcactggtttgtctcttagtttagtatttaaagtaattttgtgcttttttagaagtagatttacacatgctccgttgggagtgaatccaagagtttattttccctaggtcttctctctccgtcatcttcctgatactatttaaaaccttttttaggtccttcagctaaaaatgtgcggccttattcagcccctcctcaactagcacacaattttctttatcacaccttcatcctggaacaaacagcaggaagacacaaagagaaaaacttcaataggctttgtactaatttcaggcagtacagctttttcagctgaggaggattttccctctaaatcacagttttccgttctacacattcttattgccactttcaccattgccagaagaatccttttctccaaccatgagcctgaaccagaggttacttctggcactctctctaactgttgtgatgtccatttccaagattttggattgccttgagatcatgttgaggaatactggtgagggtggttggctggggaggaaactcactgctacttagtgacagtgatatttctttttttttgagacggagttttgctcttgttgcccaggctggagtgcaatgatgcgatctcacctcatcacaacctctgcctcccgggttcaagcgattctcctgcctcagcctcccgagtagctgggattacaggcatgcgccaccacgtctggctaattttgtatttttagtagagacggcatttctccatgttggtcagactggtcttggactcctgatctcaggtgatccacctgcctcggccttccaaagtgctgggattacaggcatgagccaccatgcccggcccatgatgatatttcaaattctgatcttttcaaccagcctgccactctgctttacagtccttacatagctcccccacgtgctgtgtttaggatttttatctgcattcagtgggagagaagggatgtactgtgtttacttgatcttaaaggttccctaacttagaacctacctaattagtatatttttacagcatcactaagcatgctagtttgatatgggagtctctgtgtcagggattaaaacaaaacagccttaattataaatatgcagactcatggatgtattctatatattctacattatacaaagccctgaagataatttagtacttgtttgtgagagaatatagacttaatggggatccgaacaacacagcacccaggctcactcaggtatgtcctagcatcatcaatttggaattatttggaaatgagtttttaatagccgctatttctaatcctgaatatatgcactgctgaaggatttatcctgaacataattctccaaataaatttcaaccttaacatcctgaagttcaaggaaaacacagccacctgggtgagagtataggctaacaaaaatgccccatgtaatgctcagtttatgaaaggcatagtagtaatagcaggaataaacggcttaggaaccattctaaaatatttgaatagctagaattctccaatgtggaaatttaaatctaaaataaaatagtattaaaatactatactaatattatattttaaaaagaaatgatgcgggctatgtttgtcataatataaccccatccctaaggcagtaagagatactaaacttaaccaagtatctataattcccatgagtagttattatcttatgacaaccatgcactagattcactttgcttctataatagatgtctgtattgtgatagaaaatgtagcataattttctagaagataaaatcagtttgacagcagtctcagtttgtttcacatgaaataatctaacatgtaaaatattttctagccaactaggttactgcttttaaattttctcatttataagtcagcaacactttggagacataaaaacctgccactgggcttaattcatggggctctgtgaactattaacgcatagttgacaagacactcactttaatgctttatgatatgtgtcatttgacaaaattgtacagtacaatgagaagctaaaataagcaaaccatcaattagttatttgtctttggagaataaaataggtgtttcatcctaaaggtcatacaattttgcttttatagtaatattctgtaaagtttttcattatttttggattatgtgaggattcctatttctaaattctaatttattttataaagtttgaggggatgtgtatttggtttaggaaaactgataaggctttaggtatttcaaactgccagggatgtaatatagggaattacagtcttaaaataatgtcagaaacgttggggtaagaaggtcaaggaatccataaccactgttcaactaatcaggaagtgcagatatcaccaggagccactgaataagatgagctgcctgcagtctccagctgggggatttgaagaagatgcccataagctaccagcaaaacctcacatctgtcatctgtcaaagccaatgtgcttactcactacggctgcaggggcaaacctggcttctatttcactttccaattctttacacaagtgtcttttaacggcagaatttaaactggaaactttcaggcaaaacagctttccagcccctgtaatatagtaaaatgcttataaaggaggaaattgtcatgagtacaaacaggcaataacatgccactcagcatttctaaatacccttccactcataattaaacgtaaaagaagattagtactgtctcaaatctttgcttattgtactagtttcctggggctcctgtaacaaagtataacaaactgggttgcttaaacaacagaaattcattgtttcatagttctggaggctaaaatttcaagatggaggctcagcatgcttgtttccttctgagagctgtgaaggagaatttgttccatgcctctccctatggtctccatataaataaaggtttcataagtcagcagaaggaagggttgtcagagcactttcgcaaaggacacacatctgtgtccaatgtatatgtctttttcagtgaaacaaaatcatctatgatgaaagccatctacaataagtccctgccacctatatgactgctcctctaagaaatgacaccattttggaccttcggcattgatctctgcttttggatattggaatcacttcagcctttgagaagaaaaatgtattcagttgaatctatacaaatacttccactcctaacaacataatgactttgtttttgagtttactgagcataggctaggatacagagaaagaggctgactgacttccacaaaataagtcatctttctcacctgattgtcgatggcctcatcattgttgagtgtacattcagatgggacactaattacttatgcagttcatttaccaagatgcacaatgcaatcctctagtcttgttttctctaaatctccagtcatttagccaaattattagccacttcaaatgaagcaatgtcaagccacctccttgaacagttcctctttaggaaaaatggacatcagatatacattttagagtctcctctttagaagggttcagtttctcactgccttttacaccaattatagatcaaagactttctagattagtgcagcagttcacttctagatgctaacagtttaagtggattccaaaaaatccctgaaaatagagatatctcttttctttggtatttcttttggtaattttattgttgtaattgttctagtggtaaattttatgctaataatataataaaataaatcatttctatactataataaaataagtcatttatatattatatgctgccacatatgtgattgcttccctgagaaatgtatataacatattcatatatatatatatatatatatatatatatatatatatcttctgtcaatttctttaatttttagatatgaaagtacttttttttatactttaagttttagggtacatgtgcacaacatgcaggtttgttacatatgtatacatgtgccatgttagtgtgctgcacccattaacttgtcatttaacattaggtatatctcctaatgctatccctccccgcttcccccaccccacaacaggccccgatgtgtgatgttccccttcctgtgtccatgtgttctcattgttcaattcccacctatgagtgagaacatgcggtgtttgaaagtaaatttaatcttaagatttttctccatttcttaaaagtgtgttttttataaaacttttattttagttttagggacacatgtgtaggtttgttatatatgtaaatagaatgttgcagggatttggtgtacaaattatttcagaactcaggtaataaaaagtcatccgttctcaattaattggattttgtaaataaattggaacccattagaagacttcttcctcatctttttttgctttaataatatctgaattgagaattatttggacaatgtgttctgtttattcttagtcttttgtgtttcaaacagacttttactcaggcatgtccaagtttatacttcctatttttatttcccatacatctgagtgtcagcctatttccaaattgttcctgagtttcccaaatgttttcacatatatgaagaatgtttaaaaagatgcacaagttctcttgaagaaacacaagagccttctttcataaacagctggatatgggttgtagtaaacatttccttttatgtatagatatttgaatatgttgaataaaccttttataagccactacattcccagaacccccagtcctatgggtatcaattaaattgtattgaaatttgggatatttacattgtgtattgaattgcatgtaaaaaagtagacacagcaacactaaaaacaaaatatgatgagtaaaaagcacaaaattagatgtagcaacaaatccaaatatatcactaatccagaaaaatggataagagatgaatatgttaggttaaatgaagaggttgtaatcttgcattagataacagcattatttatatctgtttacaagaaacaaattcaaaacttaaaggaagtttatgggatggaataactttgacaaataattaacaactattggtatacacaaaaatttttaaataaagtttaaaaagtgaactcacagaatatttcaggccaatattttaggccaatttaacaaaagataaaaaatatgccaaagcacagtacaatcgatgattttttcttatagcatataaagcaaaaatttcagaatttcagcccaggcaacaattggttattatacatcattttctattaccaacaaataaaaaatattgtatgtaatagctcacaaaatctgcctatatattagaaaggcaaaagtctgccttctaatattatttgtagtcaataataatacaatcaaaaccctataaatttaaaaaaatattaaatcacaataaaattgactggctaaaaatgtaagtggcataaatacaaaaatatttacatttgaaaacaatctttgtatatttaagcatttgaaattctaattagttacagtttttaggctaaacatttccatttgtgatcttgaaaattaaaatcattcccccagaggctggcatactaacctgggtccaactatggagcttgaagcagccctataacccacaactagcccttcatagctatggtccaggatcagtcttttctgctcaggaaccagtactaggcatgcctgtccatgccacagaggcaggcatgcagactgctgtcttggctatggaacctgaagcagccctgtgacttagatccagcccttctcatttgcagtctagggtcagtcagccttctcagagacccatctagtgacccaataggagccgctccatggctgtggcagaagcctaacccattcatgcacctggtaacaagcatgcagtatgcaaacctaactggagactctgaaacagaacattgccctgttgtcaaccctagtgaccagggttctagagtcaattttatgtgctcagggacaaaaagaattcatgctggcctaagcccatgataacaggctaccccatgtgtggatctcactgtgcacccaacagcagccatgtaatcaatctccaaccctgattgactgtaatcctggagaaaagtccataagtctttggactcaacaagagaagaactttacctgctgaaattactatttaaagactgaaagaggtgttagctccttccaatgcacagatgcacatatctcaacaaaagcctccatgtatcattcacaatcaggccaacacaacaccataaatggtcaccaataaagccacagtaaccacccctccaaaaaatggagatctatggattgtctgaataagaattcaaaataaatcttaaagaagctcagtgaaaatgaatagtttacaaacaaaatgaatagttactaagaaaattaaaaccatgaaaaagaaacaaacagttatcttggactcgaagaatacaataaatgaaaacttaaatagcttaactgcaaaattaattaaacagaagaaataatcagtcaacttaaagacagatatatttaaaattagccagttagaacaaactaagtccaaagttagtaagaagaaaaaaagaataatactaataatcagagcagtaatatagaataggcactaccaagacaatagaaaagataaaaaagtaagttatttttaaaaataaacaaaactaaaaaaaatttagttagagtaaccaagaaaacaagagagcactcagatgaataaaattaaatctgaaagatgagctattacaagtgataccacagaaatgcaaagaatctcaagactagtgtgaacaattacacaccatcaaattgaataacttaacagaaatgaataaattcctagaaacaaacaacctaccaaaactgaatcttgaagaagttgaaaatataagcagtccagtaataagaatatccaagtagtaatcaaaatatctccaaagaaaaatctagaaccagttggcttcggagattgattgtaccaagcatttagagaagaattcatgctaatccttctaggacttttctttaaaaattgtaaaaaagaaacacttccaaactaatttaatgaggtcagtattatccttatgctaaaaccaggaaagaacactacaagaaaataaaatacacatgaatatctttgatgagcatagatgcaaaaatcttcaacaaaatatgagcaaactgaattcaacaacatgtttaaagtatcatacaccaggatttgttcttgaagtgaaataatggttcagcatacgtggatcaataaatgtgatccgctatgttaacagtataaagaataaaaacgtcatacaataatctcaacagatgcagaaaaatcatctaatatcttctcatgatgaaactgtgaaaaaattaagtattgaaggaatgtacctcaacacaacaaaggccatacatgtcaatctcgcagcttaccgcttgctcaagctgaaagcttttcctctaagataatgaacaagaaaaacatgcacactctcatgatttctattcaacatagtactggaagtagtagcaagagtaatcaaacaagagaaagaaataaaaggtatccaaattggaaagaaaaaatgaaatttccctgtttgcatacaacataatctcatgtatagtaaaattgaaagactgcaccaaaaaacaactgtaaacactaataaaatattcattaaagttgcaagatgcaaaatcaatctttaagaaaacagttgcatttaggacccactattgaaaacaaaatgttataaatatctcatttacaattgcaccagaaacaaaagatagtgaggaataaatttaaccaaggaaattaatggttggcacactgaaaactgtgaagcattgatgaaaaaaataagacacaaatgaatgaaaagatatcacatgttcatgaattaaaacaattatacttgttaaaatgcttatactacccaaagcaatctacagattcaatgcaattccaacaaaattcccgtggcatcttttacagaaataaaaaaaaatctttttttttttttttttttgagacggagtcttgccctgtcacccaggccgaactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccaaaaaaaaaatcttaaaatttgcgtggaaccaaaatagaccctaaataaccaaagcaatcttgtttaagaacaaaactggagatatcaaacttcctgatttcaaactatattccaaaactatagtaatcaaaacaatatgttatcagcataaaacagaccatagaccaatgaaacaaaatacagagcccagaaaaaaacccatgcatatatggtcaactaacttttgaaaatggcaccaagtatgaataattagaaaaagatagtctcttcagtaaattgcattaagggaaatgcataccacatgcaagagaataaaaatggattcttatcttgcatcacatacaaaaattaactcacaatggattaaagatttaaatataaacaagtgggactagatgaaactaaaaagcatccacacagcagatgaaacaatgaacaagatgaaaaggtaatctagaggatacaagaaaatactggcaaaccatacagccgataaagggttatttgcaaaatgtattttacaaactcagataattcaatagctagaaaataaataacccaatttttaaatgggcaaaatatctgagtagacacttttccaaagtagacatacaattagccagtaggtacattaaaagttttcatattcactaatcatcaattaaatgcaaatcaaaaccactgtgagataatacctcacacagtaagaaatgatattatttatcaaaaagatagcaagtcttggccagagtgtagaaaaaaaaaggaaatctttgtacactgttggcaggagtattgattgatcatctattatgaaaaacagtatggaggacatttctcaaaaatatagatctaccatatgatccaacaattccgttactggatatatgtctaaataaataaaatccctatctcaaagacatagctgtaacactgacttcactgcagaattattcacaagagccaagatatgaaaacaatctatgggtgcatcgacagaggaatagataatgaaaatgtggtatacacatacaatggaatattattcagtcataaaaaagagggaagtcttgccatttacacaactttgaagaactcaaagggtatcatactaagtgaaataagtgagatactcagagaaaaatactgtgtggtctcattatatgtggaatctaaaataattgaacttacagaaatagagtatacaatggttcttgccatgggttagagacgtgaggagagggtggttaaagttaaatttttagttatgagatgaataatttgtggggatctaataaacagcaaggtaactatagttaatagtattgtattatgtacttgaaatttgctaaaagagttacactaatttaccatgtgaggtaatagatgtattaacttgacagtggtatttattttgctatatatatgtatattgaataatcgagttgtacaccttagatacacacaatttttgtcaattatacctcaatagagctgaaaataaataaaatataaatgcactaaaaataaaatcgttttcagttatacaactctaagttttcacaagattaagcaaaaaaattattgaggaccaaggggatttaacaaaaatcagagacacaattctcttggggtttctattgaattccacacaggattttggaaataagaatattaagataatttataatcaatacaaaaacaaattcagtaagacataagttaaggaagtagctgtgacagacagtgaggaaagtagtctagttgtgttcttgagcccaaaaaaatatttatggtgaaaggaaatgtgcaaagaaattatggtattattttattattttttacttctcatatatcatttgcataaacattactactttttagagcaaatgttggctatattgtttatcattattaaccatttttttctttacttgcacacatccttctgatgttaacctgaaccaagagctaatacataacttgaaataacacacagataaagtaggatgtgtctgcacatccctctgcttttatagacatccttcaacctccacctccataaatcttggaaggaagacattgaacagcacagccctcccattatttgccgagttatatgaagaaacagaaacaaaattaagtttatccaaacaggttagattaccatggatggactcatcccaccttgtttgcaatttcatttcttgctataaaatatttttttaaaaacttttattttaagttcaggggcatatgtgcaggtttgttgcataggtaaacttgtgtaatggggatttattgtacaggttatttcatcacccaagtgttaagcctagtatccattagttattttcctgatactcttcctcctctcaccctccatcctctggtaggccccagtgtgtgtttttcctctctatgtgtccatgttttctcatcatttagctcccacttacaagtgagaatatgtgatatttggttttctgttcctatgttagtttgctaatgacaattgcctccagttccattcatgttgctgtgaaggacatgatcttgttcttttttatggctgcatagtattccatggtgtagatgtactgcattttctttatccagtctgtcactgatggacatttaggttgattctatgtctttgctattgtgaatagcactgcaataaacatatgcatgcatgtgtcttcataatagaatgatttctattcctttggatatatacccagtaagggattgctggattgaatggtagttctgcttttagctctttgaggaattgctacactgtcttccacaatagttgggactaatttacactcccattaacaacatattagcatcttgtttctccacaacttcgccggcatctattatttttggacttttaaataatactagctattctgactggtgtgaggtggtctatcattgtggttttgatttgcgtttccctaatgatcagtgatgttgagctttttttttcatatgattgttggctgcatgtatgtcttctcttgctataaaatctaaaggaagtgtgaaatgtattgtttttctgacttaaattttcacatttttaggccacattattttttaagatggttgaagtttattcttagacaacaaatatgtttcctaaaatcaaacatattgtggaccttttaataatctcaaagtcaattatgaagtcaaacattaattaattcttggttccctaatgccatgaaagaattattccatttgtcttagtagctcatatctttacagagcaccttattgactgagaagatattcctaaatatattacaactgtgttatttagatattttctttgcagttcaatttcaaattaacttttttctttagcagtttgaaaagggtgatcgtaagggattgttagcagatgttcccatttaaaaatcaaccatcaaaaattagacatatattttattctaaaacttttttgtactacctagaaaacatatgttaattaatttcatgtaaaaatataaaatcacatgttttatatcccattcctattaatggttttattactttaatacttacatgtctgaaaaaaaaaccttattttacttgggaagctatctgaaatgatatgcatacataaaggcatggtttagctcagtcacttaacatctcatcatttatttcttcagagtttatcactcctgtatattttagcactggtcctttagtgcagaaaaatttttcttcatgactatttggtctagaatcaaaccatctcctcatattatttgtgtttggttacaatgcagtttaaacagtgtgctcaactactagtagcttagttacagtttgtccatctgtaattcaatattcccagtaaaatttattagaaaatgtagttacctttgtgataaaacaagataaaaatggcctactactaataatcaaaacggtttgaaacatggctcagaaaaccagcaattagttatcactaattaagggttccaaactagatgaatcatttaactgttgcagtcacaacaatagcatatttcaagtgaagggattgaaactgatttcccttcaaaagcaaagttacagttttctgtaagtgtgaaattctgaaaagttcacttctttaattctggaacttcatttcactgtactcttttcttttaaaaaataaatattagaattttattttcctcacaagataacttgcaaaatcgtacaaaggacattattgacaaatagttgtctttatgttatgacacacaaatacacatacacgtatttgtgtatctagctgttgaaagatattgacacaaatataagtgtaggtatttgtgcagatgcaggtattttatacatgagttaaaaacacgctttccattatcaagctttacagatttgaatcccagatccacagcttcttatttgtgtaaacatgcgcaacacttttatttcctccaaagctcagttttctcctttctatatgtctaataatacccatttcttaggtttgttgttaagaataaaccacataattcacgcaaagttcttagcactgagcatgggacatattatatgttaactatactttagcaatcattataattatattgccatcagataatttctgtactgcttttgttaacattctccctgagaaatatgtacagtcacagtaaatttgaggcaatccatacgtttctgtttgctagtgaaaggagttagccagcttgctttaggcagacagtaagggaagggtgccctggaaaacctcggacctaccccacaagcgcttacaccagatgttttgggcagataagggaacatgcacagggtgcttgcctaaacatgcccgcagcggactgaggacccgcatgcgcactgggggatgagatcgcgccaccaggaattcacgcattgtgcaaaaaaggaaaccagcctcatcggccttgtattttgtaaaagcccttgaattcaactgtgaagggggcaaccgggaacctgctttcaggacccctctctctgctgagagcttctccactgactcttcgacgtctcccttcctgtttcttctaggtcatgagacaagaacccggacctagctgagctaagcagtaaaaaatattccatcactaggacacgggtagttaatctgcatctcctagagtaacaaagtgggttaaatgaaacaaaatgaatcaggacaaatggcctctttgtcatattttcactggttccatgtcccttctagaacctctgattgcaatattaataataacaatacttcccataacttaaggaaaaatacagtttttcccacaaggaagaactggcctacttacaaaaaccatgtccttctttcttatctgaaagctgctagattaaaggagagttgggagaaggacctgcgcatatgttttgacgtcatccacatggaagataggaaagaaaagagtcctgaataagataacaagttacaataaaagataacagttctctatttaaatgccactctcagaacctgatgaaattgtgggcaccagaaagaaagcttataatgtagaaggctttatgtagtgtggctaagtagtattttgtaaacattgttaataattacggcaattggttagattaaaatggatagtgacattaagatagacgaaaataaaaaatttattactgatatttggaattgcaccaattttttggctcctaaggccaaggttttcttctgttctataaaagttggcaaaggcatattgctaatttggagacatgaattagcaattcttagatactttctcataataatagaagtttctaaagttctattattagattcacaatctaatctttatttaaactatatttacaatatatgggtcatatgataatttggggcttaagtgataataggagtagaatctgaataatataagagcattttcttgtgtaaatggtggtcttatattattaatgtaatatgcaaattttcctcattatgttatttatatagagagggtctataaggctgtaattaatacattaagtcctattagaatggtaaaattagatcatgaaaagaattctgtaactaccaatagttttccagtcaggttgatagttggtggtaaggctagatttagtttggctagccagtactcatcatgttgctatgagaggaagtaatgtctgtagtccacgagctaatgtataatttgaaaatgaatttgagtttaatatctatatattatatatatgccatatatcatatgtatatatgtcagtaaccaaaagaaaactaaaataactatcttaatttcagacaaagtgacatcagaacacagaatattctcatatttaaagggggatatatatatatataatgattttcaaaaggacataaatatcctaaatgcatatacatctaacaactgagcttaaaaataagtaaagtaaaaactgtaatatctaaaaataaatagaaaaaatcacaatgatagctggatacatcaaaattcctttctcaggaaatatttaaactgttgttctggatcacagattatatgtatgtgtacatatatacacacactcatatatatacacgttttgatatacatacattttatttaagaagcttaatctctagcagttttaagcaagacaattgtaatagcagtgtcataatgcaatcatagataaatagaggaaatgcttatttctcctgccggggctatgaagtaaaatgttttataggtcgctttggaaagatcaaggtatgcaatctgactacatgtttcagtattgtttcctatttgttgaaacccacaggccagttagttaacctgtctggattttataatttcagcttaagtgtaattataaataacacagttattttaatgaaagtaaagatttaaaacactaaaatttataatcatcttttggataattaatattatcaatgtcaatattatgaaattttctttaaaatgggtagatagtggagatgaagacaaatggaatttcttacaaatcatgctttatttgctctaaacaccatgtatatgctactaataccaaatatgtctccccggccaggaggtttttcctaaacttttgagtcatagtctactagctacttactgtctccgattagatttcgataaggtatccaaacctaatatgtctgaaacctctttcaaatcttctcttcccagagattttcccatctcagtaaatagaaattctttctttctagattcagaagtccaaatcatttgtgccattttggaatttttctcacctcgtgtcttctgttccaaatccagaatcctgccactttctactgctgtaatcagtatgggaaagccaccctcctttcccacctgaattattgaaaaaatactgtaaaaacactacctaatttcttactttcctgtctacagagccatcagcatgttccttttgatatgtattttatctcaggtcaaaattctgccctcatggcctcatctcagtcagatcaaaagttttcccatgccaaacataagcttatatattcccattttctgttatcatcagaacatcatacccttttttttttcttctcctccacctcaccctgcaccacgcgttctttttatggatctaggtctctcacctcagattttttgtacttgttgcttctttctctggagctctcatccatcagataaccacatggcttagaccaaattttaactatcagcaagatcttcctacgaaactgtttaaaatatcaatatttcctttcagctgcccgggagtaatttctcataattttatgttgcctcgtcttccactttcaatgcaagtttaatttttccataccagaagcaggactcagtcacccatgacagagtaaccatcgccacaacatacataaatggctcaagcctgtggccagatatcagaatttagaggcgtctctcggcctaggagacggggttcccactttgtcaaggcttcctttaaatgaaccatttaggcacttgccctcaaacttaaagtgacccacactctaattcaccatatactctgctatttgctaggcaatacgctctctttctgcctgacatgtcattctttcttcctttgacttggaaacagacagttaccctcctgactcattatctcctccttgcctagaatctgtaagtagaaatctttgacctcgtttcctattgtggtggtatattgaattcgtactttctacataaagagccaagggctacctcagggcaggtttgccgtgggatgcctgggggagtgctaggtcaggttcccagtgccagggcaatagttagacaaacataaagtggacgctggtcagacaagaaccacaagtttaaataagacatttgtataaacatgttccccctgtgaccgacactcccttaccactcccacccctgactggttggtcataggtttgacagctaggcattaggccatctaccaggtgaaagaagtaacccaaccaggcacggtggctcacgcctgtaatcccagcactttgggagtttgaggcggatggatcacttgaggtcaggagttcgagaccagcctggccaacatggtgaaacctcgtctctactaaaaatacaaaaattagccgggcggtggtggcatgcgcctgtaatcccaactactcgggaggctgaggcaggagaatcccttgagtctgacaggcagaggttgcggtaagcagagattgggccactacattccagtccgggcgagagagagatcctgtctcaaaaaaaaaaaaagtatccaatgaaagaaagacgcattgtaaacacctatgtccagctcccctttatttcctattaggacagagttgctaactgccagccgctgtggtactagaatcccagtttagctgggggctcccaaaacatattccttctcattctttccattatctttttccatagcgcatactaccgaacttgctatgttttcctaataaattatattttattaaatgaatagtttatttacttatttatttatctcatttatgccttacctggtttttattcctactaaaataaatacccattattatagcagtgactgacacataagaggttattgataaacacctgttgaatgaattaatgaggcaaagttctcttctatatgaataaacttgattttcataaagatattcaaattctctaatcctgcattcctgaccagggatttgggtcataaaaacttttgctttctatattttgttcctaatgtgttaaaattattgaagatggacatccacttgcaatgtttacttggtttttaaaataatgcaaatagaagcaggcataatttttaaaaaatatgtgactcacatgactgattattataacaataagaaaaatagttatgaaattagaacccaaattaatatacctggaccaattagtgaagaaaaagatactaataggaaaacattgtcaacaaaaattaaagtcttaactagaaaagttttgactggaatttaaaaaaatatatagaaataggaccctgagaataaggttgttctgactgtaggataatcaaggtcaaacaaaacttagagctaaacagtgaaattatattgcaatattattagcttcataccttactctattcaattactaaccaagatggccttaatgatcccctcaacttgattaaattttataaaagtttctttctgactacaggccttgaccttccttttcttagagcatttgctttagaaaacttgcatttgtaaattctttctttggccctttgaaatgtaaatttcctacaagccaggaatgtctttctccaggacctgggagccattcctttgaaatgtaatcattctgtaaaatagcacctctatctcccagtctctgtgggatggcaggagcctaactttcaaaaagtaccaattagcaaacacagatggcctaatcatattgactaacatccccttaatttccgccagtacttttctgctagcttaccccagtgtttaacaattttctttcttttattcaatggagttgaaaaaaccttcatttcccattggagtagtcttgaataaagttttccttgcctatttaattgatctggtccaaataccttcatattttactttctatttatgcattcatttttagtaatatgaatgcggaagtagagagacttcactaagtatgtggtaaaaaacagacaatgcaaacctatataaacttataataattttcatgctactttaaaacatatttttatgaagaagatataactacatgatttacttttaaaactgaactgattttttatcatacagaatataatttcagatcatgacaataatagggctatttgacttacttttttttgtactagcattacatgtcttatactttgtgaatactatttataatttttaggttttgttttctttttgttgtgtgtttgtgtttacattacttaaaatggctgagtgcctcacatgtgattgagccacagtaaatatttgtcaaattttttctaatactttatatacattttactgtgaatacttttttttactgtagagttttacaactaatgtatttcaaatcaaagcgtttttatatttaaaaaaaggcaaaaattcttaacatttttccccactcatggcaaaaactgtagttgtcatttaaaaaaggacataatgaatggaatttcccaggtcacaggttgttgcagagattaaatcaactgagagtaacaacctttcatagctagaacacattctgtccctcacaaaatagcactggaatgcatttgagtgaaagggatgtctttataagaatagctaacattctttctaatgctatattaaaaatcagagcaatggcacatattttaagtattttagggaaaacgtatttgtgctattcctcagaactgttgtttgtataccaatgtattgcaggaaaacttatctaacaataatgggctttaatataatttttctaacgtcaaaattatatgaagcaagaaattctctctctttttcttctctcctttctaaatcatccttcctgttagtcagtggatgcattgaaatagtgtgaggaaaacaacagaaaggaaaatggcaagatatcggttataattctgtattatattccatatcaatttggcttaaaatgctagaaacttcaacatgctgtctattgaaaaagaaacaattagatccagctatgggagaacttattatgcctttaatagcaaggggtaaatattcaatttcaaatattaaatagttatgacaatctttgcagcagtaagtcaagcatgtttacttaaaaggttaaaaatctggtgagtgacaatcggcgtttccaaaagaactcttgaaaacatgtgaatagcagtgttgtggtctctggtgttctaaaatattgaacatatctaatccaatggctaagaaaatgagggactggatcctgtaacaaactctgctcttaaaaccacagaaaaggaggtttacaagagcaaagcatatggttagagagtaagctcagagccaaacttctatatagggctagtctgcagtgtcagtagtaaatgtagaatgtaatcaggagaacactaatcatttgttttgacaaggaattataacaaagactcattgtttcgacaaagattttgacaaaatcacagtaaatgttgcctaattcagtaattttcatttgattacaagcactgaaaatttagacattgagagtaaaataaattttcaatcaaacgtatttagacactgttggaaagaatttacaattgaggagaataatgacaataacacaggaaagacctatgtggaaaagcataaggtgactgcaagggaaaagccaatgcaaattaaaacataggtcactttcttctccttaatatttttatacttccaattcattgttcaatatgtctgagacaaaactctcaatcaatatatattacaccctagtatttccattaacattctacctaacatttaaagattagtcagaatgacttagagggcacagccactcatagagaggtacgtgttagagaaggcagtgcccaggggatgtggctgctggcttcagtcccaaagggaggggcatcaaaccataatggactattatcaggcattgatatttgattcagcttgtcctgctggcttagggacttgcttaggactgacaaccttttatttttttaaatttcttcctatgggaataagaacgtctttcttattcctgttccaccattgtatttttatttaaaaagcagataacttgttttctttttttacaggtccacaaatggagaagacattttctccatggtgggctcacccataactgatttagataatgaggtctgggacattttcagatgattatattcaggtgagattttagattatatttaatgctgagtaaagatttaaggggatgttgggattgggtgaatccatattgtgtgtgagaaacgcatgaatttggggagccagaggacagactgttacaggttgaattttgtccctcaaaatatattttaaaacactagcccataatacctgtgaatttgaccatatttgaaaatagggtttttgcagatgtaattagttaatgatatcaagatgaaatcatcctggatttaggaggctcctaaatccaatgaatatctttatatgctagcaccaactgttaaacaagccattattttccaactaaattgaaatgccacttctgtcatgtattaagttttcatacgtacttggatatattaatggattatttagtctactgattgacttctctgttatgttgtcaaaatcatagtgttttaaaagggctatatttgtcataatatgtaatacctgagcaggcaaattctccccagatagtctctgctattgcattagtcttgactatttcagatacttattcatcatattagtataaaactcatttttccaaaatccaaaagtaaagctcaacgagatttatatttaagttaaataaattagtacattagtttggaaaacattgacattttatgacatctgttttttttcattcagaagagggtacttttaatttattcatgccttacatagcatatgatttttttgtatgtcatgtgtactattttaaactttttatgttttttatagttttcatatctattgtaaattatttacctacattatatgtgtttatttatatataaaagtacacaaatgtgtagaaatgctatttttgtattatattcactttctttatataactggtaaaagcaagcgatcagagtcatttttgaaactttatgtttattttatgaattagtagtaaaattactaatcacagaaattattaaaaatcaccttgtattcagctacacaatcaaattatcaattaaatggaatataattgtgccatttcattttccagttgataatgttttctgcagtgttttatgttccaaaacctctaaaatttttaataattctcaaaacaaaagtcatccttgtttactacattattttaataaaaatgttttagcaacatattgtttaatactttatttggtggagaaagattttgtaagtatgcagtatcatatttgcatttatagtaagctgcatattttaatgtattcatatttttcctcttatttttctgaatataactcagtagatttcctaatgttgaatttatgaattcctaaaataagctctatttgaattgctgattattagatcttttgttatatgtgctaataagatgtttgaatcattatatataaggtatatccttcatatttttattttagtactatctttaaaaggtttcagtgtgatggttgtgctggatgtatttattattttaagataaataagaaaatcaagaaatcctgcttaaccatcctctaaatgtggcttcaaggtcatggttcaaaatggatattaaaaccgcagccatttacacataaccatactggagaaaaatggaaatgtaagaaagcaacttctctagttaagatccctactcccatataattacacaatacttttacgtatacctttgttgcccagaatttaatgacatggtcttaacaaatgctaaagaatctgcataatgtactacctattgagtgatcgtgtgtccactaggaaattagggctcctatcactaagaaattagccaatgtcctctgtcatagtgcttttctctaacctccaaatatccatatgtacctttcttcccacatttaaaacacacccagccatctctcaaggaagatgatgacaaacttctgtacaagttctgcagctggtcaaatcttaggatctctaggggatgtgcagctcccactgctgcctagatatagatctttttgtcattagaaacctgtaactaaaagacgtgctatctaacatagccattaatgtacttcctataaattgaagttggatctagaaggttcatcggatccaagtttaattttgtcctggcaacacaattccataaatgttatgtgtatgcatcaagagagtgtaatattatgataccttgctgcttataattttataatgatgttagctactggagagtatttcttaaattcttgaactcactaggagtttaaaccggtaatattgtaagttaaccttttttttcaattagagttatgtaccacatgcaaatattttagtcaatgacaaaccatatatatgacagtggttacataaggttataatggagctgaaaaattccatttgcccagtgatgttatagcagtattactaacatacttctggtgatgctggtataaatatacctaagacatcaccagtcttataaaagcatagcacatactattatgtacagtacataatacttaataataattatgataccagtgtgtgcaattactatactatacttttaattggtactttagagcatactcctttttaaaagaagaaactgaattggaaaacagactcaggcaggtccttcagaaggtagtctgaaagaagatgctgttatcacaagagatgacagctccatgtgtgtgttattgctcctgaaaacctttcagtgggataagatgtggaggcagaagacaatgatattgaagattctaaccctgtgtaggcctaggtaaacagtgagtgtatttacgacttaatttttaacaaaaatgtttaaagggtaaacaataaaaatgaaaaaattaaaaatagaaacttatagaatacgtatataaagaaaacatttttctatagctataaactgttcatgttttaagctgggtgttattgtcagaggcatgtgaaccagagcaactccgtcttaaacaggagctgggtaaaatgaggatgaaacctactgggctgcattcacagacagttaaggcattctaagtcacaggatgagacaggaggtcagcacaaaatacaggtcataaagaccttgctgataaaacaggttgaagtaaaggagctggccaaaacccaccaaaaccaaaatggtgaccaagagtgacctctggtcatcctcactgctatactcctaccagtgccatgagagtttataaatgccatggcaacgttaggaagttaccctatatggtctaaaaagaggaggcatggataattcaccccttgttttgcatataatcagaaataaccataaaaatgggcagtcagcagacctcagggctgctctatggagtagccattcttttattcctttactttcttaataaaattgctttcactttgtattgcgatctcgccttgaatctttcttgcgtgagatccaataaccctcttttggagtctgggtcgggacccctttactgtaagattattaccaaagaataataaagttaaaaaaataaaaataaaaagagatccaggcatggtgacttgtgcctataatctcagttacttcagaggcagaggcgggataccacttgaggccaggagtttgagaccagcctgggaagcatagtgagactcccatcttaaaaaaaataaaaataaaaatttagccagacatggttgaaaagttatagagtaaaaaattatggtaagctaagattaatttattagtgaagaaagaaatctgaaaaaaatacatttagtgtagacaatgtatacagtgtttataatgtctacagcagtgtaccgtaattttccagtctttcacattcacttaccacttcctgattcacccagagcaacttcctgtcctgcaagctctattcctggtacatgctctagacaggtcttccattttctatctttcataccatactttactctatcttatctatgtttagatacataaatacttattgtgttacaattgcttacattattcagtacattaacatgtcgtacaggtttgtagcctaggagcggtagcctacatcatatagcctagaagtgtagtaggctatatcatctagctttctgtaagcacactcaatgagattcacacagtgacaaaaatgcttaataaggtattttcagattgtaatcctgtcattaagtgaagcatgactgtatttgaaccacttcaaaaaagaaaaagtttaattctgttaacactttggtcactcaggagtagagatcacttgggaaaagtagaaaaacaaattgattttttaaaaattttctactgagaagttaacaaaaagtcagttatcttgcattattcaaagatgactaaagtatccctctgaaagttgaacttatgccattatagaattttttaaatggaaaccatttatcctgttacatttatttatttttaattttttatttttaactattttatttatatgtttctaggttttgatacatgattgtattttttcttctattttgatattatacaatttttttgatatttcctcttatactttaaaacttaaatagtatatatgttccatttgagctatataatttgaaagaataattccatttttaaaataagactattctaataccacctaataaaaagtccatctttcctttttgacttgtttttgaaatgaactttataaatagctacggcagcttcataaaaatacttaatgcctctcattttggcactgcactcaatgtataaatgtacctaggagaacctacatacctaagatgttgagagttgaagcagtcatgtgtgtcttcatttcttcaagtccagtccagtatattttattagtattttgtagatttttctatatatattagaggtttcatttcaggcttatgactaagcatataatttctttacttgctgtaaaatatttgattttatcttctattataatattattacatatatatacatattttttgtatttgtatgcaggatgtatttttttttgcatgtgttaaatctataatctgttcttttaccaaatttcttgataattttaatgatttcatagttatttctttggagttttcctgatagatatttatgtacaatgaaaatagaaagcattttacttatgttatccttttcattgtttaaatattttattttctcttttgtaattgcattattttaaatatccagtaaagctgtaaagtgcatgagaaatagtaggcatgtttttttgtttttgaatttagtgcaaaggttttaaatgtttgtccattacacaaaatgttggtttgggggccaaagtaagtattgatataggtatacaatatgtattacgtaatacacagaagattttattaaatttagagattatatacctatcctaattacatttaaagatttaacctgaatctgtgtcttattttatgaaattatttttctccatctttgaagagattgatttttcttaatgctttgactaaaattatggatgtttttgagtttcttactattgaatgaactgtattcttagaaaaatttctgattaatatgtcttgtttttaatgtcttattggatattttttgcatttttttcagcaccacattatagatagtgcttccgtttctgacaatcgtggtttctgatgattaatcgataaatcttccaatcattgtttccctatattcaatgttttattttcctctagtggctttcaagatttttttctttatctttggtattcagcagctttactgtaatatgtctaggcattgttttattttattttattacattcgaaatttgctgagttcttgagcatttataacattaatttctggagagctatgtttatgataactttaaatactttttgctctgttgttttatcttcctgttttctaccccctaaaataatttggacgcttcagtgattcatttgttaaactttctgatataattccacttatcttgaaggatctgttttccttttttcagtatatttttctctattctccaaatgcataatttgtattcatttattttcaagttcactcctttaagttcattttgtattttatcatctccattttgctattgtatacatccactgattttgtatttcagattttttcactattatagttttattagatgcttttttaacttaaaaaaatctctatgaacattatcttctgtttatttcatgtgtgttattctttactatgttgaacatagtttcaatagctgctttaaagtctttggtaatgtcaacatcttggacttatttggatacgcactactgctgttttatccaaaggtaattaattacatactaacaggtctttgcatgttttaattaaattttgtcttgagcaaattgaatgttaccatatgtagtctctaggtctgttaccatcctttggaaaaggttactttttttttttttttacattttagcagacagccaaagtaggttcagacctttgcttcatttcttttgtctgtggctcatatagccatttaattctcaaagctcaactgctctacttttttgggtctgtcatgcacatgaaacactcagtgatttgagactaggatgttgatgtaaatctcaattcagtttctaaacctttgtgctgctgatttgagactaccagtgcttgtatagcttgaggttagcttgaggtgagcctgagacttgtataagttactacacaaaactagtgtttttctttatttagatatctccctcatggaatttttttctgcattctccaacgccaaaggctctatattctggctgttctggccagatagacaggatttccctttcactgaagctttccctggggttccactagtgtggattgctctcagagctcaaaaggaaaaatgatctatgagattcttttcctaagtttgaatttcaccacaatacacttggtattatctaattttcataatcaacaggaaacttattttttgtagtttgatcagaaattttagttgcagtaagtgagagaaaggggttataatgagtttttattttaaaaaggggttatgctgagtttttattttaaaactataaaacgaataaagtgggaaaaaaggcttttactgagtttgtattttaaaagtaaatttttttttaatttaaaaaaatttctgacacccttcacttgggataagtatcttttatacggaaagtcttgaacctttcattttttgtcaatccgaatgttttctctttataaattcatgtaaatttattaatattattgatattttggctttacttatttcatttttttttttttttgtttttgtttttgttttttgagacggagtctcctctcgctctgccgcccaggctggagtgcagtggcacgatctaggctcactgcaagctccgcctcccaggttcacgccattctcctgcttcggcctcccaagtagctgggactacaggcacccaccaccactcctggctcatttttttgtatttttagtagagacttggtttcaccatgttagccaggatggtctggatctcctgacctggtgatccgcctgcctcggcctcccaaagtgctcggattataggcgtgagccactgcgcccggcttcatattaagatacatctttatattttacattagacattttcatcatgtcttttatcctttctcaatttttaatacaaattttgtttttcaggaaggttattatttttgttttgtttttgtgataataatattaacgtaatacacttaatatcttttttttttttgagacagtgtcgcactgtcgcccaggctgaagtgcagtggcggcgatctcagctcactgaaacctctaactcccaggttcaagtgattctcctgcctcagcctcccaagtgtctgggattacaggcttccaccaccacacccggctaattttttgtattttaagtagagacggggtttcaatatgttggccaggctggtcttgaacgcctgaccttgtgatccacctgccttggccttaatctgctttttgggggattagagaaagaatattgtctactgcttacctactagaacaatgttaaaatcagctaataactttttctaactcattttcttctttttccgtaacatctcatttgtaattagatgacttgcttccaaataattgctataataagcaatctgacctgcctgaattgatacttttgaaagtaacattaccagagtttttgtctgttaaaaactatacattatacttaatgaatataatttagttttatgttacaagaaagagatatatatttatatataaatgtatatatttacatatatgtaataaatatacattaagtacatttatatattatatatatatttaatgttccccatcagtcagtatcctgtttcttcaatttttgcttgtttgtatgtctaaagcatgttcttaagtagatacttgaggaaagtttcataacatgaatatttcttcttttcttgtatggctattgtgatgattaattttctgtgtccacatgactgagcaatagggtttctagacatttgatcaaacactaatctaggtatgtctgtgagggtgtttctggctgagattaacacatgaattggtagactgtccgagtaaagattgtctccctaatgtaagtgggcctcatatatatatgtatatatatgtgtgtgtgtgtatgtatgtatgtgtgtgtgtgtatatatatatatatatatatatatatatgaatatggctgtatacaatactatttgtcatattttatacccttgaaatatttactaatttaatttttggggggtataaataattatgatgcaaaagtctgatgacactgatattcttcttctaagtgtcttgatattttgtctggtttctaaaaattccaaaaagttttaccataatatacatcaggttgggccattttaggttgttttgtgaaggtatatagaaaatatgaagatctgtgtcacgtacctaattaaaagaaagttttgttaaaaatcaattttgttattggttctgtttcattcatttggcttatttctatgtaatcctttttccatattttgaatttcttttgcttttattctgtatctatatttttatcagaaagtattttgtttttcttttgatttttacatttttctatttttcatctttaagacttttctccattgtattgaatcaccaatgtaatctatcaagttttgactttacttctgaaataatgttttatttataattattttgtgctatatgttaccattctagtcaaacatttttttcccaatcacctcatttaatagatatctaattctaatttatgttgctttcaaagagattgtattattgcattgtttttttctaattgtttttaaaataaattcaggtttcatcttgtaattatgcctttgtaatcatcttttatactctctagaaatattatcctgttttctccttatattttatcacatatatttatagataatctatttttgattgttcttttaagtgaaattacttataattttaggaatgtgtgtatatattataatgcttattgcatcacaggatagacttagaaatttatactcataaacgtacaagtttgtaatttatgtttttctaatcctcaactttttgttctgttttgttaattttatttaaaaaattcttggagagatacaagaaaattttccactattatttacttatttgcataatctttgtaattctagatgtatgcatttactgcggttttgtctgttacataaagctttatgcctgtaatatgttaagaaacctccagcacgttcatacttatattttgacctcagtccttttttgctgatgttattgttcttatttatattctttgatagatttaatgtacacatttgcaaacactctcatttctaccttctttgccaaaaattttaagggtaattttcatgaacttcatacagcacgttcttatagtatctctgtagcaaaattctatttgcataattgaatatttatgtatttgcttttattcttttcaacatattttatattctttgttataattttactttttaaatattgtttcttctttgtagtatgctttttcctctgctatatgcagttgaatgttgaagaagcttataaatttcatcagaatttggcatatagacagggatttgtggagaaaaagagttcaggggtgtataattaagcttccaactttactggtttcttatttccaagtctctagttaatttgtaaattgatttattttatttgaattcttgtgcttctattagagaaaatgtagcatgcctatattaaataagtctgatggtatgaaagtgtaatgaacttagtatatcagccatggtaatgtcactttctgctatacataaattagattagtgaagacgtctctttcacgtattgctctggacctcttaaaatagaagcagcttccttcagttattgtctaccattaaataatattatgagagattt

SEQ ID NO: 1362 - DNA, 40001 bp, Homo sapiens
ggttttggtatggatgtactttctgtttgtcagttttccttctaacagtcaggaccctcggctgcagttctgttggagtttgctggaggtccactccagaacctgttttcctgggtatcaccagtggaggctgcacaacaccaaatattgcagagcagcaaatgttgctctctgatcattcctttggaagctttgtctcagtggggcacccggccgtatgaggtgtcaattggcccctactgggaggtgtctcccaattaggctactgggggttcagggaccaacttgaggaggcactctttccgttctcagatctcaaactccgtgctgggagaaccactactctcttcaaagctgtcagacagggatgtttaagtctgcagaagtttctgctgccttttgttcagctatgcccggccttcagaggtggagtctacagaggcaggtaggcctcaaggagctcgaactggctccacccatttcgagcttcctggctgctttgtttacctactcaagcctcagcaatggcagacacccctcccctagccttgctgctgccttgcagttcaatctcagattgctgtgcctgcagtgagcaaggctccgtgggcatgggactctctgagctgggtgtggatataatctcttggtgtgccatttgctaagaccattggaaaagtgcagtattagggtgggagtgtcctgattttccaggtaccatctgtcacagcttcccttggctaggaaaagggaattcccgaaccccttccacttccggggtgaggcgatgcctcaccctgcttcagctcacactccgtgggctgcacccactgtccaagaaatcgcagtgagatgaacccagtacctcagttggaaatgcagaaatcacccatcttctgcatcgctcatgctccagctgtagactggagctgttcctatttggccttcttggaactctattatgagtattttaaaacaaaatatcccacttgtgcctaagcagtatgtacaatttggcacaactcagtttctgacagttctgttctgttaggaattttacaataaatactcaagtgagtgctggtgtgggtaggatttggaggaattggcagccaccggtgctgattccatccatagacttttcctgactagttcattcctttcacttgacctgccccagaccaccctttcctgactagaaagaggcacatatgtgcctcaaataataatatatttaaaaatatatattgtaatttatctgtacagtaggacattgcactcattaaatactttgaaaccagtcagaacttgaggagttgcttgtgccctctgtaggatttgagcatggaaagatgacttgggggcagatgtggaaatggaagcaacttcaaggattataaatcattctactataaagacacatgcacatgtatgtttattgcagcactattcacaatagcaaagacttggaaccaacccaaatgcccatcaatgataggctggataaagaaaacgtggtgcctatacaccatggaatattatgcagccatacaataggatgagttcacgtcctttgcagggacatgaatgatgctggaaaccaccattctcagcaaactaacatgagaacagaaaaccaaacaccacatgttctcactcataagtgggagttgaacaatgagatcacatggacacagggaggggaacatcacacattggggcctgttggggagtggggagctaggggagctagggaagggatgtagatgacgggttgatgggtgcagcaaaccactgtggcacctttatacctacgtaacaaacctgcaaattctgcacatgtatcccagaacttaaagtacaataataattttaaaaatgtaaggaggcagcattatgctaaacttgaaaaaaaaaaaaagtctaatctcttcattagcagtctaatctcagactacaccttgggacactgaattacaagaagtaattgaattctgattagcacttcggggtagcatttggcttgcatttgggcatatatttgctacactgtctcttccatttactggtattgaagatggtggtggctgacaccttgaaaatagaagcaaattgaagctggctgagcttggtctcctcctgattcactccttcccccacctcccagcttctctcactctctcccactctccgaaagacctgtgttccctcaggtaatattagctgtagattaagagaaactcagacttacatgacatagccacctgaaaagattatcttaaagcactaccgcagagttcctgaggggtggtaagcaagtgcccccacagatgccagtgatacccccgaaaggcttaaagttttgcttttggttttgtttttaaaatgaaaccatcctgaactttcctggttccagagcagttcgcttaggtcaacactggtgacactcaatggtgtctgagtcctctggaccgagtgtagcaagcccatgtttcttatatcgatgtggtaaaagggtttccaatatgcagccttcttctctcatgtaccctcaatttcaaactttaaccacaggtctagagaagaaagtgcaatgagtgcacaggggaagacacaaatgacaaaggcccactttttatggttaggagaaaattcaattgttcttattaaggataggatgtcaaaataatttttctcatcaaatcagttacgtagcaggtgtgggaaacaccggaaaagtaacaatggaacatataaaagcctctttggaaggtggaagcctatttaaaaagtgaataaatttgaataatttaatagtaagtgaggaccttagaattataagtatgtggaggtgaacttagcaaacagttttccttgactaaaataattgcagttactttatgttcaaagtattttgaaggagtagaaatgtagcaacacctttgaagataatgcccatagggagtatgtgggaactggcaatccaaagttacataattaactagattctaattatatctactttttctgtgcttcaaatgagaggtctcacataagaaagaggaactaggccgggcgcggtggctcacgcctgtaatcccagcactttgggaggccgaggcgggcggatcatgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcaccactgcactccagcctgggcgacagagcgagactccgtctcaaaaaaaaaaaaaaaaaaaaaaaaaaaaaaaaaagaaagaggaactaaggctgagggcagtggctcatgcctgtaatcccagcacgttggaaggccaaggcgggtggatcacttgaggtcaggagttccagaccagcctggccaacatggtgaaaccctgtctctactaaaaatacaaaaattagccaggtgtgacggtgcctgcccgtaatcccagctacttgtgaggctgaggtgggaggatcgcttgaacctaggaggcagaggttgcagtgagccgagatcacaccactgcactccagcctgggttacatagtgtgactccatctcaaaaaaaacccccaaaaaaacctaaaacaaaaacaaacaaaaaagagtaacttggttgaatttgaaatttgcaaagaatgggcagatttatgtgttgggagcatcagtcaatgcaaggtaaatgaggccataaggggctggtaattcctctgatgtcacacttttctttgaaagaatttattatatgattcaaacaaatggaaagagatatgtcattgacaatgtcctcaagaagatccctacaataaatatggcatctggtttcatagctctcatctgctggtgcgtcatagaagagaggtcagttctgaagtctgtagaaaagacatataatttccccagggatctgtcaaacaactctgatagagagataaaatagggaaaaagaaggataagtccttccacactcataacaatggttgttatgctcccaaagacttctattaccccattccactggctggggccagtaatataccactgagtcttagtcctaccctggtttctgtgtcagtcccctctaaggcaaggactgtatcaataatctcagtcgtaactcatcttaccaggcccagcctcaaccactcacgtgttacttctcacattcccaccgctgccagtcctgggagcatgcggccagtcctccagccacccttcttcccctcagattggcccagtccatcagcctggatctctgtgggttcccagccctaggttcaacagagatcactggtccaggatctaaatctagggcttcccctaaaccccaagcaggtagacaagatccttcttcccatcagatatcctaggtcacaatcccttgccccagggaatccctggtcctgaaaatgaccaagataatccccagtgatgaactcctccctcttcccggaaaggccagttgtaaaccatgcctgatgcacacctgtgtgtgccatgttctttgcatagttgatctcacacacagaaccaaacttccagagtcctatttgggtgctctcctcatgtcaagaactcgccaactcttgtcttattgcatctgacctattctgcaggttatatgaagaatttctcaaagactgaagagaagtgagatctattacatattccacctactttacatttagcaatagccgctcacaacctttaccaaaaggaagaatctctaaattctttgctctgcttgtataaagaataaaatagtccagctatcatgtcatttcagattcagccaaacaaataccaattgatattcactaaaataaggcctccctgttagataattgttgttctgtgtggcttctttatatttaaagcaatctccagcatgcctcactgcctgatggcctggggtctctcaggccctgctgcagccatctgctcacctggcccggaaagcagtgttgcagggccaggacctggcgagggggtcgggcactgggacctagtggaacatggcaaaaagtccaggtcagacaagcacctgtacgaggagtatgtagagaagcccttgaagctggtcctcaaagcaggagggaaccaagtcacccaggtctccaaacgcttgggcttcttaaaaaataaactcgggcttattttaatgaatatcaactggcaccgaggcaggttctgggggaaagaaaggggagaaaacagagaggagtaaaggaggatgaaagaaagtgagttccaggcagtgtggagaggaggcagaggaagagctccagtgtcacttccctgtgagattagacctgcctgctgagaagcctctcacaagctcttccgccaagcaagaagctgaacagacacctcttcaagatgctttgagtcaactgatgagacaattgcggagaaaagacccaagggctttcttttcatttcctgtgactgattttattgctcctggctgcttcatgatcattaaacacccaatggattttaataccatgaaagaaaagatcaacaacaatgactaccagcacatagaagaactaaaggataacttcaaactaatgtgtactaatgccatgttttacaacaaaccagaggccatttattataaagctgccaaaaagttactgcactcagggatgaacattcttagccagcaaagaattcagagcctgaattctgaagcagggcatagactttatggcagacttgcaaaaaaacaaaaacaaaaacaaaaaacaagaacaacaacaaaaaaaccttgaaagcagaaagagaacagacactcgcagagtggggtggacagaagctgctggccaagaaagctggagatgctgaagcacaagccttcaaaagtcccagcaaagacaatagaaagacaaagttatgcctgaaaatgagtttgaaagcaataatttagagagagagcagaaccaggttgaaccgcatcgttaaggaatctgaggaaagctgaccaggtggcttgttaatagtgcaaatttgaaagaagaaaaccagatggaacaacgaccttgggacttccccatcctgtgggtcccattgtaagagtcaggcgattgccctgtgagactgggaatgacaactggaagacttctgtcaggagtgaatactttgcaggggttcaaagaggataaatgaaacaaagtaactctcgtgttgtatttgcactatgaaccctacagttcttgtgcaccatattatgactccacatttgcaaatgtcagcaaggatgattctgatttaacctattcaaactatggggaaggctgatcttccaggtgctttcagcatccttaaggttttggccacatgccaagatcatccatatgttagttcactgaatgttttaacaagaggagaacattccaggaccctacaagagctggagatgtcatcgcctgaagatgaaggtcgtactaggatacttgtcacagcaaatgaaatggagattacagaaatagagccagcagtgcgtttggactccaatactcaggacaggctcatagcactgaaagcagtaacaaactttggcactccagttgaagttttgaactctgaaaaagctgtcatgttcaaaagaaacttgacaagaccaccaaattgttcaaggagctccaggaagcccagaatgagcttttgagcatcagacaccctcccaatatgatctgtctcttgggtccctcatatggagaaatgcgtctttctaaacaagtgaccaataatcttaaaaaatgtgcacagcatgtaactccacgtgatattgtaagcatgtatggagttcaaaaagcaatagggtttccattatttgccttattgtagaaaacaacttcatagatttaacagaagattttgaagaacctaaaaagattgatgttgctgagtgtggattcgatgggatttgaagccaaccggtatttgattatatactgtgtacacatcttttttcattcttaacttggaaatgcttttcagaagatattaaatatttgtaaattatgtttttaattaaactttggaataatgaattttaatgttccagagttttgacttgtattgggtaataaagctggacctgggactcaaaaaaagatatgttcgccctccctctcctctttatccataattacaatattcaatatggaaaagaaattttaaaaacaagaaaataattcaagagaagttgttaaatttggagatccaatttccaaataggagtttctaaaagtgaaaaaacagacaaaaggatcaaaaccaattctcagagaaaacattattttcgaaaaacaaaaaacagttacagagagtaccaccaaagtcccacacaaaaatcaagagcaaaaagcaacaccataacataatttcataaaaatttaaagctgtaagggaaaagataattctgcaagtttccgggcaaaaaaaagtaggttattttcatggagtaaaatttcaaactagctttgactttttccacagcagtgagcaatgctggatgacaatgtgatgacatcttctacagaggggaaaaagtgcaactcaagaataatgaaccacatcatgccatttgtatagggaagtaacagagagatacttgcagacatgaccaatcttaaaaaaatgtggcagcaggggcttcttttgaaaaaatcgctcacagctacaatgtatagtatgcaagaataaaattagagaaagaaatttgaatggataatggctaaaaaatgaacctgtgagaattattgataccaactattgttaaagaagtaaaaataactgtggaagaattactcctgatactgcagtaattatttaaaataagacacagaaagtataaaagaaacatgaagagaaaaaagtgagaaatatcaaatttaattatgaatgagaaattgaatgtagggaataggagatgcagacaaaaaaagtaacatcctttgtctttcttgcagggaagtacagcaggcttttgattagggaaagagagaaatagaatgcttatagaacatttcaagatatttacatgaggctttaaaatagatttttttgtcttctaaaacattttaaaagataaagggaaaggctgggcacagtggctcacgcctgtaatcccagcactttgggaggccaaggtgggcagatcacgaggtcaggagatcgagaccatcctggctaacacggtgaaaccccgtctctactaaaaatacaaaaattagccgggtgtggtggtgggcgcctgtaatcccagctactctggaagctgaggcaggagaatggtgtgaacctgggaggtggagcttgcagtgagccgagatcgtgccactgcactccagcctaggtgacagagcgagactccatctaaaaaaaaaaaaaaaaaaaaaagataaagggaaaaacatagtccatataaccagagacaataaagttgcctaatatatactgaaaaagttaacaccaaatgtaccaaacactggatctcatataaataatgtaaacccaccattaaaaggcagtttctgcctaaaccaataaacaaacttaatacaagagatgccaattaggttaaagttataaaggttctaaaaggttaaagttagaaaggctcatccaatataagtcatttaaaaacagcaaataagtaaataattataaaaccaggacataaaagttgataaaaattagtgtcaaataaaagagttagaataaaagttgattaagcatgatataaagtttcaataatacaaactaccaatattcaatttaaatggaaccataaaaatggatattagaaatgtgaaattttctattatgatatgatctttcatgttatcgagaactgaatcaagcacaactaaaaatcagtttttactctcatttatctattatagactttttgttgattctataagcaggaactgattgtatagcaatatgtatattcttggctattaatatttctgcaaacttgcaaactaacttaatactattgcaaggatcaggagacagcatacgtaaagcctgcaattgggtaacattgaccagagatggttaatcttgatattaactattaaaatatcattggataatgattataagactttggtcaacttggtaaatattttcaagaattctggtttaatgtggcgtgatggcaaaatggactttatagctggaaacagcttttatgtataattatacaggtactaattttctcatttgcattgatattaaggtaatattgatatcagttaatattaattgggaaaactgccactcatatacagaatttttgtagggaaaggggacagatagaagagtaatataccctcataggaacatttcccttcatttacagagattaccagagaattagagactctgcaaaagattttgatcctgctcttcaagtaaaagacagctttaattttaaagggtggacagcctgaaaaccatcatttatcaaaccctgaggcatgttctgaaagaaagagtgtgaagaaagggagctgtccaggctttgcatgtcaaagggccaagtctgtcctgggaagaagctgcagagctgatgctacaatcaggacggtgtttctgcttatgaatattaatttaggcactaaaatccctgggaattaatgtctgtccttaggaggtatgtgtgtggtcaatagttatgtaatggataattaggattaataagaatacacagagggcctcacaatgacaggagcctctaaaaggatgtgactgggaggtgaatgctcacctgcacatttctactagacttcctgtggaagctcttgtgattattttatatggaataatctgacctttggaaagtggactgtagggctattactgtgtctctctgatatggaaaggaaaggagttagaccctagagccagttttctaactaagactcaaaatccagaggcagtaaacaacaaagaacaacacaccacatacacacacgcgcacacacacacagagaaacaaattaggatgcctagaaaaaatggttggttccagggatggggcaaaaacaatataaattgtatttttaatttttctttcttttatattctgtaaaagaaagattgaggaattattacaaattgaaggacactaaaaagacaggtcaactatgcaatatgtggtcctggattgggtcttggctagaaaaaggacatcagtgaaaaactggtgaaatttgaataaactatgttatttcattaacaacattgcatcactgtcaatttcttggtcttgataatcgtgctatgcttatgtaagatattaacatcagggaaagaagtgaagggcatatgtaaactctctgtacaatttttgcatttttttctgaaagtttaaaatcatttcaaaataaaagttaaaagaaatctaaaggaataaactcctccttgaggtggctttgtgaaacaatatttgtatattaagcacttacataaatgggaagaacaagaaatttaaaactttctaaaaaattttttttacttcttatactttaaatatgtggttctgtaagaaaattttttcttggtaaagctgtaacaggaaaaaagacttagtgagcttcattaatagccttggctattacaagaagtatcttattaaaaactttaaagttttaatatctgctatataatgacacaagaaaagagatcacgtaatactcctaattatggtgtccctttggaaaaattatacaggtttaataattttgatttaaaaatagctctatatctttccccaccttctaccatataaaaataacattagcacaacattttggtttatgaaagccttgggtttactttttcatgaaaagtttaattaatttgaattttctaaatttcctctactagttttgaggttgaatgaactaaaatcattttaaatttataaaattgtaaaattatgtgttcaactaaataacttgataacatgtagtctttataaaaataggttaatttttataattctacaaaagactcaacatattaacttaaattgtattttctagacccttagttaaacttctagtacttgagataatataaatttgagttaactaataaatgatctttggacaacattattttaatatatctgtgttcttatttaattctccacatagtagtgatccattaccatatttaaaaagatgtataaatgtctgggttaaaaatatattttttattaatagacatttatcaccacaagttagtattgaaagtaatcttttcttatatccttcctttatgttcctatctggaatgtaaaacagtctacctaacttgatatgtttgatatgtggagactggaatttgggaagacacacaagcatttaaaacagtacatgatgtcaagaagtctgtattgattgatcggagacattcaggagtaacattatttttctctctattttgctccatagaatgtcaaagaatagacaagtcctctttgtgaacatcaaaagcctcttctgcaaatggatgatatacaccttattggtgagggaggaagttggtatctatctattctaactggtttattgaacatactggtgtttgtgaggtgcaagcagtagagaaaaaacacattatttgctcacaacactaactttctttcgtgctactttgaatctccactttctatgctttcatgaaattgtgggtagatctgatagcttttctggtcaattccagttattagtgaatagtctcactttctggttattaacgaatttggtccagtttcatatcaaagctttaatctcaaccaatttaatgcttcttcccaacccctggctcagtcctcacctaggctcagaaacctaaagcccagaaaagatgtcctgtttggcttctcactatttctcccttaactcttttcctctatttctgctatgatttgagtgtgcctcctccaaaattcatgtcaaaacttagtatgtcccctctggagaacgtagcaacaaggtgccatcttggaggggagagcatcccccgaccagacaccaaacctgctgctgccttgatcttggactgccccagtctctagaactatgagaaataaatttctgtggtttacaaattatccgttctgtggcattttgttatagcacagaaatggactgagacactttctcctttactcaccttgtgacctccggttccctgaagtctggcacagggggaggaagagcagcaaagggtggaaaagatctttagtgactgagacagttgtaatctggctttgatgccctctgcttgtggccaatgtccaaatgcttgactttttacgagaagatgttgaggctcacgggagacatttacccaaacttccttacccagccaacatgccctccatttaaaactccatactcagaccttggcaccctagatcccccagcccagcacctccagcctgtttttggagggatacttttctttttattattattattcttatactttaagttctagggtacatgggcacaacatgcaggtttcttacctatgtatacatctgccatgttggtgtgctgcacccattaactcatcatttacattaggtatatctcctaatgctatccctcctctctccccccaccccacaacaggccccggtgtgtgatgttccccatcctgtgtccaaatgttctcatttttcaattcccacctatgagtgagaacatgcagtgtttggttttctgtccttgcggtagtgctcagaatgatggtttccagcttcatccatgaccctgcaaaggacatgaactcatccttttttatggctgcatagcattccatggtgtatatgtgccccattttcttaatccagtctatcattgatggacatttgggttggttctaagtctttgctattgtgaatagtgctgcaataaacatacgtgtgcatgagtctttatagcagcatgatttataaccctttgggtatatacccagtaatgggatggctgggtcaaatggtatttctagttctagatccttgaggaatcgccacactgacttccacaatggttgaactagtttacagtcccaccaacagtgtaaaagtgttcctgcttctccacatcctctctagcacctgttgtttcctgactttttaatgatcaccattctaactggtgtgagatggtatctcatagtggttttgatttgcatttctctgatggccagtgacgatgagccttttttcatgtgtctgttggctgcgtaaatgtcttcttttgagaagcgtctgttcgtatcctttgcccacttttgatggggttgtttgatttttacttgtaaatttgtttaagttcttcatagattctggatattagccctttgtcagatgggtaggttacaaaaattttctcccattctgtaggttgcttgttcacgctgatggtagtttcttttgctgtgcagaagctctttagcttaattagatcccatttgcctattttggcttttgttgccattgcttttggtgttttggacatgaagtccttgcccatgcctatgtcctgaatggtattgcctaggttctcttctagggattttacggttttaggtctaacatttaagtctttaatccaacttgaattaatttttgtataaggtgtaaggaagggatctagtttcagctttctacatatggctagccagttttcccagcaccatttattaaatagggaatcctttccccatttcttgtttttgtgaggtttgtcaaagatcagatggttgtagatgtgtggtattatttctgagggctctgttctattccattcgtctatatctctgttttggtaccagtaccatgctgttttggttactgtagccttgtagtatagtttgaagtcaggtagtgtgatgtctccagcttggttcttttggcttaagattgtctgggcaatgcggggtcctttttggttccatatgaactttaaagtagttttgtccaattctgtgaagaaaggcattggtagcttgatggggatggcattgaatctataaattaccttgggcagtatggccgttttaccaatattgattcttcctatccatgagcatggaatgttcttccatttgtttgtgtcctcttttatgttgttgagcagtggtttgtagttctccttgaagaggtccttcacatcccttgtaagttttattcctaggtattttattctctttgaagcaattgtgaatgggagctcacacatgatttggctctctttgttattggtgtataggaatgcttgtgatttctgcacgttgattttgtatcctgagactgctgaagttgcttatcagcttaaggagattttggactgagatgatggggttttctaaatatacaatcatgtcatctgcaaacagggacaatttgacttcctcttttcctaactgaataccctttatttctttctcctgcctgattgccctggtcagaacttccaacactatgtcaaataggagtggtgagagcgggcatccctgtcttgtgccagttttcaaagggaatgcttccagtttttgaccattcagtatgatattggctgtgggtttgtcataaatagctcattatattgagatacatcccatcaatacctagtttattgagagtttttagcatgaagggctgttgaattttgtcaaaggccttttctgcatctattgagataatcatgtggttttttctttggttctgtttatatgctggattacatttattgatttgggtatgttgaaccagccttgcatcccagggatgaagcccaattgatcatgctggataagctttttgatgtgctgctggattcagtttcccagtgttttatgaggatttttgcatcggtgttcataagggatattggtttaaaatcctctttttttgtcgtgtctcttccaggctttggtatcaggatgacgctggcctcataaaatgagttagggaggattccctctttttctattgattggaatattttcagaaggaatggtaccagctcctccttgtacctctggtagaatttggctgtgactctgtctggtcctggactttttttggttggtaagctattaattattgcctcaatttcagagcctgttattggtctattcagggattcaacttcttcctggtttagtcttgggagggtgtatgtgtccaggaatttatccatttcttctagattttctatttatttgtgtagaggtgtttatagtattctctgatggtagtttgtatttctgtgggatgggtggtgatatcccctttatcattttttattgtgtctatttgattcttctctcttttcttctttattagtcttgctagcagtctatctattttcttgatcttttcaaaaaaccagctcctcgattcattgatcttttaaagggatttttgtgtccctatctccttcagttctgctctgatcttagttatttcttgccttccgctagcttttgaatgtgtttgctcttgtttctctagttcttttaattgtgatgttagggtgtcaattttagatctttcctgctttctcttgtgggcatttagtgctataaatttccctctacacactgctttaaatgtgtcccagagattctagtatgttgtgtctttgttctcactggtttcaatgaacgtctttatttctgccttcatttcattatatacctggtagtcattcaggagcaggttgctcagttttcatgtagttgagtggttttgagtgagtttcttaatcctgagtcctagtttgattgcactgtggtctgagagacagtttgttataatttctgttcttttacatttgctgaggagtgctttacttccaactatgtggtcaattttcaaataagtgtgatgtggtgctgagaagaatgtatattcagttgatttggggtggagagctctgtagatgtctattagttctacttggtgcagagctgagttcaattcctggatatccttgttaactttctgtctcgttgatctgtctaatgttgacagtggggtgttaaagtctcccattattattgtgtgggagtctaagtctctctgtaggtctctaaggacttgctttatgaatctgggtgctcctgtattgggtgcatatatatttaggatagttagctcttcttgttgaattgatccctttaccattatgtcatggccttctttgtctcttctgatctttgttggtttaatgtctgttttatcagagactaggattgcaacccctgcttttttttgttttccatttgcttagtagatcttcctccatccctttattttgggcctatgtgtgtctctgcacatgagatgggtctcctgaatacagcacactgatgggtcttgactgtatccaatttgccagtctgtgtctttttattggagcatttagcccatttacatttaaggttaatattgttatgtgtgaatttgatcctgtcattatgatgttagctggttattttgctcgttagttgatgcaatttcttcctagcatcgatggtctttacaatttggaatgtttatgcagtggctgctaccagtttttcctttccatgtttggtgcttccttcaggagctcttgtaaggcaggcctggtggtgacaaaatctctcagcatttgcttgtctgtaaagtattttatttctccttcacttttgaagcttagtttagctggatacaaaattctgggttgaaaattcttttctttaagcatgttgaatattggaccccactctcttcttgcttgtagagtttccaccgagggatcagctgttagtccgatgggcttccctttgtgggtaactcgacctttctctttggctgcccttcacattttttccttcatttcaactttggtgaatctgacaattatgtgtcttggagttgctcttctccaggagtatctttttggcattctctgtatttcctgaatttgaatgttggcctgccttgcgaggttcgggaagttctcctggataatattctgaagagtgttttccaacttggttccattctccccgtcaccttcaggtacagcaatcagacatagatttggtcttttcacatagtcccatatttcttggagggtttgttcatttcttcctactctttttttactaaacttctcttcctgcttcatttcattcatttgatcttcaatcactgaaaccctttcttccagttgattgaatcggctactgaagcttgtgcatgcctcacacacttctcatgccatggttttcagctccatcaggtcttttaaggtcttctctatgcactttattctagttagccattcatctaatctgttttcagggtttttagcttctttgcgttgggttcaaacatcctcatttagctcggagaagtttgttattaccgatcttctaaagccttcttctctcaactcgtcaaagtcattatccatccagctttgttccatgctggagaggagctgcgttcctttggaggggaagaggcactctgatttttagaattttcagcttttctgctctggtttctccccattttgtggttttatctagctttggtctttgatgatggtgatgtacagatggggttttggtgtggatgtcctttctgttggtttgttttccttctaacagtcaggaccctcagctgcaggtctgttggagtttgctggaggtccactccagaccccgtttgcctgggtatcaccagcggaggctgcacaacagcaaatattgcagaacagcaaatgttgctgtctgatcattcctctggaagctttgtctcagaggggcacctggctgtatgaggtgtcagtcagcccctactgggaggtgacttccagttaggctacttggggtcagggacccactggaggaggcagtctgtccattctcagatcttgaactccgtgctgggagaaccactactctcttcaaagctgtcagacagggacgtttaagtctgcagaagtttctgctgccttttgttcagctataccctgccccagaggtggagtctacagaggcaggtaggcctcattgagctgcagtgggctccacttggagagatacttttcaattccagttccgttccacaaggaccacctcagaccacaggaacactcatcccatcgctggaggaggtaaggctgcacccatgcatattaaaactatacccaagggattctatttaatggaggtgaccgattgatggcacaggaagaaattgatgccactgaaagaagaatttattatgtatatttcctaaaagaaggagacatgtcacaccaccaagaccacaggggaaataccaggtttggacaggcagaagcaagagtgaggggaaggcctaggccacagcctttgttgaagtttccatgggaaaagcaagaagggcagagtaagcactttaggattggctatttgaataattccagagggctttgaggcataggggttgtctctagttgcctggtacctggcctgggatgatttagggcaggagggtggcttagcttggtatgtgaattagatacggaggtggttggggctatagacttaggatttgttggtttgcaatgaaagatgtgcttgtaggcaagttgttattatctttaggaattagcaagccctgggaggcagttctctcactgggtctataaggcctgcaaatactagagcattaaaaatacagaatataaggaaaatcttattagtataattggacctgtagtgccaaataggccaacacagaatctaaaaaaaaacacagaacaccatggcagcctcttctcactctgctcacagagggaactttgtcacagactgtggcctttagactgctttcctggtagtgactcaaatactagtttctgtatcccaaaatttcaagggaaacatgacaacttctctgggtgactcttaagaaccagcatcgggagatatacctaatgctagatgacgagttagtgggtgcagcgcaccagcatggcacatgtatatatatgtaactaacctgcacaatgtgcacatgtaccctaaaacttaaagtataataataaaaaaaagaaccccctcatttggcttaacctaagaggaaaacaagctctaaaaaggagaaatagtacatggctctgacaactctccagtctctcatgctctagagaaacgctgtctcctaatattctacctctccatgaactcttagtcttctcttatgtaacctggaggcagaggagaggctaaaggtggaaagaaaacaggtattaatgtctctttgcatgtcccaaatagctgattcatcacttagagtttggtctttgaggcctttgctgaaaatctaagacaggaaaagtaacatctaatatcctattatgtcatcagaatttaaaaatgcacatttctttgggcacagcaattcttcttctctgcatttgtcttacagatacaaacatacatatacagaaagacatatgtacacagatattcattgcaactgtatttgtaaaagcaagagtttgaaaacaatatgaatgtctcttgataggggatgtattttggcacatccattcaataaaataccatgtaggcataaaaagaaagaggcagctttaatttactgatatagtataatttccaagatagatctttaagtggaaaaagcaaggcactaacatgcaaaaatgtacccaataaacagtctatgtgtaagagtctttgttagtaaatgcacaaaatatctttggaaaaataaattaaaatttggtgacagagtttgtcactaagaggaaaaactagggagtgggtggaaaggagacatatttttcactgtatatgctttgttatgttttgaatttttttaccatgtacatctattaatcttccaaaatgcaaattaatagctttcccttctgtaccctgcctagctatcccttgtaaggttctgcactctatttaggaacagaggttttccttgtgatttctgtctattttcctaccctagttaccagggctgattaatgtagaaggaagtcccaaagtccattttttccttctaccaaaaagcctaggttttaggacaactagaattacccagctggtgggtacccctggtgccttccatagttctacaaaactgtgtacccctaaattgccctcccccacaagacctatcattccagaaggcaaagagaaggaaaaaaaatggagaaagctcttgtaattggttttaagaatttacaaactttctggctccagacctgggttattgtccattggtgactttactgtaggttcttgctattaggatactcttctcctcctttcttcagaaagaaagtcaatgggtggggaaacagaatatgataccaacccttggttctttttctatctctgctttgagttagctgtgagacctcgtcagtagtagttataatataatagcacattggcactgaagctcaccctggctcaacatgccatgtatcctatgtgcattactcacccaatcctcccagtgaccccatgaaatagtgaccattattaattcggttttatagataaattaactctctcacccaaggccatacagcagagctaggactctcatccctgactgcagaatatctgggataatttgcccaactctcttatattctcatcccttattcataagatacagagatgaaacaaagcttccatggcccttcccagctcaagttatggcaagactgtaatgctatgactgcctagagcctggactttgtctcccttctctgtcacctgaagcctcccaaatattagatctgaggcttttctgctcagcccagaaacgctaatggcttagcccaagacttcatggctctgccacttccttctgtgcttctaatttggaaatcctggaacccaaatcagcttgcttgtcaacagtgatcaacaatcctttcaagtgtcttggtaaacatctcttccctttccccacaaaggccgaggcacaacttcacactctcctcacatccttcactcaccccatcccatggcccccaccctttctgagacctaggttcatggagatatatgagaggtcttcagaaatttcatggaaaatgagtattatgaaaacactatgcatagatttcaaaaattttttgtaccaaaataaactaagttgttttaacatatcttaaccggatctagtttgaggtactaaaaaacataagacattagtttgagaagagcccccatcagagcaacatgaatgctgttaaaattaaagcaaaaacaaacctcaaatttatggtgaagcttgtgtggaagaatgacaatttatgaaaactttatagggaaaatgcctcaaggaaattagcagtttacaaatggataacctgttttaagaagaggcaagaggatgttgaaaatgaaggccacagtggcagaccatccacatcaattagtgaggaaaaaattaatcttgttcatgccctaattgaagaagactgatgattaacagtagaaaaaatagccaacactataggcatctcaatcagttcagctaacacagttctgactgaaaagttaaaattgagcaaactttctacttgataggtaccaaaactgttgtgcccatatcagctacaaataagagcagaactttcagtggaaattatccaagtgagatcaagtgaggtcaagatcctgagacatttattcaaagaattgtaacaggagatgaagcatggctttcctagtactgtcttgaagacaaagcacaatcaaagcaatggctaccaagaggaggaagtggtccagtcaaagcaaaagtggaccagtcaagaataaaggtcatggcaacaattttttggtatgcacaaggcattttgcttgttgactttgtgtaggaccaaaaaacaataacacctgctttttatgggagtattttgagaaagttagccaagttttagcagaataataaccaggaaagcttcatcagagtccttctccaacataacaatgctcctgattattccgctcatcaaacaagggcaattttgcaagactttcaatgggaaatcattaggcacccagcttacagtactgatttggctccttctgacttatttttgtttcccaatcttaaaatctttaaagggcatcaatttttcttcagctgatagtgtaaaagactgtattgacatggttaaattcccaggacttttgcttctttagagatggactacatgactgatatcattgcttacaaaaaatgtcttgaacctgatggagcttatgtcaagaaataaagttttaattttttattgttatcttttttggaatttttgatatatatatattttaatcttctaatccctttttttccacaagctttttgaagtctcctcatatgaggcaatgccgtgtaaagtgcttcaagtttctcttcctttcaatcttctctgtgaacttctgtgattcccaaggcagaatcaggtgctccttcctctatcacatgtggcccctcttcatttgtaaggaagactctagggatcttttatatcatagtattattacttatcattgtattataactgtttgtcttcaccagattatgaaattgagggtcatgtttatcaaacacagggtcatgtttatttttctagctccagcaaattaccacagagcctgacacacacaccacagtctccatgaatatggcaaagtttttgcaggataaaaacttaatattatatgcattttagaaagatcattctgacagcaacatggaggatgaactgagaggagtgagatgtcagacagggagaacagttaagaggccataacccaggccccaaatagctgggatctgaatcagggtagggggagcagaaggtagatacaattgggcaattcttggaaccaatttgatattgagggtgagggaggtggagctttatatattgtagttcctggtttgggcaaatggatggatgctgttgccactgattgagataagaaatcgttaattgacaataaaatatcaagctccattttagtcaggttgattttgaggtaaatttttcagtagatagttggctatttggatttaaaatatagaggagaggtttgggttaacaatatatttggaatgcaccaggatctacaaaaatcatacccttaagaatttcaagacagaagaaaacaaaattattagtaagagatgacattatttgatgaaaaaatatatatatgcccttaggaaacatagttttctgtgttgccctttccttctttattgaactgtcttccatttctacaggagtacagcataaaccatctaaacactatgggaaatggttgtcttctatgaagtatgttttcaaggacccacattgcaattcccttagctggataggggatgccaaacggcaacccagagccctgatgaatagggcacttcctactagagattcaaagaatctttctcacaaaaaggaaagaaaccagattctattaaccaagttgagccctgacactgaagggatttttctgtctataaaggtgaagaaaaagaaagaatattttaaataattcttaagaggtggtgtggttacttttttttttttttttaggtttttaggagtcttgctcttgttgcccaggctggagtgcagtggcatcatcttggctcattgcaacatccacctcccaggctcaagcaatttcctgcctcagcctcccaagtagctgggattacaagtgcctgccatcatgcccagctaatttttgtatttttagtaaaggcagtgttttaccatgttggccaggctggtcttgaactccggaactcaggtgatccgccttggcctcccaaagtgctgggattacaggtgtgagccaccatgtccagccgattactttgtaataataacacaagatagcagccagcaggttatcccatagagtttgtgtatctggactgctgcaggctttttaatttactcaaataatttaaatttcagtcctagtaaatctaaaattaggtttatcattcaaaagttgctggaatgaatgtttccatcagctagtgagatctttgttctggtgcaggacagcccagagtatttgcttctggtcacaatggaccatcaaagaaaatgtccatgacctacaaacattttcttgcatgtgcagacaagaatacttgaatttccagaatccaaagataaaggagtaaaacaaacagcaaggcacataagcatttgcatttttacactaaaatctatttatctctctatccttaacaaatggaagtcatcagttaggaagaaaagaatcctaaatagctaagaacactaataaaattgcagaattttgaagaacaaagaaatgatgaattatggactctttttgtcatgaatcacggataaactgctaaaaattaaataatttcttagagctgtttgtaaaaatttggggacaaagcctaagaagtatttatttagaaactttaaacagctggccaacaggcatcacctgaattttattactacaatgtcagtagacaaagcaaccaaactgagaataaaggagaatctgatacaccaacagatgatgattttggtggaaagcaaaatgcaacaacaaatggatattgttaaattactgggagaggaaatttccgaagcagatcatttcactagtggttcagaacagaataaacaacaatgccttgaaagaaattgcaaatattgtgctttggacaaatgcttaaattgcactccaagaaataaaggctttaggataatttctatttcttttaagttgcaagcctctcttaaggccttatggagaaccttcatgaactgttggtgtaagctgatgtccatggcatgtgggtacacaaccagtcggtgataccttattgagatattttactaccaaaacatttatccctctaaaacagtgaccccccacctttctggcaccagggaccagtttcatggaagacaatttttccacggactggggaggcggcggggggatggtttccggatgaaactgttccacctcagatcatcaggcattagttagattctcataaggtgtgtgcagcctagatccctcgcatgcgcagttcacaatagggtttgcactcctatgagaatgtaatgcccctgctgatctgacaggaggcagagctcaggcggtaatgctgcaatgcttgcttgcctgttagtcacctcctgctatgtggcccggttcctaacaggcattagaccagtacaggtccttggcctgggggttggcaaccccgtgctctaaaaggctaacatggtctccatcttgttacattttgtagacacagaaaacttttttggtatgtttgtttaattttacaaaaaaaaaaaagggataaaactaaacatgttattttgcaactcatttacatagttttctgttctacagataccttgagttgctaaacctttcatccattgttagattttcaggttgtttctatatatatatttgcacatttctataggataaattctgaaaagagaggttgccgacatcaatatgttagtcatataagttttggcacaaaataattgagtaatatttgctttaaatactttaaagattttggatttgaaatactctttatttataaaaaaatctgtgttgttataaacacaagtagttttatttcattcctacactctggcttcgattaataaagaattatataaactttctaattatgtgctcagaaatatataaaatataaattttgattttatttttctttaagaagtataaaaacaagactactaaaatagtgatgtagatatgatttgtcatttggtattgtgcttttagtctgttactttttgtgtttaaatatgaaagggagaaataataggtttaattacagaagcattatattaaataattctccaatgaagagttataataaactctaatcatatttctgaattaaaaatcttaaacattttttctccaactttaatttgcagaagcagtaacaggtgattcaaaaataagtaaatacattcagaagagatacagatccagagctgcaggcatttcatgtttaaacaaaaactaacaatactattggctgtttctcatcaataataatgaaattactttctgtaattaaaatgttaccctatagtaaatttgaaaaatgcctctatttgtggttataaaaagataatttttctaatatacttgaaagcagattctgaagaaattatgtgaggtggtaggcatgtgaatgttacaggcagagtaaaaatattcacttgcttaaattaatctttccttgtacagtaaatgtatatgtgaaatcaagttatttcatttacagatctcaataagtaagatagaaggttgaacttttaaatggaagaaatctcatagtaaaagttttacttttaaaatattcaaaactcatgcatgccaaaaaccataaataataaaatagtatgatattcgtgtagaaatagaaaagttgaaccatcagaacagatgagagagtctagaaacaaaccctgtgtatatgtgaatccaatacattattaaggtggcatttaaatcaatgaggaaagaatggattatttatttggggaaactgaccactgaatgggcaatcaataaaattaggtctttacctcacatcatacgcacaaataactttaaatggattaaatatttaaatataaaaaaatcagagtggtaggtcaaagcataggaaagcatttctataatcatgaaacaggcaaacaatttctttttttcttaacttttagcttaagttcaggggtccatgtgcaggtttgttgtatggagaaactcatgtcacaggggtttgttgtacagattatttttttcacccaggtacaaaacctagtacccaatagctattttttctcatcctctccctcatcccaccctccattttccagcaggccccagggtctcttgttcccctctttgtattcatgtgttctcatcatttagctcccacttataagtgagaacatgtggtatttggttttctgttcctacattagtttgctaaggataatggcctccagctcaatctaggtttctccaaaggacataaacttgttcttttttatgattgcattgtattccatggtgtatatgtaccatatcttctttatccagtctaccattgatgggcatttggtcgattccatgtctttgctattgtgaatagtgtcaggcaaggaatgtctaacttaagcccccaaaaccacaaacaaaagatctatcgatttgattataatcaaacttaaaattttagcatagcagaaaatacacaggtgaagtaaaaagacaaatcaccaacttgtaacaacgtgttagctactatttccacatagggaagtcaaagcctactctcattagtgcttacagcaagctacaaggagacatgccaactcattccagattctatgccacacatatttacagggtgtgtgttaggtgccagccatgctccaaggcactaatgatacacaccttgttaagacattgagctttatggtgagagcaggagggcattgttaaagcgctttaaggagttcagaaaagttcatgctcagatttaaattttagttattttattttattttaatgagattgcgtttcactctgtcgccaaggctggagtacagtggcgcgatctcagctcattgcaacctcagcttcccaggttcaagcaattctcatgcctcagcctccctagtagctgggattacaggcacacaccactaggcctggctaatttttgtatttttagcagatatggtgtttcaccatgttgctcaggctggtctcgaactcctgggctcaaacgagccacccgccttggcctcccaaagtactgggattacaggtgtgagtcaccatgtccggcccagatttgaattttagaacagttgtgctggctgtggagcagagaaccatttggaggggtggttgggtaagcagatttgaagggagaaaaaccaggtgggatgctgtggcaataaccctggtggagatgacagtgacctgatctaattacgggatgtgaggatggtgagagaaagtagactagacaagactttgtgaattgcatatgggggtcgaagtagatgcagaaataaaataccatgcacacgtttctaccttgagcaactgtgagaaaatggtgccatttcactaaaataaggaggccaggcggaggagaggagcatagagggaataggacatcaggtgttgccatgttgagttgtcaatgccacgaaacatccaagtggagaagtccagagcatagctggatgtgcagtttagtagaacaatctgagctggagagctgtgtatcccaagtgcctcaggctgcagcatccaaggagaataggtttagtcctattactattatttcccaagtttcatgtgttcaggcataacatctatatgattatagaaagtctagtctgctgtaccagctctctctccaagactcctcctagaatacttataaatgtccaggaatggaatctatcctttcctttttaggttagaacggttcctgtcactcttaccatacatatgtttggctgagctgggaaagtacaacatgaaatgctggtgaaactgggagcacgagggccataccactccactggtcacactcagcctgtgacggggtatttgagcatgtctgtgtcagtgtccacagcccctctcctgtagcatacactctgggaaggtgatcagattccgatgagtttccatgtcacctgctgccctcctcctcctagacccagccctgccctctgatattagtcaccaatgctgatcctagttctttttgcctctggcccttacgttgaactctcttcagggttccttgatgtctgtcccagcaacctccctcctccaagtcttcctcagccatcagacattttttatatatctgaagtgcagggacctttcagcccttgtggaaataagtagctgtggataggtagggggagaaatgtcatttgatctccttcacctgactctagttgttgctggaacaggactttgttgtatattcaatcctgtaatgcccttgtctaagatgaagccccaaaagtctcattcaagaccttctacattctggcaggggtctatctttacaaacttccatcaacaccagatcacatcatcttccactctgttgatgtgtctggttatgggagtcctcatcctgccacatctgttcctctgagtcttatctgcctctcagggactgtctagatgctatggcagacagccatatgaaaaatcaaactctctcattccagagacccatcgcactttgaacttttggtataaccctcttcatttattcttgccacaaatattcatggaacaaaattactgaaaggcaatatgagtaatggtgaggagcactggagtaacactgtctggatctatcctagatttgccactgactagttgtataagctctggcaagttacttcatctttctgtgcttcggtttcctgctatataaaaatagcgataatgatagcacctccctcttagggttattagataatgaagtagatttattcatgcaaagcacttagaatagtgcctgcacaagtaagtgctcaataggtcttggttattgttatatattttatttttaaaatatagtagagcaacagagctgcttttcggtcagcttctctagatcagcatataggacaaatacaaagcttaccatctgcctctgatcatactgaacctgacaagtgttcttgaagaatgctttgccttcacttttaacaatctttatccagcagtgaattgacccagaatacatgctctgaatactctttttgttctgactgcattggcttttgctggcttcaattctcattgaatgataattatttagtacccgctatatgctggggctatgttaggattagataagccatcataaggaaaacatatgtgatcctgtcatcaatgcaatttaaaggtatatgggcattaaataaatataaagataaatgcccaaataaacatatgatacaaaactgtggtaagtgctgtgaagaaaggaagagtaaaaaggaaacaaaacaagaagcacctaatttacattgggaggtcagtggcatccattgaaagaagtgatgtttaatcagttagcttggaatagccacgtgaagagagaaaggaagacctcaggtgtgcacaaaggcaggaaggaaaggaagagcttgttgagatgagggagatggaaggagagtaccgtgacctcagcccaggaaatgagatgagataggaaagagaggcaggacctggtcacctgggggttcttaggccacactaggtatcagaaattctattccaagagtactgggaagccactaaagggttttatgcagtggagtgacgaataattgaatttatgtctttaagacattgcactggctgcagcgtgagtgtggattggaaagcagtgaaaagggaggaataataagctccctacaacgccagacatgactcccaaaacttagtagtaagcaaaaacaccaagtcacaggagaatgcattctcattgattcacataaaggtcaaaaaacaggcaaaaccaagcaaaacattaagaatctctgtgtgtgtgtgtgtgtgtgtgtatttattagataaagaaatataaacaaacacaaagaaacactaatccccaaattcatgagagtggttactcctggggggcacagcagagtctctagtttgaaaagttgcacatgggagacttcaaaagtgattcgaaattttctatttcttaagctgagtggtgggtacatgaatatttattctttaaaatgttcatttgcataatatatactcttctctatgtatgctatacaccataataaacatttagattaccaagctcaaaaattcataaaatattaaaatatgaaaaagttggggggcagatgcctatgggtgtatattatattattctttatatttttccaaaaataaaaataaatagcaaagggaaaatagatccaaggagggaggaagaaggaggaaagcagcagggcctccaagctgggtgattccaagggcaccttcttagtgtaaactatcacttgtagtgatgtgccccagggggtgcacgtacctaggctgcgacatacacgttgcctcctgaggccccgcagtgccatggcctggacaccagcggggaagctcctgcaaaagtccaggctatagataactatgacttggactaagatagtggcagtggggttagagaaaaatagacatattcaagctatatttaggagatagaagagaggtcttggtaatagattggatgtctcgctgtatcaaagagatgggcggtaccgcttcccccatgtcatttggcttttcgcaaaatcctatgccaagagctgggcgtctgctaggtcacagatgcctcacagacactgatcatgcctcactgggagatttcaaaactttaattctgtcaggtttggcagtttttccaatgtcaccccaaagaactttaaattctgctttcatgccagatttcccagcagcgactgccaaacagctgcagagggagcctgaaacagagaaggggctcctctggccccccagaagctaggctgatttcggaatgcctctagaatccagcgtgcttgcccatcactcataaactgtgagtgtaaaccgcagttaagctcatatgcttcagttcctaaattacagttgcacttgggggaaatagctgctggtatttatcacagtgccctccccctagaaagtggcccacacagtcagttattacttggtcctgctcctcaacccggagcagcctgggttatcacttggccaagcagttattacgtggccagccttcctgatgcacctgcgtcagcaacctgcaaaggagccacctgctgtgccctggttatggaggaagcagagtccagtgtcccttctcaccagcacagcctgccctcgaggtatagacattcatgtggtgattgaaaagaagtttatttggcattgtactctaagctcatctcatctgggctggactgtgcagttctgaattatgttcctccacctctagggcactgtgatgtggcttgtaagaactcaggacatccctgtgttatctgacagaacaatagaatgtgtgaaagcgccccaatcatctctccttctttcaatcaaaaagtacttattgagggcttgtctgatgtgaggcactgggtcagactcggtacaaaaaatgaataaggcagtcaaaatgctagctgtgaaggcattcatatccacttgtactttgcaaatgtgcttcgagtgtttggggagctaatgtgaatcatcactggctttcctactcatgcactaaatttttctaccttccttaaaacttttacttgtgttacagcctttaatccattttactgggagggtttctattcaattggtcattatttttagcaatgggatattactaagctgattttccaaaaccaatttgctattttctgtccgtaaggtatttctactagaagcattttaaagcctatggtcctaagctgatgctaatgatctgatggtatttcttctgccttatcttaccaagggtcaaaggaatattaatgatgtgtgtgcttggggtccttaggcaactgatgagcgggagactgagtgtgaaacaccacagcagccagagtccattcaatatacccacatgtagtgagcaacctttagtgaggaacattattatttatattaacactcatactgaagcctgacaaagaaaacaaatgaaaagaatattatacacaaatttcagtagtgaatatagcttgaaaaagtaaaatgtcagtacgactacattcaacagtatgttaaagaataatatatgacaaaggagtttttatttctgaaaggaaaatatagcttattataaagaaatttattatattcataaattacaagagacaaaaacaatgaaatcatttccgaagatgccaaaaggagcataatataatttaacaggcatttctaattaaataaaggctattagagagtattatgataaaaacgatataacagaaatccaaagcaatgttagattaacagtgaaacactagaggctattccattaaagtcaggaagaagacaattttactcactatcactactatttaatgttgtgcaggaaaccaatttaataaaccgtgttttcagaaaacctctaaaaatattagaaaagacaaactttgtattattttcagatgctatcattgtcttcctaaaaatccgtgaaaatgaatgaaaattattggaaaaataaaagattatagcatggtaacaaattacaagaaaaatattctgaaataaatagctttctatataccagcaatagtcagttagaattatgactgagaagaatccattcacaattgcaacaacaaaacagtaaaatgttcaggagtaaatgtaaattgaaaataaatgtataaaatctgtaaagaaaagtgttcaacattgctgaaggacaaagaagaaaacttgattatggagagtgatataccatattcattgatgagaaaactcaatgttgtcaacatgtcaactttcctcaaaatagatttttaaatttaaagacagtccataaaaatcttctacatttgaaattatggaaatttaaaatctacataaaagatgaaaaatagtgcaataagcacttgtatagccctcactgcaatttatttggttggtgcaaaagaaattgcaattttgccattagttgcactaacctaatatcaactgttaacatcctgctacttttacttcatctcatacacttttgttttctgtgctatttgaatgtcagttgcagacatccattgcactttacccctaaccacatcaacatgcattttctaagaattaaggcattttgacacagtttcacacttgagacaattaacaattgtataataccacagaaaatggtgcttgtcagactttattaagcatgcaagtcacctgaggatcttgtcaaaatgcagattctgattcagtaggtctgtgatgagggctgatgttctacctttctaacaagctccaaggttatggtgatgctgttggtctgcggaccacactttgaattgcaagaatctgctaaacattccaaatgcagttttctcaaatgagcactcaaatggcttttggtagctgttatttttcaattcaggatccagtcaagtttgacacatcacagttgattgctgtgcatcaccagtcttcagaaatctaaaatggtcattcgtttttttattcttttaaaattttttcttatttttttaaataaacattttaagacatatgctgttgttgttgttgttgcccaggctagagtgcactcactacagcctcaaactcctgagctcaaatgatcctttcccctcaaccccttagtagctagttctccctgactcatttttaatttttttttttttttttttttttgtagaaatgggttcttgctatgttgcccaggctggtctcaaactcctgagctcaagcaattctcccatctctgcctctcaaattactgggattacaggcatgagccatcgcatccagcctttttttttttttttttttttttaagaggacaggccaggttttagcagaatgacccctagtttttatttctttgatggtttattaataattacattcaggttaaattgtttgtcaagaacatgacacagttgatgttatgcactggctactgcaacacagcaggacacaagcatgccagatgttgctctattgttttgtattttttactttaaaaaactatcagattagatttacatttacagaaaagttgcagagtgagtacggtgaattttcatatacctcaccctgagtttcacctattgttaacaccttacactagtatggtaactttgtcacaattgatcaaccaacactgatacattgttattaactgaagcccatactttggctaatcagattttcttagctttaatctaatgtctttttctgctccagaattccatccacgataccacattatatctccttagactcctcctggctgtgacagtttctcagactttccttggttttgatgacattgatattttccagaagaacttgtcgggtattttgtcaaatgtcctcagttgtgatttgtttgatgttttctcacaattagataattttcatttgtgtatgtcacttaaggttttttactggccaatttcttctcttttttctttctttgttctaactctggttttattttattagagcctcattgcatgtagtttgtccatatcagcatgtataatctgtaattctttcaaatctgcaagtagctttctttatattatgaaatggtttaaacataaagtacagaaagtgacataacgaacagccaggtaccacatcccagcttaaaaaattaaacattacatatagaattgattccctctattctacctttccagcttctcccctttctttctctaaagatgaaacccttaacctaaatttggtagaggttattcctatgccagtcttcataccttgttacatatatgtatcccttaactatatatagtattttccatatatttaaactttatgtatgatagcacattgaacatattcttgggcaacttgctatctttgttcaacattatgtgaggtttattctgtagatacatgtagttctgatccatttattttaatttcagtaaacataaaagagaaaaaagagagatgattaaaaaacattatgtattaatgcccatttgtgaacttagtatttctatgtggtatgcttgggtttaatcttaattattttattcactgtgtatttattgaggacccactatcagccagatagtgtgcaaggcactagagacacaatgatgagcaaaacagactaagtcgtctgctctcaagaagcttacagtctggttgtaaagtaagggtcagacatgagtcaagtgctcacactcatttattaattacaaactgtgatgattgaggtctcctccagttagggaagcagacctaagagtctggggagactggagcagctagaatttgcaggacagaggactggagaggaaggagctgcagggagatgttcacaggtttacagaaggttcctctcgagtagtcagaagagtactgatcagcacacatatgtgaggaaaccaaccaaggccaaggaaagaaccataagaaaggtggcagggtgctcccacagggccaggaatagtgcctcttcccacaagccagactgaaaaacctcataattcataaagcactgggcttagtgctcagagtagtcttcccttaggagtggagaataattatctctagaatgagccctgctctgaacccatttaatagactttaggcaaggatcaaactgttccctagtaacttaactgcaccccagaacagaaataaaaaatattaataggaatactaaaatatccagcatctaacaagatacaattcacaacttctggcttccaattaaaaaatgtaaggcatacaaaggagcaggaaaatacaatcataataaggataaaaataaatcaagcaaaatgaacacagaactgagatgtttgaattagcagaaaagaacattaaaacaggtgttacagctgtattgcatatgctcaaaagttatgtagagacatgaaagatttttttttaaatccaaattgaggtactagaaatgaaaactgcagtgcataagataaaaaatacactgaatgggattcacaacaggttaaacactgcagtagaaagaaaatagttaatttgaagatgtagcaatagaaattatgcaaacggaacacacacaaaaaaatttaagaaatggacaaaccatcagtgagctgtgggacaacttcaagtaacacaatctacattttattggagtccccagagaataggaggtaggaggagaaacaggaaaaaaaaattcaaagaaatcatggcttagaaatttccaaatttgattaaaaaaactataaagccacataaccaagaagctcaatgaatcccaaacacaagaaacaagaagaaaactataccaaggcatattatagtcaaatttctcagcaccaatgattaagagatcatcttaaaagaggttaagaaaaaaggacatattacacacagaggaacgaaaataagaatgacaacacattcttatcaatgcaagcaaagcaagcaagaaacagtgcaagcaagaagacagtggggcaatgtctttaaataactgggagaaactgtcagtcgacgattctatatacaatgaaaatatctttcaaaaacaaaggttttcactttttcagacagggcaaggatgctcttgctcaccacttctatttaatgttgtatttggggttctaggcagtgcaataagccaagaaaaagaaacaaaatgcatcaagattgggaaggatgaaataatctagattggaaagaaagcagtaaaaccttttttactcacagataacatgattgtctagtacaaaacccaatgaaatctactctagctactagaagtgttaagtgagtttactaaggttgcatactgatacaaggtttctaaggttgcatattgatacaacatcaatatacaaaaatcaattgcatttccatacactagcaatgaacaatcaaaagttaaaaatttctaaaaaccacttaaaatagcataaaagtattaagtatttgggaataaatctgacaaatatgtacaagactcatacactgaaaactccaaaacattactgagataaactaaataagacgtaaataaatgaaaagtatcacgtttatgaattggaaggctcaatatccttaaaatatcatttctccccaaattggcctatagagtcaatgtagtccaataaagaacccaactgccttttttggtggaaattgaaaagctgattctaaaatccatatggaaatgcaaatgactagaatatccaaaacaactttataaatgaagaacaaaattggcagactaacactacctgattccaagacatacataaagctacagtaattaatacagtgttgtgttggtgtaaagacagacaaatagattaatggaacatagtagagtctagaaagagactgacatatatatatatatacacacacacacatatatacacatatgtatatacacacatatatatttatatatacatgtatatatataaatcatgtgatatataaatataaactgattttctgattttgccaaaggtgtaaaggcaacagagagaagaaagaattgccttttcagtaaatgttgggaacaactggctaagtatatgtaaaaaaaagaaaagaaaaacttcaatccacactttatactatgtacaaatatcaactcaaaatggatcataggcctaaatgtagaacctaatactatataattctaggggaaaaaatgtaagaaaaaaatctctgatcttgggatagacaaagatttcttagatacatgtcccatgtgcctaccataagcatctcttctgagaagccctttcatgcttgaacagtttgcttttttcttttcattcttccttagtgctttatacatgataatcattaaattatattgtaagtgtgtttatatttctctattccactgagtatccctggagtagaaaacatgttttaatccttttaatattctccaagtccaataaatgttaattacatgatatcttcaacaccaaaattaatcagagagcctcccagaatatttcccccatgtctcactggccatagggttgcccctacgcaaatcattagtaaagattaatgggattactattatttccttggacgaattatgttttgctctttggcgatgggcttattttctctaaggagctttggctattgggtagtctggatgcagagcctgccacggggaacctaacggaagtgtgatgggaaagctggtgacactaaccaggctgcttaattttccactgtgaaggtataattgacaaacaatcttaccttatgtttagattttggaggaataaactgtcagatatcactttatttgaaaataaaaagaataacagccatactgcagtaggaagagtgaaatcattcatcttaaacagcaagcctttgcactgagctttttatagctttttagataatgtctctatagaaagaaactcggtaagctttactgctgaatcatttatatcaactcacacaattttgaatattcattaattttcacaatagccaccagtttagaacttatgttatacaaacatcttcacaaaactaactcaagcacagatatctttattgtaaatgtcagaaacaaaaaaaaatctaattggtgctgtgggtattgagagtttgtattttctctgtggatgtaggagcttacagaaaatagagtgcaagaaaaaaatgtgtaaatgttgtttctagcctaacaaatctggccagcgagcatttcacttcaaaaaaattagcttctttttttaaaattcatatttttgatattttgtacttttgtgtttttttttttttgtattgctacagaggatctcttatttttatcccatgctctgaatctcaggctctacc

SEQ ID NO: 1363 - DNA, 20001 bp, Homo sapiens
tgaggctgagctagccacaccccgcccatgcccactgctgggatgtaggcctcgaagccttctacctagaccctaggccctcatcctgcctcctgacttgctcatgcctacacacacccctccccaggtccttggcccttgccagacattagcaccatgagcttcgtggcatacgaggagctgatcaaggagggtgacacggccatcctgtcactgggccatggtgcaatggtggcggtgcgtgtgcagcgtggggcacagacccagacccggcatggtgtcctgcggcactcagttgaccttatcggccgccccttcggctccaaggtgacgtgcggccgaggtggctgggtgtatgtgctgcaccccacgcccgagctctggacgctgaacctgccgcaccgcacgcagatcctctactccacagacatcgccctcatcaccatgatgttggagcttcggcccggctctgtggtctgtgagtctggtgagttcctcaggctgcctcagtttaacgcagaaattgacacaaaggtggaggtcagagcctccagcctgcccttcctacagacacatgtggctcctcagtttctattttcacatctttccgggatgctgacagcagggagtgaaggtggaggcagagaagcccgttaggaggctggtgctgtaactggagtgagaggtggtgggaaatggaccaggaggagctggggaggactggtgctctagtgagggtcctgcttgccttggtggggcgtggccagcttgatgcttggcgctgtcctaggtactgaccgtcaacctctagtcctccgtgctgatggtgaagcagagagagttgccccttctggaaagaggccagggctaccccgaggagctcactgtaggtggggagccttccccatcctcatccatgatcagatcctcacctgctaccaatgaatgtgagcaccattgttgagtccagggcctgggctgtgggaacccctgcacatatacaggtgctggggccgcccagtgtggcgattgaagccaagattggccccaggcgctgatgcatctaggttgttggtggcgtgttcctcccgggcaggagagctagggtccaggttcacgaagagtgcctagcactgccatgctggctttctgagggctgcaggtcaccatgtccctccctggggtgtctgggtgggaggggtggagagcaggacttagccaactccatcagctgctgctcctgtgcatcctgtggtgggtgctggcctctccgcccctgccccactctcgcgagagagctcaatcaagcagcaccttctcctggcctcctcagatatgccaggtcccctcctaggaaccgtgaactagagagaccaggttcctgccctcgaggagggggacacagcctaggtgagcatctcagtgccgctggttgctgtgaagcctgtgagacagggctgcgtgtctgaggggtacccagagtggggactctccagctaggccaggcagggaagacctctctgaggaggggacatttgagttgaaaatgatgaggagggacctacgaagagccaagggacagctctgcaccaaggaggagccgtgccgaggccctgcagttggagcatgctgccgagtcaggctcagtgggggaggcagaggggctgggagtgaggttggaggggaagcgagctccaccccggaggctaacaagtctgacttgccccttagtgggaagggggcatggccaggctttgcagaggggcgaggcagcaggctgggggcacccaggggaggggctggacaggtggggagaggggctggcccctgaaaggaatgtgggaggtggcaggacgtgggacgggatagagggagtggaggcacctccatgggtctggcccaagcacttgcgatgctcagcgctatttgggttccaggcatgggtggcaagtgtgcagtggctgctctagcaggagtctccagtggaggggcctggggatgggagtggcatcaggtagatggcccctgaagctggagtgggaggagggatgcaagccttgaccctctccataagacaggaagtcaagcagaggggccatcttgagggaagctggggagggaagctgggggcaggtgcgctggggaggactggggccgtgtggctggtggccaggccctgcgtcctgagtccaaccaggccagggcagagccccagcccctgtgtggtgggggcaggtttgggcaggcttggtgggggtgggctgtctcaaggggaccaaggagcttctggggagaggtgggcatgaggaccggcagggtgggccactgttgacggggattgaggaagtgatgggccatgcatggaataagacagggctgagtgatgggatggcctccctgtcccccttgcacagatttccccggaggctccaggcagctgggctgctctcattccctatacctgcgctaggcaggatagggcagggttgccactggcctcgcctgtgcccacaacagacagcacggcatacacagcctgtcaaccccagctcacccctagacagggtgcccaacccagggctagcctggggctttaggcagccaggaccatacagccctggaatgacgcccacctgtagcttggggtcctcccaagccctgtgtgggtctccagggtgaggtgggggttgtttcctgggaggctgtgggtcccgagcagtcccaactgatgccttgcccatcccttcttgtcctgccaggcaccggcagtggctctgtgtcccacgccatcatccgcaccattgcacccacgggtcacctgcacacggtggagttccaccagcagcgggcagagaaggcccgggaggagttccaggagcaccgtgtgggccgctgggtgactgtgcgcacccaggacgtgtgccgcagtggctttggcgtgagccacgtggccgacgccgtcttcctggacatcccatcaccctgggaggccgtgggccacgcctgggacgccctcaaggtcgaaggtgcatccggggttccgggagaggtacagcctgggtgggggtggggcaagggtgcaggactgagctcctgggatctcagaggggtccagagaccaagccacaccatggcagtggccaggccagggccccactttggcctgaggtgaggagtgggtcaggctggccaggggaggcagagctggggaggatggtccctggctgggccctgctcctggtctctggcctctcccaaccccctgatggaggaaggtggcagcgccacccaagtgcagggcaggcccggccggaggagtctggagtcccctccctgctgtttcccaaaacctctcctcccccaggctctggagcccagggagctggccccttttagggaagatgctgggtgcggaggcggggcagccctggggaaggtcgggcctcaagccagggaggtggctgggaggcccagggtttttcccttttctggagaaggagcagctcaggcagcaggggccccttccttcttcccagctgagagttgtattctgagagggttgaagggtggaggtgctgggcgccccaccccacctcaaagatgagccgaggcctggtgcgaacagcaaggctgtggccgggggtcccctgctggctccagcccagccctgactcctgggtcctggtctctgctgaggtgggtagctgtggggatctccacaccctgcctcctaggcttcctgctctggggacacttctgggcctggaccatagtcccagggaggctgaacccggcagagcctcccctggggcccccctgctgcctttgtgactccttcctccagcgtggctcggggaacccgcgcctgcctctgggacctgtccctttccctgcgagctcccccttctgggtccaaaggctcctggctcattcatgggcccggcatctcctgccggccacgggagcccgctggggaggatgcggcatgctcagcctctgtgccctgtctaggctgttgtcacacagcaggtgcctcctctaaccccgaacctcctggcggccccgtgttagggtacagctgaggagaccaaacctcagggacgtttgaggacacttgcctgggccacatacctctacccggccctggcttccccaggtcctccctgccaggacagggacccgggctgggttctcattcactgcaggccaggccaagtgaagcccgtggctgccctggtgggaggcggcagggaggggctgtcatgctcgggctctgcttcgagtaggcgcctcctgttcccgggagcagcgacagcctctaatttcctgtgacagcagcggcccccgcaccgccccacgctgccgtgctgtcagagctgctccgggcccagagctccagcagccctgtggaaggcaggagagcagtgcccgctgtgggccaagtgagacaatggcagcgcgggcttgacccggtgcctggcacatgggagggcctggcatggctaagctgggtgacatgaacagcggcgccaggccccatggggggctgtcagttgagggccaggcccctctgccctgcagtcccagctcttggagagcttgcagtctgtgttggggctgtcttaggctggcctcagaccctagggtgggagtccagggatgctagggccagacgggccaggctctgccacccctgccctctgaccctcgggtcctgtttcccacaggcgggcgcttctgctccttctcaccgtgcatcgagcaggtgcaacgcacatgccaggcgctggcagcgcgcggcttctcagagctgagcaccctggaggtgctgccacaggtctacaacgtgcgcactgtcagcctgccaccgcccgacctgggcacaggcacagatggccctgccggctccgacaccagccccttccgcagcggcacgcccatgaaggaggccgtgggccacaccggctacctgaccttcgccaccaagaccccaggctagggggccgcctcccagggcaccagggagctgggagcactgaagggctgggcagggaggccagaggcaccttatatggtcagcgatgcctgccagacacagacggtggggtggggcttgggggcctcctgggtggccagagtgggacagcaggaagggcggctgtgatggaggagcagtgctggggctgggcctcagccattcctgtccagccctgtggcccatcccagctgctgtttgttgccaatatgaagtatccactgccacaggctcccctgggtgttgaagccaaagggtgcaggtgggggagtctgaccccctcccaggtgggcctaagcaggaagggggtggaggagggaggggggcattgaccctgagaccacgctgcgtctgacccctgggcccccacggccctggctgccccacggggcctgagaccatctcgtgcttctccagtccccgggccgaggctccagccttggccagaagctggggtgagctgacccagaatccctgccctgctctccccagcgctaggagaccaggccagcccaggaaccagggaggtgaccctgctctctggcctcctggctgatgtcacagcactgagctcagcccaggccttcgtccactcatgtccaagaggcggggcatcccccacccagccagagcccctgacatgggctgcactcgctgaggccaggcagcgctgcggagaggagcggcagagtgggttgtctgccgcaggcaaccaggcaagtgtgtcggggctggggtgtgaatgccagcctgtgagtcccggaactatgtgggtacccctacccctcacagaagccaagggcatggaggaggtccctccacagtgacaacggtgtggggtaggggaggtgcattcaggacaccacccagggacagtgcctatgtgatcacctcttaaaggctaagcttaggggcatttcccaaagtggggacagagggcaggacgcccaggctgggggctctcctcgcccgccctggtgtctgacagcctcaaggaaggagcagtgcctgtgtcagccatggggcccttggagctgccgctggtgcctagggggcctgggtttctgcccaggcagccagtggctgttgggagcctctgtttcccctgtgctgggggccttgagtgctatgctagcaggggcctggccccaagtgtgagtgatgagcaataaacgtaccgtccccctctgttctgagtgatccctagcagccaaggccacccccagctgctgtctaggccagccctacctgcgctctgcccctggtccctgctcctccctgtcctggtttggcatgataggcgctccagtctccaggacaaaggggcaaatgtgtggccacccccatctggctgcagaaaaggccactccttcctggggttggggtggtccaggagtgctgggccttcttccacagtcctgggctggaattcagtgtggctgcctgggttacttgtatgcgcccctgaaggaagggtccactccaggccgcctggtccctgcgaagtgtcacactgtgggtcaccgggggctgtggctaatgtggtccgggaggcctgtgtccctgagagttgctcagccctgctccgagggcttgtcctctccttccaggacccagcttcccttctaaccttgttactcacctggggcacagaggaggggcccccagtcaggttcaacatggaagtgggtgaccctaatgccaggagctttggggtcaggctgtccctggggtgtcatgaactgggtgacgcacacccctgagatctcagttcccccaagcctgccctgcccctcctggccacagcaaaggcctgcatggtgtctgatgggtggacaccgggaggtgtttctttgaggcgcagctccatggtttataggacacataggcctcaggcaccgtagggtccaggttgtgcccattttccagccggggctggttgccctggtggcagccctgggtgagtcaccagggtccgcacatggagagcgggaggtcccagcccacccttagttgtcacatgggacagagttgctgtgtcaatcccctcggccctgctgctctgccctgcacacaggcccccatgatgaccttgagcctccaggcatccacccccaccgtatggccctctagacccagctgggcctcaccccactccctcagcttggatcctcacgtggcctggagccagcattaaactcctgtatgtccttcaagaccccttcaaatgtccttttctcagcatgcttccccagacatctaatgcccaggcgggagagtcctgcacaccatgtcccgaaggagtccccatagcagaggagcagaaggcaagcagcgccccagttctgtgatggggagcctgactttcagaggtagagctgggcccatggccgtgagtgaccgatgagcaggcccggatggtcagcgcgagtcagcagcacgggctcatcatggggcacggattcaccagaaactccctgcctggcccagtgtgtactcgcctgtggccctcagattttccctggcaattcctccccgctcaccctgctgtcctgcactgagacagtggcacatgactcccagctgcccaagccctggaaggtcccagaccctggctctgactcagctgcttggagggtcctagtcctgggaactgccctagagccgagattagagtacccctccctcaggaagccccggggtgtcagctgctcctgggcctcactctgccccacccatgcctgcctcagggcccagcccctcacccaagagccccagaggcctgggcccaacctgggcttcacgggtggggaccagggcagggtttctgggtgggtggagggcagcaggccggtgggggcacaccctgtctagtagcatgtgatgaggcagggttgcccctgagggcccaagaggccctcacccctgcagcctaggtctggggctgtcccctccactccctcttctctgcctccattgcggctttgctctctccacccaccacctctgggccagaagatggaggatacgtgggctgccaggggacccgagtcccccaacagtccactgcacaggtagggaaactgaggcacagagctgcaactccggaatcctggccataagtggttccccagtgcatgaccctagagggcagagagttttcaggcagagtcctggaaggttcctcagaaaaggagacacctgtgcaggtggacattggagaagggtgggcaagtcatgcaggggggtgggaggtgccccagaagcagtgggtggagagggtgcacttccagcctctgggctggcaagtgccatttccaaagctgctctaagcagggtgggcactggactcagtgcccccacagccccggggctgttgggctcgcacgccagcctggaggggccttgagcgagagggtccccagagaggggcctggctcctgatgccctcaggagggagtgagcaactgccgggcctcgcgccctgtcctcaccagccacagagggtgggcgctgtcatcagtatgcatgggttgagtgcctcccacgtgccagcccctgcccattcaggacgcccaggcctgcccttcggggctcccaggagccagacccagatctgggcacacagtgcagagtgagctgtggctgcgggagcggtggtggcctggaccctgtgtggcaggtgtgggtcggtgtggagtgggggagtggacgggcctttctgtctcaggagctctgcgcactgcccactcctggacactggaacttagcctcgagagaagtcgcttcccgaggtggccagcgggttggcagcagacaggctgggtgccaggtgtgtgcaccccggagccagcgggttgggccctgcccccggtgggtcatcagtgaacaaggaggggcacagtgggaccagcctgctgccctgccccagcagtggccttgccagcccatgggccctccccacgcggagcctctgtgcccaggggagcctgtgtggcccagcccggtagccaggacgagggcgtttcaaagtcaggccgcctccaaagcagtggcgttggtgggagggaataacttgctcccaccaggctgagaatagctcagaattgggtcacgctcaccgagatctccggtcacagcctccagcctttgacaataatcagctttctccccgacatctgtcccttcaaagagggggcaggccagtgcaggcacttctagaagcagcaaagcagaggggacgggagtggggaggggcgtcctcacctcctggccccccatggcaggccccctccctcccatgctcccaccccatgctcccttccgtgcctcaggtcccaccagcttcccgcgcagggccaggtaggggagcaaagcacggcagtgccccctgacagatgaggacaccagctaggggctgcggggagggtggcgcctgtgcctggccctctggtgctctgccacccatgcccctcagctcctgagacttaggggcctgcatgccactgccccaagccgccctcctctcgcccctcccggtctgtcctgggctcttctaacgtggttgaagggcatgggtcagagcaggccgtcctgctccgccaggcttttgggggcttgtttcccccagcccaggacttcaccccgtgtcttgtttcctatccattttcccgtgtcgggccctcctcatcccagagcagccttgagagggctgaggtgggtggtgtcacaggccctcagagcctgcatctgtgctgtcacctgcgtatgctgccaccaggtgggtgctgaagccatcctcgtagcagcatagtaggtgcctcctgcacagagagatagatatgcctaccacatgccaggcacgctgattttggttctttaatcttttttttggagaccgtcttgctttgtcgcccgggctggagtgcagtagcgcgatctcggctcactgcaagctccgcctcacgggttcacgccattctcctgcctcagcctcccgagtagctgggactacaggtatccgccacctcgcctggctaattttttttttttttttttttttttgtatttttagtagagacagggtttcaccgtgttagccaggatggtcttgatctcctgacctcaagatccacccacctcggcctcccaaagtgctgggattacaggcgtgagccaccgcgcccggctggttctttaatctttaaaaacccacaaggcagttcccgtgttctaggtgacgacaccattgctaaactttagccacaggtatgttcctgaagtgcccgtgacactaagcatctcaagatgtggcccctggaccggctggtcagcgtcgtccccaccccacccctgctgagccgaaactccaaggcagggcccagggggccccctttccccaagcctccaggtgctctggtactcaaatttgagaatcactgctggaagacccgggagtctcgcaaacatttctttttatttcttaaataaaaacccccgttattaactgaagcggcagctctctggcagcttcctgcaagcagctggttgatcctctgaggctgcactgtcagttgcagctcagtttcacccggtgtggctggactgtctgcttctgagccccagaccctgtcgctccctgctgctcccctgtgaatgccctcgtgctcccagagagaaactgaggcagcaacagcaggtagctgtgcgcagaccccgctgggccccagtttgaataaaccaaatgtcttttacaaaataggacagttgggaagcttgaagcttgagtggccgttttgtgagtttaaggagtggccacatttgcgagcatgctgacaaagtgctggggaatgacagggtggctgagatccaactctgaataacagggttggggaggaaggggagtagacctcaaaccaggctggccacagactcctgggagctgcgtacaggattcttcacacgattctgctggtgcatttctttgacaatttccaaaagtttttatttttgaaaaaaggagactgggtgtggtggctcatgcctgaggccaagatgggaggatcgcttgagcccagcctgggcaacacagggaaaccctgtctctacaaatgattaaaaaataaaaaaaggagagatgccccaggccagtggccagcactggtagctggcaggacccagcctgtcacccagggtgctggcatggcacatgtaggctgaatgcagtccggggcctggcccctgcctggaagccctgggcctgcagagacacgggccctgcagaggaatgctgggccagctgtgggcggggggctggccatggatggggtggggacagtgggggcgacaggcacaatagacattctgggtgccaggcaacggggaagcagacgcttcttggcggggaaaccctgaggggcccaggccacacctgtccctcagcaatgtggcgtgcacccccaccctcaggccattgaggctcactggctgcctggcccctcagggtgaagggcagccaccctcctggtggggcttcaacactccctgatgccagcccccacccaactgaggacctggtcggagggtgcctcgatggctcctgcagccccgagctctggcctgctcacctcttcgtggcctctgtctcggggccgccggcactccccgcctctcctgcctctgactgtgcctgcctggctggtgcccccaggtgtaggcaggccctcatggggttcagaacagggcttggagttctggtggagcctccatcccctgccacccctctcctggccccagactcagtagcccccagccctgccagccaggctctgccagagccacagggcccctgtggctgtccctgtccagtggctcccttcaggctccacatcctccccctccgtggatggccctgctaaggagctctgggcccagctggtggccaggaggagggaggctaggaggtcgccgtgcccggtggccttccccacctcacagacggttcttgagcttctgggcacagcggccagccctcgccctcccccaacacacgccctccgtccctctgcctcagcccctgcctcttgccccagccctgagggtagaggtcggaccccagctgctgtctgcagtggcacccagggtcccggctaaagcacacattccgtgtgggccaagagtgtacacagttcctttccgtcctgggtgagccaggcgtacagtaggcgctccgtgaacacacagtggaacccgccgggcagtgccgccaccctccggtggtctcagcccccgctgctctgtttgcatggcttttgccactctggtctctgccacccgttcctcgctggcctcactgggccctttgccccacaccaggaggtatccagtgccctccatggggagggacgcctcctttgtgctctgcctggggaaggcagggaggctggggcaggggcgggtcccagccctaccaccctgggcggggctttggccaaaggccttgccctctctgagcctcagtcccctgcccgtcccaggggtaccctcaggagctcccgaactgggctcgtgggagtctccttgaggctggcattggaagtgcccaggagtgccccaggcctgccagcccctcattccaccgcgtgcacggcagggaggcatggttttagcagctggtccacacgtctggatggttgccccagagcccccatcaccagggtcacactgcccaggcagctcctaacacctcaggttcctcaccccttcctgcagctgccgtccccacccccagaagcctgcctgcctctcctggggacccgggcggacagctggacacagcccctccccctctggaggggctgcccctcaacaggtgttgccacttgatcaggagcaaagtcagggttggggttgctcctgctgctcccccgctctgtgccccgcctgggatggaagcccaggctcctccaaggctgagctggggcccctcagcgtctctcctggggacaaagaggcagctgccagcagggcggggcagggagggcggcctttgtgtgcgccaggcccctcctggtgacctcaccaccggccggagaagggccctttcttcccaaaggcagccgttgggaatccgcctggggacaaagccgctgccaggcaggggaccagcgagtggctggctcccctcgtagcataaattagggggggccgaggtgggggaggggacggcaactactctgaccctgggagagggtcacttggtgcaaacagataaccaagcccccaacttacacatggggtgcatggggccgccccttcaagcttcattcgttcattcagcccattccttcattctgcagatggctgctgggcgctggcccaggcaggccctgtgagggccctggggacacagaggggatgcatctgatgggtgagggagcagtgggtgaggggcgggggtgcccagtctggagggggaactaggacagacgagtcagagctgcccagaagccccagggcctgggttggggcaggcgggaagatccctgctgagcatggtcacctagcaggtcacccagcagggcagcggccacagccgccaagcccaagtgcacgcagcaggccaccccaggcctccaggagagctcaggaaaatatctgattttcaatgcgtggtgttgagtgacacccaccccccatgtgtggccaagggcttcccgtccccagggtccaggtgacccacaaagcgtcctcacagccttgttggccctcggcctggcttcctggccccccgcaggacactgttccccccccaccacctccctgtaccctgtcttgaggcctagggcctagtggcccagggtggccaatgcagagagcagtgtggccagcacagagagacaggtggcctgagagtcccacagatgtccactgctactcaggcccagctcccaaggcctgttcctctgcctcccaggcactgggcacgtgctccatccccaaggcgctgagcacatcaggccagaccacgtgggcttcctgcaggaggaggcagcaggcccaggtcaggctgggtccgggaggcaggcacggggtgtgctggtcagcagggctcactgccaggcccagaggtgtcctggccatgcggatgacagaaggccaagtgcgtagggcagagggtgtgaagggcctcgtcctgtgagcagggcatgcgagcagctcctggcctgacctccagccccgacacctgaggcctgagcttgccttgcagtcatcagcagagccaagactcccagatttccggggctgggaaaccgtcaatgccttacagagccactaggtccacagctgcccagggcggggggcacctgctgggtgctggacctccctgcaccccgtctttacctccgtgtgtggatgggcaggagtgtctgcaggcctggcccaggccaggaggaggcctgaggcttctggggcaccgagcgaccacaggccggggtgcgtggctcccccaggagctccagaggccctatgccccctcccccaggagccccagaggccctatgccccctcccctgcagcgaagcgagatgggcgggggcgggtgtaagtaggacagcgctttgtgcgcgttgctatggcgccgccgccgcccgtgcaggcttcctctgggcgcgttcccaggacgcagagcctgccagttggccctcccagcccctggcagggccccatcccagtcggggggcctcagagctttctccacccacaggctgctggggggcagactaattgtcccacttcgttacaccctcaaacccgcagcacacatgtgctcacagccacgcagcacacacgtgctcacagccacgcagcacacacacacacacaggaatgtgcacatgctcacacatacatgtacacatgccacacacatgcatacaccccacagccacaggcaggcgctcagtccttagcgtgccctggggctgcagcctccaggttcacacccaggccccaggggccccaggccagtgcgcggcctccgagcagagcacacgtggtggtgggcatgaacgtgcaaggccaggggctgccccatctcagccacctgctgagactgagaggtcattgctgaccttgaggaggaggctgggggcctagaattcagaggacaagccaacctgaaccctactccccaccgctgggcctgtgggacagactcaaggccctgtgctgggaggactgggacttctgatgccggcgagctgaggctgggcccttcctgctgggccagcgcctcgccggccactggataccaagcgccccattggatgctcacagccccacagtggggtgagcaccaccagccctacacgcaggacaaagtggcctagagatggcacggagggggccgggcagcgacgctttgccggggtgtggcaggagggtatctgtctcttgaggcacaagaggccttgggtggcccagcctggctcctgttgtcagctgatgtcacagggtggagaacctgggtgtccggggagacagatggccccgggttccctggctgccctgaaacctgctgatgacgaccccaccaaggggcgggacggcttccttgcacttggcgtcctggagaggtgacgggctataggctgcagggtgggaatgcagggaacacccaggccctctctgaagaccacagctgggccctctgacccatgcctcagcctccagcccaatggcacagagctggccgaggtccttgccccacgcgtgccgccaccggctcctgaggggccggtggacagggacccggcggtccctttaccaacaggaggcccatggctcttggcactgccgcagaggctgtggcttcctcaggagcacatctgtcctttggggtaaacgctgctgcctcttagaatctgaggcccctgggacaggctggagctgaggctgacaggcagggccctcgtcacaaagccgctgagtccccccgaagccctcctgagcgcggcgctgtatgagaggtacccagaggtgctctcagaaggcagggctgggtttggggcagggcaggagtgggtaccgagaggccccaaacagcttcctgagggagagggggcttcacagaggcagctgcctcagtgaccctgtggcaggtgtgtctgctggcaccgaggtcttttagggcaatgaaggagaaagggcaagacagggagaactcgggggcataaaggccagggcgcgggggcctggcttgttcctgcagctgcagcgacatgcgccaaggctcgctgtgggcagaggtctccgccaccaagaagcgaggctggagggcaggcactgattctccatcaccacacccagagcccccactgggaccagcgaagcacaaggcagccagtgccacagccccacaccccgcccgccagctgccctgtgtggtgtggaggcggctccgggggcggctgttcacagcagtgacccccgcctgctgcacggccacttgagctgtcctggctgctgccaacgccactgtgaagtatggtgaccccattggccagggatggggtcagcacccacggacgtggtcggggaggtcaccaaagccttcttgccggaagtggcatttggcttggggtgtggaagaggagcacaaattacccaggagggccgggccagggtccaaggaagggccacctgtgcagagacgcagggctgatggcacaggccttgcccacaggccctgccacggggaaggacaagcccctgccagccggctgtgagccaccaccatcctgatgacagacccacaccggcaggcagggcaggctgcctgtggcagagttaggggggttggggggcgtaggttagagactgccagatctgctggggatccgtaccaacccatgatggtagcaggtggtcactggatgccccgcgcaagcgccatccacccccagaacagaagcgcagctcaggcgatgccatggccacctgtccaccattggccagggcaggtgcacctggcgtggcccaggcaggaccacttctggtgttctgggctcggcaaaacctggccttgggcgccacctggtgaccagacatgggagaaccaagcaggcaagtgggggcctggaggggcaggtgcgtggcgtttgggggacctccaaggtcagggagccacgtgctgtgcaggtgagccaccctgcaggccaggggctgtgtggagggcggcaggtagcagggtctgtctggagtcctccctccacccagcctggccagtgcggatgctgagctgtgtggggcccatgtgcactgggactggttgagggaacaggccagccatggtccccactgcagcagggacaggcctcgcacgttcagctagaggcaccccctggggcgggctatcgggtctgccctggcacagacctactgccggtgtggggtccatggcagtcactgggccagacttggtgggctgctgtggggcaggccttggggggctccccaaagagaacccaacccaggggaagcctgggactggtgctgtgctctctgtgggagccactgatctccaggatgcagtcctgcccctgtaggggcccgctgccccaaggctctgtgggatctggccctgcagactctcacctgcctgccaggctccaacctgggggtccttgctccagccgtccagcctgcacactcttccccaggcccccatggcctgctccacaggaccacctgcatagccacattggtgctgggatgcctgcttttcctttcaggggctgggtcaggattaagggctggaagatgccctttccggggagatgaaaccaggatgcaagaggaaggggcacacacgcccaggagccccaggctgccaagagcaccctgggcctgctgtggccatctgcaggcaatgcccagaccagaccacagctcaagaaggcagctgggcgcctcgctgccccacgcctgcaccctgacatccccagcacgttttttaattttttttttccattttttattttttgcgtgtgatagtcttgctctgtcgcccgggctggagtgcagtggcacgatctcggctcactgcaacctctgcctcctgagttcaagcaattctcatgcttcagcctcccgagcagctgggactacaggcgcccgccaccacgcccagctaatttttgtaccccagcacctttaataagcagctatcggcgaggcccagtgggttctgctgcccatgcttctgtgaccccgcccccatggctcacccctcctcctgccagccaggccagaaccctgggtgcccgcatcccctggtgccgtcctcactgcccccaaatcctttcccacccccctcccccaaccccactgctgcccccaggggcactcagcaaagcctccaaacctcccttggcttgtggggcccaggaagccctggcagtcctggcgctgtcccctacccgctgcctgaagttcttccagggcctccagtgtgcccggccctggctctgggctctgcttttgaaaagtcttcattttcctttacatccccacgtgcagagaaatgccggctgcgcccgaggagcagagttggaggggcccccgggagaatctgaacatcccagtttcctgatctctttctgggtctcactttcatctctggccatcagcaagggcatgcccctccacccgaaggccctgcctctgtgccaggctccaggtaaagggtacacccagcggggccctgactcccccaacatgggtgatcctggtggcacacgcacagagctcatgtacacccagccacgcctgagggtgccggttcctgctgaccccccgtgccccacaagacaggtgcccacagagctttgcagcatgttccccgactcaggaggcaaaaccgtccccctgggctctgctcctgctgcccccggggcccacgccacctgcagagtgcacccacaggtgtcagcgtgttgagccaggtgctgctctaggtactggggatacaagcaggaacggaacaagtttggcgtcttcagggtctcaggtggcggggcccctggcatcgtgctaagccctctgaggacgatgaggcagggtggggcagagcgcaggcactgtggttggagactgactgcagctgacatctggcacgtggtgcccgctggggtccacgtggcccactgggctctctggcttctctgaagccaggcgtggctgctggtggtcagaggatggcttggtcatgccagagctgggacacagcacagaagccagtccttcctgtgggaatggccatcaggtggcctggccatgaggctgtttctgcccgtgacccagcaccagacagcggccgttccactctcaccctctctgggtgactggtacacccagagacagcagaagggagagggacctcaaggaacccggctggccctccgcatccatttctgtccctgtgagcagagccctggtgcctctctaggcccagcctgcccaacctgggaagggctggcctgggacccagaggcgggaagatggctctgtcctggctcccagccacactgagcctcgggcaccatgcccttctgtcagcctgcagatgcttgctgggcaccctccctgccccaggcctggcaggaaaatgaggtgacagaggcggccctggggagctccttctgctcacctggccacccctcacctaggccagagccagatcccggccccgcctgaccttgccccgcagcggcctctgcaggcgcagggcctccgagctgccaggacacggcttctggtcttcttcctccctcctggtccacgcagcagtcctgggtgccccaccccacacggctatggccctctgtgggtctgcccttcccagccctcaccagtctgtgaaagcactggggatgcggcgagttcacgtgcccgtggggaagggg

SEQ ID NO: 1364 - DNA, 20001 bp, Homo sapiens
gagcaccaagggccggtggaaccgcagaaaccgcagcgagggagccagccctgctgacactttgattccggacttccatcgcagaactgagagagagaatcaacccctgtcgtcctgagcccccagcgtgtggtgctgtggtgcagccgcaggaaacacgtgctttccagaatgacagctggtgtccgcaagaacagcaggaactcatcagcatttggaagtgagactgggtggatgtgcagtcccggaaaaagaggcggagatttatgtctggtggcggggagcccgtgtgttcagcagcttctggaaggaattgatagatggaagctgctagaggcgttgctgacagcctctccttgaggccagactccagagctggaacctggtagaagccttagtctcctcatttaccgcagcggtgacgggtggggcagtgtgagatctgagccgagggcccgcatcaaagtcccctttcggcttctccatctgtgacatgggttgcacctgctctgactgctgcttacgagagatggtgagcagtgttctgtgctgcgtggccgtgactgccgaggttctgtgaagacgggaaccacgggctgaaagcaatagagaccccagaccaccagggtcagctcgcccccgcccccacccatcttctttctgaaggctgcgcttttccttttcaatatgacctaagccctttgcaggatatctccattcgcacatttccttactcagggtctgggtctgccctgcagagctgagctgaacggcactatcaggactttctactgggacaattgaatgcgacccccctcccaccgtcggctctgccctcctcctgtttccacaggtctggagacgttccctctgcccaggtgggggccgtggctggaagtccgcctctgctggaggtgcccgaacctcatgcctcttgcccccagatcgcctttcccttggacgttgcccgaggcgtgtggtcccagttggccaacatggagcttagttgggaggatgtgagtggccctctcctcccaaagatgatcgtgaatcctcgggggctgagaaacctgctgagagagaaagaaaacagtgggaatagtgcctacagctgcgcttcctcagtagacaggaggcagggctgctgggggagggaaaagggaagccggccggggtgggggtggagaaggtggggtctctggaggagaactcatcctggaggagtttaacaataggagaggtgggtgggagcatggaggtgtctcccatacaccacccctgcctctgggggtagaggtgccaccccaaggaacagggcttgtgaactcaaagaacacttgagaggattgggccgccccagcctgcatgcccatccccagcctgctacagtgtgttcctgggggggcctgtgggcctaagccaagcagtgcctggcattctcttggccacagacaagggtccaaggtgggctggtaaccttgggaggtggaatccaagtgaagcctggggcattatcgatgctttgggggacaagcttctcctgctggacagtggggactgcagatacaacgtctggaactgctctggccatttctgcctctacagaggagccagactgacctccagccacacagccatgcagacactgggaggcagagccaagaaagctgtagggacccccagtgtagggtccgggagctcaagggcaaccacagcctgctcatctgggtgcctacatgagccaacagcccttctgtagtttaaccagttgaatcatctaggattccagcaagaaataggattcctgggccaggcacgatggctcacacctgtcatcccagcactttgggaggctgaggagggtgagggtggatcacctgaggtcaggagtttgagaccagcctggtcaacatggtgaaaccccatctctactaaaaatacaaaaattagccaggtgtagtggcgggtgcctgtaatcctagctacttgggaggctgaggcaggagaatcacttgaacctgggaggcagaagttgcagtgagctgagattgcgccactatactccagcctgggcgacagagtgagactttgtctcaaaaaaaaaaaaaaaaagaaataggattccccccagagggattgaaggagacttgactgaaagggccagatgggtgaatagggatttggaaacaaaccaaggatatcagggtgcccagagactaggaacagagagaagccaaagggacaaggggaaggcatggcacctgatgggagctgcctggtgagagaaacagtcaggaaggactacaggagctaggacaccaggggatcacatccttccctagcaccttcacggggagtatggtcctgccaacaccgtgatctagaacttctggcctccagaacggtggaacgatacatttctattgtttatgccactctgtttgtggtactttgctacagcaaccctacaaattaatacccacctcttggggcaaacccaatcagaagccaggcattgaaggagcctgggagagcagtctgcagggaaggcctcccaaggcataaaaagcaggattgaggaggggcagtgtggcaaaaggagaacagccagaatgccagatgccccttcggctggaaatgaggagaggggaggggactgaatacatggactgctctctcctcccacccaggcctcctcctgggcttccctgttacaggttgaattgtgtgcccccaaaattcatatgttgaagtcctaaccccagttagtaccttatttggaactagggtcattgcagatgtgattaaagtggggtcctactagagtaggggaggcccctaatccaacatgactggtgtccttataaaaggggaaatgtgggccgggcatggtggctcacatctgtaattccagcagtttgggaggccgaggtgggtggatcacctgaggtcaggagttcgagaccaacgtgaccaatatggtgaaaccctgtctctaataaaaatacaaaaattagctgggcgtggtggcatgctcctctagtcccagctactcaggaggctgaggcaggagaattgcttcaacctggaaagcagagcttgcagtgagccaagatgcgccactgcactccagcctgggcgacagagccagactccgtctcaaaaaaaaaaaagaggcagggggtgacgtgagctgggcatggtggctcacatctataatcccagcactttgggaggccgaggcgggtggatcatttgaggtcaggagttcaagactaacctggcaaacatggtgaaaccccatctctattaaaaatacaaaaattagtggggcgtggtgtcaggcacctgtaatgccagctatttgggaggctgaggcaggagaattgcttgaacctgggaggtagaggttgcagtgagcggagattgcgccattgcactctagcctgggtgacaagagtgaaactcggccgggcacagtgtctcacgcctgtaatcccagcactttgggaggctgaggcgggcagatcacttgaggtcaggagttcaagaccagcctgaccaaactggtgaaaccccatctctactaaaagtacaaaaattagccgggcgtggtggcaggtgcctgtaatcccagctacttgggaggttgagacaggagaattgcttgaacccagcaggcagaggttgcagtgagctgagaccaggcaattgcactccagcctggacaataagagtgaaactctgtctcaaaaaaaaaaggaaaaaaagaaagaaagaaaaaaaaaagggaagtgtggacagagccatgaacacagggaaaatgccatgtgaagattttgagttatgctgtcacaagccaaggaactataggagctaggacaccaggggatcacatccttccctagcaccttcacggggagtatggtcctgccaacaccgtgatctagaacttctggcctccagaacggtggaacaatacatttctattgtttatgccactctgtttgtggtactttgctacagcaaccctacaaattaatacctccttcttagggcaaacccaatcagaagccaggcattgaaggagcctgggagagcagtctgcagggaaggcctcccaaggcataaaaagcaggattgaggaggggcagtgtggcaaaaggagaacagctggaatgccagtttggtgggttgtctgttgactgcaaccagaagtctccaaacctcaacacagaatttggtaccaggagtggggtgttacaagtgaagagactaaaacatggagtggtctgagctaagggggtaaaaatggaagatggtaaggaccccactctaccgagttgggaaatggccatggggtagcacaacagctggttgtagctaaggtgggaggatcacttgagcccaggtgtttgaaactagcctgggcaacatagtaagacgttgtctctaaaacaaataaaaactaaaaaattagctaggtgtggtggtgcacacctgtagtcctagctacctggggaggcagaggctgcggtgagccaagatagtgccactgcactccagcttgggcgacggaataagaccctatctgaaaaaaagaaaaagaaagaaaggaaaaagaaagtgaatggtgggtgccagggactgagtgagggggatggggagtgcctgcttaataggtaatgggaacagggcttgtttggggagatgagaaatttctggagatggatggtggcagggctgcccaacaacatgaatgtacttggtgccactgaactgcacactttatttacttatttattttttaatttttatttatttatttattttttagacaaagtccttgctctgtcacccaggctggagtgcagtggcacgatctcggctctctgaaagctctgcctcccaggttcacgccattctcctgcctcagcctcccgagtagctgggactataggtgcccgccactgcgcctggctattttttttgtttttagtagagccggggtttcaccgtgttagccaggatcgtctcgatctcctgagctcgtgatctgcccgcctcggcctcccgaagtgctgagattacaggtgtgagccaccatgcctggctctatttttatttttttgagacagagtcatgctctgtcacccaggctggagtgcagtggtgaaatcttggctcactgaaacctccacctttcgggttcaggtgattatcccacctcagcgtcctgagtagctgggattacaggtcccaacactacgcccggctaattgttgaatctttagtagaggcggggtttcaccatgttgtccaggctggtcttgaactcctgacctcaagtgatctgcttgccttggcctcccaaagtgctgggattataagcatgagccacagcgctcagcctaaactgcacactttaaagtagttaagatggcacattccatgttgtgggtattttaccacaatgttaaaaaaaaaaaaggaaggccaggcacagtggctcacacctgtaaccccagcagtttgggaggccgaggcaggcagatcacctgaggtcaagagttgagaccagcctgaccaacatggagaaacccgtctctattaaaaacacaaaattagccgggcatggtggcacacgcctgtaatctcagctactcgagaggctgaggcaggagaatcgcttgaacctgggaggcggaggttgcagtaagctgagatcatgccattgtactccagcctgggcaacaagagcgaaactcaatctcaaaaaaaaaaaaaaaggaaaagaaaagaagcaagacacttgtcacctaagatcctatcagctaaacatggtttctttgtacaaatctgtgttttctggcttttccacaatagagatatattatctgtgtaataagataaacacgtggccgggtgcagtggcccattcatgcctataatcccagcattttgggaggccaaggtgggaggatcacttgagcccaggagttcaagaccagcctgggcaacaaggtgaaacctcgtctctacaaaagacacaaaagttagctgggtgctgtggcgtgtgcctgtaattccagcactttgggaggctgaggtgggaggattgcttgcatccaggagttggggaccatccttagcaacatagcaagactgcatctcattaaaaaaaaatttggctgggcgtagtgtctcacatctgtaatcccagcaccttgggaggctgaggcaggcgaatcatctgaggtcaggagtttgagaccagtctagccaacatggtgaaaccccgtctctactaaaaagacaagcattagctgggtgtggtggcacacgcctgtagtcccagctacttgggaggctgaggcaagagaattgcttgaacatgggaggtggaggttgcagagctgagactgcaccactgcactccagcctggatgacagagactctgtctcagaaaaaaaaatgtaaataaaaaaaaaaggaaaacatttaataaaacatatgattttgtatctgtatatatcatgtctctactcttcaggaacatcaatgtcctggtagacacactgggggcgctgttctacaataaaagaagtgaaaaaacatgacaagtaaatgccattggatccagacttaaggaaaattgttctccaggacattactgggacacttggtgacatttaatcaaggactgactgtagacagtactgtggtctcagtgctgtgtctgctgggtttgatgatacgccgtcgttcttagcagaggtaggctgaagcatttaggagtgaagggtcattatatttgcaacttattcccaaatggctcaatcaaatcataatggccccttctagctcttaaaagtcatgaggcggccaggcctggtggctcccatctgtaatcccagcactttgggaggctgaaacagacggagaccacagagtggggaaccggactggagtcatcagctcctgtttcccagcccagtgtggctcctcatgggccatgattcaggactgaattcagttccttcctttttccttcccttccctccctccttcctttaatgccaaccaccctgtgtatcatcacaggggccacagagatgagcctgacctcggctgtgtgggaggaggcaacactcacctaagcagggacgtgaggcagaagtgctagtgcttctagagataacgatacctctccatgcccaagaagcagggctcacagcaggccatgcatgctccaacgaacaggatcatgccgggaactgagaagaccccaggggatgtgcaggccaccactgcagcttgatgaaccaccccaagatgtagcggcatttaaaacactattttatttgtaatcccagcatgttgggaggccgaggtgcgcagatcatgagatcaagagatcgagaccatcctggccaacatggtgaaaccccgtctctactaaaaatacaaaaatcagctgggcgtggtggtgcgtgcctgtagtcccacatactcgggaggctgaggcaggagaattgcttgaacctggaaggcggaggttacagtgagccgagattgcgccactgcactccagcctgggcaacagagcgagactccgtctcaaaaaaaaaaaaaaaaaaaaaattagccaggcggctgggcacagtggctcactcctgtaatcccagcactttgggaggccaaggcgggcagatcacttgaggttaggagttcaagatcagcctgggcaacatggtgataccccgtctctgctaaaaataaaaaaattacctgggcatggtggcacagcacctgtaatcccagctacttgggaggctgaagcaggagaatcacttgaacctgtgaggcagaggttgcagtgagccaagatcgtgccactgcactccagcctgggtgacagagtgagactgtctcaaaaaaaaaaaaaaaaaaattagccaggcatggtggcatgcacctgtagtcccagctactcaggcggcagaggcaggaggattgcctgagctcaggagattgaggctgcagtgagctatgattgtgccactgcattccagcctgggcaacagagcgagaccctgttcaaaataaataaataaataacaatttcattatgctcagattctgtgggtcaaagatttggacaaggcacatcaaggatggcttgtctgctcctcaatgtcttaaagactgacacagtggctagggtttggagtgctccaaggacatgttcactcacagctcagccggtgatgctggctgtcacgactgggcttctctatgaggtgttgtcgtgtcccccaccccagccccccagtggctgtttgggcttcctcacagcatggcagctgagatccaagtgtgagcttcccaagagagccaggtggaggctgtatcacctctttgttttttttggagacagagtcttgctctgtcacccaggctggagtgcaatgatgtgatctcggctcactgaaacctccgcctcctgggttcaagtgattctcctgcctcagcctcccgagtagctgggattacaagcatctgccaccacacctggctaatttttgtatttttagtagagttggggtttcaccatgttggccagactggtctttaaactcctgacctcaggtaatccacctgcctcgtcttcccaaagtgctgggattacaggcatgagccaccgcacccggcctgtatcaccttttaaaacctggcttacgagattgtgccattgtactccagcctgggcaaaaaagagaaactccgtctaaaacaaacaaacaaacaaacaaaacctggtttagggccgggtgttgtggctcacgccttttatcccagcactttgggaggccaaggtgggtagatcaccttaggtcaggagttcaagaccaggctggccaacatggcgaaatggtgaaaccccatctctactaaaaatacaaacaaaaaaaaaaaattagctgggcttggtggtgggtgcctataatcccaccactttgggaggctcaggagggtggatcacctgaggtcaggagttcgagaccagctggccaacatggcgaaatggcaaaatcctgtccctactaaaaatacaaaaaaaaaaaaaaatgagctgggagtggtggcgcacacctgtaatcccagctacttgggaggctgaggcaggagaatcacttgaacctggggggtggaggttgcaatgagccgagatcatgccattgtacaccagcctgggcaatggagtgagactctgttgcataaataaataaataaataaacctgggcctggtgcggtggctcatgcctgtaatcccagcattttgggaggccgaggcaggcagatcacgaggtcaggagtccgagaccagcctggccaacatggtgaaaccctgtctctactaagaatacaaaaaattaggcaggcgtggtggtgggtgcctgtaatcccagctactcaggaggctgaggcaggaaaatcgcttgaacccgggaggcggaggttgcagtgagccgagatggcgccattgcactccagcccgggcaacagggcgagactccatctcaaaaaaaaaacaaaacaaaaaaacataaacctggcttagtcctagagtgttacttccactgtagtcacaggcctgtccagactccaggggaaggcatattgattctacctcatgtgggagaacgtcgaagtcttactgtgagaagaactgtgtaaggggagatggtgaggcagcctgaaggacggctgattattttctcccaagacggcagctgcacgacacctgctgtacccttcctgcttgccacccccatctccagtccctccacattttgggcacatattccaatattcttttttggtggcagaatcattggtttacggggtggcttctgaagggactctgcaccttgtgggcggggctgtggccgagcagccagcctttcttccctgcaggagcctggatacctcccggccctctctaatcacccagacccctggccactgaatccaagcaaagccccctccctgccgggaccctggggctgttctgcagggaaacgtgagtctctcatgtttccctgcatgtatgatcagcggcactgactcctttgttccagcccatcctctcaagcatgttggtgtagcaaattaccttcaacaaaacataacgtagccttcctgagtggaatacgggcggcctttccagccagctcctgggcacagggatcctctcctggaatgcacacgagtgtgtgtgcaggtgtcatccagccctcttcacattgccctgtgggaactgtgggaaccgagctcaggaaccagcaccacagtgctgagactcaggccactgtagacctgtgagtaaaaatctgtcctgtctcatatccaggcgttggtgtcctttgtcagcatccgtgaaccagtggcaggccaccttgttagcttgcagctaaggtaaaatctcagaaatttcaggccgggctcggtggctcacgcctgtaatcccagcactttgggaggacaaggcgggcagatcacctgaggtcaggagttcgagactagcctggccaacatggtgaagccctgtctccactttaaaaaacacaaaaattagccaggcatggtggcggttgcctataattccagcccccgaggctgaggcaggagaatcacttgaacccgggaggcggaggttacagtgagctgagatcatgccactgcactccagcttgggtgacagagcaagactccgtctcaaaaaaaaaagcaaaagagttgaacaaacatttcacaaagatagatatataaatggccaataagtacatgaaaagatgttcagcatcttacgaggcaaatgcaaattaaaaccacaaagaggccgggcacagtggctcacgcctgtaatcccagcactttgggaggccaaggcaggtggatcacgaggtcaggagatcaagaccatcctggctaacatggtgaaaccctgtctctactaaaaaatacaaaaaaaaaaattagccgggtgtggtggcgggtgcctgtagtcccagctactcgggaggctgaggcaggagaatggcgtgaacccggaaggtggagttgcagtgagcccagattgagccactgcactccagcctgggcgacagagcaagactccgtctcaaaaaaaataaataaataaaaataaaaaataaaaaaataaaaccacaaagaggccaggcacggtggctcaagcctgtaatcccagcactttgggaagccgagtcgggacgatcacttgagtccaggagttcgagatgagcctgactatcatggtgaatccccgtctctactaaaaatacaaaaattaggggccgggcgcggtggctcacacctgtaatcccaacactttgggaggtcaaggtgggtggatcacttgaggtcaaaagttggagatcatcctggccaacatagtgaaagaaaccccgtctctactaaaaatacaaaaattagccagacgtggtggcaggcccctgtaatcccagctcctaaggaggctgaagcaggagaatcgcttgaacctgggaggtgaaggttgcagtgagctgagatcgcaccattgcactccatcctgggggacaagagcgaaactccatctcaaaaaaaaaaaaaaattagccggtcgtggtggcatgtacctctaatcccagctacttgggaggctgaggcaggagaatcgcttgaacctgggaggcggaggttacaatgagtcgagatcgtgccattgcactccagcctgggcaacagagcaagactcagtctcaaaaaaaaaaaaaaattagccgggcttagtggtgtgcacctgtaatcccagctactcaggaggctgagatggaagaattgcttgaacccaggaggcagaggttgcaatgagccaagatagtgccactgcacttcagcctgggtgacagagtgagactctgtctcaaaagaaaaaaaaaaaaccacccacagagagaactacacgttcaccagaatgactcagattcaaaagactgatgccaccagacgctggggaagacgtggaacaactggaatgcccatagctcactgatgggagggatagatgggcagtcacctaggagaaaggcctggaagtttctttctttctttctttctttcttttttttgaaaatagagtctctgttgcccaggctggagtgtggtggcatgatcttggctcagtgcagtctccgcctcccaggctcaagcgatccccccacctcagcctcctgagtagctgagactacaggtgcatgccatcacactcagctcactgttatatttttagtagagacggggatttgccatgttgcccaggctggcctcgaactcccgggctcaagcaatcctcctgcctcagcctcacaacatgctgagattacaggtgtgagccactgtgcccaaccagaagtttctttttttttttttcctgagatggagtcttgctctgttgcccagagctggagtgcagtggcgtgatctctgttcactgcaacctctgcctcccaggctcaagcaattctgcctcagcctcctgagtagctgggattacaggcacgtgccaccatgctgggctaattttctttttcttttccttttttttttttgagacggagttttgctcttgttgccctggctggagtacaaaggcacgatctcggctcactgccatctccacctcctgggttcaagtgattctcctgcttcagcctcccgagtaactgggattaccggtatgtgccaccatgcccagctaattttgtatttttagtagagatggggtttctccatattgattgggctggtctctaactcctgacctcagatgatctgcctgcctcggcctcccaaagtgctgggattacaggcgtgtaccaccgtgcctggcctaatttttgtatttttagtagacacagggtttcaccatgttggcaaggctggtcttgaactcctgatcttgtgatctgcccacctcagccccgtaaagtgctgggattaacaggcgtgagccaccgtgtccagcccagaagtttcttatagaactaaacatatgcctggccgggcatgatggctcacacctgtaatcccagcactatgggaggctgagatgggtggatcacgagggcaggagattgagactgtcctggctaacacagtgaaacccctgtctctactaaaaatacaaaaaattacctgtgcgtggttgcacgcacctgtagtcccagctactcaggagtactcaggaggctgaggcaggagaatcacttgaacctgggaggcggaggttgcagtgagctgagatcacaccactgcactccaccccgggcaacagagggagactccgtcttaaaaaaaaacaacaaaaaacaaaaaaacaaaaaaaaacaagcaaacaaacatatgcctacctgatgacccagcaatttcattcctaggttttgttgctgttgttgttgtttatcatctgaaatacagtcttgctctgttgcccaggctggaatgcagtaatgccatctcggctcactgcaacctccaccttttgggttcaaacgattctcatacctcagccccttgagtagctggggttacaggcatgtgccaccacgtccagctaattttttttgtagttttagtagggacagggttttgacatgttgtccaggctagtctcaaatgatctgccctccttggcctcccagaatgctgggactacaggcatgaggcactgtacgtggccttcctaggtatttacctaagagaaatgaaaatacatgttcaccaacaggcttgtataagaaagctgagattacctttactcgtatcaaccaaaatggaagcatcccagcttctatcagcaggagaatggcaaacaaatgtgggacaatgtggatgaatgtcaaaaacaggaggtgagtgaaagacgctagacacagaagtagatgctatgtgacttcatgtaaaatgctagaacaggcaaaataggtctacatttaaaaaataaaaactggggtggggcgcgatggctcatgcctgtaatcccagcactttgggaggtgagcagatcacctgagatcaggagttcgagatcagcctggccaaaatggtgaaaccccatctctactaaaattagtagggcgtggtagtgcgtgcctgtaatcccagctacttgggaggctaaggcaggagaactgcttgaacccgggaggcggaggttgcagtggactgagattgcgccatcgtactctagcctgggtgacagagtgagactccatctaaaaaaacaaaaaaccaaaaaaaaaaagaaaaaacagcccaggcatggtagctcacgcctgtaatcccagcactttgggaggctgaggcaggaggattgcttgaggccaggagttcaagaccagcctgggcaacatagtgagacctcctcgctacaaaataaataaaaaataaataaactgccgggcgtggtggctcatgcctgtaatcctagcactttgggaggctgacgtgggcggatcacttgaggtcaggagttcaaaaccagcctggccaacatggtgaaacctcatctctactaaaaatacaaaaaaataagtcaggcgtggtggtgggcgcctataatcccagctacttgggaggctgaggcaggagaattgcttgaacctgggaggtggaggttgcagtgagccgagattgtgccactgcactccagcctgggcaacaaagtgagagtctatctcaaaaacaaacaaacaaacaaacaaacaaacccaagagtggttgcctggggtcagatgggaaggggcatgaggcaaccctgcaatgtgatggaaacgttccatttcctggtagggacttcagttacacaggtgaaaggtttctcacaactcatcatatcattatacttacatgtgtcaaaacccatagaatatccagtactgtgtacaatacagacagtgagcccttatgtaaactctagacttagttaatatatgaatatcggtccattggttgtaacgaatgtaccacactagtgcaggatgttagtggtaggggaactgggtaccggacatacatggcagttctttgtacttttcgctcaaattttctgtgagcctaaaactgctttaacgaaacacaattaaaaatgaaacaaaaccggccgggcacggtggctcatgcctgtaatctcagcactttgggaggccgaggcaggtggatcatttgaggacagaagtttgagaccagcctggccaacatggtgaaaccctaaaaatacaaaaattagctgggcggtagtggcgtgtgcctgtaatcccagttacttggaaggctgagacatgagaattgcttgagcctgggaggtggaggttgcagtgagctgagattgcaccactgcactccagtctgggcagccgagtgagaccctgtctcaaaacaaaacaaaacaaaaccactgtttagtctctgaaataaaggtcaatatcatataaagcaaaactcttcaaatgctgtccttaagatttatgcattttaccacgtgtaaatgtttcctaaaacaaacaagcaaagaatatcggattccattaatgctatgaatgctgaagcgtctagaggtggtgtgtactgatctttgcaatttactttgaaatgcattaaaaatgtattgatagatagaagaatggggagaagagatgtgataaaggaaataaggccatatatatatatatatatatatatatttttttttttttttttttttttttttttttttttgtagacggggtcttgttctgttgcccaggctggagtgcagtggtgtgatctcggctccctgcaacctctgtctcccaggttcaagcaattctcctgcctcagcctcccaagtagctgggactacaggtgcgccatcacacccagcgaattatttgtacttttagtagagatggggtttcgccatgttggccaggctggtcttgaactcctggcctcaagtgatccacctgcctcggcctcccaaactgctgggattacaggcacaagccactgcgcccagcccaggcaaaatgttaatggtagaatcctggtggtgggtatgtgaacgttcactggacagtttgttatttttttttgagacacacggtcgtgctctgtggtccaggcaagagtgcagtggcatgatcatagttcactgtaaccttgaacttctgggctcaagggagcctcccatctcagcttccagagtagctgagactacaggcgtacaccaccaggcgtggttaatttttttctttaaattttgtgtacagttggtgtctcactatgttgcccaggttggtcttgaactcctggcctcaagcaatcctcttcccttggcctcccaaagtactgggattacaggtgtaagccaatgcacccagccttcactgtacaggtttttcaactcttctgtaaatgtattttcataataaaatgttgggagaaaatctccaatatggaatctgttttccatggcaaatccctaatcgcaggtaccacagccccactgtttccctctatcagtgttcttcaaaccattttgaaattatctggaggacataggtgtcttcccttctcccagtttctggcataaccttttggataactatataaaacacgtccagtctccatgccacatactgtgggaagtccagcactttcctcaagatatctcatgattccttgagaggaagtgaagtggggtaaatattatcctggtcacttggagtgctgtcgccctggcacctggctcaagtccagagacacaggtcgggctcagtcggcataggacgaactcagtgtacccagccaggctgagcttggtcggtgatgtcttcctccctgctgccatttgagcctcagtcctcatctgcagaaattctggtcccaggggaccgcccagacggcttccctcgctgcctggcgcctccagctgtcttaaagcttcggccggcactggcgcagcctccctccagctgtaccaggaaacaggacacaaatgctgagggtctgggtcaccaggccatgtgaggaaaccagctaccacaaccagggcttgctgagacaggatcccaggtgtgggggacagtgctgctgagccgtcacggtggcctgctggccctgggagaacccagggctctgttctctcaggggcccctgggctgtcctgcgggagtggagtgggtgtgaaggacagaaagacagactgaggggtggcttcctgccagggtgtccaccacacctccttccgatcttgagcgcgcctttccctgcagttctgaaggaagtggtccctggagctctgtgctcagcggccccagctctttaaagaaaaaacaccctggccgggtgtggtggctcacgcctgtaatcccagcactttgggaggccgaggtgggtggatcacgaggtcaggagttcaagaccagcctggctaagatggtgaaacctcgtctctattaaaaatacaaaaattagccaggcatggtggcaggcacctgtaatcccagctactcgggaggctgaggcaggagaattgcttgaactctgcagggcggaggttgcagtgagccgagattgcaccactgcactccagcctgggcaacagagtgagactccgtttcaataaaaaaaaaaaaaaaagaaagaaaggaaaaaacaccctggaaatcagaggaattgcatttttagaattgaagcctgagaccagagagggtgtgacctgtggctgagagcaacgcgggccagatcccagattagccaggtccggatgccaggcagcccctccctggaccagcacgcccgtccggtgactcgtccctaagcctcgtgctgacaaggagggtgagcaggctgcggggaggggtcagagctgtgtggagtcaaccagcctgctcttcccatggcctgtgcttcccccgccccagcccctccagccaggtcacccctcccagccagaggatgggcacctgagtacagctgccagccagggacaggcttcaggctgcctccaccctgcccttcttcttctctccctctttcctccccaccctcttcctccctcctttcttcaggcattcacagacagggctgcccacaaggctgcagatcctcaagaaccaaagggaaattcctgcctgcttgtctcttccaaaaagccgctcgcaaagacagacatctacaaacatctacagtaaaaagatgaatagtgtaaaaaataacaacttcctgttccattctccacttgagacaaacgggactgcatggtttgttgcatgtgggcactgcacttccttcctgtggtccccccacctgccacgggagtgtccctctccctcatctcctggatccccgagggacgcagggctcccctctgcacttcttcaggcctctcatcttagttcctgctggccgtcagctcacttgtccagggcacccggttctgttgcccagcctggcacctgatactagcagttctcaatgaatactgagaatgacgtgaatatgaaaaattgtaggctctatgcttgcctccgatgtcccaggggcctggcaaatggcagaaggtgggtagttccccccctccttttttttttttgagacagggtctcactctgttgctcaggctggagtgcagtgacacagtcatagctcactacagccttgacctcctgggctcaagtgatccttccacctcagttcagccttctgagtagctgagactataagggtgcatcaccatgcctggataattaaaaaaaattttttttgtagagtcagggtcttactatgttgcccaggttgtccatgccttttaaccccaggcagtaccttaggagcccaacctaggagctgctaacggctccaaggactgcaggatctcctgaggatcatggcagaagtcagggacttaagggacccgaagagtctgctccccttgaaaagggagcaagagcagcatctctgtgcaaaggaagcctggagaagcagcagcccagccctcctctcatgcttgcttgagggttgcccttgcagctgcgtcaggtgctgagcaggctgtggggaagaggacaccagcccctcctgttctctgcttacaggctgaggagaaggcagctgtgtaagctgaccacatactacacattggggaagggacaggtgggtggtcagaggaggccttgacccaggcaggtgctgtcagaagcggcttcccccaggaagtgacgatcatttgaatcctggagcactggggggaatgggggagggagaacattctaggcacagtgaatactatgtacaggggcatggctatgtgagagaccagggtgaactcaggaacagataagggtgttcagagcacaggagaccaggaggttggcagcaccaggccctgggggccttgttgaccaacccaaggaatttgaagttgctgcagacagtgatgcgtggcagcactggtggatgaattggccttttctcctttcccccaacactccagggtcattcctgcctgaggactcctgccctcagagctctcctggggcttttatttattttgttttgagacagaatgtggctctgttgcccaggcttgagtgcagtggtgtgatcttggctcactgcaacctctgcctcccaggttcaagcgattctcctgcctcagcctcccgagtagctgggactacagacgtgcgccaccacgcctggctaatttgttgtattttagcagagatgtggtttcactgtgttgcccaggttggtcttgaactcctgaaggcaatccacctgcctcggcctcctgaagtgttgggattacaggcgtgagccacctcgccggcctctcctggggctttgaacgcctgcctccctcctctcatttgggtctcaggtcacc

SEQ ID NO: 1365 - DNA, 40001 bp, Homo sapiens
tttaaaaatatgcatataaatgcatttctatctatatataacttctatctatgattatctatctatatataattccttttttttttgttttgtttttttttttttagtagagacagggtttcactgtgttagccaggatggtctcgatctcctgacctggtgattcgcccgcctcggcctcccaaagtgctgggattacaggcgtgagccaccgtgcccggcctatctatatataattctatgtattctatctatatagcgatatataatttctatctgtaatgcaaatctacatgtgatttctatctatatatacatgtagatagaaaatttagggaattcactgcaggtgctgcttgcagtccacttttaaaacctaacattacataataaaacactattttaagaagctgcactaggccgggcttggtggctcacgcctgtaatcccagcactttgggaggccaagtcgggtggatcacaaggtcaggagtttgagaccagcctggccaacatggtgaaactccgtctttactaaaaatacaaaaattagtctggggtggtggcgtgcgcctgtagtcctattcaggaggctgaggcaggaggatcgcttgaacccgggaggtggaggttgcagtgagccaagatcgtgtcaatgcactccagcctaggagacagagcgagactccgtttcaaaaaaaaaaaaaaaaaaaaaaaaaaaaaaaaaggagctgcacgatgctccccttgggcgtgtaccataccttatttaaccattcccaaactgtttccattttttctgatgttaaataaactctaagatgtacagacgtcttttatctggctctccgattaccttctgcagataaactcctagaagttactggggcaaagggagtgaacctttaatttttaataaaattttttaaattacagaaaaagccgtagtcgtcagattctacttcctaggcggtccacagggatttcaacaagttcgattcaaaccatcccaaattccctcccggcactaagttttcctcggtcttgggaaacgtggccccgcagtccgcactcacgactgcgcacaaacgctggcctctttccaatggcgaaacttctcgacacgcccccgaggcaccacctctttaaaatttaaaacgaaggcccaggccaatgaatgctaagcttctctcggaccacagagacccgcccaccgtcactccctccaccaatcagactgaagttttctccactgcccctccaatcaccgccaaaaatggaagttgctctcgtaacttacgtaaggcaagcagccaataggagcaaaccttggaaactagctcccccaatagcagcagttcctggagagcgcgggagcctttcgaccagggtcccaaaggaaagcagtgagtggtgctgtttccctgaaggaagggactaagggacggtggcgcgggcccggaccggggccccggggcggcggcacggccgatatggcatgctgtcacaaagtaatgctgctgctggacaccgcgggcggcgccgcccgccacagccgggtccggcgggccgccctgcgcctcctcacctatctgagttgccgattcggcctggccagggtccactgggccttcaagttctttgactcgcagggggcgcggagccggccgtcccgcgtgtctgacttccgcgagctggggtcccgctcgtgggaggactttgaggaggagctggaggccaggctcgaggatcgcgcccacctgcccggcccggcgcccagggccacccacacgcacggcgccctgatggagacgctgctagactaccagtgggaccggcccgagatcacgtcgcccacgaagccgatcctgcggagcagcgggaggagactgctggacgtggagagcgaggccaaggaggccgaggccgcgctcgggggcttggtgaacgccgtcttcctcctggccccctgtccgcactcgcagagggagctgctgcagttcgtgtctgggtgcgaggcccaggcccagcgcctgccgcccacccctaagcaggtgatggagaagttgttgcccaagagagtccgggaagtcatggtcgcccgaaaaatcaccttctactgggtggataccaccgaatggtctaaggtaaggaaggttactgtcgtctcagatggcgtgcacggtgctttccttgctaaccagaacttggcagcgtccttagaacagccacagaccccgaatgagactaatatgactatgcgtcccttcggaaggaaacaaataaataggaacagttttcacaacaaaatgggtagttcctcactacctactgtttaagacccctcacaatttgggccctacctgccttcccagacttgattttcctacacactacatctactctagcatattgaagtccagtccagaaaatcaacaggtctggactgcttgttttgtgttatgtgtgttgttcaatctgcctggaatgccagttctcactcttccaggccagtcttaacttcacttaccctttaaggcttcttctcccagtgacaactgctcagtccagcgtctgaattgccatacacattttgtgtggcacttaaccatttctccatatgttttgattatgcacatctctcaccctccatctagtctaaaaatacctcagaggcaagcagcaggttttaacacaatacccaggggtgtgtgtgtatgtgtgtgtgtatatatatatatatatatatatatatatatatatatatacacacacacacatatatatacacatttatttatatacatatatatatttatttattattattttttgagacagtgtatgtcgcccaggctggaatgcagtggctcactgcaacctccacccctccgggttcaagcgattctcatgcctcagcctcccaagtagctgagactacaggcccacgccaccatgcctggctaatttttttgtattttcagtggagaccaggttccatgctgcccaggctggtctcaaactctggcctcaggcaatccgcctgccttggcctcccgaagtgccaggattataggtgtgagccaccacgcccagccacccagatgtgtattaaacgttgtaggtgttcagtcagtattggctgactaaatgagtacattcttgcgtacattcttgcaaacttaaagtcttaaatggctaatttggatttttgctgaggcggtgaggccccctgctcctgttaagtgctaggataagtatatacttttgccttcatccttctcattgcacttcatttagtcaacaaatgttcattgagaagccagtaacatctgagtgcctaccacactgtttgagctgctggggacatggtaaccaaagcagggaacagattaaacagataagcaagtgacaatttcaaatcatgctctggagaaaataaaatggggtgagaggatgggagtagaaggtggttattgtatacagagtggtagtgagggaaggcctttttttttttttttttttttttttttgagacagagtctcgctttgtcacccaggctggagtgcagtggcgtgatctcggctcactgcaaccttcacctcctgggttcaagcaattctcctgcctcagcctcccaagtagctgggattataagcgggcgccaccaggcctggctaatttttttgtatttttagtagagacggagtttcaccatgctacccaccctggtctcaaactcctgagctcaggcagtccgccaacctcagcctcccaaagtgctaggattacaggcatgagccaccgtgcctggcagggaaggcctttttgagcagagaattgaatggtgaaggaggaggaactcaaaggtaggtaaagaacattccaggtgaggagacaagcaggtgtaaggatttcagctggaaatgaacttagtttgtttcagaaacaaaaaggcaaggagtgctgagacctagtaggcaaggggagcagtgtgagagaaagtcagaaagcaggagaggccgatctgtagggccaaggtcaaaaatgtggattttgttctaattaattaatgggaaggctttggaatgtggtttaaccaagtgaaagatgtgattccacttaatggaaatacatgtcactaacccaggagtgagttaaattgcaagattacagatggaaaatgagcaagcatttaaataataatatggtatgttaaaattttcaaagtgctttcacatgcgaagcccaaaaaaggcgtggcaaatgcaaaataaggcagcagtggtttgtcaagaaaaggaagggacaaaaagtgtttaaggggatggtaaacatttgatggggaaaatgaaatcctagatatattaaaatttaaggcagccagtcaagccttagacacagtatacaacacattgctcagctggaaacaattgatatcacatcaaagactttcttctggaattttattatgttaaatactggctagaaataagttagatggggcttgatggatcttggagattctttgtctctctttttttctctttaatctctctctctctttttttttttgaatagcattgaaataagtgggttgactggatctttttaaagatcccttccaggtctgatgtaccgtcgactgaggggatgggtcatctctgaggcttcccttcttacatcggctgtatcccctaagaaaatgcccatcagatactcaagtttttctggaattttcttctgctgaagatctatcattttctattcaaaaacctgcccagccatgctgggcaaaaggaaggtttgggctgtgtccttggggagtgctctgtccaggagcagggagaagggaggaagagaaaatccaggtcctgccttggggagcgtgcagtctgggaagtagaactgggagaaacagaacctgcacttacattggaggcagagggatccaagcgcataaaacaggatatcatatttgcaaagatataggacagaatggaggataagagacctctgacacattttcaactttatgccttagatttattcaatacatatttgttccatacctgccaggtatgctaaggaatcaaatagatgtggtccctgccctcttggagcttatagtctagtggacatttacagatccccaaatttgaaactaccactaggacatgtctgtcacttatcctataatacgcatacgagtgaaaaatgtgaccatactctatagtatactgtttgtatttttgtttttgttttgtttgagacagagtcttgctctgtcgcccaggctggagtgcagtggcgcaatctcggctcactgcaacctccgcctcctgggttcaagtgattctcctgcctcagcctcccgagtagctgggattacaggcgcttgccaccacgcctggctaatttttgtatttttagtagagacagggtttcaccatgtttgctaggctcgtctcgaactcctggcctcaagtgatccacccacctcggcctcccaaagtgctgggattacaggctgttatttttttttaatcacatgttttgctatggtttgaatatttgtcccctccaaaactcatggagtaatgggtgtcatgggagtgggattggtggctttataaaaagaggaagaaagtgttgagctcacttgctgagcctcatcgccctgctttgccctgtgctgccttgggactctgcagagtccccaccagcaagaaggcctttgcaaagtacaaccccctggccttggacttctcagcctccataactgtaagaaatacattccttttctttataaattacccagtttcagctattctgttgtaagcaacattaagcagactacgccatgcacacattacctttaatagaaacttaaggtccttttcaacacttattaaagttacatcttcccacccacctcccgagacagagtttcactcttttcacctacgctggagtgcagtggtacaatctgggctcaatgcaacctccacctcccaggttcaagtgattctcctgcatcagcctccctggtagctgggattacaggcacccaccaccacacccagctaatttttgtatttttagtagagatgggttttcaccatgttggccaggctggtcttgaactcctgacctcaggtgatccacctgccttgtggatcaaagtgaggggtgttgggattacaggcgtcagccaccacaaccggccataaagttacatcttaacctttcattttattaacagggtttttttgtttgttttcctggctggtcttctggctgaaacaatttcaacaaaatttttgtgtccatttggcagaaaatcctaatcaggatctatggcgtctgaactaggttaccattctctccatagcagtgaacacagatatagatacatgggtggtaacatcacatactaattaattggttaatctaatacagcattttccagattgatattcatgactgaaaagtttagatagattagaagataatgtgctccaatacattgtttatcttcattacatgggatcttttttttgtttgtttttaatgctgatcataaaccactcaatccatcagagaatctatcaaagtccgtcagatggtcatgatccgaattttaaaagcagtctaggccaggcctagtggcttatacctgtaaccccagctttggaaggctgagacaggaggatctcttgcacccaggagtttgagaccaacctgggcaacatggtgagaccccatctctacaaaaaatacaaaagttagccaggtgtggtggcacatgcctgtactcccagctacttactcaggaggctggggcgagaggattgcttgagtccagaaagttaaggctgcagtgagccatgttcataccactgcactccagcctgggcaacagagcaagatcctgtctcaaaaaataaaaataaatgaaagcagtctattcagaacagtcctgggttcttggacttgtctatcattgccttgctgggaccatggacgattccctgcttgtctttgaacttgactacaatgggaagtttgggaatgacctagttgactttcgagacccttctagttctgattcctaacattcacatagcaattataatttataattgttacccggcatgatgagcatattctaaggggtgtgctccttcatattcccatagtagctgaatattgttgttatactgtgatgccacgttaaacattttatgttggtactgttttattcacaccccccgccccacttcgagatcctagacatggcacatagaagttactcaataaaagtttgttgacagaaggttgactgaagagtcagctgtgtgtgaaggagtgaagcagggcttttacaaagaaagcaggatttgagccagatacagaagcgtaataaccattcagttggtgaagaaagaaggggaggcccaggaaatagaaatcagcaaaaacagggaagccttaaaatatggcatgttcaggaaatagcaaatggttcaatatgcctagaaggagtgggggtggatgaggggtagaagataatgtgttccaaaaggtggtttagggttggcttgtgaagggctttgtgattatgctgaagagttactttattctggaggcagtgggaagcctttcagaatttcagagaagtagcgtgaccagagaagtgatttggaagaatacttagagcaccatggaggaacgattagaggcagagcacagactttacaggctatggtaacagttagggcaaaagatgccacgaggcctcggtttgtctcgtctctgcacaggcctgtgggtgggcaagtcagagtgatggtcaccgtctgggggaggtgctcctgcctcactcccatgacacctggccattattgtgttgtgctgtataggacataattatttttattaataggccaggcacagtggctgttgcctgtagtcctagaactttgggaggctgaggcaggcagatcacttgaggtcaggagtttgagaccagcctggccaacatggtgaaacctcgtctctactaaaaatacaacaattaggcgggcatggtggcgcatttctgtaatcccagctacttgtgaggctgaggcaagagaatcgcttgaacctgagaggtggaggttcctgtgagccgagatcatgccactgccctccagcctgggtgacagatcaagactctgactcaaaaaaaaaaaaaaaaaggttatttttattaatgtataatggttctatgttccttctaacattttatgatctatacccagtgatttgtgtcacttctttctgttccttgacaaaaaatataaatgaggtactatttttactaaatgaatgctttctcaaagggatataaggtagtaatttgttctggggctgcacagtagcttgatgctgaccattatttctatttagctcagcaaatacattggttgtgtaattcgatcctttaatattggtatcaactttactttctcctgatttcctttacttttatttgtgaatgcctaatttatagtaacctaaggttgtttgtcgttttattttagttgtgggaatccccagaccaccttggatactggactgtttgtgaactgctccaccacggaggtggcactgtcttgccatctgaatctttcagctgggattttgctcaagctggggaaatgctgctcaggagtggaataaagctgtcaagtgaacctcatctttctccgtggatttcaatgctgccaactgatgccactttaaaccgtttgctctacaattctcctgagtatgaggcctcgtttccacgaatggaaggaatgttatttctccctgttgaaggtaagcaaataatattttaaggtttttttttttttaaatctcagttacattaatttcttcaaagaagcttttaacttctttggcatttctcacagcccaggcactcaacgaatgcttgtcatgaaagaattaaaagacatcaaggcaaaatcagagatactgtaggaaagagttgaactcttaattcagtacaactgccagcctttgtacaaaaaaacaagtgaatgattgattttaaagtttaccagctgttcccaaagaagggtaatattattcaggtgcccaagcacatgggtatacgatttcattgcctcatagagtagattgataaattgaagaccatagagaaacaatggtcgactaaaagaagaaataaattagtctacagaaacccagaatgatgcttgttaccaggaaaagcaaacatgttggaatcttcattacattagtttcaccatatgatttgctatatggtaaatctcatttctgaatatattgtatattcacagaaataatactttatagagatatgtacataaaactgttgtacattatgtgcagtttaaggaattttcaagagtagttttgtttatataatttcattacacagtctttagaatttaacctcctcataagatatgatgcactgtactttatggatttaagaagtggtgtcttctttcttataagtagtaaacattgcttgaatacttacttcttttttttttgagacaaggtcttgctttgtcacccaggctggagtgcagtggtacgatcatagctcagatcgcagctcactgagcctcgacttcctgggctcaagggatcctcccacctcagtctcccaagtagctgggactaaaggcatgagccaccacacctggctcatttttgtattttttgtagagatggggttttgccttgatgcccaggctggtcttcaactcatggacctcaagtgatcctctggccttggcctcccaaagtgctgagattgcaggcatgagccaccgtgcctggccttcaatacttatacttatttctaagtcataatttctgagaagttctgccatcacatattgcctttgtaactccatttgtttatagctttttctatagagctaaatgaacttgctatgatgacttggcagtagaataagtgttgaagtgttcaactaagtgacagtatctcaattgacaacttgattattttcttattgttattaaatctctttttagtatctattccttatattggaattttaatctttttttaaaattttaatttggcatcctggtctaattaatctttatttctagcaggcaaagagattcaagaaacatggacagtcaccctagagcccttggccatgcatcagagacattttcagaaaccagtcagaatttttctaaaaggctcagtggcccagtggtctctcccaacgagcagcactttgggcactgacagctggatgctaggaagtccagaggagagcacagcaactcaaaggctgttatttcagcagttggtaagcaggctgactgctgaagagttacacctggtaggtatcctccacacgggaagttattcttgtctaacaacacactggtaaagtgaaataagtgtgtttataaatgccctacacaatatagtcttagtaaaactgattatgcttttgcaaataatattgttgacattatagtatcatgacagcaatgcttattagagaagaaatcacttataaaattgcatgtaccaagaatccaattaagttaaattatattcacatagggaagaaggcagttggccagatgaagtgcttatgttagggtagtaatgtgatgagtgatttctcattgttttttaaatattctgttacatatttactacttttatataagtatttaagaaaaagctgctacacagtaaaattagatgtaatagtataatagttgtgtaactatatacaatgtaatataattgtctgtgtaactcagcagttggacagtagttacacaaatgtagaaatgtcttctgaaaaggaacatatacatacccagatttgatttaacggtgagaattatttttaaactaccagcaaattccttaccttactttgtcttttgccttcatactctcaggaggggtctctattctggttcccattgtaaaatattctagagaaaaatacggtagtcattggacagatgctgttctgagagttgtgtgctctgaggaaaagggcactgggtttgggagtcagtgatctggattaggtctcagctctgctgcctactgtatgttctggataaatcactcaagtggtatttctgcctcatggttaagtacatgggtttcaaagtcacatatgcttggcatcttctcttactaagtaggtggctttaacaggttacttctgcctcagcctcaatccctcctttataaaatggggataataattatttttacctcagggcgattgtgaggattcagtaagcacatagtaaatacctagtaaatattcctggtaatgtcaggttttacttatttgtaagtagaaatatgaggactctgtgattaataaattcccttctacctctattaatgatcaaatctatctttttcatagttttcacgttaataataattgggaaaatggttattctgtcttttagtacactacattcttctttaggcatattgacaataatattctcaactaattagggcttctcacgtaggttgctgatgtggaccctggtgaaggccggccccccatcactggagttatttccccactctctgccagtgctatgatcctcactgtgtgccgcaccaaggaggctgaatttcaacgacatgttctccaaacagctgtggctgacagcccccgggacacagcttcccttttctcagatgttgtggatagtatattgaatcagactcatgattcgcttgcagatactgcttctgctggtaagctcctaaactagtaactaacagagtctagggtggtttgcagtcttttcaagcatcgggactttttcactgtgcagttagtagaaccccaatatgttataacacagatgaaagaaagctataatacttcaggcagtttaaatcattattatttatagaattccttaagtacttctgaggaggctgcaggttccatgaaaccagtctgaaatcgaagtcatggtttttaatatatttaagaaatactgcatataaaactgtagtgattctgtctaccctgcattgcattgttactactagcattgcaactaaatgcattgttactactaaatctacctagcataaataaggtttgtatcatgttagtattacaaaccttatgtaagctaggtagatttaaatatacgtatacatatatatatatataaaatcaacttgatatttctttaattcattcattcattcaacagatttgagtacctgctgtatggcaggcactgtttgaagtactgggactatattagagaacaaaatggacaaagatgtcttcccatggagctgaccatctagtccagggagacaaaacaataagtcaggaaaattacggtttagtctaaagagacaaaaattgtagtagtaaagcagaaacaaaggaatggggtgtgttagggtagggagggttgcaattttaagtagggtggtcagggaaggccttgctgaaaaaatgatatttgagcaaaggcatgaaggaagtgatggcagggagttgctggtagaggcgacagcgagtgccaaggctcagaagggtgttagaggaatggcagggaagcctgtggctgcagtgaaaggagcaaggagagagtaggagggggtgaggtcagagagccagcagcagaccaaactgggcagggctttacaggcactgaaaagactttggcttttactgtgagtgagagaggaagcctttgggtgattttctgcagtgacaccatctgacttatgttttaacagcattactctggcttccatattgagatttgactatagaaaggcaaggatagaaccagtcagacatattacaataatccaggcaagagatggtgggaaatgtagggagttggaagtagttggagctcttggatatattttgaaggtaaagccaacaaaatttgctgttagattaaatgtgtagagtgagctgtagggaaattgaaagtgactccagagacttttgccctaagctactggtagaaagcagtttctttctgagatagggaaggctgtgggagaaccaggggctggggtggtgaggactggagggtttgttttgggcatggtaagtctgagttgttcattagacatccacacatggtattgagtaggcatcaactatgcatgtttgagtttgggagatttgtctggactagagatgatgggagtcatcagtgatgttttaaagccatgagatgggttaagatcaccatgggggtgggcgtagatgggaaagagaaggggactaaggactaacccctgcaccctaatgttaagcagtctggggaatgaggagagagaaaccagcaaaggagacaaaagggggacagtcgctgagttaaagaaaacccagattgtggtaccctggaagccaagtgaagacaggaaatgcttggctgggttatttactactgacaggccaaggaagatgaaggctgggagctgacattcaactgagcaatgtggatgctcgggataccatcacaacgtgatggttgtgatactagttttggtggaattgtgagggtagaagtgtgagtgggaatacgttcaggagggactgtgaaaagaggaaaacagcaagtgtggacaattttttggagtagttttgatctaaaagatattagagtaatgaaaacagtggctagagagggaagaagagtcaaggtttttggttttgatttttagaaataataatagcctgcttgcatgttgatgagataatatggtaaaaattaatgcaggggatggagagaattgctagttagagggctttgaggaagtgcaagtggaggggttggtcttgggaacaagcacagttcatctgtgacaactgggggaaggcaaaaatgtaagggctgggatgccaaggtgagtgatgttggtgtgagtgtacggggttctcttccgattgcttcagtttttttagtgagttaggaagtgacatcatcagctgaaaatgaagacttaaggagatgctggaggctgaggagagaggggaggaggaagtggctcttgagagggtgaagatagcaggaaggtggaggaagtttgccgggatagtcgtgaaggtaaagtgagatccctctgtgggcttgcctgcctccagccacattcaccagctggcacagctgcagagtaggcagggagctggattaaccagggttgggattttcccaaatgagggtggtaaagctagagaggggtcagggattcaaaagtgtgaacaggaagagattacaggatttgtccatggaacgaggcagggtaaggagggaagtgaggacaacggaaggacaggcgatcagatcaatgggttataggggtctcaggatttctggagccaatctgctcaaaggagagagctaaaaaataggtggaggtggtcagaatggggtgcttgagatcatagagggtggtgaccagggggagagagtgactgaaggagggcaacacgctggggcaccagaggtgaggaattcaaggggacaaaggccagagtgttggtagcatcaaatgtgtgtatggaagttatccagagttaagactgagtagtactggagagactgacggtggtgagtcgggagctaacagtctttgaggagtaagggggaatgatccaggcttgttagatgactatgagcgtgtagcctttgatgtgagactcaaagctggatttttgtcgttattttcagcaggtagagggaaaatgatctggaagaggcaaggaggataccagcccacctcagggccaagtggaaaaagagcatggcgggggaacagcaagctctctccagcgctgcaggggaagcagtgtgttcagggcaggaggagatggaattgaggacataggggattttgctgatgagggtcagtgagttccagagggcagggtgggaggattttacgtgtggaagggctaggctgtggtgccaggatgggagacggaaggagcagtgaggagattccagtgggcagactggagtgacctgggggtctagggcttcgcctgacgggaaaaagcagctatgaaggggagcatgagattgattcctgatggtttcaacgcagctaatggtgctgaacctgtgagtttggggggtaagaagggtgggtgtttggcccacccccactcctgcccatgtcggcgtggagactagaaggagggcatctaactccgagggcctagggctccctccaaagccctgcccaggcggccagtggagggtggccttgtttttagcatggggctcctgcttgacatttgctggaagaggtgcaggtaactctgaggggcactctctttccatgcagagggaggcttgagacttggaggcctgaggcaggtatttttggcctttctcccctaatccagcatacaacgacttgagaagaaatcatgtcatgtttattctcatagacctttactgcacttgtctgaattttgtaatataacagcaaatgcaattataggcatttatgctgtcctgtgatgtgaagtttcttttgcttgtttaaaaaattctacaaaatcttacactaaaaataatagctttgggaaaactacagttggggcagacttctcaaaatctttggtagtgataaaaactaagacaatcctgggtgtggggacacatgcctgtaatcccagctcctcaggatgctgaggcaggaagatcgcttgagcccaggagtccaagaccaacatagcaagaccctgtctcaattaaaaacaacaaaaaaaagtgcaatcctaataaaaattctagtttgattaaaagacacattaaatccataataagtaaagtccataataaatataccttgtcctttaaaagaaaggtgaagatggcatgatggaagggttgaggctgtggtattatggagacaggggccaatgacaaagatagggaactatatcataagcactttcaagaaagtgcacgtggccaaacagccaaggagaagaaaaggagaagaatacgggttgaaaggacgtagtgtacagcactgcgctcctctggcttgttgtatttagttatgtttgtgcactttgaattcagctgctacttggtggtataaaatattagcacattaggaatgatcacataaccaaagcaacgtaatattttgtactactgtcactaccttacttaccaattgtgtgtaggctatttgtagaaaattttgtattgtagaacagactgtatcttgactatttatatagtcttggaagcagctcagaaaactgtattttggaatctggtaaaggaagaactgcagtattttaccagtactctctgctgtagcatggcccacagtttcttccaggttataaatcagtgtgccggcttattgtccagtctccccaccatgctccatctgggtgaggtcctattcatgcattggtacctagcccaaatactgcattctccatgagaccttccttgcccatctagacggagttagcatgtgctaacatttatacgtatctccatgacttcacaagagtggatctactcttcctatactgggagctcctttcgaagtatgcattgtatttatctctgaattctttcactgatagaaagcctagaacttggttgtctcaataagtttgaatacattttaagtatttgggtttttttccccaagacttcattaatgtctaacatttcatttgtctggggtcttagatggatctctcagaattacagagttcactgaaatttctgttactgttcccccaaccacctcctccatcaggcttattttaagagagccttctaccctcacactccccaatacagagccacatcttcttatttccaattttcctactcagtgcagcagaactgtgatattctgcagttttgttactgtatatttattcttgtacaaagccaatttttgtgtgtgtgtgtgtgagacggagtctcgctcttgtcacccaggctggagtgcagtggcgtgatctcggctcactgcaacctcagcctcccgggttcaagcttctcctgcctgaacctcccgaatagctaggaatacaggcacctgccaccacgcccagctaatttttgtacttttagtagagacggggttttgccatgttggccaggctggtctcaaactcctgacctcaggtgatccacccacctcggcctcccaaaatgctgggattacaggcgtgagccaccgtacccaaccatacaaagccatttttaagaacaggaccaggcacggtggctcacacctgtaattccagcactttgggaggccaaggcaggcggatcacctgaagtcaggagttcgagaccagcctgaccaacatggagaaaccccgtctttactaaaaataaaaaatgagctgggtgtggtggcacgtgtctgtaatcccagctactcaggaggctgaggaaggaaaattgcttgaacccgggaggcggaggttgcggctcatgagccaagatcgtgctgttgcactccagcctgggcaagagcgaaactctgtctcaaaaaaataaataaataaaaagaagaacaatatatatttttaacctgtttagaggaacatttcagaaatgagaggatttatagccagtaataagaacaaaagactttaaattgtgtctgtatgtttttcagtagcattttttatttaccacataggcctgtagcagtttgtggtgccggagaacaaatgttaactgtgcactttgtatgtcctttggagggatgcagtcagtccaggggaggagcaagtgcttagaattctctgctttggttctcatgctgtttcctctcctgccgctgctcctttgctccaatagcttctcctgttccagagtgggcccagcaggagcttggccacaccactccctggagtccagctgttgtggaaaagtggtttcctttctgtaacatcagtggtgccagttccgatttgatggagtcatttgggtaaaacgtttttatatctcttgaatattgattattaaaatcaacgttcagttatctgcatttttttcttaacagaccacattctctgagtatagtctaataatattaaaaagtagttacaaaaataaaatactctcatacttaatatatattgtgagagtatgttagctagataatatgttaacaatatataaatatatacctgccaaaaattctttaaaatttaccaaagtaattcgtcaagttaaatataaataaatactcccttaaagtgagaaaatatttataactaagtatcaatgcaaatagaaaacagcaaacttgaataatgcagctgaatttatacttaaagaagtatttgcagaccgtttttgtaaggaaaaaagttaacaaccgattactaagaatccaacatgagaagtaaataagaaagtaacctccaccctacaaaagataacaacagaaataaatagaaaacaaataaatgtaagtgatcaagagaaacaaaagatggttctttgaaaagccaaataaaataatctatagcaagatcaagcaattaaaagacgaacaatattagaaatgtaaacgatatggcagaaattcaaactattattaagaggtatggttgacgtttattttctccacacatatatccattcagttgttccaacaccatttgctaaaagactatcttttcccactaataactgtggtaccttgtcaaaaatcaactggccacctttgtgcagattgatttctagacagaatacagtccagaaactatgttaataccacattatcttcaatattgcattatagcaataccatatactgtagctttatagcaccagtcactaaatcaggtagtgtaagtcctctaaactttggtttcgtttttttaaaatttttttggttattttagatacttcgcattttcatataaacttcagaaccagcttgtcagtttccacgcacacaaacatctgttgaaactctaggagtgcattgaatcatagataaatttgggaagaactgacatcttaacaatgttgagtcatccgatccatgaacatggtgcagctatccatttatttaggtctctctttaatctccctcagtgttttgtagtttttaatgtacaaatgtggcccatgttattttttaaaattatctctaagtatttttatgagatgtaaatattgaagagtttgaagatagtatgattgtctttatagaaaatccaggcccggcatggtggctcacacccgtaaccccagtactttgggaagccaagccagtgaatctcttgaggcctggggttcaagaccagcctgaccaacatggtgaaaccccgtctctactaaaaatacaaaaaaattagcccggcgtggtggcacatgtctgcagtcccagctacttgggaggctgaggcacaagattcacttgaatccaggacgcggaggttgcagccagccaagatcgcgccactgcactccaggatgggcgacagagcaccacacacttagggaggattaatctgcttcatattggctatatgaatgaagctgatagacccaacacatattccaccctgtgatatctgttcaactaatatcaccgtaactttcttgcactttttaatcagttatatcagataatggaaaatattaaaatacaaataacacattttgaatgttgtgccattttcataatttccttaatgacagatatttagctctaggtggaaaaggatttaataactaatcacccctcctgcctgccctacttcctcctcttctcatcaatcccaaattagtttattacaatgtgaaagaattattcgaagtcattgcaatacttactacaatgtgttaacatcattttgtactttgatatatggaaactgagtaaaaaataactatggaagcttgaagtgaaatagttgccataattagacttgcatcctaattcatgaagaatcctattaataaaagtcaatattatatgtaatggttaatggttttgtgaacaagacagctttggttcctgcattcgttcaaatcgaaaatgagaggagggacattttctctcctaagaaaatatatttttgaaggcatcttgtggggacatctttttggttagctttttagaggatagtgggtattttggtgttatttctaaagcattttgcaaaattagaatgttggttttattctagacatcttgacttcacaggttactacaggctgcctcagctaataaggaagagtcttccaaaactgaaggcgaattaatacattgccttgccgagctctaccagagaaaatctcgtgaagaatccactatagctcatcaagaagacagcaaaaagaaacgtatgtacctagaaaggctgtttcttaaggcattcttttttgagactgtatgttttaaaagatgggcatttcctgaaatgaggttgaaatggtaactaaataaagaagggcaaatttttatatttaaattttaaaataattacattagttcaatagtgatttttaaaaaatcaaccagtcttatctgtctaatgaataagccatcttcatttttaattatgatagaaattcaaatacaactttgtgttctgcttattagtattttttcttttgctaccttgcctttttagatattattccatctcattgcttaactaaatttacaaaattctcatgttgttgaacatttagattgctttcagttttcatcattataaataatactgtagtatacattatgcgtataatttgttttttaagtaattaccttagcagaagtttccaggaaccagttactgtgtcagggtatgaaaactggctctttatgtagattgctaaattgtcattcagaaattttcatcaccatttttcgtggccattgggtaacaccaaaataagtctgtttggcatttgccttatgggaaaaccatccattgagatgtttagttccaatccaatcacattgagatgtttagttcctaaacttcggttaaaagaaaggttctctttctaccctgtgtgtgggcagaaagagatgcaagaacttcctaattcaaatcattctggagggatatgcttcattttgatattctttcacagtaatctgaattaaagtagttcttctttccacagaagtggaaggcaatttactttccctcctctgatgttgttttggtaggaggggtccctcgtactccagtgagacagaagatgaataccatgtgccgttccttaaagatgttgaatgtcgcaaggctgaatgtgaaggcccagaagttacatccagatggcagtccggatgtggctggggagaaaggaatccaaaagatacctagtgggagaacagtggataaattggaagacagaggaagaacactaagaagttctaaacctaaaggtattcctcttagtctataatttactcttttataccccgcttttttaaaaataaaatttaatcgtacccttagtttattgactatctgctacatgcacaaaaaggtgttatggtgaatacagtaaataataagataatgtgctattcttagatttatgatctagctacaaagataagggaggcggaggttgtggtgagccgagattgcaccactgcactccagcctgggagacagagcgagactctgtctcaaaagaaaaagaaaaaaagaaagaaaattctgaggtgtaaattttatgctgctttacagatttttttttttcctgtggaatgtgagagccatagatgataatcagtttgaatgggacagaacacctttagtgggctagtaaaggtgtgtgaaatgtgcttgatacatgcaagggaaggctgaaacaacagtactgaagacagtgtggcaggaacataatttctggactagattctgtctagcagtagacctgcacaatagtgggcaaatgatttttgacaaagatgccccaataattccgtgagaaagacataatcttttcaataaatgatgctggaacaactagatacctttatggaaacaaaattagaccttacttttaatagtattttgtattcctgctatttttaatatttatgccttccatctctctctctttaattgctcaatcttgctatagagttttctgttttattcctcttttctttttttgttgttttttgagactgagttttgctctttttgcccaggctggagtgcactggcatgatcttggctcactgcaacctctgcctcccgggttcaagcgattctcctgtctcagcctcccgagtagctgggattacaggcgcatgccaccacacccggctaatttttgtatttttagtagagacagggttttatcatattggtcaggctggtttcgaactcctaacctcaggtgatcagcctgcttcggcctcctaaagtgctgggattacaagtgtgagccaccgcgcctggccttatttggcttttcaaagaaccgtcttttgtttctgttgattgctgttgttgctttgttttcaattcatttctgttctttatgattaccttcctacctttatttttggggtttactctctcatattacttcacgtgttggacccttagatagttaatagtttttaatttgtctgctttacaaaaataatcacttgtctaaagtctgtacattttctctttaagtataactaactgcattatgtatttactgttttctattttcattgatacttatttataaatattttctgacatccataatataagggagtgttttataattagcttttaatatttttgaactgtgctcaatgtggtctgtaagattgattctttaatatttgctgaaactgacctaatgtgcacttgaaaataatgggtattctctaattgttgaatatctggttttatacgtgtctgtacatcaagtttattaatgtttgaatattcaacatttttagtaatttttttctgctgcttttatctattgctaagatgattgtattagtcttccactattgtattgtctttgctcctttgtcaaagatcagtggaggccaggtgcagtgactcatgcctgtaatcctagcactttgggaggctgaggcgggcagatcacccgaggtcagtagttcgagatcagcctggccagcatggtgaaaccctgtctctactaaaaatacaaaaattagccaggcgtggtggcaggcgcctgtagtcccagctacttggggttactgagtcatgagaatcgcttgatcccgggagacagaggttgcagtgagccgagattgcgcccctgcactccagcctgggtgacggagcaagactctgtctcaaaaaaaaaaaaaaaaatccgtttactatatttatgtaggtctatttccaggctctcctgttacattgatctctctattcttttgctaatatcacacaaactgtcttgattactgtagctttatagtaagtcctgaaggttggtactatcagtcctcaaactttgtttttctcattcaatattgagttagttattctgggtctttcgcctcttcatataaactttagaatcagtttgtcaatatgcagaaaataacttatttgatagggatcacatagaatctatagatcaaattgggaatctgaaatcttgacagtattgagtctttcttgctgtgaacatggaatatctctccacttatttagttctttgattttgttcacagaattttgtagttttccgcatatagatcttatacaaattttgttagatttaatacctgggtatttcatatttagggggggtgctaatttaaatggtaatgtgtttttaattttaaattttgcttgtacattactggcatatgggaaagcaatggacttttatgtattaatcttgtatcctgcaaatttgctataatcacttgttagttccaggagttttttgtttgtttgtttgtttgttttttttagtagagatggggtttcaccgtgttagccaggatggtctcgatctcctgacctcgtgatctgcccacctcagcctcccaaagtgctgggattacaggcgtgagccaccacacccggcccagttccaggagttttgttgtttgttctttcagattttctaatcatgtcatatcaccaaagacagttttatttcttcctacctttaaattgtttgtttgtttgttttgagacggagtttcactcttattgcccagactggagtgcaatggtgcggtcttggctcactgcaacctccgcctcccaggttcaagtgattctcctgtctcagcctcctgagtagctgggattagaggcgcccgccactacgcccgggtaatttttggtatttttagtagagaagaggtttcaccatgttggccaggctggtcttgaactcctgacctcaggtgatccacccacctcggcctcccaaactgttaggattacagacgtgagccaccacgcctggcctcctacctttaaatttttaacacttaaacttggtatacagagccttaaaattaatcacttggctgggcatggtggctcatgccagtaatcctagcactttgggaggccagggcggatagatggcttgagttcaggagttcaagaccagcctgggcaacatggtgaaaccctgtctttaccaaaaatacagaaaataagctaggtgtggtggcacatgcttgtggtcccagctactccagaggctgaggtgggaagatcacttgagcctgcctgggaggtggaggttgtggtgagccgagattgtgccactgcactccagcctgattgtcagagtaagaccttgtctcaaataaaatgaaataaaattaatcacttatctctgtagtttctcagtctctggactattgacattttagaccagataattcttcgttgtagggctgtcctatgtattgtaggatgtttaacagcatccctggctcctacatactagatggccagcagccacccccgcccccaccaccatcagtcatgacaatccagacaaggccaaatgttccctgcaaggaaatattttccccagtggacaacaactggcctaagtaatacaaggacttgagcaagatatgattaatccattttattttatttttttctcagattttaaaactgaggaagagctgctatcatatatacgtgaaaattaccaaaagactgtggccacaggagaaatcatgttgtatgcatgtgctcgaaacatgatctcaaccgttaaaatgttcctaaaatcaaaaggcaccaaggaattagaagtaagagggtccagatattgttgtttgtcatggatgtagtggttggttggttggttggtggtggatttggttagtgtcttggaaaatgtctgttatgtcatatgtgattcaaaaatggtaagataagtaagggagtaagtacagttccagatctcagaaggtggatatggtgaactggtaaggcagaaatcaaagagatggggtgagcggggataattacatataattctctcctaatgaaaagcctttcctcatgtgagctatatgttagctgcatgattaagccagtggtttttaaccctggctatactttagaatcacttacagcatttaaaaaatatatatatgccaactaaccgtggtggctcacgcctgtaataccagcactttgggaggccagggtgggtggatcacgaggtcaggagtttgagaccagcctggccaacatggtgaaaccccgtctctactaaaaatacaaaaatcagctggatgtggtggtaggtgcctgtaatcccagctactcgggaggctgaggcaggagaatcgttttaacctgggaggtggaggttgcagtgaggcaagatcgtaccattgcacttcagcctgggcaacggagcgagactccatctccaaagaatatatatatatgccttgctctctccagatgaactgaaacagatctctggggttggcgcttttaaaaagccccctggataatccttttgcactgggagtgttgcaaaccactgttttagaccgtgttgttgttttattcatgttcagtggccatcacggagctccttctctaaagcaaacaggaggatttgtttatgatacttaggtttcttaagcactgctttatggaacgtttcttttaagacactttatttagggcaggcttgttttatccatgcccactagctctcaaaataacttttaccatgttctttttaaagatataaaagaagaatattcacgtcactttttcattcaaatgaaagaatagagaagtttataagggaatatatttccctttagtcaactgtgaaagaaattagaaataatgacaagtaacactattctcctatgtaataattttgtatttttaggtgaactgcctgaatcaagtaaaaagtagtctcttaaaaactagtaaaagtcttcgacagaatctaggaaaaaaactggataaggaagacaaagttagagagtaagtaactaccattttttaaaaaatcatcactctaaaagctgtgagattagctcgtatcagtttaaaatagattgttcgtgacatggtggctcatgcctgtaatcctagtaccttgggaagccaaagcaggaggattgcttgcagccaggaatttgaggccatcctgggcaatatagtgagaccgtgtctaccaaaaaattttttttaattaggtgagcatggtggtgtacacctgtagccctagctacttgggatgctgaagctggaggattgtttgagcccaggagctcaagactactgtgagctatgatcccagtactgcactctagcctgggcaacagagcaagaccctgtctcaggaaaaaaaaaaaaaaaaaaaaaaagattaccaactgcatgaagatgcttttgtagccaattcttttttatgttataatatgcagcttgaatcacctatttatctaataactacatcagtttttagaaaaggcactggctctcctcctttttggttgttgtgtcttatataaatagatctatgcttacggaaggagctttttgtttagtgacatccaaagtagatatgaccaagtatttttttctctcaaggtgccagcttcaggtatttcttcgtttggagatgtgtctgcaatgcccttcaataaatgaaagtacagatgatatggaacaagtagtggaggaggcaagtatatagtttcgtgccattgaaatacgccctagatgctttcagcttccctgcagagggcatctatatagtaacgttctaaaatctccttcaggtgacagatttgctgcgcatggtgtgtttaactgaggattcagcgtacctagcagagtttctggaggaaattttgagattgtaagtttgatggttactaacttaactttaaaattgttttgtcaaaacctatgtatggtgttgtctctgaattttggagttgtaaggactactttttaggctgggtgagggagggaatagagagggtaagatggtaactgttccgtattcgatcaatctgttccacaggtatattgactctatcccaaagacacttggaaatctttacaacagcctagggtttgtgattcctcagaagctggctggtgtccttcctacagattttttcagtgatgactccatgacacaagagaacaaatcaccacttctttctgtgccttttttgtcaagtgctcgtagatcagtgtcaggcagccctgaatctgatgaactgcaggaacttcgtaccagatcagccaagaagagaaggtaagaggtcaaagaatcaaaggaattatttgcactgttatagttctgataaaagatgtgtttaaactacagtccagtcatctttgtccatataatttgttgaactaatagctgcccttatgtctgaatcagagaagccaactattagagctcctaataggagcatctgacaatctttatattatctaggaaatatatagtcatgttttgcttaacaacagggatacatcctgagaaatgcattgttaggcaatttttgttgtactaacatcagagtgtgcctaccaaaacctagatagtatatattttttcatttatgtatattttttcatatggaaaagctaatgttccagcattgttactgaatagcagtcatttcccctacttgatctgtaatgccaatatcaagtgtcatttattaggtttctatataggctccattataacctatgggaccattgtcatatatgcagttcgtcattgaaggaaacattgcatgactgtatagtgtttatttcctatttcacaaagtcttctttactgtccacatgaggtctccagaaactaggccttctatgaaataagcttagagtttcagctttttaaatttcccttgatgcttttcgttgttcataactggttgaatttgttacttttgaaaattctggggtgacttgttttattataaacccagaacaaccttaagataactggcttttatttaaatcatattttattttacttagactccagttccatttgaatttaactatatataacctctatctagtatgtattaactatttctatttttaaaaggaaaaatgcattaataagacataaaagcattgctgaggtttcacagaatcttcgacaaattgaaattcctaaagtgtcaaagagagctacgaaaaaagtaagtaaaccttccagcttgagatgacacagtaaataagaacaaaaaggcagtgtccctacttttaggaaaatgaactttggaggatacagaaataatattaaatatttttatgaatgtgtataaaactataatccaaggaataaagaaatataaacttgtcaagagattaacaattttactcaagagtgtgatagttagaggtaatgtgaagaaaaatggcaagtaaaagttaggaatgaattaattcaaaatctttaatgtagataggaaaactcataaaacaataactaaaataagcaaagcagtcactggaagagaatatacaattgtaagtggactttggttgcataccagaaggtgcttttcaatatgttatattttactttaataacaaatttaggccaggcacagcggctcacacctataatcccagcactttgggagtcagaggagggaggatagtttgacaccaacagtctgagaccagcctggacaacatagcgagaccctgtctctacaaaaaataaaattaagaaaaaattagccaggcatggtggcacatgcctgtaggcccagctattcaggagtctaaggcagggagattgcttgagcccagtaggtcaaagctgcaatgagctatggtcgtgccactgcactccagcctgggtgacaaagcaagacttcatctcttaagtgaattaatgaatgaataaatgaatgaataacaagttttttgaaaaagatgatgaccatcatggagccaggaggtggagtagtcgccccttatctgcagaagatatgttccaagacccccagtggatgcctgaaaccacagatagtactgaaccctatatatagtactgttttttcctatgcatgcataagttcaatttgtaaattaggcacagtaagagattaacaacaatagtaaaatagaacaattatagcaatataatataataaaagttatgtgaatgtggtcttcctctcaaaatatcttattgtactatattcacccattttggggccatggttgactatgggaaactgaaaccatggaaagtgaaatcacagataatggggtactattgttgtttttttcatggcagttgatataaggacttgaggtttttattggttgaaaaaaaaataaacctagctggaatctgtttactaagtagaattaatgtctcgctgaggaaaaaagggagactaaaaacacaatgaaacttttcaactgcatgaactatctgagaagagttaaaattcaataagaactatctttagaagcattaattattataatagtggtttgttctgtttctagatatttgtagcagtcctttggaattggaggtgggatttcttttaaatggttaatggtgttcactttcttatactttgtgaataaaatgcatatcttatatatctcacaatcctgattgaagattggaaaatccgaaagtgaatggccaaaagttgccaggcctttattctcactagattttacaatgatttgcagatctttctagcacactttgaaactttggttttagattggacaagacagttttcttctctaagatcagaattaacgcctgggcgcagtggttcatgcctataatgccagaactttgggaggccaaggcaggaggaatcacttgagcccaggagttggagaccagcctaagcaacatagtgagaccttggctctacaaaaaatttaaaaattaggtatggtggtgcactcctgtagtcccagctactcgggaggctgaggtaggaggatcgcttgagcctgggagtttgaggctgcaatgaactatgatgaagccactgcactccagcctgggttacagagagagactctgtcaaaaaaaaaaaaaaaaaaaaattgaggtcaggatttgattgtggttagtaatgttttttcatgtcaaagttggtaccatagataagtgacaattgtttaactgaaaggaccagatgttacatttttaaaagaataaatctcagttctctgaaggaccaatatagttaactcgggaagcagtgaacttacaacttaagcgtagacatatagtattaattacattaatgtatattaatttcttttacgtatcttaactccagaagatcacaaggattaaaaaaaaaatatttgatcctgccttaataccttcaggacatactctcctagtttttcattcaattacatggattaacaagggttgacaaactttttctgtaaagggccagatagtagatgttttagcctttgcaggccatacgtctctgcaacatctattcagttctgctatagtggaaaagcagctacaggcattatggaaagaaacgagcatgactatgtttcagtaaaaactttattttcaaaaacaagaggtggcccagatttggtctgtacactgtagtttactgaaccctggataggaaattggatgtatgacttttatttttatttttattttttgagatggagtctccctctgtcgcccaggctggagtgcagtggcacgatctcgactcactgcaagctccacctcccgggttcacgccattctcctgcctcagcctcccgagtagctggcgtgcaccaccacgcctggctactttttgtattttttagtaaagatggagtttcaccatgttagccaggatggtctcaatctcctgacctcgtgatccgcccactcgacctcccaaagtgctaggattacaggcgtgagcctctgcgcccagccggatgtgtgacatatttttacaattatagtttatctctttataagagttattaatcaatataagtaagaatgatcacatctcatgtcttatcagcaagaccttggttatatcactgagaccatttgttaagtttctgcccatatgtggtggcttcttcaattattatgatgaattgaaaaaacaaaaaatctttaaaaaaacagtttccttgttttgatgcatctggggtttagactcttgaatcttctattgtaatagcaagtacatagcagtctgataaagaaatgtttctgagagtatagcctccctctaattaatgtatatggcttttcccttattaggtataaaaggtatgcatgattatcgttaaaaagttaaaacatataaagttaaaagttagggtgttccttctccatccattcatcagaagtaatcactgatgatagtttgttgtgtatatttccaggcccttttctatatgcaccaataacaccaaagatttatgcagatccgttatatacatatatataaatgatataacttagaatacttaatattttcctttttcctccctatcacagatctctatgttagtacaagttgagtatctcttacccaaaatgcttaggagcagaagtgtttccattcttagatgtttttggattttggaacatttgcattacatgtacttactggttagcaccccacatccagaagtccaaaatgctccactgagtgtttcctttgagtgttgtgttggcactcatgaagttttggattttggagcatattggattttcagattagggatgctcaaccatatatagagaggtcttccttccttactcttgtaatgtctgcattggatgggtatgtaatttatttaactgtttcactctttatgggcatttatagtgttttttattttgtgttattactatagtgcagcattgagtgtttttggaacatttctgttgtacattttattatttctattatggatccctataaatgaattacaagagtcaaagagttcatgtgaaatctttattcttttatttcaatgaatgcctatttaaattttctttctggattttctcatgtttcaggagaactctcaccctgctcctcagcagccttcccagccagtgaaagatacagtgcaaggtatactgttttctcagtgtatgtatttattcactagcatgacaactttatttttattgtatgtatttaagcagctgcttacaggtgtaaattaaggctttgtatgattgttggctaataaaatatgtccaaataccatggacatagtcccctaggaatagtctcaaaatattgtattttacaaaataactggtctgaaatctttaaaaacaaaaacaaaattaaaaaaaacatcatgaaagctggaagaaaggaaaaagaaaagaggcagtgggactgtttcagatgaatggagtttaagcatgatagctaaatgcattccatgatccctgcttggatcttaaatttagggaaaaaaatactagaaaggatattactgagacaactagagaaatttgaagaagcggtgtatgctagataatattgtatcaatgctaaagatattttgagtgtaataatggcgttggggttatggaggagaatgtccttgtttttaggagatacatgctgacctttaggaagtgaacagttgtttgcaatttactctccagtgtttaggggaataacgtacatacagagagaaggaaggagaaaacaaatattgtcagttggtgaactttagtgatgggcgtatgtttaattttattattatttgaaacttgctatagaaattaagcttttcaaaacattgggaaaatagagaataacaaaccaaatttggctttcaggtcataaatcaatttcaccaacagcctaagttaggtaacaggaactcttataatggagataaggaaacaatttttaaaactttggtgtgtgttattgatgtccttaataaccttaatgtgaacctttatgtcattgatgggtaaacacaagggttgctcccagtttgtggatcctagattatttggtttgggtttaaatgattaatctttgaagaattcacccttggtgaatttttggatcacttccaccagactatcttaagattaaggtattgtcttgctggctttgccacgtacttcttgacttttcagctatttttttctaactttgagtctagatgatgagaactttcatgctttggagtcaagaataaaatttaaaatgtcccagcagcttagtaaagtagtcagaagaagaagaaagaaattatagaattgaacaattctttgctcaatgctgagctgaatacacagcagcaaaaatgtccaaagtgagaaaaataatcataacatgggatatattaaaaggacgatgacctatgttagccatcctcttacttaagaattatgtccatcttacattgagtagcttctaactcaataagtggtgggggccttccttgtgttcctgaaaagttagatttaaattgaattcgtaatggaatactacaaaccactgtataccaacaaattgtataacctagatgaaatggacagactcctagaaagatacaaactactaaaaacagactcaagaagaaatagaaaatcagaatagatctataacaagtaaaaagtttgaattagttatcaaaaaactactcacaaagaaatgcccaggactagaagttttcactgctgaattctatctagcctttaaaaaagaaattagcactagcatttattatggtcaactgatattcagggtaccaagacaatttgatggagaatgaatagtcttttgcacaaatgatgctgagacaactggatatccacatgcaaaagaatgacattggacccctacctcatgcaaaataacatataaaattttttttaatttgcaaaagtaaatatttttaatgcattatgggaatatgctatttaaggaaaccttattagcatatgtgacaatagcaatctgtagtttcctcaaggagcttctctgttttggttatcttttctcagatacggcatttattgatgataatctttgggtttttctttttcttttaatttttgatgctttcagaagtgaccaaagttcgaagaaatcttttcaaccaggaattgctttccccttcaaagagatcactaaagcgggggttgcctagaagccattctgtgtcagctgtggatggtctagaggataaacttgacaacttcaagaagaacaaaggtaccacatttcagaatagctaggaaaaaggaaagggagattctgtaagattagtagtaatgtaccgtctttctttcctgatttagtaatttgagtcttcttccctcttttttccttcagtctagctaaaggtttgtcaattttgttaatcttttttttttttttttttttttttttttgagacaggttcttgctctatcacccaggttggagtgcagtggcgcaatctcagctcactgcagcctccacctcccaggctcaagtgattctcccacctcagcctcctgagtagctgggactacagatgtacactaccacacccagctaatttttaaaatttttttgtggagacatggtcttatcatgctgcccaggctagtctcaaactcctgagctcaagcgatctgccctcctcggcctcccacagttgctgggattataggcatgagccaccacacccagtcaattttgttaatcttttcaaagaatttactttggtttattgttttttctctattggttttctttgtcttttttttgagtcagagtctcactcactctgtctcctgggctggagtgcagtgccgtgatcttggctcactgcaacctctgcctcccaggttcaagcgcttctcctacctcagcctccccagtagctgggattataggtgtgcaccaccacacccggctaatttttgtatttttagtagagacggggtttcaccatgttggccaggctgctttccaactcctgacctcaagtgatctgcccgcctcagcctcccaaagtgctgagataggtgtgagctaccgcgtctggcctctattggttttctaatctcagtttcattttttttttttccctctattggctttggtttttgtttgctctttttctacttttttaaggtgaagtttaagctattgatttgagatcttttttaataaagcactgctttaggcatatcctataaattttgatatgatttgtttttgttttcatcatctcaaaatattttctaatttcccttgtgatttcttctttgatccattggttatttcggagcgcattaatttccacatatatgtatttcctaaattctcttctctgcttattctagtttcattctattgttgtaaaacatacattgtatgatttcagtcttttgaaacttgagacttattttgtggcttaacatttggtctatcctggagaatgtttaatgtgtgcttgagaagaatgtgaagcattctatagatgtgtgttgggtctagtggatttatggtattattcaagtcttctgtttccttgttgagcttctgttttattgtttatttattattcaaagtggcatattaaagtctccagctattattgttgaattatttatttctcccttcagttctgtcaatttctgcttcatgtattttgagactctgtacttaagtatatatgtcaataattattatgtcttcttgatcaattaaacttcttaccaataggtaatgtactttgtgttttgtaatctttcttggcttacagtctgttttgtctgacaataatacagctccccacccaccagctcttttgcataggatatctttcattgtccttttactttcaaccttagtgtctttgtatctaaattaaatatcttatagacctcatagagttggatcatgtttttttaatccattcttcttatctctgcttttcaattgcagtgcttaatccacttctatgaatgtaattactaataaggaacaactgtcattttctatgttttatgcttttttgtttctcaattcctgtttttttgtatttagctgattttttgtagtatactagtttaattccattctttctttttctgtgtatttttaagttgttttctcagtggttaccttggttaacccagctactggttacctcagttagcatcttaagcttaaaagaacctggctttatgaataaagccaacctcttttcaataatatacactctgctactatgtatttctgtctcttcttctttatattgttgtagactgcatctttatacattgtgtacctgttaatacagacttaaattatatagggtttaaaaaaaaaacaaaattaccataatgctggcttttatatttatctgtctagttacctttaccgttgttttttatttcttctcatggctttgagttattgtctactacctttcattttagcttttcttacagggtaagtctactgattatgaactccctcagcttttatctatttggaaatgtcttactttctactttatttgtgaaggacatagaatttttggttgacaatttttttttcccccttcaggacttcaaatgtgacatccactgccttctggtctcccaaatttctgatgagaaatcaactattaatcttattaagctgcttctctattgctgctttccagattctctctttgtccttgggtttcaacactttgactacaacgtgtctcagtgtgaatctcttagagtttattcagcttggagttcgtggaacttcttggatgtatatgttcatgtctttcatcagatttttggaaggttttaaccattatttcttcaaaaaattttctgccacttttggtctcatttcctccttagactcccatgatatatgtgttggtacacttgatggtgtcctacaggtccctcagactttgttcattttttttttaattattttttctttctgctcaggctggataatttcaattaccttatcttcacgttcactgattcttctgccagctcaaatctgtggttgacccttctagttagttttttcatttcagctccagaatttctactggattcttttttatcatttctattgctttattgatattctcattttgttcatatattattttcctgatttccattagtttcttatatatggtttaagtgagctcattgtgcatatttagagaagttgatttaacatctttgactagtaattccaatgtcttggcttccttagtgacggtttttgccaaatttctcttttctggtaaataggccatactttcttgtttctttgtatacttcgtagttttttgttgaggactagttattagggatattataatgtggtaactgcatggaggtcagatcctgtcacccctcagggattcctgttctttgcttattaaggatctcagctattcatttgtgccttttctgaactatttgtgtaaagtatgtataccttgttgtgtgtggtcactgaagtttctgtctattatctctgtggtcagccaatgacctaagaaggatttccttaaatgtctgattcaagaaacgaggagggggaaggtgtgtctgtcccttaaacttctgataattgggagaaacccactgtagcctaagagagctgaaaccaaggcagtgtctgcactgctcctacaggaatctgcctggttgaccaaagcatgcaacccccaatttttggaggacgaggtcttcactgtctgccctagcaccagccagctgctcctggaatgtgggctgctatcccaatagctacagcagggatgagaaaagggaaatggtagccagttcatgcacatcattcccttcctaaagatcatcagtctctcccatcatcaagcacttcctaggttattacaggtgttcaatcaagttgccaggttccaaaatagtgaattctgatctttttttctagtttactagttatttgggttgagggactgacccctagagctttcttctccatcatgttgcataacctcactccccttggagattacaattaagatattaacttataacagcctagttctcattgataccaatttaactttgacagtttataaaaactttgctattgtatagttctactgactatcccttcttagttctatattgtcatgcaaattacatctatacattgtatgcccatcaacactgatttataatcattactttgtattttaaataacaggggggaacagttacaaataaaaaacacttttataatgtttttcttatatagttacctttaccaatgctgtttaactctttatgtggacttgagttaccctagtgccctttcctttcagcccacaggactccttttagtattatttatagtgtaggtctgctaatgacaaattctgttttattttgtttcattctgagaatgtgatgatttctcctcatttttgaagaatactttcattgggtatagaattcctggttggcagtcttttttctctcagcactttgaatatgtcatcacactgccttttgtcttttgtttctgacgagaaagcagctgctaatctcatcaaggatctgtacacgatgaatagctctctggcttctttcaagatcttctttttttcacttttgatagtttgattatgatttgtctggttttggatctctttcactttattctacttgtattgagtttcttagatgtgtagtgtctttcatcaaatatgggtcatttttagccaatatttattcaaatgttctttctgcctcttcctttctgtcctttccttctggacttccggtatgtgtgtgttgtgcttgatggtgtcacaagtatctgaagctctgttcatttttcttcattcttttgtctttatcttccttagactggatcatctcaattaaccttgtcttcaaatttgttgactctttctttgccacctcaaatttacttttcatttttgttatactttttaactctagaatttctattcgcttttttttttttttttttttttccgtctgttgatattctctgtttggcaagtcattggactcatattttagatctttaggtatgattttctttagttctttgaacatatttaaaacagctgatttaaagtcttgttctagccgggcgcggtggctcacgcctgtaatcccagcactttgggaggccaaggcgggtggatcacgaggtcaggagatccagaccatcctggctaacacagtgaaaccccgtctgtactaaaaatacaaaaaattagccgggcgtggtggcgggcgcctgtagtcctggttactccggaggctgaggcaggagaatggcgtgaacccaggaggcagaggttgc

SEQ ID NO: 1366 - DNA, 40001 bp, Homo sapiens
acaggctgttggtttaggcaaaaattgagactggctggataaagtggtcttgggggaccatcaccagagaggaggcgctggaggtctgcaaggccttgtcctgcccctccaggggtagaggttccaggaggggctgactttttctcctggaagcctcacagaactgcagaccccacggatggcttggtgttgccaacatgaggcttctaaggcttctgcggggagatgggttggtggggagaagctgggggtggcagtggacaggacagggtgtggggacagctttgggagctatgctaggcaaggacaagggacaactcttggggggactcacccagaggggtcttgaatggtgctgaaggcccccgacagccctcctgcaatagccactgtagctctgcctgcacctgggccttcgctctgctgtcgtcccaccggcaggagtctggctaaaggggcatccctcagccctactccctcatcagtgttcccagtacccactccctggcacttccactcctagagggaggaggctgagcaggcagagaatgggacgtgtcccctcagaggagcctcgagcccagttccagccagcggcccactcagtgaggtgctcaagtacccacgtcccccgccagctgccagggttccctctcctccctccgtccctccccccatctggggagcccagcggtactgagggggcggaacgaggcggggccaccgagcggttatagctgggcctgcaggggacccacggctcgcctccagcctcctgcgctccggtacctgggcgtcccaactccactgcgcgcccaaacccagccgagccggttcgtggcccgccccgccgggcggccgtcgacgcgagcgccctggcgtggcgcccaggggagcggggggctcccgcgagccggccgcggctggcactgctgctgcttctgctcctgctgccgctgccctccggcgcgtggtacaagcacgtggcgagtccccgctaccacacggtgggccgcgccgctggcctgctcatggggctgcgtcgctcaccctatctgtggcgccgcgcgctgcgcgcggccgccgggcccctggccagggacaccctctcccccgaacccgcagcccgcgaggctcctctcctgctgccctcgtgggttcaggagctgtgggagacgcgacgcaggagctcccaggcagggatccccgtccgtgcgccccggagcccgcgcgccccagagcctgcgctggaaccggagtccctggacttcagcggagctggccaggtacgtgagaggggagaggcctggaccgccgcgggcaagggggtctcgggaggtctgagccggagcacggagccgcgcgttcagggggcaccctcgggcccttccattccctgctccgcgcccagaagagctttccctgggcaggctcgaccctggcacccgggggcggtggttggagggccacagcctcctccccacggccttgctgtgttctcgttagagacttcggagagacgtctcccgcccagcggtggaccccgcagcaaaccgccttggcctgccctgcctggcccccggaccgttctgacagcgtcccccgcccgcccgtggcgcctccgcgcctgacccaggaggagtggccgcgcgcttccaggagccgctcatagaccccgcctgccgtccggtcaataaaatccgcctgactcctgcgcccccgcatgcgaccccttcgtctgcttgtgtactttgccgtctagctcagggcgcagacaggcgcgcccacgccctggcaaatgtcaggggcccctccctcgccgaccaggggaagcgccgggcactcagcattcatttcaaacctggatctcccggcaccccctccctcccttagccaaaggcttccgcagattgattaagaacccctggtccccttcttctgggtcatgccccgggaggaggggcccctccacctgagccccaccttgcttcttgcttttttttttttttttttttgagatgcagtctctctttgttgtccaggctggagtgcaatggcgcgatctcgggttactgcaacctccacttcccaggttcaagcgattctcccgcctcagcctcctgagtagctgggattacaggcacccaccatgatgcccagctaatttttgtatttttgtagagacagggtttcaccatgttggacgtgctggtcttgaactcctgacctcaggtgatccgcccacctcagcctccctcccaaagtgctgggattacaggcatgagccactgcccctggctgctcctctgcctttttttttttttttgagacggagtctggctatgtcgcccaggctggagtgcagtggcgcaatctcggctcactgaaagctccgcctcccggtttcacgccattctcctgcctcagcctcccgagtagctgggactacaggcgcccgtcacctcgcccagctaattttttgtatttttagttgagacggggtttcaccatgttagccacgatggtctcgatcacctgacctcgtgatccgcccgcctcagcctcccaaagtgctgggattacaggtgtgagccaccgcacccggcctgcttctctgccttttatccccctctgcatgcacttctggtcactggctccagcccccccacataaatgtgccctgccatcttgaacaccgaggacctccatccaccaggccccctccagttcccttcccaagggtctgggcccctcctccctcccgctgcctcttcaaccctctctaatcttccctgggactccaatgactgtcctggaccccaaaccaccaaggtcacatgccctgatgcagcccacccttggagccctcctgtggccatgtggcagggtccccccttggggccacccagcaagcattgggggagaggtggtcctgggcctggctccaggatgcctctgtggaaccagctccccacccccacttctagaagcccccctcccctcactggtaggtcctttccatctccaaggtgtgtctgtctcccaaatgtgggtgctttttatctccaccccttcaattctttttcttttcttttttttttttttttttttgagacggagtctccagcccatgctgaagaggcactatctcggctcactgcaacctccgcctctctgcctccccggctcagatgattctcccacctcagcctccccagtagctgggattacaggtgcccactaccacgcccagctaatttttgttttttttttttttgagacagagtcttgcactgttgcccaggctggagtgcagtggcatgatctccgctcactgcaagctccgcctcccgggttcacaccattctcctgcctcagcctcccgagtagctgggactacaggcgcccaccaccacgcccagctaatttttgtatttttagtagagacggggtttcaccatgttggccaagatggtctcgatctcctgacctcgtgatccgcccgccttggcctcccaaagtactgggattacaggcgtgagccaccgcgcccggccaacagccaattcttatggagcccttggttccatctagccctccctccggctctgtgctgggtgaagaggtggtcacacacctcacagggcaactcattctcctgcgagctcattccttcccactcctgcccctgttcctcactgaacctgacctctaagaacatggatgtcctgacctcgtcaccaccacaccacgcctcaagggctccccactgcctatgggacgatacccgtgctctggcagggctggctctgtctgctctcaccgcccctcccactgcctcctcccccttccccaccgcctgctccagactgcagattccaggacagcccgggacctcccccgccgaaggaggactccagggccccaggctgggttaaatgttcttcctggggctgcttcagctctggcctccccttgcgcaggccaaggtgctcaaagctctgttctcgcggggctggcgggggggcgttcagtgatgttccctggtgcttgcctggtccaagatggggagacagagcccatgagaggcttctctgcctcccccactccacacccttattcccctgcagcgcaaccaggcctagggcgccagcctcaccccagtccccaccccacaggactggatcgagtggaaggaagccagatgggcaggatcctggggcaactcctcgcacgatgcaatgccaccagttccggccaggtggcgctgcgcggctactgttccgggcggtagcgtccgactcgcgcctccagcaacgggcggggctagagccgcagtgggcggggccacgacgggtgggcggggtcgccccgtcggcggcagcggtttcctgcctctccccactcttgggtcgtcgcagtcccccggccttctctctctgtctggtctgtgggtctctgttggtcacctccttctgtcgcgctggctccgcctgctccagtttcagaatgtaaagagaggcatggtgcagcctgagggaagaggccctaggcgcggtctggttatgcttgaagggccattaatgtccattaggaagccccgcctgcctgagcagctctggaccattaccgggagtcggaatagtggccccacccccagacagggccccaggccacggccacaccccggagccccggtccaggtccaggctcgggctccctgagatcgctgggaccttgctggagggatgcgggttcaaggcccgaaggaaaggtcctgccaaaacaggagtgcacgggcggcccccaccccggtggaccccccaccgacagcccaggggaacggctgagacctgctctccctctgctggataggacccacgcctgggtagcatgctggcaggcgtgggttaagggggttgggtggagagttgggggatctcccaagcctctgattgcctctgccttgactttcttccctcctgctggggcccggggagcccacgtcacccacaccccatctgcaccccacagaaccaggaaaataaagtccaccctcctctcgatgctgaccctactccctcccgcccacctccctagccctttcttcgagacaccaagcactttgcggcccctgaacacctttgcccaggtgcttcccttcgcctttctctgcctccagcgcagcacccatacgggccaaggtcagcctcggaccagggctgagagcttccggaggctggctggagaagaggcctgggagggtttgcccccgagagcttctaggtcacccttcctcgcctgttcctccaggcccctggactcactgtcccctctcactgactctgcacctcctctgaaatcgtgacctctggttcctctctggctgcctcattcctcctgctccctgctttgctaggcccacttcctttgttgcccggccctttgctactctgttaccctcctcagctccttcatggctttggggactcttttgttaactctgtagcagcagtgtgtccggtgatatttccttggttcctggccctggttgtgacctcatgtcccttgtggcccctccctctgccatgctgttctccatcccatctttttttttttatttgtttttaaattatttatttattgtttttgagatggtgtctagctctgttgcccaggctggagtgcagtgacgcaatctcagctcactgcaacctccgcctcctgggttcaagcgattctcctgcctcaacctccccagtagctgggattacagatgcccaccaccacgcctggctaattttttttgtattttcagtagagacggggtttcgccacattggccaggctggtctcgaactcctgacctcaggtgatccacccacctcggcctcccagagtgttgggattacaggcgtgagccactgctccggcccctcagcccatcttcagtcactgggagtaggaatcagctgagtcctgggccagggaaggatggtgtatgcccaaggctgatcaggcgtctgccccacccagggcgggtaaggtctgcaagcccccttacccaggggacctggggctgctggagtctcccatccagccacctccctcgactctagtgtggccaggaagctacagcctgccaggttttgggtggacctggttggtgtgggatgaccccctaagcccaaacaggtgtggtatgtggggtgcgtggtggtgggtcacactgcccacagccatcttcacagactccaagggtggcagcaccaggctgtgtccagggaggccagccacaggccagacaggcagcctctggacatgcagacagagagatggaagcggccggccgggcgggagcctgaagcagccttacccaggaattgcaggggttggggtggcgagcagtcgcggcgcctcagcctaagtggcttttaggggcagctgccgggatatgggcacccagggggccatggcccaggaggctgcccagaggcgagccctgtgcttgggtgggggcaggggagcccagcccagggccccggagagacgagagggagaggaggactgcgccaagcctgcttctacggctcacatggggaattgcctgggctggctgtgcctgacccctgggaaccaggtatgtgcaagggggcctggctgggctggggaggagggcagactggggctgtgcctggactcagctaccttcctatattggagacagaggaagagctgggtggtgaagatagcatggactccgaatctcacatccctgggcccaaatggagctgaggaggcttcgtgggtcttttccctctccaggcctgtttgcaggtctgtgaagtggccggtcccctagggttgttccaggtaaaatgcacttaggcctaaatgatttcactgtggtggtgactgtcctgttggggaaggagggacactcgtgcttcaggtagaggctgagggacgtggacggctgtgggcaggggaggggaggcctgctgcctgcctgtggacactgtggagcagcgcctgtgcacacccagagcttagagcccaaataattcagtggagtgtagcccatgtcaggaggtgggtagcagggaccctcgagactcatatccttttgtcaccctgcaaagtcacagtccaggcctggggtgggctgggacacaagtgagggggccggcccggccaagggaaagaatggcagcagggcgtgggaaccgacgcggtgcagataggccgaacacggtgggtaggccagggagtctcccagccactggcccccaggatgcagggaggggctgctgcgtgtcacttttaaagccctttttgcctcctgggccctcctgagactctgccctgggccagggagtctcccagccactggctgggagggatccaggtgagacacagccgagaggagacaggcaagggggtccggaagggcttcccggggagggtggggagggctgtggcccttgttcttaccctttggcccctttgtcggggtcccttggcctggagaccctttgtccaacccgtcgcccacctcaagacctgcctcgatgctgcgcatacagtaggtatccaataaatgttcctgggatagaaggcaaaggcgctggcaccaaggcggctgcccagagtaggggcgagacagagaggtcccggtggttaaggggtcccctagccctgccgcctccccctgccccgcctcgggctggccgggcgcggaggtaggggcctggccgggacggctgggactggaggcgggggcggccgggcggcgggggcggggaaggggcgggcgcggaggcggtgccgcagcccgagccggagcccgagccggatcccgaggcgacgggagccgaacaggagccgccgctgaagccaccgccgggtgcccagcgccgccgccgcccccgagctcccccgcgcccctgcccgcgggcggccggtgggcagcgggcgccatggccgcgccggagccgctgcggccgcgcctgtgccgcttggtgcgcggagagcagggctacggcttccacctgcacggcgagaagggccgccgcgggcagttcatccggcgcgtggaacccggttcccccgccgaggccgccgcgctgcgcgctggggaccgcctggtcgaggtcaacggcgtcaacgtggagggcgagacgcaccaccaggtgggggccagcgctcgcccccggcccgccgccccctccccgagcgcgtccccctggggcgagcaggggtcgcacgggggcccgagggggctcccgcggggaggacgcggacgttgtcgggaggcagcggcccggcgccttcggagtcccggcgcaggaagctcagtcctgcacgggggtgggggggggcatcctggcagggaggggcccgcactgcggctcctggccgctggcctcgccctttggtcgcgttttggcctcagtgtgccgtgaaggagggtgttgggccgcctggagcccctccggaaaggtgaagacctgggtgcttttgcctgggtgtgtgtgtacacgtgtgcgtgtgaacacagctgggcgtgtgtatgcaggtccctttggggtcagccatgtgtgcatgcgcctgcctgtgcgtacccaggaggggtcgcagtaaaggcatcagtgtgtctgcacctgtgtgtgctgtagtgtgtgtgtgagtatacaggtctgcacgtgtgcctgtgtgtgtgcaggtctggactcctgggcgtatgggagctgggctctgtgtgtgtgcacgcctggctagtgtactcatcactgtctgcaggccggtgagtctttgtgtctgtactctagtgtgtcccagctggtgtgtctgggaccgggctgagttggtcattgctggcaaccacattccttagctacaaaggcactactcctcctcagaggctgcctagcctggctggggttactggccgaagcctcctgcctcctggctaaggagaacagagccttttctctgtgggttctgacccctgaggtgtgtctgtctcccacaggccagggactccctccagaccctggttggggtccagcgtccacacaccccttttcctccaggtcccctgtccctcacagcaccgatgaatccataacctgtctacatggctggtcctggaacctagagattagcaggttggttcagctggacctggagctggtctcctgtttacctggtgccttgtctgtcactctgtcggccggccccatgccttccacccagagtgtctgctgtgtaaggttgtttgctgaagaatgtggggatcaggccaggggcctggacctgagggattgagggtagggctgccagggctggggccaggctgctgttggatagtcactgccaccctcgccctgggaacacctgcttttccaaggccctgtggggctggtctctgaggactggacacacagaccatggtggactctccccactgccccaggagggcaagaggggcagttactgccccatttgacagttgaggaaactgatgccagagattgagggtaacttgtctgggacacatagtcaagaagcagctgggcactgggttcctcttgtctcactctgggtcatggggagagaggagggctgggggaagatgggcctggctcagtccctcctatctgttcaccacccctgctgagcccggcagctggtggggagccttgtccaccctcccccaggccgcaggtgggagtagggctgcccctcttcctgcccacttcccagtgggcactgctttctctccgcgggtgtgcgctggccccccgcgtggtccagacacttcacaggcacctgcacgcacacaccgacggccaccaagccacagctgtccacaggtgcacctgcctctccccctcgccggctgcacctgaatcctgcttccctggctgtgtgtgggtgcccgagccaggagcccagcccttcccctctctgcagatccagagggaatgggcccatggccatggcctggaggtagatataaggcctagggtcaggagtttagactcccacactgcacggcagagaatgacgggaatgggcacagacacactcaaactggggcccagggagacacacctctccttcaaacctggacggagacacagactttgaaacagatggatgcatgcgcgcacagggacaggcagactgaaaacctgaaggtccactgtgcaccatttttgtcacttccagacaggacttacccagcggccctatcctgcagccccttcccagccccgcctggagaagaccctgggctaagggcaaggctctgggagcaccctgaagccctcacagcctgggcctcagtgtccggagcctgagtgcagagggagggagccgctggagtccgggggtggggggcggggccggcaggcctcttggtgcagccacccgcccatgcagaccagccgcctgtccgcacgcctgggccagcccagagtggtgccactgcccatgtgctgcccggaatgtgggccactgacccgctcctatcgcccattcgccccaggtggtgcaaaggatcaaggctgtggaggggcagactcggctgctggtggtggaccaggagacagatgaggagctccgccggcggcagctgacctgtaccgaggagatggcccagcgagggctcccacccgcccacgacccctgggagccgaagccagactgggcacacaccggcagccacagctccgaagctggcaagaaggtatggcgggcttggcccacagggaccaccctagcctctcccagaggctctctcagcttttgacgacgatctttgcctttggtcacctccagaagtcttggtctcttctgccttttggggctccttttctgccccagggaccatcttgttggccactgggggccactgtttctaccctcagcctgtgttttaaactgggtagggtcagggcagcctggcctgttcctcttctccaggatgctccagagccacttgccctatcgaggggtcactctgacaagctgccgcctccccagcccccagcctcgtggctgaggaaccctgggaagaggcattccaggtctgcgtgtgcgcagctctgtgcctgtgctgggtgtcatccgtggctctgtctttgtctctgttgaaggcgcctgcatgctgggaaggcctgggagagggccggccttctccacaggcagcgccgtggttggggaagcctaggaggccactctgccaggcctggcgtaggtggggctgggagcatgggagtggagttgggggtccaggaggctccagggtgagcccactcctccccctagatacaagggagggccctgggaccctgtctgctgttcctcctggactcctgctgggtagtacttcctccttcccctgcccttgctcccagccaggagacccagaaaagtacaggggcggcctgctccacctcctgctaggtggccgactgggaggggcggcctggcaggccttggggaccaggaggaacagcctgaagctgtctgtcttatcttcctggaggccctgatggcattatctccatgttctctcctacctttttttttttttttttttcattttcaaagagaaccctggccgggtgcggtggctcacgcctgtaatcccaacacttcgggaggctgagatgggtggatcacctgaggtcaggaattttgagaccagcttgactaatgtggtgaaacccccgtctctactaaaaatacaaaaatcagttgggcatggtggggcacgcctatagtcccagctacttgggaggctgaggcaggagagtcgcttgaacccggcaggcggaggtttcagtgagccgagatcccgccatagcactccagcctaggcgacagagtgagactgtctcaaaaaaaaacaaaaaaaggaaaagaaagaaatcccttcaggggatatgagtccaggggttggccagaccccactgtgagaaccgcgcttggggcaggggtgtgggatctggagttctgagggtgcaggggatatacacattcactttctccctttcccagacgtcactgctgaagctggctgcccctaggagctgagcccggggggagcggcttggcagggagacagcattccctgtggggagcccagcctgggcgcaggcctgcccgtgggacctgtgggacccgttttgttcctggggcttgagggcgggccacagtggtgctcagggccaaggtgcccagcccagggctggtgggggggctggccttgcaggggggctggctggtcctaagcccctgtctccaggctgagggttggggcctccctctttcccagccaccttccctcccccaggaggaagctccccctctgcctcaggcgtttgtccattgatttggacacaaacgcatggttcaccttcctgtggaaaaatccggccctcggactttatctggagggtgcagtggcccaggcaccttgccttgggtgggaccttccccctctgctatttcaggctctgggggctgcaggaagccctaggaggggcttcctctgggtgtatttttagaggaacaaagggtggcctgagtggcaggtccctttgtgcatgagtctggctggggacaggggctccaggaggtcagggggcacccaaggaacagggtctccccttctctcttctggcatcaagacctgaggtttctttttctttttctttcttggctcactacaacctccgctgtctgggttcaagcgattctcttgcctcaccctccccagtagctgggattacaggcgcgcaccaccacacctgactaatttttgtgtttttagtagagacggggtttcaccatgttgctcaagctggtctcgaactcctgatctcaggtgatctgccctcctcgacctcccaaagttctgggattacaggtgtgagccactgtacccggcccctgaggtctgaggtttcatttctttctttctttttttttttttttgagacggagtttcactctgtcgcccaggctggagtgctgtggtgcgatctcggctcactgcaagctccgcctcctgggttcaagcaattcttatgtctcagcctgctgagtagctgggattacaggcgtgtaccaccacacctggctaatttttgtgtttttggtagagacagggtttcaccgtgttggccaggctggtctcaaactcttgggctcaagtgatccgcctgcctcagcctcccaaagtgctgggattacaggtgtgagcccctgcgcctggctcaggacctgaggtttcttcacctgagctcccagcatgggcaggaagaggtgggcctcacctgacctccacagagcaggctcagatcctgcccttctcagcctgggttcagggcatgcctcagatggtcagggagcccaggagggcaaagcttaccttgcggggatggctccagtgggggcactggtggcagagaggcagagctctggaagggatgtgtgtagtttgtctttggtgaaggatggagagggcccaactttgggtgccccctgggagctaagggtggctctcagtgtcctctgtcctggctggggataggggaggtgggcaggggaggacactgatgtggttggcccctccttttgggggccgtgaaggcctagttagtgatgactcagccctgggccacaccaggctgggggtggccgcagctgcagtgcagctgatcctagtagtgacgacaggggacagcccccaaacagagacggggtggccagcggtgccaggccctggaggtggtggcagaccctgagccctctgccccctgcccctagcccatgtctccacccccatctggagggccttgggggctaagagcaggtgtgaggggtgacagttctgcgggaggcggctgtgtggttggggcgcggtgcctgcgggggcttccgggcttccctggctcttgctcctctggagcctcaacaggaccgtcctgtgttctggggccgggactcctccctgtcccctcagccctgggtcctggggcagggcagggccttccagcagcttccttccttcctttcttgggacggaagcctagctgggtggggggcgccaggctggagccttcgcaggggagcgggctcagtcatcaccctgctccccagagtgactcagcccccacgtccccacccatccccggggagccagggccgcagagggaggtagataagtggggtggcagcctgggtcggccagagagttcaggccaccccggccggacgcctgccacttgctgtcactgtgccgctgtcatggcacgctccgggagtgccacgccacctgcccgggctccgggagcccctccacggagcccaccccagaggctggtacaggtcaggtggggtgggaggaagggagggctaggaggaaccggcagccgctcagcctcccggggtggaaggaggggactccgggaccttgatgtaagcaggctggtcgctgagcaacaatgaaggcctttctctgccagggctggtgcgtcaccatctgggggggtgcccagggtacccccatgccagcctctttgtccggacacaggcatggctgggggaccagggatggtccagctctgtgctggccgccggcagggagggagcctggagcccgtgggagcccgagggcctggcgggaggcggcaggaagtgtgtgctgagccagggcagggaggaggaatgtgagctatgaacgccgcccgagctcctcggctctctgggccccccttccccacgagcccatgtgctgccagcagcccaccctggcccctccattgcagcccctccacctgaggttttagtgctgtgcctggcgccactgggaccctgctgacaatgaaggggtttaggtttgataggcagaacttcttgccttgtagagtgaaagacggctgcttctggacagaggcagaggggtggccagaatgaccctgagaacactgaggggtccttggcctggcctcagggccccagacacccaccagatcctgcttcctgtctggtgccctgagaaaccctgccccgcaggccgctgtgcaggcgtgggaagggctgccgggccagcactgtggggctggccgcatgtgtgggctgctgtgcgtgtttgcaggtgtgtgtggacgtcttgtgtctgtggctgtgtgatgtgtctttgcggactgggcccatatcacgctcccacctcctccactgaattgggctcctgtccccacgccttccctgcgtcccaggccagcctgggggccgtgctccacctcccctcccgaactggactcctgtccccacgccttccctccgtcccaggccagcctgggggccgtgctccacctcccctcccgaactggactcctgtccccacgccttccctccgtcccaggccagcctgggggccgtgctccacctcccctcccgaactggactcctgtccccacgccttccctccgtcccaggccagcctgggggccgtgctccacctcccctcccgaactgggctcctgtccccacgccttccctccgtcccaggccagcctgggggccgtgctccacctcccctcccgaactggactcctgtccccacgccttccctccgtcccaggccagcctgggggccgtgctccacctcccctcccgaactgggctcctgtccccacgccttccctccgtcccaggccagcctgggggctgtgctccacttcccctcccgaactggactcctgtccccacgccttccctgcgtcccaggccagcctgggggccgtgctgtgactgcatccctgaggggcactttggtgggcaggtgtcagggtcagccttgaagccccacgcctgtgccaccaggtgtgtctgggggaggagtgagtctatgtggtggggccctggagattttgggggtcttgcaccctctaattcagcccatgtggcccagctgagcccctgtggggccagggagccacaggcttgtccctggagtttctggtgtgacgggctgggtggtggccatgcagagagggttcagagggtgggcaggaggcttcagatgaggcatctggcaggctggacaggagaagggtgttccagaccaagggcaggtcctgagcccaggggacagagcactagctgtgtggagaaggacccccttgctcccttggcggggcggtcccccccgctgacatggccgtttctggtccattggggtttggagcgagcttgaaggtgggtggctggaggggttgggggtgtctgaggcctggagacctgccctcctgaggtctgagcgcccccttgccatgccgccccagccctggcctggcctggcctgtggtccctcagggacacacagggaggtaggaggtgagggaagggccctggcagcccccagcccgcctgcacagtctcccctgcgcacgccctcaagcttggcgctccctggaaacctgagctgcctcctgcctgctccggccaccgccatgtttaactgagcacgggcagccgctggccaccgccgccgcaccctggcccaccccctggctgggaggtggtcattgggcctggccttgcctgcatggtcccctggcccagagccctaccgcaggatgccagaggtaacatggggcagggcctgggatggtagcggggggtccttccgggcaccaggaggccctctgtgccctgtccacactaagctcctgccccagcccctgcttgctgggcccacgggggtggggcggctcattttcctggaatgtgaaagcaaacagagccgccaccgcagccagccccacggaggcctctggagagaaaacaaaactgctggcctaggagcgcctgccccacgctctggaggagagcccggggcagggggacgcacaggcagagccctcagggacaaccgccccaggaggccaacggcgacagttcatcccacctggtgcttcctcccaccctgcctgtgcgccacgctggcctcgagccaaaggaattctcccagcaacccgggaaggcggctgggcccgtcggggaggcttctgggtttgaaaacaggctttgcccaagttcccacagctaaagctctgtcacaggcagcctgggtgcccggagtgtttgccactgagacctgggcctgcccgtggggggcacggtaccgagtttgggcagtggcggcaccaccggggagtggcctctggaggcgggaggctggagcaagagactgaccctgtccgttgggcctgcaggatgtcagtgggcccctgagggagctgcgccctcggctctgccacctgcgaaagggacctcagggctatgggttcaacctgcatagtgacaagtcccggcccggccagtacatccgctctgtggacccgggctcacctgccgcccgctctggcctccgcgcccaggaccggctcattgaggtaccggcccaccagggctgcggggtgccgagtgccccgcacctgtccacactggggccctgggtccttgcagggaggagggagacgctgggaacctgagctggtgcgcctcctgctgcctcggtgggcggtggctgtgatgaatatttgatgccacacctggccacgcggcgttgggggctgtctgggcccatggcggggctgatacatgctggtggcggcaggtgaacgggcagaatgtggagggactgcgccatgctgaggtggtggccagcatcaaggcacgggaggacgaggcccggctgctggtcgtggaccccgagacagatgaacacttcaagcggcttcgggtcacacccaccgaggagcacgtggaaggtgggccacggcccagggcacagggtgggtgcggtgtggtggctgagcagccactgacacgctgtccccacaggtcctctgccgtcacccgtcaccaatggaaccagccctgcccaggtaagagggtggggtgcccatgagacacagggtgcctctgggggtacccaggcccgacagaggcccccttctccctggagatccgtcctcgaggtgtgctagtgacacccgattttagccctgtcacctccctttaatgcccctgtgggtctcatcctgggtcgtgccacacacaagccacgtggggcccctggggtcggggccactgccttctgtcctctcctgggcaccacctggtaaggagttgccctccagtctctgcctcctcagggagctggcggtggcctcaccccaggcgttgctcacgccggccattcctgcacctgaaccccctctgcaccatgagccggccaggccacctgcctgtcactgccaggcgcccggtgcctgccccgccgcatctggagtccaccagaggcccgaggccccctgccgagtggaggagcacacactgggggggggtgtgcctctgtgcacatgtgtgcgtgtgcaggtgttgtgtgtgtctgtgaaaccacaatctgcccttggtttcccagctcaatggtggctctgcgtgctcgtcccgaagtgacctgcctggttccgacaaggacactgaggtatggatgttctccactcctgagctcacacgtggggttgctagaggccttggggtaggcgtctgtggagatgtcagcccgggcagtggggtctctgttcaggaagtcctcgtgagccccagccccagcaggcagcctctgttggttgctccctaggaggggccaccgtctggggtgtgggactagggctcactccagacaccccacccaccgtgctcaccccaggatggcagtgcctggaagcaagatcccttccaggagagcggcctccacctgagccccacggcggccgaggccaaggagaaggctcgagccatgcgagtcaacaagcgcgcgccacagatggactggaacaggaagcgtgaaatcttcagcaacttctgagccccttcctgcctgtctcgggaccctgggacccctcccgcacggaccttgggcctcagcctgccccgagctcccccagcctcagtggactggagggtggtcctgccattgcccagaaatcagccccagccccggtgagcccccatcctgcccctgcccaccaggtactgggggcctgtggcagcaagatagggggagagagacccagagatgtgagagagagtcagagacagagacagagagagagagagagagacacagagagagacagagagagagcgagcgagcgcgcggcagccgcggggcgagggcctttgctgctctgccggggcctgctgactgaaaggaatttgtgtttttgctttttttccaaaaagatctccagctccacacatgtttccacttaataccagagacccccccccttcccctcccccttcccctcccccttgggacgcgctctaaataattgcaataaaacaaacctttctctgcaaaccatttcctccccgccccctcccctcagcagcggccgtcctgagtgggagtccctgggacttcccagtggccaagttggggcgcccagcctcttcgtggggaccttgggtaaggccagggaggcctgatgtggccgtaggagctgcccctgcccacctgccctggtgtgggggtccctaggccacaccctgctccccacccagctaccctgtgcgcctgtgccctgctgggggcctgggctctccgaggggcctgaggatggaggccccacgtccccgaggagggcggcctctggacaggcccctcattccgcgcggcagctcccaggcctggggaacgtaggtgtgtgagagcggcacccgggaaggacgcctggcctctggctcagccctgcttggcgggctcccccgtggacaccctgttgactttgcacttccctcccgggccccgcacccccgaaccgaccaccgatcgaccggcaccgctgttgcctcgtaagccatagcgcatgcgcgctctcaggataaacaggccctgcctgggacccacacgcctctgtcttttctgagcctcctccccgtggggtgagaggggtggagggatgaggctgtttcagggagccccctccccgagtctcagcagctggaaacggtctcgttcctgagcccgtgccctgcatccatctgctcccagccctgctccatctcccccgctgacccccatgggaccccctgctgtgtggcacatcctgggcccatgcccatctctcttatttggcagactcagcctcccaccttcaccttccctgtgaagccatccggccccacacaacacccacacgggccaccctttgcccaattcaccctgcgacctctagcagtcacaggtcaagctttgtaccctgtggcgccctgcctgggtccccagtgtccctttcaaggccgggtagctctgtaaacaggggtgggaccctggcagaggctgggctttgagggcatgaaagttcaggagctggcggtgtccgggctgggaagctggggggccggcggtggatagcatgaggggccagggtccccagccagctgcccgggggctgcttgcttccccagcggacttccaacagctggctgcagctggctctccccacttcctccctcccaggttcatgcacaccccctccccctccctgagtacatagcaaagattgtcacgtccccagccggcctcccaggcagccctgctccagacacgcgagcacgggtgtgtacgaacacatccttgtatgcgattcccaggctctctgccccctcagggacagacatcagccagatcccatctgcaaacacaccaaagctttattcaacaggcgtggcttcctgaagcgtaaagccacttcacagacggtggccacagcggcacctcggccagagccatgcggccatcagagaccctgggcggccgggcagagggcttggttgaggcaggcgtggcagcgagggtgcacaggcagacaggtctgctggccgaagcccaccaagagtccattgatctcgtgccacagctccctgtgggggtgggggctgggtcagtgctgacagagggcgggcggggtgagctcttctccctaggaagccccccacatactcatacctaggcagccactcctccagggcggcgcgggtctcctctggggacttggttgccttcttggtccacctcagcctgttggcgattctgtgcacatgcgtgtccactgctgctgggaggccaagcggggtgaacaggggcacactccaccagcctagcccgtgcccctccccgcccagaggcgagtctgccaccacccccgtggccctccagttagacattggaaccgcaaagccctggctgcaagcctacatgtgaccatcttggctgcccctgaggtgctggggcaggggctgagccctctgttggggtgcaggcctctctcccatcacctgagccagcctggggggctctgttctgggctgcccactcccaacactggtgctagttggatgtgtgggtggtggggtctctgctttgggcagggcctgggggtgatgactcggctctgcttggagctctattccccacaataacagcgacagctcgcttggacaaacgcttgctgggggccagaccctgccagagagattggccagctcagtgagtcctcatgaggtcctacggatgctgaaaccgaggcccggcaggatcccgactccgaagcacctctcagccctcagcctccccaggaacgtggccctgtccccggaagggtccatccaggcttccctctgtctgtctcctgtggcctgaggctcctctcggcataagcactggctctgggcaccaggctgggtggcaacagctctgcctggcaggccggcatgaggtcactgcctgcagacctagcacctgccactgcagcggtcagggacacagcgggagcatgccctggccggccgcagctgctgtccacctgggttctggctcctgctcccctcagctggccaccccaggcgtctgctcactggggctcccttctcccacccggtggccccggccagctgcagccccagccctgcctcctcctcccgtgtttcccaaagagaaagccgaggcctgcaccagctccttcgctgctgcctagaaaaaggtgtccgagggtgtggggagaccacaaggcctgaggggtcacacccctggggctctgagcctcagtttcctcctctgtaacacggaagtggccatgcttcaaggctgagtcaggccacgtcacgttgtgtgagcctcctgcccacctggacagtgaatgacgaggactgcctcacccactttgtggccagagcttagagaagccaagggcctggcccagagtcacccagccaggaggtgcagagctgggaccggagccagcaatctatggctgtggcatttttttttttttttaaacggagtcttgctctgtcacccaggctggatacagacaatggtgcgatctccactcactgcaactttcgcctctgggtttcaagcgattctcctgcctcagcctcccgaggagctggaattacaggctcctgccaccacgcccggctaatttttttttttttggtgagacggagtcacgctttgtcgcccaggctggagtacactggcgcgatctcagctcactgcaagccccacctcccaggttcacactattctcctgcctcagcctcccgagtagctgggacaacaggcgcctgacacaatgcctggctaattttttgtgttttttagtagagacggggtttcaccatcttagcctggatggtcttgatctcctgacctcgtgatctgcctgcctcggcctcccaaagtgctgggattacaggcgtgagccaccacgcctggccacacccggctaatttttgtatttttagtagagagcgggtttcaccacgttggccaggctgatcttgaactcctgacctcaggtgatccacatacctcggccttccaaagtgctgggattacaggcttgagcccttgtacccagccagctctgacattttaactgagagcgtttctctttcggggaacccctaggaggcagccctggggtctccttgcaggtggtcaggcccacagacacctggagagggaggtatttccacatggctgtctcttgtgcccgctgctcccaaagcccgttccctgcctggctgcgggcagggaccttcccccacagccctgcccaaccacgatgcagcaccccagggacacgggcagctgaggacagccgcccagataagctcaagtgtccactgagaggctggcaggtggtgacgctgggagtctcagtcgggaggaggccctgccccggcgcacctggcctggctctggctctttggggctgctgtggctgttcagcctcaccaggtggccccggctcagaatagaggcccccggcccttggtggccctcttgcccaccagaaagtgctgcaagccccccgcctccggcacaggccccctgcaggagtcccaaaggggcctgggatgggggcacacagagggcagggccaagccctggtttctggactggctgggcccggctgcgtgtggccttaggagccccaaatcctctggacaaagccgaggaggaggcagccccaccccaaacccaggggtctgtctgcacccaactgccaagaagcctccggtgctaggaagagacaccaggacctgggaaaaggattcaaggagggccctccccccagtgcctccctccccaccctcccctcttctccctctcaaccctcccctcttctccccgcagcacctccctctccaccctccccccatcctcccagcgcctccctccccaccctcctcccccattcccccagcgcctccctccctaccattcccctcctgtccccgcagagcctccctccccaccctccccctttctccccccagcacctccctccccaccccacctgctgaggggatactcttcctcctccctcctcagtccttacctccccactctgccctcatctcattccagaacttcctgctcctggccctctctctcgcatcatggttttacagatgctgttccttctgctgggaacacacttcctcctcttggcctggctcaccccaccttgctctgcagctctcaggtgaaggatgaccttgggggccttcccagaggccctgggcccaagccaggccccaagagcaccctgcacaaccatcagggtttccactccacgagtggggaattcctcgctccacatttctcccgaatacaacgcagatggagtccagctccggggcctctctcagagccctgcacggagcaggtgctcagcccatgtgacctcctgccccagcacctgtctctgagtggggctggcctggctccaccctgggagcacctttctgactctatgggctgggtggaggaccagcatgctggaagtggagtcacaggtcacaaggatgtggggaatcccaagagcagccagtgggctggagccagccccgccctcctctactcaccaatgcctgacacagtgccccaggccacagccatagccaggtgtgccatcttgggcccaacacccggcagcgccaccagctcggccacagaggctgggatgtccccaccgtagtgctgctgcaggatggcgctggtctgcttgatgtatttcaccttgctctgaaagacaggggtgggttcagccttggaggcaagggcacagcccaacctgggaggatgcagcccccaggagacccacaggtggccagagctacctgcacctgctgaggacgtgtgcaagctcagcccccgccccccaggaggcgggaacaagcggagggcagcagggaggcccaaggtaggcctgaccccctcctcccacccgtgtgggccaatgatgcacgtgtaggctctggctggggttcccctgcccgtcattccctgccagcacccaggccaggccaagcaggccagccgctcccaggagtggggcttggctgcacctgcgccttcaggaaggagggctggagctggggcttccccaccagctgccaggcctgccgggtggttcccatcctgtgcctgagtggagagggctatttaaaacccatctgagaaactgcggcccacgcgggtgccaaggggaagcggccccacccaccaagctgctttcaacagatccgcccaccaccatccagtgctcggcggggttggggagcagcctccccagggctcctggagggtgaggggctctggacaggagggggtgacacaccgggagaggctagcagtaaacaaagggaaaggcgggtgggcaggcagccttggcggtgaggaagggtgggcaggcggcgaggcggggaagcagaggaaggaagggaggatgcgaacaggaaggccaaggagctgctgggactgggcgtcaggcctcagggccccacggcctggggggggcttcagggggaccccccgagcctgagatgcttgaccctcacttcctgcaccgtcgccacccccctcagccttctgaggtctctctcaggccactgccacccggcccccgttgccacaggcagggctcaccctccagaaaccgacggggtagatgagcttgcccagcgtggcatcatctgtctgcaggatgctgtccaccgtcaggccccgcgcccgcagtcgctgcatggcgcccgccgtcacctggtctttggtttggctggagagcatcagtgacagcagcacctggtacctgcgtacctgcttgtgcagtgacagggaccggggtggcggcgggtcctgggtgattccctggccaggctccgccccccgccctcgacacaccctggtttgttgccctgggccacacttgaggcatcagcctccccctgtggggtggggaggtctggtttgggtatgtttggtcatctacaacaccaggacaataatagtacctgactcactggagtaatgtgaagcttaaatgaattatctcagtgcttagaatcgtatgtggccgggcgtggtggctcgcacccgtcatcccagcacttcgggaggccaaggcaggcggatcacctgaagtcaggagtttgagaccagcctgatcaacgtggtgaaaccccgtctctactaaaaatacaaacattagctgggtgcggtggtgcatgcctgtaatcccagctactcgggaggccgaggcaggagaataatttgaacctcggaggcgaaggttgcagtgagctaagatttcaccactgcactccagcctgggcaacaagagcaagacttggtctcaaaaaaaaacccaacacgatcgtatctggcccatcactactgaacagccattggccactactattatgattgcttcgtgaatcatcacactaccctttaaaacaaatttttttttttgagatgcagtatcactctttcacccaggctgaagtgtggtggtgccatcttggctcactgcaacctccgcctccggggttcaagcgattttcctgcctcgccctcctaagtagctggggttacaggtgcctgccaccacacctggctaatttttgtatttttagtagagacgtggtttcgccacattggccaggctggtctcgaactcctgacctcaggtgatccacccgccttggcctcccgaagtgctgggattacaggcctgaaccaccatgcctggcccatactacccattttacagacaagcaaactgaggctcagagaggcctgtatccaagccacctggtagcagaatagggattagaactcagcttggtctaagggtttcaggccctgggaccgtgaagcaaaaggaactcttccttcctgatatcacacaaagcccaggtcacgcctgcactgggcagaagttcgagcacgaggccctaaaccactggtgtcctgacctgctgagtggctacagtgatgcaggcgatgctctggggcaccgggtgtccatcctcccaaggtgctgtctgcaggggagggtgccagccaaaagccaccgggtagaaagaaaacaaggaccttgctaagatggggggtcatctgggcagatggggcccctgcctacctttgggggggcactggagtcatagcagtgctcagtccccagatggtccacaggtgcatcctttttgttcctcatggcacggatgttgaccagctgttgctgccagtcctggggctcccagactggcaccttgaggggctcagccccctcacctttctcactgtccgagccctcataggccacacgcagtctctgtgctttccgcggacgcttcacggggctgtggcttttcctcgcttctgcaaaaagcaccacgcagtccctctggtggggccacaggtgaaggtagggtaggggtgccatcccgcctgctagctcacccctcactcgttcatgccacaactgtccatcatctaatacacttggggtgctctgccctctgcagtctggggtatgtgggccctccttatgccagcgaccctgacaaggtccatgttagctcatgaggactctagcaacagcctgtaccaaggtgcccccaatacatcttctatactgcaccagagacagtctgctaacacccacatcaggttgtgtcactcccttttaaaaaatcctggccggccgggcgcggtggatcaagcctgtaatcccagcactttgggaggccgaggtgggtggatcacttgaggtcaggagttcaagaccagcctggccaatatggcaaaaccccatctctactaaaaatacaaaagttagccgggtgtggtggcaggggcctatagtctcagctacttgggaggctgaggcaggagaactgcttgaacctggggggcggaggttgcagtgagctgagatcacaacactccactacagcctgggtgacagagcaagacccgatctcaaaacaaacaacaaaacctcctaattgacttccgtttactgtcataataaactccaaactctatcctggcatcaaagctcctgccaccctggctggcatcaccacctgcctgctcccagctgcaccagttcctcctgacatagtctggactacccctggggtccctgggtgcctatgggaatccagctctggccaattctgcagaagtcccagcgggactagcgcagaggccctgtccgtgtccctcactgctcactgcagtgcttggcccccagcaggtcctcaacggctgcaggataaatataataagtgccatgccctttcctgttttccctcagaggcaccctcccccgagctgggggagcaggcttctggctgcgtgtgtccttggcacccagcctctccgaggacagcaagttcactgcaggagggcggggatgggacccacagagcctggagtggagagtcccggacagagtggtgggaaaggaagcgttttcttgcttggggcgaaagggggcagcggagcggagcgcccgaaacccagcccctgcggaccgcaatctttgggaaaaaggcgcaaggtgggaacgcagggccgcacgtgggaaccgttcgcggctgccgggtttgcagcccctgcccgcgcagctgggagccgcaggaggcggcccgggactccagcctgcagcccctatcccgcctcctcccacgctccagccacggcgcggcgctacctgctgcagcctctcttctccggagaggcccgggctcctccctacacccccgcggcccagccccgggtcccaggctccggctccgggtcagcatcctcgcgctcaaggcggtcatgccggactcctgcggactacacatcccggcggcccatgcggccccgtcacgtgatgcaaggatcgccggcctttccgccagagggcggcacagaactacaactcccagcaagctcccaaggcggccctccgcgcaatgccgctaccggaagtgcgggtcgcgcttccggcggcgtcccggggccaggggggtgcgcctttctccgcgtcggggcggcccggagcgcggtggcgcggcgcggggtaagtggcggtccccacggggcaagtggcggtccccacggggcagcggcctagagaggcggaccccgcagtgtccgggtcccgggccctcacccgcgcccactgcaacccgactccggagctccgagcatcccttagttttaagtcatggcgggtgcgaacgggtctctgctgcaggcggctccgtgacagctcctgcttcacatgggtagaggagagacggcaaacgtcggggctcccaggacttcgcggcggcagtcctaacccgtgcactgagtcgggcggggcgggcggcagcgtctgagtagagagctctctagaccaggcctggtgtctcccgggctttcctaggtgcctgtttgcgagctggtcagctgggctgtagttgagttctcccagggagtgtgggaggaaaggttatgcccaccagagacccagggtcctgacggctggaggtccgcagtggggaaggtgggcagaggtgttgctcagatgtccccattcctgtttcgtttgcacagaggggttttctggtgcgtcctggtccaccatggccaaaccaacaagcaaagattcaggcttgaaggagaagtttaagattctgttgggactgggaacaccgaggccaaatcccaggtctgcagagggtaaacagacggagtttatcatcaccgcggaaatactgagagtgagtgagctacctgtgtctttgctaggctagagggaaatgcagagaaggctgggtttggtcttgcaccaggttctgtgggagacgggttgctggcaactgtctacacaggaatgctgtctccagtacttggaggccgacatgtccttcctcaggagacttcgaaagtcaggatcttggtgacctggttcaggcacacttgagttactattcagatgttgatgaaagaaagcccatcttatagatgaggcctgagtatcatcatcttcacaggtaaggatatgtccaggtgttacatgataagatgtgagttcctgggagaagtaggttctttattttattttttttttgagactgagtcttgctctgttgcctaggctggagtgcagtggcacaatctctgctcgctgctacctctgcctcccagtttcaagtggttctcctgcctcagcctcctgagtagctgggactacagacacgtgccaccacacccatttaatttttgtatttttagtagagatggagtttcactatcttggccaggctggtcttgaactgctgacctcaggtgatctgcccgctttggcctcccaaagtgctgggattacaggcatgagccatcgcacatgggctaggtcgttatcttttatgtgtgtttgtgtctttgtcacacatgcctggcattgtgttttgcccatgagtaaatgctgaatttttgcacttgtaaagttttctacttagaaacaactaaaacgttcatcaactgatgaataaaatatagtccatcctggctgggtgcggtggctcacgcctgtcatcccagcactttgggaggccgaggcgggtggatcacctgaggtcaggagtttgagaccagcctggccaacatggcgaaaccccgtctctactaaaaataccaaaaattagccggtcatagtggtgggcgcctgtaattccagctactcggggggctgagacgagaattgcttgaacccgggaggcggaggtttcagtgagccgtgatcgcgccactgcactccatcctggggaagaagagcaaaactccgtctaaaaaaaaattgtgcagtttgaaattgtatttcatgttatgttttatctcaatacaacatttgcagttgtgaaaaaaaattgcacattctcaactcctcgggatggagcagtaaagcccctcagtaaatctttttttttttttttttttgagaccgagtttcgctcttgtcacccaggctggagcgcaggggcgcgatctcggctcactgcaatctccgcctcctgggttcaagggattctcctgcctcactctcccgagtagctgggattatagacgcccaccaccacgcccagcaaattttttgtatttttagtagagacagggtttcatcatgttgggcaggctggtctcaaactcctgacctctggtgatccacctgccttggccccccaaagtgcagggattacaggcctgagccaccgcggctcgtcaagtgaatcttgattccagaaagatctgttttaagtctctagtctggaaaatgcagtgggagtctttaggtggtttgtgacttgcagttaaggagaccgtggcctgagcactggcccctttttcttctttcatctctctccaggaactgagcatggaatgtggcctcaacaatcgcatccggatgatagggcagatttgtgaagtcgcaaaaaccaagaaatttgaagaggtaggtttatccagttgagctactagagagaggcacgtagactattcagagcctgagtttgctttttttaggaacatggttgacagctgactgccgatgatctggtttgcactttttttttttttttttttttgagatggagtcttgctctgtcgcccaggctggcacaatcttggctcactgcagcctctgcctcctgggttcaagcagttctcctgcctcagcctcctgagtagctgggattacaggcacgcgccaccacacccggctttttgtatttttagtagagacggggtttcgccatgttggccaggctggtcttgaactcctgacctcgtgaaccatatgcctcagcctcccaaagtgctgggattacaggcgtgagccactgcgcccagccagtttgcactgttttaggggaatttagctttcatcgtagtgatggggaagctactggaaatgccccgaatacaaccttgagggaccaatcaagcgtggaaatggggagcaaagggattaggcttttctagcaacaccagaaaggatttctatgccgagcgggggtgcgggggcttatgcctgtaatcctaggactttgggaggccgaggtgggtggatcacgaggtcaggagttcaagaccactctggccaacatggcgaaaccccgtctgtactaaaagatgatgagccgggcatggtggcacatgcctgtaatcccagctacttgggaggctgaggcaggagaatcgcttgaacccgggaggcacaggttgcagtgagccgagatcgccccactgcactccagtctgggtgacggagcaagactctgtctcaaaaaaaaaaaaaaggaagagtttgtagtggctgatagaaacgcatgctcactcgctctctcctgttacaagttcaggccaagaaaaatcaagaaagggtttgttccacagagaacaatcctaggcacgctggtcttggtgccattttgggagggtgactggtcggtggtattgggcgacctcacggacatagaaatatttattttgggcaaacattgccagactttcctgatgacttgtggacaggacaggaagtggtcattttgggagtgcaggttgctggtagagcacctgagggctctgcccttgccttgcccagcatttgtgtgtgggagagcagtgagacctggacctctcatgctcagatctgctaagaggagagtgattgctacctctgcagcagctcatctgaaacgtgctggccgtacgctaccaaagataggtgtaaagaacaggtgtccttagccgggcgcagtggttcacgcctgtaatcccagcactttgggaggccaaggtggatggatcacctgaggtgaggagttcgagacccgcctggccaatgtggcaaaaccctgtttctactaaagatacaaaaattagctgggcatggtgtcgggcacctgtaatcccagctacttgggaggctgagggaggagaatcgcttaaactcaggaggcagaggttgtggtgagctgagattgtgccattgcactgcagcctgggcaacagagcaagactgtctcagaaaacaaaaaaaagaacaagcgtcctgcatcctgttctgaaagttgtttgtgtgggtacggggcagcctgtgagtggataaataggcctccgaggctgggatggtcccgggccctgtgtccacggatctttgcagctcaggttgcaacggtaagagtattgtcaatgagacaaaggaggtgagagtgccagttgtctgaattggttgggatgttggtcagatgacatctaaaagaacacggccattttgttattatttggttagagacaaggtctcactctgtcacccaggccggggtgcagtgtcacaatcatggctcactacagcctcaacctgccaggctcacgtgatcctcctactttagcctctcaagtagctgggactacaggcatgcagcaccacgcctggctaagttttgtattttttgtcgtgacagggtctcactgtgttgcccaggctagtctgaaactcctgggctgacgtgaccctctcccctctgccacccgaagtgctgagattacaggtgtgagccaccgcacttggccagaacacggccattttagttcccctccttagaggagtaaggccaggaatgagcctgtggtctgaaagccgtggctgttggttaatgtggagaagggaaggtggtgagagccagcccaaacccctgccgagtgagactgattctggcagctttagggagcagggatgagcccctcacaggctgggtggtagttagaggaggcagatttcagaaggccacgcagcgctctttctcagcaggtcaggcaggcagcagaggtcgggcaggggcatggggtcgagggcccgatgctggtgtgttcactagaggagagccacaagcagggattctgggtcaggtgcaggcctagggcttagtgtgcacttgtggttctgagactgtcccatgacttcctgccagcattccggcagctctagtgggactccctcctggtccaggtgaggccaccattgctgccctggcttgctgctgtcctctcagcccccagtctgtcacctggtgggagttaaagggacctgctggggtttgaggaagctctgagccgttccctgtacgaagcctgtggtcatctcaggctgcaggagacacaggagatacgagctttggaggtggggctctcagtcacaagcccccgttgttcctccctgtcctccgctcacggcactgctccagttgccggggccagggttcttggagagcacatcctcaccgctgtcccctctgctggtgacagcacgcagtggaagcactctggaaggcggtcgcggatctgttgcagccggagcggccgctggaggcccggcacgcggtgctggctctgctgaaggccatcgtgcaggggcaggtaaggcccagggcgacgctgggatgggtgacgtcaggctgcccactgactgtcctgtccctgctgggccgtgtttggactcctgcctcggtgagttgctgggcacagggtctaggggctgatgggctctggagctggatggcctgtggggtctcctggtgtcatgaggtctgtgtgaccgtaggcactgcctcctcgcctgtaaacagatggtcactgcaccttcctcttatgggatgttctggggatcatatgaggcagttctcgcagagtgctgagatcgtacctggcagctggtgtggggctacggtgttgttttgcccttgcaccctttcggggccactcccctgctcactgcattccatctgtgctggtcttggctgaccctgaacacccaggcctcttggtgttcctgcctcccctggtcggccacttctactccttcatgtcccagctgctcagaagggccgtccactctcacaggctctcctgggtttcccccactcaggccttgtcctcagtctctgagcacaaggctgtctgccctgcaccgagtgcaggggtcgggcaggagctgtgtcatcccctgctctgcgccacccgctgtgccaggtcccgacacacagcagttgctccccatacgccgctctgcggtcggccggtgcatccggccccctgccctgtacaatgctgatgctgcagacctgtctcttgcagggcgcctctgtgggaaggagaggggtccagggctggagtccgggtgcccctgcacttcagggacttcttggcagccgtgtgggcgacgctggcaggctctgctgatcctgtggcttttgtctttagggcgagcgtttgggggtcctcagagccctcttctttaaggtcatcaaggattacccttccaacgaagaccttcacgaaaggctggaggttttcaaggccctcacagacaatgggagacacatcacctacttggaggaagagctgggtgggtgccaccttgggttggaggtttctctggccttgacgatcaagtgtaacctggatgggaaggacctggggctggggaggggctgccgttctcagggatggcctgcagcgggtatgcccaccctgcttcatgcacctgggctcacctgcgtggccggagtgcccctgaggcacgtgttaaaaatgcagagtcctggccttcaccccagacctgctgactgtgagtctctggggcttggggcctccgaacacctctgcaacggcaggagctgggcgagttctgtcactgggaggtggtgctgctgacttggtctcaaccggagcgtactggtcccgtcttcctcctcctttctccactttgtggaccttcctcctgccatcctgtggtgggaggtttccattagtcttgggtctctgtgtcatgattctgggaagtagagaaagaggaggaagagatcggtctgactctggctttgctgttctgtcgcccagaaaagggcctcagtggctgggctgcctgcaggacaggtgccggccaggtgcctaccgtcaggtttcctgtctgaggtgacgtggccggcagccaagtgtgcacacgtctcctccgagccactctctgctgggggtggggaacgcccaggagtctggtgatgtcggcgtctcccagcctcgggttgggccctgagtgtacggcatacacacttctgctgccgcctcggcacagaccctctgtgcagccccaggggcggtagatcctagtgtccgtgcgtagccggcctgccctgggctcccctgagcctcttcgggcccagtgcgtggtctgtctgttgctgccgggggactgatgatggggtttctggcagtgacgggtttggacacactgtcctgcggcgggagggggaggtgagtgggagatgtagattcggcgtcctcgcaaactgccgccgcttctcccccagctgactttgtcctgcagtggatggatgttggcttgtcctcggaattccttctggtgctggtgaacttggtcaaattcaatagctgttacctcgacgagtacatcgcaaggatggttcagtaagaaaagaattgagatcctgttctgataatggtcctaagttcagctccgcagtgaataaagttgaaaccaccaaaaaaatagaggttgggctgggcacaatggctcacgcctgtaatctcagcactttgggaggccgaggcaggcggatcacgaggtcaggagttcgagaccagcctggccaacatggtgaaaccctgtctctactaaaaatacaaaaattagccgggcatggtggtgggagcctgtaatcccagctactcaggaggctgaggcaggagaattgcttgaaaccggaaggcagaggttgcagtgagcggagatcgtgccactgcactccagcctgggtgaaagagcaaaactccatctcaaaaaaaaaaaaaaaaaaagagaagtacgtagctatcttctgtttagctctcatctgatgtcttggttatctttttgttgtttgtttagaatgttgcatgagctctgtctcactcatgctgaacacccagcaccgagagcagtggctggcgcacagcaggcacctgagtgcttgttgggtgggtgggacccccagggaggatgagccatgcgtgttattgacgtcatagagtgactagaccacagcccgtggtggctcggccatccaggcagtgctgccgggactgagctcggtgctccctgcaggatgatctgtctgctgtgcgtccggaccgcgtcctctgtggacatagaggtcagtgcctcccctccccagggccggcccatttcaccctggtttctgggaggctggggcttgggggttgagccctgtgtgccacctgctggctgtgtagccctgggcaagctgctcggtctctctgagcctcaggagtcccccatgtaagtcaggatagccgggcgcctccatgtggagatgtagctcagggtggatgacagcatcaatgacccacagtgacagggacgtcaggtgcttcccacatgcccgcttgccctgtggcttggagagagggtgccatggcagcggggagaggtggcagcgcaggctgaaggaggtgggaaggaagcctgggtgtcctctcctgtggggaggagctggggtaggacgggcgtgagccgtctccctctccaccaggtctccctgcaggtgctggacgccgtggtctgctacaactgcctgccggctgagagcctcccgctgttcatcgttaccctctgtcgcaccatcaacgtcaaggagctctgcgagccttgctggaaggtggggtttctgaaactgctctggaaggttcctgagagcacatggatgggacaagggccatcctgtctcccatgaatggttgtctgattcttggggtggccagacaatggcctgttgagggacggccagtgtcattttcccaggcagttgagctgaggtcagggttttggtggcattttgagaaccctgctgcctctgtctttgggaggagatggtggcgagctggccggaccttgggtggctatagggcagcagccaggcggggccagcagcgggactggggctgggggcagggcttatgcctgccagcccctgacacgcattgtgtctcgcagctgatgcggaacctccttggcacccacctgggccacagcgccatctacaacatgtgccacctcatggaggacaggtgagtgtggtgggtggggcgcagggcagtggaggccagcacagccctcggggcagctccagtgtcccttgccaagcacacactggcttagagagtccttgtcctctcgggcagctgttccagaggctgccactagagcgaggcccatgacttctaggatccagcccctgtcctctccttcctctgtcagttcaacagaatatccacacccagctcagtgcctgccccatgctcggacgtcctccagcggtgctccccaactacttagcctgttacaaggcgaggctcggggtcttggcttgacgttgcccttgccctcacccccacagccaggctgtggccacttttgttgctttagccattagagatggctcagctctgcccacaccctggcctcccacccatgctgccagctccccctcctgctctcctgtatccatccgcgcctcctgaagcccactccatgcagcacccgggtggcctttttctgacacagatatgtcggtgtcaccctttgctggaagccaggtggttcccagcgcccttgggatgtaggcttctcctatggaaccaggccctggggccagccctgcctcagccctgcatctctcccagccctgcctcggcccctgcatctctcccagccctgcctcggcccctgcatctctcccagccctgcctcggcccctgcatctctcccagccctgcctcggcccctgcatctctcccagccctgcctcggcccctgcatctctcccagccctgcctcggcccctgcatctctcccagccctgcctcggcccctgcatctctcccagccctgcctcggcccctgcatctctcccagccctgcctcggccctgcatctttccttccctccatccttggaaccaggccctggggcccagccctgcctcagccctgcatctctcctagccctgcctcagcccctgcatctctccctccctcctcccgtagaaccaggccctgggggccagccctgcctcagcctgcatctctcccagccctgccccaccccctgcatctctcctttcctccatcttgccttctcccctccaccaagggcttgtgcatgccctgattcctcttgccagcaggttcttccacctttgccgagttactctgtttactgaggtcttagcgtggtcactgactcccccacctccctgagtagtttttgctgtggctttccttcttggctgtgattggaggaagagattttgcgtttacctgggagattatgtggctggcgcctgtctcccccagactgcgaggctgtgggccatccctcttgcctgcttcctgtccctggcatgacctgtagctcacagcgtggtcagcagtgatgggctgccgcctgtgcgcaggagtgaacaagagtgttactgctggcctctgttccctgcccttccccagcggtgctcctgccccccccaagcacagggacctctggggctgctgcaggagcctcggcaacctcacacatccatggcggaccctgggacagggccctgctcacattccgtctctctggggaacacttttagagcctacatggaggacgcgcccctgctgagaggagccgtgttttttgtgggcatggctctctggggagcccaccggctctattctctcaggaactcgccgacatctgtgttgccatcattttaccaggtaaggcggtttctgtgtgcagtgagctggcaggaacgggagagctcccctcacgcctgcccacccatcccactgggggtcctgctgcgggggctgcggtggcatttctaggcctttccaggcagttgctttgcagctgggggtgaggtttggg

SEQ ID NO: 1367 - DNA, 73611 bp, Homo sapiens
atagtttggcctctggcaaaaatggttttattgtagtttcatccttgttgagtcaataattaactgagtttgattaaagctgaattttcctaagtatgaaaaccatgtgggcccttctctttcctcgtgatgcacggtgatagtgcgtatctaacacttgaaggtgtccacgctggccctagctcagtgagatggctttgctttgggggggtgagggggcggaggtggtggaaaggcagcaagctacgatgttcttatgtgtgtggccttgcttctggtggtggggtggcacacatgctctgtagtctttctggatgggtttggcccacgggagaccccctggctgtccaccagcccctttgtgatagtctcatagtcttatttgtcttttggcttgtatcccacctgttcactttttaccatagctaacctttctaagtggtcaggtgggactcatggagattttccgttctttggcaactagcagcgactgcagattactcatcagctgtctccttgagtccacaatgccgggcggtggacgggcttcctgcctcctggcccagggcccctttgccggctcttagtgtagagcactagttgtaccatctggtagttgtttgtgcctgcgactctcttccctattaggctttgactccttaaggataagaaccatgtcttattttttttaatctgtagctccagtatccagcccaggacttgacaccagcctctgtcaaatacatccgtggaacgcatttgtaagaaatcgaggccaaggcactggaagtcccattgtctctggatgctgagaccttgaatttcatgccatggacccctcccttacattccgtctttaatgtgctataaatagacattcctggccttgcctaaataggattaagtagtaccaaatggtccttaccgttctgaggcctcactgagactcattttgaatctttaaagaaagcagtagagggatggagaagaagtgggtcaaaacctggtttctgcctgtgggaaaatacaaaacaacacaacagcaaagcagactagcatggttcaaagcacacattgaggtttttggtgtgccattctaatgcatgagctcattttgagccaaggatagctttttggtgtagaattttgccagtcctacggtcaatgcagtactaattgtgtgtgtgactttgtgcagtggggaaaggtggggctttaaaataaaacagaaggtatgaattgcttggcatttgctgtggttcctaagtctccattccgcttgccaagattaaattgaattattcccgctgccattcagttttactctgcacaaaatacagccaacatttttgcatttctttcttccttcctccttttcttctttccttccttccttcctttttcccttcatctatctttgttccgcttttgtttgtttttttttagatcgctgcatgctgccgcgttgggttaaccatggtagcattttaccatgagaagccatagcaagatgtgccaggtgcatgctgctggaacacctggctgaggctccaacagcattttcctatgactgagggtagggtaggtagatgactcattacaatttataaaatggggggcttagcttgggtatcatcgtggttattccaagcagtcttccagctggactagcttttcgggaacacgtgtgtgtttgtgctggaagccccagtaatatcatttaattcgaaagcttttttctatgatgaattattcaggcagtgtttaccaaaattgtcattgatcagtacagacccagagagcatgtacaacagcgcctgtgctgggcctgctaggagtcgatattttctggctcaaagaagttccaaaagaattcaaagccagtgtgtctctttctctggacggccaagtgatgcaggtaccacgcttaggtctgctggtgtttagcttgacttaaaacccagccagggaaatatgtttcactttgctggggtgcaggtggaggaggctattattcttaggcatttaacagtgaagaatgttgggcagggcagagggtcagctgaatggcagggattccaggtctcagttaatgcccacaaatttctgaactttgaacataaataccctcactgcaatacatgtttttctttctctctctttctttctctttttttttttttgaaaaacttttttggagcagcacctgcatgttgtaaaaacacaaaataaaaaaaaaataaataaaagcagaccccttggttcagatatctttgtttgtgtaaatgttttggcattctttatgaaaatcttcagattttcaagagcttaagatgacctcctctagccggctgcagcagtgtctaggtatctgtgaatgtgtaagaaattgagacagcctgcaaaatagctcacccagcttttctttaaagttccaacctttttgctggctctctttcaaactgtactgctcactttgggctgtacgttagaaccacctgagaagttctttttctttcttttttttttttgagatggagtcttcctctgtcacccaggctggagtgcagtggtgggatcttggctcactgcaacctctgtctcctggcttcacgccattctcctgcctcagccttccgagtaactaggattacaggcatccgccaccatgcttgggtaatttttgtacttttattagagacagagtttcaccatgttggccaggctggtctcgaactcctgacctgaagtgatccacccacctcagcctcccaaactgctggaatctgagaagttacgtgaaactagcgatgccctgggctaatgaaatcaggctccatggtggggaaggatgttgcggtggggttggggtggcaatgaaaggtgaaaaccactgtggtcccacctgcccatcgtcagatttcggttcctctcagagttaacgtagaaggtttctgggggcatggacctgagtcttatcccctttgcaaaagtaagaattgtatcgtagcctgactcagggttttagccaacttctctggatgctaatgctattctcttctttatacttgtcttccttcccaggcacacatccactggagctttgcagggcctatctgcccttagccctccaatatccttttcattttctttaatagttttattgatatataatgtgcctaccatataattcatctgcttaaggtgtacaattcaatggcttttagtgtattcagagtttgcatccaccatcacaatcagttttagaacattttcattaacccaagaaaatgaccccttagtcatcaccccaaatacctcctctctccagttcctggcaaccactaaccaatctacttgctgtttctatggatttacctattctgcgtacctcatataaatagagtgatatgttagtcgtctcttgtgtctggtttcttcctcttagcatcatgttttgaaagtttatccctgcgacagcatctaccagttcatcatttctttttgtggctaagtaatacgccattgtatggatataccacattttgtgtatccattcattagttcatggattttgtgtctattatgaataatgctgccatgagcatctgtgttgtccacaagtttcagcatggacttctgttttcattccaatatcctttgatgacatgtcttggcagtgatgtctatgacactgggcaagtgtcttaaaatgttgtgcatcagaaaaaagtcatcattgccaaggccagcagatctcgaaaagggggctgggatacgttggtgatttttttcatgctctacttacagtatgactcgtaactgttaatggctgagctcctccttaggtgaagaaggaaggcaatggcgttttctattctgggcctccctgcttccagcgatagcaaggagcgaaatgagatgctgtctaagaaaggaaggtgctgcgatctttgattactacacagcctcggcagtgtttgtatgattaatgagtccatgtttcagacgttcccatttaatgtatttgagccttctaacaacattgcctttcatatgttgctgactgtttttgagatttatgaggcctaactcgcaagcgatgtgtgtctggattaagagaacctgagaatctctatttatgtctgaccccaggaaattccctttaagctgcttatcagaggtgcatgctgagagcatgatgggaagatggagtcttccatccgctggtaaaatctggaatctgctctcatttcattttcactgaactgaaaataaggtaacagaccctcaggtctacctataagtaccttccaactgttccacttttgtaaatttagttcagataatacatatgctgaaattcctatatcccccccatactccagatcttcagtgtggaatttaaatataattccttattgtaaaaaaaaaaaatttttttttgatcaaggtgattttgataaactaaatgcatctttaattttactcacagcaaagcgattctttattttctctctaaaagcataattgatgtgccatgatctttgtctttgcatttttaaaactgaaagaacatttccacaccattagaaataagatttcttcttaaaaatattcacaaggtgcaaacacttacatgtgtatatgcatgatttcaccaccagggggcattgtggtttgactgtccagttaaagagcctgtgttctatcagtttacccagaaactagaaggcctgcgagtatttctgattccttccaagaaggattcatatctggaagagaacagatgtcgactctttttcctctctagcaaacagtagtgttgtcaaatttgctaaacttagccagttgaagattaacatgcaatatataatatgcatgcgactaagtgtacaataaatagtaaatcacatttttatgctttctctgaacttggaagctgcaagttatgttttttttattccctgggtgtgatgaaataaataacattcaaatacatcttaaagatgtcagtcagggggaaaaaagtgcttggcaactgtgtttgatagatttcttttatgattaattctcctattaagttttaatgacttcaaagatacaaagctagaaactacaaaactaggcatggttaataaataactgaaataccaggtgtatagaaatgcatctgtggaaaaatgaaatcatgtattctctaggatatattaggaaatggctctttggcaagtctagagggtaaagtatccctgaagggggaaaaggtttaaaaacagtaaactaaagaagattgtttttctgaaagaaattcccaggagaaaggtactttctgagattcacatatgtagattacattgttatgaaccaacatttataagcaagcttgatctctcagaatgcgtttgtctatctcagattttcaagaatcctcatacaaattgtccagggtttccacctcgcagttttcttccagggttgctatggcatggaaagtacattgctattttgttatgtaaatgctcaacagactggctcattccagaagtgggcgtcgtgatgccagtgtcttcgtaatactatctttctttcccctttagcacccagaacttatgaaatatgactcggtttatcctgaacacatctctgtgcatcggggaggatgggagaattaattccagtttctcaattgcaaaagtgaggctggtcatggggcttggaaccacgccacggacgcatgaagcctccccgtttacatgccaaatccagagcttatgcatccgtgctcagggctctctgtggtaggcaacagctggattatttactttctagaatatctcgagttcttaatctgagcagtttcgaaaccaaacccacattaattaatataaataatgactgggaaacgttgcaggactccccggaaaagaatgtataaattgatgtgtttttgtatatgcttatgtatatgcctttgtgcacgaaaggagataaatggtgtatttcacacagttccttctcctcctctaagggatattattgttcctgaatttttctgagccgccgaagcacaatagggtttagagcgttcacaccaggcagcccccactcttcagaacttcaaatctaaagatcttttaaatacacagaacttacttttgaaagctgtggcccatcccaaatgaattctaatcgtcagcctctagaatgcctggagtgagaaaacagaatattgttcttttctgtttatattatttcatactgagttaatacacttgccaagactccgaggcagcttctggcttgacaatgccttctttaactagcctagtttctagaataaagttcgggtccaccaggccctctgagtggggctcaggacactctgagatggaagagactggagaaagccaatctgtttctccctgaaaatcatcttacttttttaacgcttcgtacctagatttggcctgggcagcccagggagactgttcaagcactggatacctagactctgctgggctctagagaagtgctgggctacagcgcccagtgccctacctcttggggccagccagcctcaccaaaaaatcacgcttctggcttgctccaaactcaggaagttgctgggaagtctggctagcaacaccctcattcccagtcctggccatgcctctctgctctccctagcacagggagcatgcaggcttaaggctggaagaaaccccaagcatttggccaggaagaggcaactagttccagctggcccacatactacactttaaaaattacccagatgatctgattctgtagagagagtgggtggagaggactccagggccatggaggaagattcggcctttctctccctaatcatgagcaatgtgatttggagagagaaggacccggttggctctgcaaaccgcatttccttggctgaacgccagaggagagaaatgatccggcaagaagacacaccattccccgtcagccccttcccgacccttgcacccctggatcttctgctgagtatcggattggtctgcgtccaagagctcctcgcttggccagcaggggctgcctggagaaggggaggacaggcttcgagttttttgggtagtgacttctgtggacgtgaaaagactgcaccagaaatcggaggcagccctccaaacataacttggcctcttcgttctccctgtggacacacaggctgtgttctcctggccaagagtccaagcgtgtttttggcgcgtgctgacactctatatcgcttttgcttcggaaacgaatctggtcagtgacttagccactctataaaaatgaagagcagagctcgagtgcttataacacgtcatttttacccaagacagagaagaaaaacgaaagagagcctgagcattcctttgactccctccacccccggaaggtatattcagagtctccaagactgcctccgcccactcacatgtttatggcccggtgagaccgcatcctccctttctatatctgtcccttttctggatgcagggacacagaatcccctaagtgggaagagctttggagtggaggctgttcaaagttctgtggtgattaattattacctacccaaggtctggtcattgctatacttgagttcttttcaggctcaagatctctacctttttgtgtgtttttttttttttttttttttttttttttttttgtacagagtcttgctctgttgtccaggctgtagtgcagtggaacaatctctgtatgctccctgcaacctctggctccaggtttaagtgattctcctgcctcagcctcccaagtagctggaactacaggcacctaccaccacgcctggctaattttttgtatttttagtagagacgggatttcaccatgttggccatattggtcttgaactcctgacctcaagtgatcctcccacctcagctgcccagggtgctgggatcacaggcgtgagccaccgtgcacgacctcagggtcccttctaacctgtgctgttgtcataaaccctggaggagaagcaagatctttctagcaggagcaacatcatcccaaataaagtgatagactttgatagtgttcttctattcattcaaccaacagagaacaaatgaaaagaatcaggagtctattgaggagacagaacatgagtgatttctgtgtgctgactatatttaaagacaagattagcagtaatatataaacgtaaataagaatttttttccccagccaagaaccatagattggacttcacattcaaaatgtaaattgtgcctaggaaacatcaatgcttattttaagcaactgacccttgggataaaaataaaaagtcaaaaggaaacaaacaatgttgctgagaagtgatagaatattctagtttatatctcagtcattttacagctctggcatttctgggtaacactttagaatacttccactccggttggtccataaaaagctgcctgtgtttttatgttttgaaaatacacgcagagagacccactgcatgtcctattaggcatcttatccttgagtaagcaggcatgcaacatcagtgtcacacacatatcacccccatactcgacattctttgagaaatgccttggtcccgtctccagccagatcagcattgcacctcttggcatgcgttcttacctgttgaggatttgcttgaattataatatggtagaggaggaaacacagtcttactgtgccgtgtgctgagcgcagagccattctcagcatcctgccttgattaataaggcgtgaaagatcctccgaattcgcacctgttcagacaagcttgtccaacccatggcccccgggtcgcatgtggcccaggacagctttgaatgtggccccatacgtatttgtaaactttcttagaacatcaggatttttatgcacggaccttttatgcatggactgtggtgttttttgatttttggttgcgtgcgtgtgtgtgtgtgtgtgtgtgtgtgtgtgtgacggagtcttgctctgtcactcaggctggagtgtagtggcatgatcttagctcactgcatcctctgcctcccaggttcaagcaattctccgtgtctcaatctccctagtagttgagattacaggtgcccaccaccaagctttgctaatttttgtatttttttagtagagacagggtttcgccatgttggccgggctggtcttgaactcctgatctcaggtgatcctcctgcctcagccacccaaagtgctgggattataggcgtgagccactgcgcccggccttttttttttttttttttttttttttttttaacgctcatcagctattgttagtgttagtgtagtttatgcgtggccgaagacaattcttcctccactgtggcccagggaagctaaaagattggacacctgtaaacaaaaacaacacagccatctagctgcaagacgtagctaattgctctgcagaacagggttggccagcctggccttgatgtcggagtgttctctagacctcacacccagtccctattcttaggttttatttctcaaaccaggttttgcctgagaaattacagcaaatgattcagagcacaatgatgttgctcatttttgataagtagttgaaagctgatggtgccctccatttcaaagcaacagaagaaacgctggtggtcatggagaaagagttgggaagcagagcgtgaatgccgggatctgcagatctgagcactatgcctgcagccgatgtctctccacagggctgatctggtggctggggtgcccctggtcagaaggggtgattactgtttcctctctctccttggtctctgtcaaacctaccaactcttttcaggaatgcagatatttaattatcttctgctgttacatctgcatcatgtattggctggctgttcaaaagtatcctctctaggcaaataacgagatttcgccagcaggatctcccgttaaaggcgtgcatgtgtggctttgtagacacgtatgtgtgtgtgcgtgcacacctgcctgcccttgcacagtgggcactgtttccagtgtgcagtgaggccctcccttcgtgtagaacaggacaggacaatgacaaagttattcaattaataattgaagcttgccgggcatggtggttcacgcctgtaatcccagccctttgggaggccaaggcaggcagatcacctgaggtcagaaattcaagaccagcctggccaacatggcaaaaccctgtctctactaaaaaatacaaaagttagccgagcgtgatggccagcacctgtagtcctagctacttaggtagctgaggcaggaactcgcttgaacccgggaggcggaggctgcagtgagctgagtttgcaccactgcattccagcattggtgacagagcgagactcagtctcaaaaaaaaaaaaataatataataataataataatcgcacctcaatactccgtagccattttaccgcatgtgactattagctgtgcttttgcggttatctacgtctgttgtgtctatacggtggagtatttgcagacgctctgccagtgtgcaatgcttcccagccctgcattcagggataccaacttgggtgctgaaaagcagcgatggcaggactatttacaccacggaaacaggcaaaaactactgatcaagccttcactgttttgtttatattgtcttgacttagaaagtgattgcaatgttaataatgcagattaaattgaagcgtacagtgcctataaaccattacattatgaatagtataaaaaattgaggaagccgtgtggctcacaaattcagcactttgggaggccgaggcaggaggatcacttgagcctgggagttggaaaccagcccaggcaacatagtgagacctcatctctttaaaaaaaaaaaaaaaaagaaagaaaaattagctggcatggtggcacatgcctgtagtcccagcttctggggatgctgcagcgagccatgattgtgccactgctctctggcctgggcaacaaagagagatcctgtctccaagtctgtctgtctgtctgtctgtctgtctgtctgtctctctcggaaatattccttcagtgtattagtaaagaagttacttaggagtcacttatgcccttgaagagtgagtgatgtatcaaaatatgtctgtctttattgtttcactttcatccttctttttttggagatggagtcttgctctgttgaccatgctagaggtggcgcgatctccactcaccgcaagctccgcctcctgagttcaactgattctcctgcctccgcttcccaagtacctgggattatagacacccaccaccatgcacagctaatttttgtatttttagtagagatggagtttcacccttttgattggttggccagtatggtctcaaactcctgacctcaagtgatccacctgcctcacctcccaaagtgctgggattacagtcgtgagccaccgtgccggccactttcatctttctgattaactgaaaagtatcaagcaatacttacatgtaactgcactttctcatcaactgcaaccataatttagctatggatacaagagttgggcacaaatccatgaaagcattgagtgagaatcaattggctctgtgggatttacaataaagaatgttgtttatttttatttgtaaattgtgtgctacagatccttcgtatcagtaaaatgtatgataaacatatgtgtgtatattcacacacaccctttcattttggcaggagtgtttgttaaacatttaccacagcagtggattcacttccatcagctgctaactttcaaggatgtttgaggatgcatgacctgtgcaatgcacctgcttcggtgcctggcacagagtcgcaaagccacaaagatggtgcttgttggttgtatgtgttgtttccatctgatatcaccattgaggggagcaagatgacatgtgcctaccccacgtgtccagcagcaaagccacctggcatagtgggctgctcagcgtgcctggttcatactgcgtgtttatagtcccagggtgttttcagagagcaaaagtcctttatgattagcaaattgcaggtcctcccctttctgatatttacagcccttgcaaccgcctgtacaaaaatcgggaaaaggcagaagacggctgtcattaatgtaaaagcagctggttacctccccctccccagcgcacacatcacctcctagtacaattagtcaccatgtcttttcccttccgtcaagccttttagcggagttcacagggatgccttcggtccagacactatgaccgttgacgaaggatttgaaatattttgagaactctgaaataatgcacaccagaaacgtccagctgaaaacaaaaagggaacaagatgacattttgcaatcccatgcacgttgcaggcacgttgaatgtgaaggtcagtagtacttcagagggcaggcctgttgcccccaagcctgttgcctaagaaatgcccaggccctttgaacaaaatggattcgagtgattacagcacgtcctcacttacatctcccaatatatttcttgttattctcgttgagtactgcattcagacagaggttgccaataaagtttattgtaggagctaagtgtcaatatctgtagtaccccccgcctagggtgctgctaataaaatgccacagatagtctgggagaggcatgaaaatttgatggcaaattgatttcaggttcatcttgaaatttgtcctcagctggactcgatacttctggcagacatgggatggcttttgtcagaagggtctgctggaatgagacagagatgtcttgatctgaatattaaatacaacatgctgtttatgacattatccgtttactgctaaaatacccagctacttctgtttacacattcttctgcgttgaatgggtaagatagcatctcatagatccactttacatatgaaaagaagttgtatcaaacttgctgggcatcagaaataaagggttttagagacactggcttcaaacacaagttattccatccaagattctaaacttagcaatgcaacttgcacttaattttaaaacgctggaaaaataatgataaagattgtgtgatcaagtatagcagccctgtggtgtttcctcagaatggtgtattacagaaaaggaaaaagccatatacatggagaagaaactcccgatatttaatattatcaattgctggttcctgtaaatttgcatttatggatcacattataaaagcaattactcttatggattgttcatgcagaaatgcactatgatgataatatacttttaaaagtatatttatttccagaattcaatttgtaagaggtttgagggaaaaataatactgagttttgagtgtttctgattttaaaaatgtgttgagtagaattaaacgtgttcaccaaaacccattttatcactttaaattattgggcaattaattgtatttacttagcattgaatgcatgattagaaatggaatttttaaaaaagcaatactcaagtggagtgagttcatttgttcattcagcaaataggacttgagtcccctactatgtgcggagccttaaaggatgagaaagatttctgggtgggacttcaatgagactcatttcgcaggttttcatgttattatgtatatgtggtaaataattaattttttcacaagtacttgcactagtgatgctaaaataagcttgactggcttgtaaatcaatgaaggttactgttgcattgctttgaaattgaatttaaaaacagaaacagagcagtccctttgcttccgaatgcagccctcccattggaatcactttggaagaatctggatctgcgtgttacccagtcttacttttcaggcagtcccaggcaggaaggcccattagtgaaaagagccctgcatatgctgtgggtcatcacagctgctgctttgcacatttaggagatatttgtggacctttcattaggacaatttttatggcccgagattaaaagttaaagttaagtagtaaacgtaatgaacatgtgcctttggagattccaactggtttgtattttcattctctccgttggtcatggcccattgaattttgatgatagcattaaaacaaatgcctcaaatcatttttggaaggagacaggatatgaattgacaaattaataaaataaattatacttcaaagatgctaaattatctcttctatgtaagtaggaggctctcttttcagatgtggaatttgtaggagcttgaatattctcaagagagggtatgggcaacatttgataaaagatgtaattattgggtcgtaggaaataatgattgagatagggtatccactgccctggtgggggaatcagtgaggctaggaatcactggaaaatgacattccttgagactccttcaatgggtagagtttgctttagcttttcatgtatcttactgtatgatggttgcttttgggttgaattccaccttgggttcaattcaacatgaaagttaaccttttggtgaaggaatgatccaggggaaatagtaaaatattagcctgtcctccaatacaaattgcctgtgagtcccactgatacttacaaatatacagaggtggtgtaaaaggattctgtgtcaaaactattaatatttgagaaatacaatacttatcagagcctttgtatgtaaatgtctcatatacccctctaagaaggggagcgaatagtattttccaaacttacgtcaccacttaccatccacctgcatactttacacgtcttggaatcaaccttacagggaacacttggtcgaaaaacagtgttttctaaatttatattacagttcccactccccccccccccacttgtatcactttgtatgacagtcttcttgggaacatccattgggaaactcttcccttgcaggtgtctgttacaagtcctggttcacacagtgttgcgaaagaatagttgtatgtcacaattttctttatatagtatttattgagaaacctattctgttaatagaatgactcaaaatcagccaaccccataaatactgctcaagcatttagaaagactttctctatagaggcttcagacgtcagaaaaaaacttagagagtgactttcagatacagcaacctagtctatgttatagaacattctaaaaagagcagattttaatatctttcctcccacacttgctttgactccctcctttagtaattagataattatgtataataagcacattaattatgtgcaacagctgccattgagtgtgtgcatgtacaactgcttgaaaacagcttgtgagttcactattaggtccatgaaatttttctccttggcaggttttcactattagtttgcttgacaaaggatagatacattttccatgtgtggaggtaaaagcagtgcagtgagctaaaaagttagcaaaggtgaagtggtcctaatctgcggccctggtacacttagataggcatcattgcctttcctctgagctcttggtgctgataacagcttccttgaccgataagtgtaccagatttccttacctgtcccagggcaagatagcaagagtttcttgatgcatttaaaaaatgcatttagtgttggcaaaaggctggcaatttattattaagtggaataagcagtttaaaaacagtatgtacagggtggttttctggctatataaacacacaggcattgaaaatagatatacataaataatgttactataatttgtctgcctcccttctctcagaaaagaccaatgaattatctattatgtgccactcactatttgagtgctgggaatacagccccataaagtgaagtttcatatatcaggtagcaagatggccatggtctgtgttttgagaatcacaggcgtttttgaggctcatggctataatcccagcacttggggaggccgaggcaggtggatcacctgaagtcaggacatcaagaccagtctggccagtgtggcaaaaccccacctctactaaaaatacaaaaaaaaattagctgaacctggtggttcacgcctgtaattgcagctactcaggaggctgaggcaggagaatcacttgaacccgggaggcggaggttacagtgaaccgagatcgtgtcactgcactccagcctaggcgacagagcgagaccctgtctcagaaacagaaaataaaacaaacaaaaaaatactattccatagctgactattttctgaaatgattttgttacttttctaatgagaaaaaaatagatctcgtgtgtggagggaattgaagatgtaatttcagactctgcgtacagctaagctcatcgtagttacttaactaacacttaaggaattaaatggcatatctgtgtttgagaggcacactgagatgagacaccagctctttttatttatttctaatggtttgcttggtgtactggtcatttccccggaagtgtgcaagaagaggtaggtgacttgcatgttgtctatgaacgtttttagaaacgtctggtggaaccatccgggcatcacatagctatctctgtgcagagccaggccggatgcctaggtgagatggaaagcttccgtcagctttcttgccggcctctcctcgcagccgctcccttccacacctgccttttcacctgccagactgcgcgttgcccgttgccctaggtctgcgtgttcagcacttctgcaacagtttcttctgcaaaggtaacttagcggagggtacagggtcttcttccaataagtcagcaccttcagttaaaaaaagcaataacattctccaatcttggcagtctggcaaggtagaaagacacctgaaggtgaacatctttggcccatgtgaaattttgttacgtgttgttaggtttcatttgtctctcagtcaatcagtcaatcaatcagtctctctccttccatccccccttgtcccccttttctcttctctccccttccctgctccctctctttaaggttttctcacagattaagagagtagcatgtgctcatcccaattattgaaaccgtgcaaatgaatagcaagaaaaatagttcttggcgtgcccctttctttccgcagtgcccaggccagaagtacctgctgcccaagaccacagctgacagcgccccgggagtccttcacactcttctctgagctcttccatccttaaacagacatctatgccaaatgcagggagggtttgctgttggcttttacaagaacactgtcctgttatgcctgctgctctttgcttggttttccctggacggtcacaaacatacctccaggtcaacagttaaagagagaacccacttcttctaatagttgtgtaatattccatactacagatattctgttatttatggtagctagatttctattcatttttaattcccatgctcagagctttccagacatttggaaacattttagaaaattgacatcatctcttcaaatatctgaactcagatttcctctgtgatgttggaatctttaaaatatcatgcatacttggcctgtttctacaattttgttccccagccatcgttctccattttgcacgtgtattgtctcctcctattcctctgtacccttcacacgtgcctgcagggtatatacttttgcacaggcaaaagtccagctgaaatgatccttacttagcataatttaaacgcgagggtttcctaatgctccttccatttaaataattcaaaaatccgtggcaaggtacctgaaaactactaagagaagagaggtgttaatggacacatcattgaggctgaagccaaactgtgtgattctgtctgcagttgagaactgtaagaaaaagatcaagattaacattattattattggtgttacctcatgtctgtacctttttggagacttgggtctgtttcccgagaaatcatttttcctcctccttgaaaatagtgaatttcaagtggttttaattttaactgcattatttgtttgctttatatagtttttaaagttttatgaaaaagtcttccatgtgttttttatttatgaaatcggggcagccatccttcaaatatgaagcaggtatctgagaatactaaaatcttacagtgcattttataggagtgtgaatgatttttctgcaattgacatatcaaggagcttatcatctattattaagttaccttttcctgaaacaaaatatttgtcagatgtaacttggtacccaaatgccttttcttgctaaactaggaactgtcacacacacccacccacccacccctttattcttggttctctcctatattttgacatttgaagcatccacagaaaagtaatagaatgagcaattgaaaatcaccagaactgaaattatttccagctatgtttaaatatgaatgtcttgttcgacgcttcgcatatgtatttatggctgtgtgatatcattatggcatcctaatgaatgtctactgaattatgtgggattcaacaggggatacaaatggatttgaattctgtaactgtcatattgtggtccggagagggtggaaactgaagtatccctctgcgtcgccacatctgtcaaaagtcctcagcgctccccgcaatccatgtctggtggaagcgcgaggtggtgaggatggaaagggcatgcgttgacttcatgttgggacgggtcttaaactaaacacatgtcacgttatggagctgtttaccttggctttgaggtttatttccttctggattaagagtgatgtcgttttatataacaagaagtgaaaaaaaaaaagaatgatgttacacaacctattttttttttttttttttttttttactctgaatgtgtaactttaaatgaagaaccaggacacctcatcctttagtcttttctttactagtgagtggcagatatgtgtggaccacagagatggactgaaaagagaagtaacagtccttggtttgtattccagcccccaccttcctatgtctttgagcttggtaattagatgcttggagcttcagtttccccatctgttggatcagaacggcagtatgtgctctccagtattttcataagagtcacatgaaatatgtacctacagagtctatcactgtgctttttaagttggggcttaatatgtggtagttgttgctgtttttgttattattattattaatgttattttttgtttgtttgttttttgagatggagtcttgctctgtcacccaggctgaagtgcagtggcgtgatctcaactcaccgcagcctccgcctcctgggatcaagtgattctcctgcctcagcctcccgagtagctgggactataggcacctggctaatttttgtattttatattagagatgggatttcaccatgttggccaggttggtcgtgaactcctgacctcaagtgatctgtccgcctcggcctcccaaattgctgggattacagacgtgagtgaccacgcctggcccataaatgttatctttatataacatactcacagctcccttaggagtacttttgtccatttctacacaatggaaacttataattttagccttagcaacatgtatttactgggcatctagatttcatttatttaagaactttttattgaatgccgattgttcagcagccaccatgcaaggtcctggggaaccagtgggcagccacacagagaaggtcccaatggcaccagaacaaggccagcttcctaggaggtgtctggcttcaagacagggatttcctttagctgggtggtagagaaatggattgcctgtgatttcactgtgcataaaatgacctttcagcccttaacctgcgacatccacatgtgttctttggtactcacgggtgttatggttcatagctgtggtcttctgaagtataggaaaaggcagcttacagaaaaaaacttgcttgtttactgtcttctgagctgatttctcacctactggcaagtggataggtctagtttttgtttagctgtttttctaatttaatcttatacatgagacagctatagatggatgtatagtctttgaagtggggccagttggctccgtctattagctgtgtggcttttgtgcaggtgacttgtggcccccggcctcagggatctcatctctaaaacgaggctcttgatgttacctgccttacccagctgtgaagattaaaagggttttgtgtgttaaaggacttgcggagtgcctagaacccaatgagggccacagagcttgctccgattgctttcctgaaggcagtaagcatgttgctctggtaatagtcatcttcacggccatcattttgatcacattttggcttagtttcttcctctaccctcttcccacgtcagacctttccatggaaggtaaaacatgttaacagtctaatgtgtttccttctaatttttttcttcatttatattatacatctatgaaatatatatatatatattacatatggatatatagacatacacagatgcatatttagggtgtgctatggttagaaagtttgcatccccccaaaattcacaggttaaaatcctaatcctcaaggtcgtgacggtactacaaagcaggacctttaggacatgataaggtcctgggggcggagggtactaatccccatgaatgggtttagtgcctttataaaacagacccaagagagaccgttatccattttaccatgtgaggagcccacaagcaggtgccatctatgagccagagtggacccttacccaacaccacatctactggcccctttatcttgaacttccagcccccagaactgtgagaaataaatttgttactcataagccacctaagttatactattttgggatcgcagcgtgaatggactaaaggtttttgagattcttttttcagtagtttcacctaataaaacatggaatcattctacgcatgctgttctgtattgtagtatggttttccacactgagaacatactgtgaccatgcagtcatttcccagatggaacttattgagggacattcacttagtttcgaaaggtttctccctccactcccatcccggccacagatagtgatgcaataacatccttgttcgcatgtccagtctgaagcttttattcctatgggatgagttcccaggcataggattgccaggctggactctaaattttgaaaatggatttttatcattctgatggattacggtgaagagagccaaagtcttgatagaaacactcaacgcagtgaattttttagatgtaaaagtggatggtacttaaggatacgcacattagaaggagtaatttgaccagcccatcacagtattaattgattttcatgtctcgaagacttctgatttcgttttcgaggctggaaaggcaggtggaaagcccatcagttttacacacatattttgcagacaagtattagaaagtaactagcctgcttttactaatggttctgtggaagaaacacagcttgaataaatgtcgtcttggatgctcagcacagattggcagtggatgtcaggattgtctggtgggaaggctgctgggactcactctagactgggagtggggtggggtggggcagggcaggacggccctggctgattaataatgtttgttatgaagtctagggtacgtggggagagcttcatgaatccctgcattggccacccctgtaccacggccaatgattcaccctccctaaatcccagggccagatattagaacatctgtgatgaggactgattttctgttcgtggcctctggaagtccagtttttctgagctcaggggagccttggttgtatcttataggcaagagacgaatttacattttgccatggtgttaacaagcaaaagaagacaaaagagctcaaaatagacagtggcgtgctggggtcaggggtgctggtcaccagggcgagcagttatgggtgaagggctgaatttgcagggtcaaggagattgcctccaggccccttctggaaacacactccctgagccttgtagaattgagttgattctgtttaactgcccagtgaagaaatgacttccttgctttaaaacatttgacagctgtcttatataacttaattcttcattccagtggcttttggagcagcctcaaaagtcattttatcttcttggctctttgatattatttgtagtaatttatttaaagtaattagagacgggatcttgctgtgttgcccaggctggtctctaactcctggcctcaagtgatcctcccacctcagcctcccaaagtgctggaaataaggtatgagccaccaagcctagccttgatattattttttaatgggggtgtgtgggtgggtggtgatggggatattccagcagaatatcagaaacagagatgaggaaggcagagagagctcaaagacaaggctcaagttcatattccaacgccagtacctgccacctgtgtgaagctgggctaattatgtgtttaggtttcctccttcgttaaatagagttctacttatattacagggttgtcatgcaagttgatgaattaaatacgctaatatatataaattctgagtaagtattaaccaaagaaatggaacatcaatattggttcccagtctagttcacaggtgttatcaagatggttacctttctaagtgtctttttatttcactagttccaaaagagtatctctcaaaatattaggtagtatttagtcaacactttaacacataacttgtttttttttttggcataagaagcccatgtgaaaacacagttgaccctaagcctatgaaaaatgacttgtgtgtgggactggggtggctcataggagaaggaggatattcgtctggatttttactggtatgtatatatttttgggtactggagatggggacagtgagtatttgaagctcacagcaggcccattttgcaagttttcaggaaactgaaattcagagagattaagtattttgccatgaatcactttgtagtaagtgggagagctgttgcaaacccacgtctgtctacatccacagcctgtgctcttttcatatacaagggaatatggaggagaagggaagtgatggaaggctttaaaaaaaaaaaaaaaaaacttcagaagctgatttgagatttattcatctttggtgtactttctttactaaggcaggttgtagactcatgaaacctagaaggagttgaaaaataagggttaggattaaaaaaaaaaactagtgaaatcaagacaccattttgcttaattgaaggcttgcggaacattaaagcacaacaaaaacctaattctttgagtgtttctgaggccaagccttttcccacaaggcactgtgtacacggttctggaagctctcctctgtttgcacagtagtcactcatcctgctctcgggctctgcctgcagtctcttcctctgtctccgatgtcactcttctctgtcttcttcagaagctgtcatatgacctccagatttctctttgactccctgtattaccattagaagacatctacactgggaaattgctcagttcctgtttttgattaatattttatcagccgcaagaggaaatggtattctatagcaacactaataagtaattgagcagatgagatgctcttgctagctttggtaaaaagtcggggcaaggttacaacagaggagctctgatgagacttgggatgataaagtcaagtcgaatatctggtagggttaaaaatctaacagtgggccaggcgcagtggctcacgcctgtaatcacggcactttgggaggccaaggcaggtggatcactcgaggtcaggagtttgagaccagcctggccaacatggtaaaatcccgtctccactaaaaatacaaaaattagccaggcatggtggcatgtgcctgtaatcccagctacctgggaggctgaggcaggagaattgtttgaagctgggaggcggaggttgcagtgagctgagatcgtgccactgccctccagtctgggtgacagagtgaaacccatcccccaaaaaaataaataaataaaaattaaaaaacctaacactggtacgagaagaaattatgctctaaatccttctttgagcagtggcttacagacctaaatttatcaaaggtggtggcagtaatagtaataattaccatcttcatttaaaggcacgtatctaaaccaaaggacctaaataaaatattaatttttcatagtgtttaatatgtgccagtatatataaattcaaggtaaggtagacagctgtaaactggatcccctgctgtacccagcaaatgctgagagccctgcttcccctcttgtattcaaatggctctataagagaggaagtagtacagctatcagtaacaatgccatccggtaattaccgaatcataaatgtttggggagctgaaggtcacgggcttagtagcaattctagtctgatgtttgattccttgtgaattttaaatgcttgtactctctatctgggtgatggtgttttagttgccagtggacagtctgatggaggtgggggaagagttattcttccatatttatttttctccaccttgggtgaaaaaacttcgcttttcgtaatgtggtacagtgtgtgcttctgtaaatggaaatggtttcagcacatcacagtcatgcttccctgttgaaagatgctccgttttcccgcatacatgatgtccagcacaacgtctgatttatgagagcatgaccctgggggcctctggaacagctgctcacacactccctttaggaggcccaggctctcaggggaggcccatagtgcagctaggagctagagttttaggatgaagaaattacaggtaagaacacagccccattttaagaaataccagtgatttctgtttttccttgttcttctttccctcagtattttattaacatgtgctactatacaaatacacaattcacttaggactctgtttcgtgtggatcacatgggagctttcattaaattgtggtgattccaatgtgagtggttatcaagtcaacatcaaataacatgaagtgtgttttagtcggcaaacatcactttgtaattctctgatgtgtttgggttgattcccttctttctgctctttttctctttataaagtaaacatttttattgcaaaggtactgctattgttagtttctaaaggcacttgtcatggtgtgactaatattagaagcagacacagccatgatgagcaatactctttttttgtttatttttgttgttactgctgtaagccactttcttctccctctccattaaaatgcaacttaattggtaaagtttagttgactagagatttcatttatttatttatttatttgtttatttatttatttatttatttgtttgtttgagatgagtcttgctcttttgcccaagctggagtgcagtggcatgatctcggctcactgcagcctctgcctcccgtgtccaagtgattcttctacctcagcctcccgagtagctgggattacagttgtgcaccaccaggctctgctaatttttatatttttagtaaagacggggtttcaccatgttggccaaactggtctcaaactcctgacctcgtgatccacccgcctcagcctcccaaagtacttggattaaaggtgtgagccaccgcgcccagcctgtatttatctttttaagtaacaaagtattagcattgtgataaataatatttaatatatagtaagggaggtcaaagtatgaactattttgattttttatgggttttttttttttttttaaagaatgcgttgattttgtttttctttcttttttttttttttttttgaggcaggccttaggtctggcacccaggctggagtgcagtgacgtgatcaaggctcactgcagcttccacctcctgggctcaagcaatcttcgtgtttcagcctcctgagtagctggaattacgggctcatgccaccacacttggctacttgtttaattttttgcagacatagggcctcactatgttgcccaaactggcctcaaattcctagcttcaagcggtcctcctgccttggtctctccaagtgctgggattataggcatgagccactatgcccagccaaattttgtttttcttttctttttttttttttttttttgaaatggagtcttgccctgtcccccaggctggtgtgcagtggcatgatctcggctcactgcaagctctgcctcctaggctcatgccattgtcctccctcagcctcctgagtagctgggactgcaggcgccagccaccacgcccggctaattttttatatttttagtagagacggggtttcaccatgctaaccaggatggtctcgatctcctgacctcgtgatccaccagccttggcctcccaaagtgctgggattacaggcattagccaccacacccggcccagattttcttataaagtcaaatgggagatacttgtttgcaggaaatagttcttttggttcttacttttccataaggattgagtctcaaaatgtctggtagcatccactgcattttgtaggggacaataacaaagaagatgccagcaatatcttctatcttttccaacattattcacctctcccacccaaggacaatggtgggctggacagagcattcaatgaccgagaatctaccataagctactagggccacatcttcccctttcttctcccccaggtttgtcccatttgtactgactctgacccaggttgtcatgacttgagactcactagaagtttcagaaagatgcacactgctttaaaaaaaaaaaaaaaaagggcaaggggaggtgtgagaagaaagtataattctttttcttctaacgggagatataaaaatcatataagcatgatttatcatttgattggaacattgtattttatggttgcagagcacatgtatcatcctatctgcttctgacacccagtaagcagctctggcttttataattttgatgaaagaggtttcctaacagtatttcggtgtgcatgctcacacaccagccctggtcatcagtgaacagattcttccaggtcttcattgtagcggaagaaagtgagatcagagatcccgaggaagggcttcagtttcaccagtagtggagctagggagtagcggggcagaagccgcaggaagtcagtgcaggacgccggaggccactcctaattgcttcatgtgttgttgccgtgctgatgaccttggaggcgctgctggtcctggatccttgcgaccttttcttccaagaggaaatgtggtgctgagccccccttccactggctgtgacaaagaaggacccctcatgtgggggcctaattctagtgaatccccaaaggtacatgttgaaatagggaaaaggcccaggtgaggctgtctatgtaatagagaagatccattgcaaaatgaaaatatggggttctagccaggggcagggaacttaatctcccttttccatgggcccaacacctgaatctagggcaaacaggtgtcccccagattggatcctctgctctaggacacattcttgtcctagagcgggttgggcaagaggcttttctctcagtcaccagccccaaaccctgtggtcttgccagcccaggacgtgtcaagactgcagcctttgctgacctgtgaccatctccaagtccatgcccaggcccctactaggagttgagggcaacaggggcagtgggtctctcctgcttaggaaatttgggttgagggtggcagtgatcttgaggggggtctgggagggaggagccagcctggcctggtctggcctggcccagtgtgccagcgagggcaggtgcaatggctcacgcctataatcccagcactttgggaggccgaggcaggtggatcacctgaggtcaggagttcaagaccagcctgaccaacatggtgaaaccccatctctactaacaatacaaaattagctgggtgtggtgatgcacacctgtaatccctgctacacaggaagctgaggcaggagaatcgcttgaacccaggaggtgaggttgtggtgagccgagatcatgccattgcactccagcctgggcaaaaagagcggggtaaaaaaacaacaaaaaaatgatgtaggaatgaacagatgaacaaccccacacaacctaaggacgactttgaatcaattcttctaagctggtagcagaagccacctttccatttgacttgtatctcgctctttttttctttcttttttttttttttggagacagagtctcactctgttgcctagactagagtgcagtggtatgatctcagctcactgccacctctgcctcctgtaatcaagagattttcctgccttgggcccctgagtagctgggactataggcatccaccatcacacctggctaatttttgtattttttgtagaggtggagtttcgccatgttggccaggctggtcttgaattcctgacttcaagtgatgagactgcctcagccagccaaagtgctgggattacaggcatgagccatcgcgcccagccagacttgtatctcttaatgagtttaactacatttaaccatgtatgtgtcagtcctactatgcaccttacagctcactaaccctgtttaataatgtatgttgttacatttaatctttatggtagcctcatgaacaggttcttgatcaggagtgatattgcctgccagggaatgcatgtcaatatctggagacatctggggttgtcagttcaggagggtagaggataggggggaaaaggtgctactggcatctagtgggcaaaggccagggatagtgctaaggatcctgcagtgcaaaggaccatgcccaccacaaaatatcagcagtgcccaggttgggaagctctgtgccattgtgcaaagattcaaggtggctatgtcacaggactggtacatgtcctttttttttttttttttttttttttgagacggagtcttgctctgtcgcccaggctggagtgcagtggcgtaatctcggctcactgcaagttctgcctcctgggttcgtgccattctcctgcctcagcctcccgagtagctgggactacaggtgcccgccaccacacctggctaattttttttttttttttttttttgcatttttagtcgagacagggtttcaccgtgttagccaggatggtctcggtctgctgatctcgtaatccgcccacctcggcctcacaaagtgctgggattacagacatgagccaccacacccgccctacatgggtattctaacccagtctagtgatagtccaacctcctgtactatgagtaattagcaaagaattaacagcagaagatcgctctcaccaaagcccatccagaaagtggctcgtattcaaggtgctaattagggtgttttgttgccagtaaaaacatgagtcagatttcatgattgattcatgatgactttaaaattaatgctgctgttatcatacaaagtagtggtaagtggaggtaagagaatgtttttgctttggggtactaagtcatcgttataataaacacacagtaaacccatttatctcaggcttaatgctttcttgtttcttctaagcacttcttaggtgcctctgggctttttaacattctttggcagttgtaatttattaattgatttttaaatttggccggtgaaaatgaactttaggtaggggtttgaggaaaatgaaaaggcctatttgtttttcagtggctggttcttcgtgttcagcattaaggattggtagaaatcaggcaacctctatgtaacctcagccatcttggattcccagcttactcacatcatagatggagagtcagttgtttagaaaaaaactttcttttttttttctttcctttttcttttcttttctttctttctttcttttttttttttagggagggtctggctgtattgcccaggccggagtacagtggcacgatcttggcttactatagccttgacctctctggctccagtgatcctcccacctcagcctcctgagtcactgggactacaggtgcacactaccatgcccagctaagtttgttcattttttgtagatacagggtctgactgtattgcccaggctggtcttgaactcctggcctcaaaggatcctcccacctcagcctcccaaaatgccgagattatgggtatgagctactgtacccgaccaagaactttctattatatagattttaattaaaaacagtcctgttgagtggcctctttatcaaatgcattctcacataacctcatagaagtgagccctcttactgaattatgtggctggggttcttgggtatgttttgttctattttctggttggtggttttctttctgtcgggtcccgtgggctctttctggacctcttctcagaatgtttttcgttttttttattttttgagatggagtcttgcactgtgtcctgggctggaatgcaatggcaagatccctgctcactgcaacctccgcctctcgagttcaagcgattcttctgcctcagcctcctgagtagctgggattacaggtgcatgccatcacacctggcaattttttttttatttttagtagagatggggtttcaccgtgttaggcaggatggtctcgatctcctgacctcgtgatccacccacctcggcctcccaaagtgctgggattataggtgtgagccaccatgcccagccctcagagtgttttaaaatgcatactattaaatacctaggattataaagggagccagctatacttacatatagttctctctgtgaccctgtagaatgcactgaagcaaaaataacaggtaatgctaatcataaagttttacaaatctcctgaagagtcttgttggtttccgtgttgatgaagcaggaaatttccctgacccctttgcaggcaggaagtggagtgcggatgctggaactagctggctgctttggtgccagtagaggtgaactgcactcacttgaaccccctgcactccaccccttctgggaggaagcatgcaggtgagcaggtgcaggagccagggtaaatgcttttgggcactggcaggaatgaactctgtactggccctgggatagcatctggcaggggatgcccgtgacccctgaaaccctaaaaggagtgttacagtcagtgctcttttagttttgccatccacggacggcttaagtgttaacagttcagtggagggtcagcgtgacagccttttgcacccacatctgggttcttgtccagtgtccaggaggaacgaggtctcatgagcaaattttaaggatggcagatgtgggggattttattgctgatgaaagtggctttcactgggaagataagctaaaaagaagacaaagcaggaaggtaattttcccctggagctatgccatcaagctgttcttctgaagtccagccgcttctctccaactgtggtctctaatttccagctgcttctcctcttttcttcaatgtgccagcggagcctggggtttttatgggtacaggattgggggcaggccgggccatgggtggttgtggaaaaggcaatatttgagtggaaaaacagggatatatgttctcactttgggccacagttccaggcttgaggatggggccctcaccacggacctgccctcttctgcccagaatttccctgcctcctgtccctatcattgatacctgcaattctttgtacatatgaaatttaatatggtgagattggcatctagctgctgctagagatagtgctcataataatttttaacattgattgagtgtggataataatccaggagctgtgctaaacgttttacaacacattatctcacttaatttcacaactccataaagtagttttcacttagttgagggatgaaaaaagttaggctctgagaattgatattactctgcaaatatggaattggaatttcaaagcaatctatggtctttatcacttctccattaactgtccttgttttattaatgctgattactttttgatttggtttggttctttggagttgtttgcatttcatgagtcttggcatctttttggtagagaaccttgctaggttctcacaatgtagaaattaagcagaaaacagaggtctcaatttgccttttcagcgtgaatgcagactcttacattcagtgctgggagtctttcttgagggacagtgagagcgaggaagggtttccattctccgagatggatggttgcattagtatttatttcctttttgtttttccttaggatgagaaagaaggcagtggagcccttttccttaggttagaatggttctgttggttgaattgtgcaccctgtttggttgaaacaattggacagtaaggatgtgactattattgttgctctctaatactttattatgtcataccaaaaattatcttttgtattttgctaccagttcttttagtttctcttacatgtatgaagttggatagttagaatgagatgaaaataaatgggctgggcgtggtggctcatgactgtaatcccagcactttgggagtctgaggcaggtgaatcacttgaggtcaggagttcgagactagcctggccaacatggtgaaaccctgtctctactaaaaatacaaaaatttttttgtattttgggattcggtttaggtgatgtgtgtctgtaatcccagctacttgggaggctgagacaggagaatcacttgaactccagaggcagaggttgtagtgagccaaacttgcacaactgaactccagcctgggcgacagaggaagactctgtctcaaaataaacaaacaaataaataaataaaaattgtttaaacctgccaactacaataactttttcagtctctttctccctttcccaccttcccaaaagggtgggaaatttttaaagtaaagtaataaacaaataagttttgggttgggcgggagattagttagagacaggatctgtaggtcagaagtggtatttgggggagtagggagttttttttttttttctttttcccttatgcatttgggagtggaagagctgtcagattctgaatttagttagatttataatgctagagacattcagcagtctgcctttccctttctgttataaaatcatgtttttattgaattacattttaatattggtatcactttaaaatgaaaatgagtacttgcaaaatgtatttttgaaggagttgggtggtggtggggggatgccattttggcaacagatgacttcggttcaagtcctctctctgtctcttacttgctttgtggctttagaccagccacccactcagagccttgaaatcctcatctttgaaatgaccatagtaagttcctgcctaggctctcccctgaagctgaaatgcatgaacatgctttgtaattttttttaaggattgatactagctagggtgttgataagaaacagcaggcatagttactgggtgattgagaagagtttaacaaaagactgtattagtctgttttcatgctactgataaaggcatacccaatactaggtcatttacaaaagaaaaaggtttattggacttacagttccttgtggctggggaggcgacacagtgatggcagaaggtgaaaggcacatctcacatggcagcaggcaagaaagaacttgtgtagggaaactctcccttatgataccgtcagattccttgagacttatttgctattgtgagaacaccttgggaaagacctgcctccatgattcagttacctcccacctggtccctcctgcaacatgtgggaattcaagaagagatttgggtgggtacacagccaaaccatatcaaaaaccatttataaaactctaagcagccttaaaggaaaccaccaagggaccaaggcctgatgaagcaagagtaggagggaacagatgcttggatagggcaggtgagtcacaggctgatgggagctgccaccgtcagtagaggtcctgatgacctgggagggtgggagccagacagatgggagtatcctagcctcagttcctttccatcctcagaactcctcccagtgcctctcaatggctaaaccaaccaaaggttggagctcaaggaagctcctgaggctatctttacaggtcagccagttgggaacagagttgacggagaggggacaggaggtgactagatttggaaggaaaattagaaaacttttggccgggcatggtggctcatgcctgtaatcccagcacttttgggtcagttgagtctaacataggggtgtccaaacttttggcttccctgggccacattggaagaaaaagaattgtctttggctgcacataatatacaattgttgatgagctaaaaaaaaaaaaaatccccaaaaaatctcataatgttttaagaaagtttatgaatttgtgttgggccagattcaaagttgtcctgggccgcatgtggcccaccagctatggtttggacaagcttagtctacaggttcttcaagaggggcttgagcatttgaaagacttctagtgggagagatcacaaggtacaactagaaaatcctgggctggcctgagaggcagacctgtgattattttgctctttgaaagttgtccttctgcacccattttccccagacctaacctcgatttgtgctccaggtctgagcagaaatgttattccctccagaaagccttccctggatgttgagggatgaagttgtaggcccctcccgaatgcgtcctcagaactcgctggttctcgtcctcgccctcagcatacttgctcattgtttgtttccatctctatcatctctgtgagccctttgaggatggatgtgtgtccatcttgttaacagttggctccccagtaaccagtacagtgccagatacagagtagtaaccctacattctagcgtaggcaaatattctagtatttgccaaaactagaggatgaatgagtgatgggtaagagagttctcagaaaaatggatataaacaatattgtaaatcatatttggaaaataaatattagaatcattgaatccctgagttatagaaaaatttattaatagcgctatctggctactttttaaagtgtggacatcctcgatgtattagctatgcatctgtggataggaggcttacccactctgagtcttgtcaaataccaaacacaggaaaacaatatcttcctgagaatgttgtgaagaatatatcatccagtcagagtgaatcagcttgcccagtgcttggcatatagctgctcaagaaatattaggcattctttgttattataaatcccctttgtattttaaaatcctcatgtatcactgaaacaaccaactgaaaaccattgagaggctcatggtgaaagaagacagacagtgtaatttccctggaaactcaattttgattcagacgtccacagcatctcatttctgcctttaaaaaatttcaagagtgacattttggcatgactggactcacaggtggagaaggtatgacaaacattctggaaatcttggaaggtgaaatatagggaagatggcccctatggaggttcattgtcccccaccttattctaaataatgactttcttaaaactacatgttttgggggaatgtcctgcaatattgctttacatctttttatttttttatttcattttattttttttgagacagagtctctgtctccaggctggagtgcagtggcacaatctcagctcactgcaacctccacctcccgggttcaagcgattccactgccctgatcagcttcctgagtagctgggactacaggtgcgcgctatcatgcctggctaattttttgtattttagtagagactgggttccaccatggtggccgggatggtctcgatgtccttacctcatgatctgttcgtctcagcctcccaaagtgctgggatgacaggcatgagccaccgcacgcagcgtattgctttatattttaagactatacactgatatccccgagcacccaagttcctgtccgctggtagaattcacaaagctggttttatgtctccttctcttcctcttccagtgttgtcttttccctgcattgagatagcattgcatggagatccttgtactcttcgaacagaggctgcagatggacacaggatctgctcagggagataagatcacctgctaattctgctttctccatcagagtctgaatgatcagtgatggggaccagagctaggttaggtctctggaaacgccctctgtctgagtccgggagatggatgatatgggtaatgacttgctgctttatcttctctccatctccttacagcagctccaactactgacttttattgtgtggcagctaattgtaggattctatttctgtaaagagaaggcaagagaggaatgcagtgtccaccatccctgcagccctttggcgccttccccctcccattaccttgaagtagagggaaaggggacgacagaagaacccttagaagtaagactttttctgtctctgatgccacggacctttgaaatatttttttgaaaagaaggcctcccttggctgataccttctgactgttagtgaataaaggaagtttaaacaatctcttccctgtaatcattaatctcgtcttctttgttacaatgtatgttgtggtctttgttacaatgtatgttcacgaattcctagaacactgttcccgttggccatgggatcaggggaagagagaaggaagagagaaccagacacaagttggagggaatccatctccagtgctgctcagaggtatgacctagagcaaggggtttaggctttcttggactcattttcctcggtggtgaagtggggataatttattgacagtggaccgtgaggttctgcgcacaaaattcgttgcatagcacctgatacacacaaagctttcaggcaaggttagtttcgggtatttccagccttagtcttggctgtgggagccataatggagttgttcagaagtttacagctagtgtttataaattgcttgccatggggccttgtatacagtaagcattcattaagtgttccctcctattatatccttaggtttaagatacaggcaccacaacataaaccacccccagagtacacatgcatgggtgtaatttggtgccattctcctcccttttgcccccaccaaaatgaagtttttagtgtaaatgtcatgtagattttaaccaaaggttgattggagggtctgagtttctcagctaaatgaaggcatgaggactgtatccctcctgaagggtgtgatcagttccatgagaaagaagctgcgagctgtggggcatccaagataatgtaatctgccccggggtcctgtgagggactggccgacaaggcaggctgaatgcagccttgcccactgagctgggttctctctgctttaggtcctctctggaggtgaagagggaagtccgctgattgtttttctcttggtgcaacttcgcaccacccttacatatcccagtgtatatggtagccaaggacagtactgtttgagcctcccccattaagtgtcaacattgaatcaatgcaatcccatgcaaagaaagctgagcatgggattgtgccggtttagccagctaaagtgtggtctctgatgctgatcatgactatgaaaagggaaaatggaggagaatgatgacgaaggaggaggaggaggaaaaggtgacttgcctctagctgatgtggattatttctcttttttaatttccatgtctgtgtagcttcatcatagatctcagcttaaggacaatgaaagtcgtttattgagtacttagtatgtgctggttgcagagccaagtcttttttttttttttttttttcctccttttttgagagagagagtctcactctgtcacccagactggattgcagtggcacaatctcaactgactgcaacgtgcacctctcaggttcaagcaattatcaggcctcaacgtcctgagaagctgggactacaggcatgtaccaccacactcagctaatatttgtatttttagtagaggcggggttttgccatgttgtccaggctggtcttgaacacctgacctcaggtgatctgcctgcctcagcctcccaaagtgctgggattacaggggtgacccaccacacccagccagagtcaagtatttcaagtattagagttgtctgcctgcctccctgtctccctgccttccttccatctgtttgttatctgacttaatctttgaaataacccaatgatacatgatatgcattttctaggtagatagatgaagggttaggaagatgtaacttgtcctaaatcacgtgtcttctaagcggtggaactgattttctcactgactatagatgttgagcccattaatgtgatacctactgccttttaattttaaaagttctcattgttttatcgttttcatcattatcatatgatttacctcttctcttgtgtcttataatccgattggtcatgctgacatactaaaccatattgtttgccactgggaaccaattcatctgtgaaaagtcatacagataggctcgaagaaagagcttggttgtgatgttgttgttgtgacaactgtctcgggggctggagttagagccagggtcccagctgccacagttcatgtaggggtagaccagtgcttccttttgggtgatgaggaagctggatttggcagctggttttgtctggatttgaaagggaggtaatcaggggtgtgctgggagggccagaacgatccacccacgtgttggtgccacccggcagtggaaaagcctctggcctcggccttctccggaaggttgtccgcggtgccagtgagagctgcttttcaccttacagcagccccggcctatctctcaggaggcctgctgataatcagtaaatgaaattcacctttccccgattcttgaaaacggaaaagatgagggttgaattatagggcaaatcatgaacactgtcttttttccagcatggtattttgagcggcacagaagggggtaattattttatttggaagaacaaatttaagtttggcagttacctgaaagaaaatttagtgattgccagtccattctctagccttctgaagaagatagattgtaatctttaattaagctatcactcacaccaaaaaaaaaaaaaaaaaaaaaaaaaaaagcggggcaaggggttggagaatgttcatatcacattattttggatgtctggggttgcacctggaagctcagatagcaatatctaggcacggctgccagcgctctatacattgacgtttgtttaatattttaatttccccatgagtcttaaacctctgcgtggtgtgcaagttgaggcctggtgtatgcacttcggccacgggctttcccactgtaatgaagatggaatgactccatggatgacctttccgtgcctttgtctgtagcctgccctcctctttaactgaacaccttccagacgagcatgctctgaactcctgaactgctcattctgttctctgagagaattgctcaagctgcagtttatcattatatgcctccaaagactttgtgtttcctatgtttgacatcgagatagaatttttcataaccctttactagtaataaatttgattgttaagggaccaggttaatcttatttctaataccagcatctgattttaaaaccctgatttaggagcattttctttctgctaccttcctaaaacgcatgggtggaaatgtataaaatatgtcacctgatattggaggattgtttatttctgttcatttggtcctgaatagtacctatgagatgcatttgaaaacttaccttgtttatatgtttcttctgttgcaatttcttccattacctggaatagctgctttggacggcaaaccaagcaatgccctttcacagctgtgggatgaatggggaaagaagtcttggtaaggaagcaattcagagaacatggaagcatctcatggcagcagtcacaattttgtgttgcgtaatatttcaggaacttgcaaccctgataacttgtgcctgcctgtctgtaggcctttaatgatgttttattgaattttggttttcccctagactttgcagtgcatgacacatagtaattgctcaataaatatgtgttcaactgaactatggtggttaggttagtaattagatgcacagacaaaatcacaggaatctgcgtgagccttgtcctactggtaaaggagtcttgtgaggattaattgaaataactcgcaaaaatatccagctctctgtttccctgctaggggctcttgtcataggagccattgttgtagccttagaaaacatacagcattattttagggggagaggttagagtagaattttaaagagtgcatttctcttccagtaagcaattctgcatcgataaaaagtggagaaagaataagtgaaaaaatatttagttaattcttgttgacagaagtaggacttcaggtccacatatatttcattgtagagtgcacacatgcatttttaagaatttcccgattctcttccacgtgtggacagattggcacatatgtgtgtgtgcaaattgtacttgcagtggctgcctgggaaatgaaatttctgcaccttgccagagcatgttttccctctaaagagaggcagctcataattagtaatgctaatgtcggggtgagatgcaatagataatctaacaccagcaatgatgcccagagcatttatctttgatgctgggaatgcgttcattttctttatcttgccattactgtacctctattgggaaatttactctctcttcatagataggatcagatccagtacatatttataaaaccacacttacatttaaatacaggcctttcccatttcacagtgtttctagctcccctttccaatacatctctctctctctttctctctctctctctctctctctcacacacacacacacacacacacacacagccaaatcagacaccaatataaactgtagagttaacattctttttccaccctcacactttttttagctccgatctgtgttcaatttctgcctgagagagtgatatattcatatatttaggtatagttagaaaaagcaaaatggtaacaatagaatcttgatgggattgatctcctgcagcaaggagcaacagaaaaaaaaaaaaatggaatcaagaacccaggtgctttttataggttaattgtgcagggttatcatgtatctctttaaaatcaccatcttgattctgagctttggttctacacattagaattgttgcctgggcctggatttttccccttgcatgttgcgtgtggtagtccagcacatttgctgattgcaaatatacttgtctcttctcatgggcattactagtactcaggaaatcattgatgtggggtaaaatgagaaaaggattagttttattttggacagataaacaacatgtcattttaccaattgctcattaatgctgatatttcccgtgggtctctgactctgaaatctgcatggagtggttacaccctgggcttgttagctcctacctgagctctgagtttctgtggatttctataggctcctgcaaattttatctagtggatattttgttaaaaaaaaaaaatggggtctcattctgttgccccggctgcagtgcagtgacatgatcataactcatggtgacctcaaattcatgagcccaagcgatcttcccacctcagcctgagtagatgggactacaggcatgtgtcaccatgccaggctaatgtttaaaaatttttcttagaggtagagcctcactttgctgcctaggctgatctagaactcctggcttcaagtgatcctcctgccttgagctcccgaagcgctgggaccaatagagatttctctgagaattaggtcccccactattaataaggtcattgtcagctgagttggggaggtggcgtgggtagatacaattaatttagattttttaaaaggcttttgagaatattcggagaacctaatatattttgagacctgacatttattttaaacgtgaaaagcaatttacaaaattgcacatactctataaatacacttctgttataaaaatagacacgtacggccgggcgcggtggctcacgcctgtaatcccagcactctgggaggccgaggcgggcggatcacgaggtcaggagatcgagaccatcccggctaaaacggtgaaaccccgtctctactaaaaatacaaaaaattagccgggcgtagtggcgggcacctgtagtcccagctacttgggaggctgaggcaggagaatggcgtgaacccgggaggcggagcttgcagtgagccgagagcccgccactgcactccagcctgggcgacagagcgagactccgtctcaaaaaaaaaaaaaaaaaaaaaaaaaaaaaaaaagacacgtacacagacaaatgttctgacagaaatacactgagatatctacagtgcttgtctctggataggatagggtataatttaattgtttatagttaagttaatgaacttggccagacagacctgggatcaaatcccgcctctatcatgaattggctgtgaggtgtgacattgaaaaagtgatttagcctttgttcccctccaggtccttatctgtaaggtggcagttacaataatacccacctcccagggttatatgtcaatgggttaggcacagacctaggaactcagcaaatggactactatgaagtattagctttttactgtttctggttttctgatttttgtctcctgttgtgaacatacgttgcttttgtaatatgaaaaataaaaaataaaagttaaatttgttttgtttgtaagaatcagttgaggacagatgggactatttgcatggattggtgtcatgtttgaagtcagttaccagagggtttctttcaacagagtataccaaaaaaaaaaaaaaaaaaaaaaaaaaaagtaaattgcacagaccccagcttaggacctggacttaatcttcatgatgtttgtaaagtaatacttcttggagaaacctcccaaatttctatcgacactagacatctcaggatttgaaatgttaagctaacagaaattgttcatcaggtgtatctccagccctccgtaaacactgccggatggatgaacctacgtaatgatctcctggtgccattttcctgactgtagatacttgggtaaggaggagactttgactctagatgacatgatgtaccctgtgttctgcaagctggagaacatcatgtagaatctgaaaattaggagagagaggcaatcagaagaagacagagtggtgttgcagggacctgcagtcagcctagtcccccagtttgcgtttgaatttggtcccagattttttttgtttttgttttttagtagttaaagctgagagcaaaccacattgcttactattgtcagggaatgaaaactatgcaacagaagccgatgtgcagaggtgaccgtgttcgctggaattgaacttaagcaggttcctaccgcacagatccacacaggagggattgcgtaatgcacccagcagagttgtgctcaactgtgattttataaaagacacagaaacacatattaaatagacaattcttctatcagccctctaaactggcataaccttgaatcataattcaatgaatgcatttctgtgagaagtgaaggtaataagctccaagtgctttcgtttcctttctttctttcttaatgcagggaaaattgagatgggattctcagttaaaacccaaacgacgggcctgggggttgtcacaatgtgatccctgaggatgttagccccaatgtctttctgtagccagaaccaatagaaaaatgagaggaggagagtagaagcagaatagcaaacaatttttcctttcatggtctacctgtgtgactgtgtatatgtccagaaggggatgtggttggggaagggcatagtacacatatttgagcagagtacatgtgtttcatttcttgctcatacgacatgtccagtgtgggctggcatgttcttctgcacagtccctgagggacccggacttatagagtctgtgatctcacagctgctacatctggcacagatggccttcttgatctccagttagggcgagtcacaacagcaattaaatggtttggtctgaagtgtcacgagtcgtttcctcttggctgcctactggctaggccagtcacgtggccctgaagagggtgggaatgtctcatccccctgtgggcttagaagaaaaccagaggtctgtgcacactatggatttttactacaatgatgccctttcacatacagcgagaaggattaagaggtactgtattgttggttgataaagtcaaacttgtgaacagagcaaaagggcattgcttggtcattgcagcttccacccatgcaccttacacagaagtttgggccctaacatggaaacttttcaacactggccaaattctgtttgaagcactgtattgagcataccatatgctgaaagacttggaatgcaaaaacctaaggccaagggcacttctcaatattaaaccctcagttgtaatggaggcatcaagactataagacccaagaccttaacttttgtgctccttgtcttgtggagggaacatccatcctcaaaacagaaacctgtgagatcccttgaatatactgacaatacactgatgagaattgaatgccccataaattgcatctcccgcagggcctgataggtgccctgtcttcctgcttatgactctgaaaccctgtttatttgtatcaaggacggttggtactttaatcatcaataaactaacatctcaacagcctgccataaatttcttgtcaaaaaaagaggttatgattagaatactgtgattaaagagaatttgtagatagacttacatccctcagtttcaaagcttctagtagtagggcttagaggttcctagagtaggaaaagcctagccaagcagaaacccatgtttttgactttcaggatatttgtgaattaatttacttgcatatattggccaagatctagcataatctcttaatattcaatgaataaaaaattgagttttgagagcaaatattttggtaggaaatagagaactgacactaatattctctctgactataattgtaaaacagtagatgtctttcaccaagcgctaacattatattaattattaataaaatccaactccttaataatacaatcatagttaccatttattgagagcactcttctgaacattttgcattctttatttaatcttccctacaaccttattaagtagacattatcttcatcttattaagtagtcagttcctcatttgcagatgaggaaactggctgactgagttaaatgaatgccaaagtcacagagctgctgagtggcagagttgtaattcccatgcagaactgtgtggcatcaaagccattttttaactcattgcaatgcacagtgggttaaaatgagatgattgaaaatgagatgtggctgggcatggtggctcacacctctaattccagcactttgagaggataacttgagtccgggagtttgagaccagcctgggcaacagagccagaccatccatctctacaaaaaatttaaaaattagctgggtatggttgtgcactcctgtggttccagctactcaggagactgcggtagggggatcacttcagcccagaagttcaaggctgcagtgagctgtgatcgctccactgcactctagcatgcgtgacagagtgagactatctcaaaaaagaaaaaatgagattatggccaggggtggtggctcctgcctataatcctagccctttgggaggccaaggtgggaacatcatttgagcccaggagttaaagaccagcctgggcacatagtgagacaccagctttacaaaagagagagagagaaagaaagagagagagattatttctagaataagcaaaccaaacgtgaattaagttttcattctcattttagtgattctctaagtacatacccacattctgattccctcagcactttaggactgactgattagcagtaactgccctcccactggtaccactgtggccagggagtgactgcaagggtcaaaacttttgttggggagctgtttggactaagtgaatgtccagccccaactcagggatgttgtattggttctaatctctgcttctgaggaaatggttacctgcagggcgattgtggcctgctcctcgtgggatatattgagatggttccttttaatccatttcttttaaaaaaaaaattctttttaaagagatgggatttcattatgttgcccaggttggcctcaaagtcctgggatgaagagcttctcctgtcttagtctcctgagtagctgggacgacaggtgcctgcaaccatgtctggcttaaatccatccttaaacaagttcaatgttttatttccttcagataaaatgagagtggagagaccacagtgatgcccaggaatagtcatggttggcgattaaatagccattgagtctctattctgaaacaggcaccgtgttcatttgctatggctaacatgacaaaataccacccactggggatattaaacattagaaacttactgtctcacagttctggaggctggaaattcaagacaaagttgctggcagggtctctctgaggcctctctccttggcttgcagacggccgccttcttgctctgtcctcacgtggccttccgtctgtttcttggtgcacatccctggtgtctcttcctcctcttataaggacaccagtcctcttggattagggcaccacgcttatgacatcatttaacttagttaccctttcaaaggctttgtcttgaaatacagtcacatggagggttagaacttcaggatataaatttgagggggacgcagtttagtctgtaacatgctctatgctgggcacaaggaatgttatggtggataaggggaaaatggtccctaccctctgtcagttttttatggaagaagaaagacggtctttaaagaaatttacataattaatcacaaaaagctaatactatgacaaagaatgtaagttactaatacagcttagaacagatgactctaaccttgtgtaggagctagagaaggcttctctgaggaggtgaggttggaactgaagcatgaaagggaacagaagggggtcaggcaggagaaggcttgggaccaggaggtagagaaaacagtagtgtgatcagaactttaaggcccggttctgtatacaacaggtttcgggacttgaaaggcagcccacattgagtgtaactagaaagtgagggcaagagattgttcaaaagaatactggacccagagtttcatcactttgttaattacatctcatattgtgggattgcaattaccttgcccaagaaaagattatttacgattccattgtttatattgtttgttgaaataattaattctcaaaacttctggatacctgagactcagctaggaacttatttttaaaatataaattcctagtcccactccctaaagattctgagttagtacattcaggatggggtctaggaatcagtgtgtttaagaagtgcatcaggttcttctggtactgattgtccatgaaccacactttgagaaagctccatctaaagagataagttactgacgtgtgttaccagagagagcctagaaaacctgggcacaacagtagttgttaagaactaccagacctgggccaggcccggtggctcatgcccgtaatcttagcactttgggaggctgaggcgggtggatcacttgagcccaggggtttcagatcagtctgggcaacatggtgaaaccctacctctacaaaaaatagaaaaaattagctgggcatggtagtgcatgcctgtggtcccagctacttgggaggctgaggttcgagggttgcttgagcctgggaggtcaaagctgcagtgagccaagatcatgccactgcactccagcctgggagagtgtgagaccttgtctcagaaaaaaaaaaaaaaaaaaaaaaaaaaaaaaaacaactaccaggcctgttggaatgtctgccagtttcaacccacggggatagggtgagatgaacattgattgagcctttacattggagacactataacaaatgctttgcgtacatcagctctttcaaattaatacaattctactagagggggcactattagtatccccaatttacagatgaaaaaaatgagggacagagaggttagatgtgtatctaaggtcacatagctcacaaacgacacagcatgcacccaaatgccaggtttcaatgaccctgtggtgaagtgtgattgctggcatttgcctagtgttgactgtgctctagacactgtattagttacaagtgattctacttctcattcattaggccatccagaaagccttgtgctttagtctgtcctggctactataacaaaatatcataaactaggtggcttataaacacctgaaatctatttctcatagttcttgaggctgggaagtccaagatcaagctgctggcagattgagtgtttggcaacggcccactttctggttcctagatgttcacctccttgctatgtcctcatatcgtgggaggggcaaagggtctctctatctggcctcttttaagcccttaacccattcatgaaggctttgcctcaatgacctaatcacctcccaaaggccctacctcctaatatattatattggtgattaaatttcaacatatggctgggcgtggtggctcacacctgtaatcccagcactttgggaggctgagatgggcagatcacttgaggtcaggagttcgagaccagcctggccaatgtggtgaaaccccgtcttttctaaaaacattttaaaaattagccgggtgtggtggtgaatgcctgtaatctcaggtactccagaggctgaggcaggagaatcacttgaacccaggaggtggaggttgcagtgagctgagatcacaccactgcactccagcctgggtgacagagcaagactgtctcaaaaaaaaaaaaaaaaaaaaaaaaaattacgaattttgcgaggacgcaaacatttaatccgtagtactgatgtggatatgatttgagctaagactctgctgttgattctcttcaaaaacttggcagtagcccttggatcccattaattgcattcaacagtcatgtattttattaatttttgttcctaaagaaaaaaaaaatccagattgcttagaaaataaatgtgactcacgcagagcagaatccgaattttctaagtgatgaacatgttaacatattattttaatctaaagacatcctatccctgaatttagggggagacatttttttaagtaaggtttatttttaaaattgttttgcaaacattttaacagtacatcactgcctcattggatgaatcatatttttaactttcacttcccatcaatttaaacatcatctctcaaggaactgatgggccggttgactctaaatgattttgcctttcatgcagtattgttccatccgcctgccacagaagtgattccaggtcattccaatttatttaattaattttggagatgaaattattttgcccaataactagaatgctaatgggacttagtgtaatggtttagttcaggtttgttggtttgaaaataaacgccttcatttcaatatttgccttttggctgcagcccgttaactggtcacatgctgtaacctcattaacatcaaggcttaattgtaagttaatgtgcacctagtttttgtaaagaaggtttctatcttaactgccaagttttgccccccaaatatagccccaaactggcatttccaacagatggatgggttggtgtaatataattcatgcttttaaacatcatacttttatcggtgccttgataataaatatttgaacttatttttagaagttagaataaagtgaggaaaataaatctcagctctctagagtgtcactgtggtattgagatttgtggaggtgtactacatccgtaattgggagagattgccggtcgtaaaggagggacaatagaacctctgtagaatcaaaggcagaattaaaatctgcatgttaatagctttcctgccagccacgaatagattcattcttcacgtctcagatatataaagcttatttcaaaataaattctggggagcgttcaacctgattgaatctgctgtaagctctgttaatatatttgttcgagtcacttgcactcaaaaggtttttagacagaatatcacttttttatattattcatggtaatgtaattcccccctttaatctcttcagggtttcccattcagtcatgatatgcggttcagagaaagttggatcgaccattaatcatgctatctcgacttctgtgtgtctcctttttgtccatctcttaaatcagtcacttggcagcagcaagacatgtggccactccagaccatttgatcgaagagctcttgttaggagattaggctgctaatctgcaagcgagctaatggaaatcattctgggcaaggaaacaaaactgaacaacattagcaaaatcactacatattataggaatcaagtacattctgaacggcttaatcctacagtttagatatgaagcctaagggtaagatgaacgtcttagatgatctgagatatccaaatacctgtaacaaacatttgtatggtgtatgtagggcaggaaccccatcagaattggggaatctttaaaggattttttatttagccagataaaataaacaaggacagagttgactgagaaaaaagaaagaaaaaaaagaaaagtcaggagaggaggactgaaaattcccatcccacccccgcaacaatgaagggaaatgcctaggttgaaaacacgcaatacacattcaataaatgttcatggttgaatgaagttacctggtagggatttaatctttatttcaaaaagagtggctgtgaatctttaaaaatttctttggttctttaacattctcttcttcactaaacccaaattaataattccttactattgtcattaaaagttctcactggatcattccatttatactcagagtaacaaagcaaacccaattatttgagagacactgaaatgaattttgagtctagaacagcatctgcaaactttgcaaaggttcacatgataaatattttctgctttgtggcctacaaggtacctatcacaactactaagctatcatgcattagtgaaagcacatagataatctataagccaatgggcatggttgtgtgacaataaaactttatttagaaaaacaggtggtagactggatttagcttgtgggttgtagtttgctggcctctggtcaagagcacttgtttgtctgggagacataatttcaaaaatcattttcttttttgattttcatggttttagaacatgatattttctactatggatgaatgctcctcttttgaattttcatttttgtctgacataactcaaagtgcttgctttgggagttcttgttaaccctgacaattcttgtcaaatatcttactcctgggctgtgctggggatggcagcagagtggggtggttggatgggaaggcgggaaagagctagcttggagatgatacgcttttccatccttgaataacttgggaaaaagtcaggagtgtggaatgaagaattggaatataaaggctgagggcggacctaattttttttttaaggattaagaaaaaaggagtaagagagatggtatgacttatcacttggctggggactcagcattaattgataaatccactgtaaggaatgcatgacactgtcttttgaagaaagacattgcatgttaggattctgagtaacagtcaatatattcagtgaaacaaatacctaatatattccatgaaacaagtatcgtgaatatattccatgaaacaaatatcatgaatatattgtgtgaaacaaatatcgtgaatatattccatgaaacagatatccagtatattccatgaaacaaatatcatgaatttattccatgaaacaaatatcgtgaatatattccatgaaacaaaatactgtgaaatcataccactgatttttgaagaaacctaatgaaaacagcatgctcctatatcttttttctgggtgatctttagatatctcgtcttccaaacttttgtgtagcattgtctgaattttcccaagaaaggaggatgttgatctcctatttatttatatttatttaaatttttaacctttacattgacccagtgttgtaaggaaatgggagaatattgccctgatgtctgggaaattgggactcccatcctacaattcaagtgttggaatgttgcagggaggctgggctaaggtgttctgttcctgtctctggttcaaaggaaaggaatagcctagacctaaaggattctgtctggtagctgtttgctcttcgcgcctgtgctttgaatggtgaataccctcggcgggaggcaggcacctgatgccactgcccccgccccacctgcccccgccccgtttctcagatcacacaggcaggctgaggagcgcttaacaccccagcctcccatgaagcatcctgaaaaagcagactttgtcttcctccatcagctttgtttgtcctctgccgagactccagggacatgattgctcttcattttacgctcgagatcaaaataaacagaaaccactttcagctttcccgttccagggttaagtgcccaagcaggtgttgtttctgttatgtggtttgcagtgagcaaaaccaccccctcttacctgtggcagcaaaggcagggagactttgagacctggggagggctctctgctgtgttaacagaactggctcttggttggggggtggggggcacccattcttggcttcttataacacttcctttctcatgcattacctggggctccctctggaaagaaaatggtggagaggttactggcctgatgacccagggacccaggcagtccttacagggacccagaatttcacatgcaaatgtgacctccaattaaagctggacttgattaaccccatttcccctcaaaagatgatacttgtaatgccgttccgatgaggccgtctcactccgtaaactgtcatctgatttacacaaagccatctgcttccatacggggtgttttatttgggatccaggaggggagaaggcgcatctgccccctccatagcatctgaatcttaatgaataaaagcactgacacttctttaaaagggaatagcgtgatgctatttacagtttatacagttttgtaatccagctccatgctggatatttaccgtcagtcatttgaggaagttcacttctctgctggttttctgagtgagggagcgatgagtagaggagcagctggagggtccaggagccccctgaactgagtatccggtgggaggtcagatttccgcattcagaacgagagctcatacggcatccacgcgtgtctttctcatgcatatccccagcccgagtagaagaggacttctgcatctctgttagttctttctcctcctaagaaaaagcagattttaagtaacttatcatttgttcatttaattactcattctttattccttcttcattcattttccttttctccttcctttctccctctgttctctctgttttaacaggttttattcttattgtggtatggtaaggccaagatgaggaaatgactgctattgcaaagatggtttgttactcacagatccatggggactccacatgccacagggagttacctgggaaagccccagggttgggcaggaggcagagggagagggggagaactgtcaagagttttgagctggaagctattatcctcagcaaactaacacaggaacagaaaaccaaataccgcatggtgtcacttgtaagtgggagctgaacaatgagaacacatggacacagggagggaaacaacacacactggggcttgtgaggagtggggttgggggagggagagcatcaggaagaatagctaatggatgttgggcttaatacctaggcgatgggttgataggtgcagcaaaccaccatggcacaggtttacctatgtaacaaacctgcacatcctgcacatgtaccctggaacttaaatttttttaaaaaatgtttttattgtgattttcacaggaaagaaggggccaggcagggtaagcaggcttaggattggctggcttgggtcatttccatgggctctgggacacaggggttgtctttaggtgtctgacccatggctatggggtgattagggtaggtgggtgtggcctggagttcgagcccaataaagccagtggtgagggtgtggctgtgaattggttggtttgcatttgaactgtggttaccagtgagctgtctactatctctaagaatccgctagagccctgtaaagaaagcctacaagggagcaggttttaggcaataataagtgagcagtatggcgccctaatagaaggagggatgcctgtggccaatatacacggctcaaagttgaccatgatagagaacctttccctagaaggtctgtgagggaggaggcctgggagagacagcagggtgaccagagtaagtgaagtcaccgaggtgccaatgagtgtggccctgcaggtcctgcagacccccctggtggcagtattggtggtcacagctggcaaagggaagtgtggctgcccggagagcttggctgaggttggaacgtgggagtttaagagagcaaactcccacagcttggtgcagagagaaaagtgtagaaaggtcgggtgtcatacagcagagggctgtgatgctctactgaggagtggaagtgtttttctgagggcatcaaacacgccgtcaagcagggaggcaacaaatctgagttgttccacagatactttgagtgcagtacaagttggtaatgggtaacaggctaaaccatgtggcaccccttccctcttatcagcttcttgctaccatgcagaaaagtgctgaaggtggcctgccctaaggcagtagcactagagcagggatggggaggacttggtggccagatgcatgtggacatgatggaaagggaagagaagaactgtcaagattttcactatcagtggtataagccccgtagtaatatgcctagtgttccattattggaacactaagtatgtgggaattatttatatcctaccgctcaaagccatcaccaaggtctgatcgtgaaaattcaaaaaattgcaacctgaggcataaatgggttttaagctccatacagtaaaacctagcatatgaaaacagttctggctgatgggttggtagaagtgatagatatagatacatacatacacatatatgcacagtaatagatataggtaaagaccttgatatatgtacatatattgtatgatacatatccatgcatatacgtgggtgtacacacacaggtacacacaaatatatatgtgcctttggacaagaaaaaatccccaggacagtctcatttggcttttaaaatgctgcagttgaataggaccgtagaggtggcctaaggcagccttccattcagggcacgcagatttggttcctcagctcccttcttctctatttctgagtcacgtgggctgcacctatctgtcagaagcccactgcccacccagagcccctgactctgaatggtggcccagtgctttctgaagacagaggtgggacctggtgctggagacaatccattcctttcacaaagactgtaagccttacccaagcattaattttgctgcataggcggcctgttctcccacaaagcactgagtaagaagaaaaggggcccggataaaccagcagggcctggcagacaacttctggctcccttgccatttaaggtcccgaggaatgtggagacattggtgggggccagggtgggtttggaaggacggattttttcctctttgtctctatctctctttctctctgtctttttctctttctctcatagttaatgctatgattttgtaaaaaaaaaaaaaaaaaaaaaattctagtttctcagaatcctcattggaggcatgtgtatatttctaaatttaaatgtattctcctatactgtccggggaaaggaagcatttttcaaccaaactgaaagggaaaggtactcttttttattctaatactcacatttcccaaaacatatccttaatattgtacatttggcacagttattgttgaatacttggaaggcgatgtgtatagcatacagagctgcagctttggactttgtggctttaggtaaattacttattctctttgcacctcagtgtattcttctgactaatggggacagtagcaacatcgatgtctcggggcttctgtgagtattcatcaaggtaatatatgcaggccagtaccacattccccactaaaggagtgccacttttttttttttttttactacttgcattattgttgttgttgttgctgtacgtctgaagggctttagtcctcttatgagcaaggcaaaagggacaatgttcaccctttggactggaagtaagaagcccctgcagttccaaatgactccacatttggaatgatttcacaaggagtgcaaaagaagcctcttgtttgactttgcccacaaatgccagaggaggactcttctgagccatgccaataagaaaaatgagaatgccagcttaaataaatgttatcacaatctctgcagaatcgtgatgtctccgattcttaaaagtgtctactgcagggtatttattattctgtgataataataaatcgctgcttatgaaatgcaaggaatcgagtgtcatggaggggaggaagggaagtaacagggagaagaactgtgagagatggaggtccagccaggcccgggctattaatcatcgccctccattatttcctgaagattcattcattgttccataggtacctagagggtcaattagagaccacagacaggctttttcaaagacgcaagagggtcaattaggccctccttataattttctgctttaacagcaaatgccagcctatcgtgcatcagatgcaagggagtttggaaataaacagggtactttccctcctcctctaaaaaaaaaaaaaaagaaaaaatccaacacagagacatggagacagtcggcgattgggaacgcttggcttgctggctgtcaggatctggttcaaggaaggcaaagggaattttatcaccaactgggacttgagaggagcagagttcttctggtctcagagcacggggaacggtcagggaatttgtatgatggagcaccctgttcccatatctgagatgattcatttatcttgagtgccatcttaactacaattagagtacaattataaagtatctacaatggaaatgggtcttgaaatcaatcgcagctggaccggcgtgcggtgagttgccgtgcccaccacgactgctgtctgtgtttaggacagagttcaaccaaacgtaccggtgtgtgattttgcacaacactgctttgtatttgttttccctgagaccggcaaacacattttttatttattttatttttatttttcgagatggactttcgcttttttgcccagcctggagtgaagtggcatgatctcggctcactgcaaactacccccgcccccgggttcaagcaattctcgcacctcagcctcccaagtaactgggattacaggtgcccaccaccaagcccggctaagttttctattttcaatagagatgaggttttgccatattggtcaggctggtcttgaactcttgacctcaggtgattcacccacctcagcctcccaaagtgcagggattaaggcgtgagccaccgagcccagccggcaaacttactttaaaacacattgcaataaaataaaaagaaaagggattgtcctaagtgagaagcagagatgaaaatgtggaaggatgattgtgagaagtccacattgctccatttggacttcctttttgtagtgggctattagattttgcctctgcttgtttctgaatacccaagcttgctaacacagggaaagaccaattatcatgattattattatttaccttaagacctgattctacctatctatgatcacatagacatttggaagcaaagagaaatgcttttcatgtgggaaaaaccaataccaacttcagtgatattatttctccgccccccgcaccgggctcttgggaatatctcttagccctcaattgtcacattcattcagcagatgttagcacgtgcaggcaccattctaggtgttggggatacatccaaaaacaagcaggaaaaccccattctcttcatttctggaatgccggagcactgggcccatggagcccgtttcacttacacgtttttgtcgtctttgagtttccaagaagggagtggcactatagctgaagaggatgaccctctatcacagcctttgctaaaaccactgaaaactgtcttatttttcattttgcccggaaatgcgacacataagtgcattcctctagggaaggatttttttttttttttttttttttgagacaggagtctcactctgttgtccaagctggagtgcagtggcgcgatgtcagctcactgcaacctccgcctcctgggttcaaacaattctcctacgtcagcctcctgagtagctgggattatagtcacctaccaccatacccagctaatttttgtattttttagtagaaacagtgtttcaccaggttggccaggctgctctcgaactcctgacctcaggtgatctgcccaccttggcctcccaaagtgcagagcaggaatttcattggatttctacactgctgctttttcagagcctggaacagtgccaagcacatagtcggccctcagtgagcatttgttgactaacttaggtcacagatgtggggctgtgattctgaaggccccggctcattcttggctttcagagaggtttgctttcactcctgggcagcagctgccctggctgctgccaccaccgccttcccggaggtcagctttattttcagtgtttttgcccttccgatccctgggtaagaagtaagaaaatttctagtgcctggagtctccatcctcgtttcccagtcatatcctagaagctgcaaattgctggcttgtggatgtctttggtttggcctgctgaagtttgttttggattttttaatgaaataaattagctgtgaacatttaaaacttgggagacatcccatcaaaattgggatttcctgcttatctcgacaaagcagatctggcatcctttgcctgcattttacatttggctacagttggctggacttgagcagcggctgcccctctttagctggggcatgtgccctgtggtttgccatagtacccatcaggcctgcttcactcattgtagaaatggcctggcctcctaggcattggagatttctgttatgctcattcatgagcttgcctgcttacacctagctgttgtgttggttctcataggtctccctgattccagcctccaattcactgagctggcctctgccagtgtcacttctccccagtcttggctttgatcaagcttggaaaggcctggcctttgtgttgtcacattcttctgcctagagtatgccttttccttcaccaaaccaagtggctctttcggaagacttgcctgaatcctagaccccttctctctacaaccttcagtctgagttgggtaccttgcatcctcctttgttcccatactaacccctacaaccatggtcattttgtggttatctgtttaattctctgctggctattccaggctgtcagctccctgactacaaggactttgttgctcacaatcatatccacggcatccacacaagatctggccgctacgtggaaggacacatagttccgtctggcttggagcctagcttgggagagggacagtagtggggaagggtgagcttggagatagagctgaccttcccaggtgcttcagcagttacagcaagattctagatcttaccctgacagtcacagaaagcactgggagcgtttatgaatgttgtggtatctcacataataaggggaccatgcatgtattttagaaagagccctctggcttcagggaagaacgatggatttgtgagggtcaggactggtagcaggtgggctcctagaatagtcccggcaagagatcatggaggccagagccagggatggatatagactaagacatgcctgtagactgagtgtcgaggagcaagtagatcaaattctagcatgagactgggagaaagagatgttctccagccaatggatttatgaaatgaatgaactttttccctttcctcccaagcattgcctggatcaccttgttaatatggtttcttattaaacgtgctggaaaaaagaggctctaagtgcgtatgcttttaaagcaacactattagcaaatggccactggcttcatttttcctgtgcatatatttttgtgtattccgggaggattttcttttctttttctttttaatcctcctcctcaagggaaacattcttctcacaatagcttcctggtagaaagttctaactaatgactttaatcgtgtgaatgtattgcagaaatggacaggacaattctcagcccattcatcttacagacctcaagtgaacaggcacaaaacaacaggctccaccctccttcccccctctatctcatactttacctcaatttatgacttggcttacaatccgttgcagaaagcctagctccccagcttctcctgaatctacgtttttctattttgtctgaactagccaaggtctctggagtttgctgttatattgcttcagagaaattagtgacattgaaaggctgttgtcttttttagtgtacttttggttgttaggagaaatttacaaggccatttttttctcccgtctctgcagttcaggagattatattagaaaatattctatacaaaaaatatgcatagtagggcttttctccagctagtagctcagaataagtcagtactactgaaacaggtaccttttgtggaattgattctgaaatctgtttggatctgaaatctttctttcttgcctttgagtaagatacggcagagaaaaacaattacactagctgctggtctgtatttactggttagaatagaatattattaccatcaagaataacattagtggccaggtgcggtggctcacgcctgtaatcccagcactttgggaggccgaggtgggtggatcacctgaggtcaggagttcaaaaccagcctggccaacatggtgaaacccccgtctctactaaaaatacaaaaattagccgggtgtggcggtgcatgcctgtaatcccagctacttgggaggctgaggcaggagaatcccttgaacctgggaggtggaggttgcagtgagctgagatcacgccattatactccagtctaggcaacaagagtgaaactctgtctcaaaaaaattaatgataataatgttacaataataataatgttagtgatacatatcattttgaaaccagttcttaagcaattaaaaaaaagcagctatggtgattgagtttttgtgttatgaattttatactctgaaggcatggtcattgtgaatgccaaagaaatgaacaggagaaaattttatttgaaagctgggattgttgcatgctgcagaatttttttttcttttgctattgctgtgtaacaaatgaccacacacttagcagttcacattcacatcttgtttattaactacaattctctagatcagaagcctagacacaatgtgactggcttctctgctcagggtctcttggggacaaaataaaggtgtccgctggaggaacatcctttcctgcatgctctgtggaagaatccactgccaagctcattcaggatgctggcaggattcagatccttgaagttgtaagactagggcccctgtttcctactgacttctgctggtggctgccctcagctcccagaggcaacccacattccttgacttttggccccctgcatctcaaagccagcaacagaaactctcttgtgcatggagtcccctcctgctttgaatctctctgactttccttgactttgatgtctaggtctggatttcaagggctcagaaactctctcatgcatgtagttccctcctgctttgaatctctctgactttccttgattttgatgtctaggtctggatttcaagggctcacgtgatgaggatagtttctttatcttaagggcaactgatgtggagtcttaattaacactggcaaaatcccttcatgacagtacctagagtatgaattgactcagtaactggaagaatgcatgcgtacaccatggaccgggaatccgggaggccaatttagaattttatgtatcaaagccccatttttttttgaataacagaaaaaaaaaagagacctgatatttggagagactttttcaaaagcagaaagtttaatataaaagaaagggggtaattgaagaagatataaactgcaaagaaaggatgttaggtagagcgccttatagggaatcagaggttttattacaggcagacacggcttcacctgtgagccgagcaagtgattttgcctgcagagaagaacgcagggttccttctatggctcaggatcttcagttaccagcagtggaagtgaattgaaaatagttggtctcttgagtgacctgatgcaactcattatcttctctgtgccttaacgtctctatctaatttcccattaaaagtaacaggaaaaagcgcaatgacttttgcaccaacctaacaatgggttgacattcaggattgctataatgatgaagcaatggcaaatggagtctttgtttttagccccgtggaggcatatgctgggcactcaacaaacatcacttcccctgcccttttctcagatagagttatccaaacaaattggatgctcaactctggatttgatccaagctctctggaaatctctagcttctcaaactgtttcgtggtggagtgccttttgggcacaggagaaggaaataagagcctcgcgaggtttgggaatgctgcctctagctctcacactgcatgcagaattcctactctgagagctcactttatctcaaaaacccatgcatattctgcatctactctgaattccgcagtgttgtgtgttactatacgatctagtgttttcgttgcttacaagttagattcacactccaggaatgtatctgttcccacatcccctgatgctgagcataccagagttaagggaggcaagcaaggcccctaacctcccaggttcatggaggtacccattctgcacttgttgaccttgagcttgaggactccataaatgtctgcccttggcattgcacgtgcctccctctgggctgaccctgctgggcctgtcacttactcccattggagaggcctgtttccatacatagctctttgtcagttgctcacactcggtcaatacttgccttcctttgaggccatctgcactcactgacaatctgatcgctcccctgaatggaggtgaaagcatgcaagctaggagttaagatctttaactcagggaagaccctgtctatggaagtgctgagctcttcagtgtcatcacagaaaagcatgagcccctccctggtacggagtcatcacatcccatagctgagcgacgtcggagctccacgatggggaggtgacacatagtcagttaattacataaagagaacttgagcaaactcttactctgccatatgctgtgcagatccctctgaaaagctttacagatgttcttttttttttttaatccctccccctatctttctttctttgcacccacgatgctctgcacttcaagctaaatataatgtatctgattttacagcatacatactaatcaggtttgaaagttgtcttgtgaggctttaaaaagctagccaagagcagtgcgatttctccaaaaggatgtctgcaatcaagatgattacatgggaaaataaatcataatttatattgctgaaaatgtcatttgcaaaacactttgacaatactttcctttcagtctattttcctgtgtatggggtaagtgttgcccttctgcaactttccttttattttatttatttatttcttttcaatactctgaatatcactggagcagctgcagattcagggcagtatggggtggttcaggaacagaactgacaggtattgaagccaaaaattgaacaataacaacgtaggagggagaatccaaagatagtatgtgttcaggatacgggcactcgtgtgggtgaacacacacacacacacacacacacacgcttttttttttttttctttttttttttctcctattgcaatagaacgtaaaggtagatttttagaaccaaatgccttttaggaagctacctctcttccaccctgctgcctttgtgttgaataaactatattaaattatccaggaggaatgattagtgatctgattcattaatatcccttgttattaagaactgtctgtatttgtgtcctggttggcagatattaagtccacagataccaataattaatatctatggttgattgtaaaaatggccaccaattcttccctgtcccctgcatatgtacatccttgcactgtgaaattgtagatctcgccctccaaaggtgaagttcgtttgtccactccttgaaccaggatggcatgaaacttgatttgaccaatgaggcatttggaaacacggcacaagcaaaggcttgaaacgtgcttttatgttggtgcttgcccacttgctgtgctacgaacccttttacttctgggtgcgaacaagcccaggctagccttctgggcgatgagagacacaagaccatgtttccatattgccccagccaagagccaacctacagacgcaactgccttgctgacagcagacacctgcccagctgagcccagcccaaattgctgactcatgcaatcttgagctaaaaataagtagctgttgtttatagccactaatatttgtgatggttcattgcacagcaaaattgaatggagacaatacttttgaaattgactcttcgggagctgttgtaaagaagtaaaatgtgtagtgtttgcccttttcctcagctgtaggcctggtatgcagaagtattcagttatttggtgagtgaaccctcgctgatgccctggctagtgttttctgtctcaggaagcatgaacatttcatccagggttatatgctacagggatattcaagaaattgaagatccttgaaaatctagtctccctcacaaggatcaggtggcaggatctaatgggaggggtagagagtgagtgttaacacacagagaacccaggagacctttctcagaggtctcatatcaagaaaagatcatttctcctaagcaatcaatttctttttaaatctgaacctcatatctgagaatattcccttcttttatctggccactcgggagctcaaaaataaatttctggcacccttcttcctggctccagtaaagtcatacaaccatatggtacctctctggcaactaatttcacctatttccttatttgtttaaaaattttaacttaaattttttcccctcaagatctatttacggatcatcagttttattttttcttttctttcctctttttcttttgctcccttttctccccactcttgactcttctctagtttttatatgcagtttgtatttatccatgccatctgaaatcctccttcctttttaacaagacaagtagaaaacgaaaacaacatcaaaggatacactacacaattgttggagccctaggaaccgagagaagagtacaagcaggttcttgaactgttctctccccagcaactataactggaaggaacctcagtttgtccattcattcattcatcagagcagcatagcagagtagaaggaactctgactttggcattggtgcctctaagtttgaagtctaactccatcactgtgtttctttcctcttgctgatagctgatttgttataaacaaattaccaaaaacgtactggctttaaacaacacatgcttatcatgttgcagttctggggagtcacaagttcaaaatcagtctcacctggtcaagatgtcagtagggcttgttccttctggaggctctaggggagaatctgtttccttgcgtttttcatcttctagaggcctcctgcattccttggctcttggccccttcctctggcttcaaaccagcagtttaatatcatcacatctcctttactgattcctcttccgttgtcccatcacattctcctcatctggccctctggccactctcttataaggacccttttgatttcattgggaatacccagataatcttggataatcactccatctcagggtccttaatcacatcttcagagtcccctttgccatggctgatgacagagtcacaaatttggggaattagtgtgtagacttctcttgtagggagtcattattactctaccacaaccactaattctggacttcacgttccctcatccatagagcagggataacaatatcctccaggctatccgcggaagtagagaatataagctttatccagggggccactcagtgatgggagtcttccttatgaagctgtcccagctccatctctcaggactgaaatgtgggtaagaccatcacatttttcatcccccgccccccgcccccaacattgactgggcagatattcatacaatggcgattgttttgtctgcctggatggctttaacataataccatagactgggcaggttaaacagcagacctctattcctcacagtctagaggctgggaagtccaaggtgaagccatgggcacattctgtgcctgcctgaggctctctttctggttcccagatggatgcctttgtgtgtcctctcatggcagagagaggaaggggtctggaacctttctcttataaggatactaatcccatcgtaccccgtcccccatgatctcatttgaaattagtcacctcccaaagccccacctccaagtactgtcacactggggcatagggcttcagcatatgaatttgggggagctggggagaggaacacatacatttagtccataacaactatctcacttacctctctactaagtgattcagaaaatagcaagtatagtagtgggagaacatggtatcagaaccaggagagggtcctctggctttctgagttctgccaaaaaccaagttttgctgccttgggcctgtggcttctcctccctgattgtcgctggccttgctgtaaattgtgaggcatccatgtgaggcacaggatggttccaaggaccaactgaggctgtctgtgctgaggctgggagggtgtaagtgctcagaggcagccggaagctgtggtttttacctcccaagactgtgcagagcttccttcttctgtagggagaagtctctcaggacagggctcacaacagtgcagtcaggagattggaaattttagtgacaccaaagtgggctttacttcctcctcctagaattcctgccagaaaggtggagatgtgcaataaactgagcaccgatagagtaccaagaacatgctttttgcacattgtttgattcatcaatcagagtggggcatggctgtcatcagttcagagttgaaagaattgaagatcaaaggggtcacgtctctgtgaatagtattagtaatagcagcagtatcgatagcaatcatagtaattaaaatggaagcaaccaccagtgtaatcatagcagaaactcacatgtgtgtgctttctatgtgccaggcatgaggctgaagtcatacattcattatttgttaatcccaccctaagtgataggtgtattcatcattctcagtatcagaagaagaaactgaggttcagaatgacccagtaaagatcacaagcccaaccctggtgaagggcgtgattggcagaagcccaatttaagcccccatcatgtcctgacgctttcccaaagctgagctgcctgccagggtctttgctcttccactgccaagaagtaaggttttggttgggcgcggtggctcacgcctgtaatcccagcactttgggaggccgaggtgggtggatcacgaggtcaggagatcgagaccatcctggttaacaccgtaaaaccccgtctctactaaaaatacaaaaaaaaaaaaaattagcccggcgtggtggcgggtgcctgtagtcccagctactccggaggctgagacaggagaatgtcatgaacccgggaggcggagcttgcagtgagcagagattgcagcactgcactccagcctgggcgacagaaggagactccgtctcaaaaaaaaaaaaaaaaaaaaaaagaagtgagttttttttgtgtattctgaaaggttcccaagctcgccgcagcctgctattgtatttaaagggtgccctttgctgcgtaactagggcaaagaagaaccaactggctgttccccactggctgtggagagttccagctcatccaccctgcctctgtggctgagtcggggagaaaaggacaaagtttttctcccgcaactgggccaccaaaccagcagagcctccagccggggtggtctcgaggaggcccattaccggctggagtgacagagtgtgtcaagcctgcagctcgtcccgtgtctaatggaacagaaacaagcaccctgctgcccttgttttccagtggctcaccggggctctgcgaggtttattaatcttagcgtataatggaaaatgtgttgccatgtgaaatctagagcctctgttcactactccgcgaattgaaggcggcaggagtctttgtctcatttacacacagtgcctgcgagagactcttagggcagaagaacgccgtcgtaaaaatccgtgcggaatttgaaagtgtgcattaatgcatgtgaccagatggttctaaaatatgccactttcaccaaaaatcatcctctgaaaaactcttctgaacaacatcggctgtgcatagtaactgccttgagtggggccattttagaaaatatatgaggtacgggatgaagatgagggaggaaaatggttcctacttatcattactttgtccctccaaaagcctgcatgcgggaagaaaaatccacccagtgcaagaaccgtggcagtactcagaccatttagaatcactttgagttattaccaagaaattgctaaccactgctttccaagttatatattaaatttttcttttttttaaaaaaaagcttccaactttttttttttttttttttgagttggagtcgcactctttcacccaggctggagtgcagtggcccgatcctgggtcactgcaacctctgcctcctggattcaagcgagtttcctgccttagcctcccgagtagctgggattacaggcacccgccgccacacccagctgatttttgtattttagtagaggtggggtttcgccatgttggccaggctggtgtcgatttcctgaccttgagtgatctacctgcctcggcctcccaaagtgctgggattgcaggcatgagccacagcgtccagccccaacttcttaaaagccagaaacaactggctgttagctgtcacaatattaatactagtgtgtgcaagtaagtttgttttctgcttctgtcttacacgttttacgggctatcagtagatgcatctaataatcctaacactgtcatccttatacttgaggtcttattgtccacttctaccttagctatgtaaacagatgagtaacctactctggatttacccagatagtgctgttaggcaccacacacgatgagattggaggcacctgggtgtcagcctcttgggctggctcattacaggccactctgtctgaggaacactcaggtttgcaaaccgtttcttaaaattacaggatacctagggacctgttggggtgggagggaagaaccctatgggcagaaatgtgactttctgtagcaaagatgtactgtttcccactgagaagaatcaaaaatagaaaagtgcttccttgtctctctatattgttattaaaacaagtagatgcattttcattgaatcaaggcagttttcctttataaaatgtcctatttcatatcactgttcaaacttgacatccacatttgagttggtttaaaatatcactgttttgttgacattcacctgtattatacatttcagttggtcaagtcatttaatttatcataaaccatttaaggagcagttggagaaaagggggaaaaagttaaatgttaatgattcttttcgtaactgcaattttatcggctcctttttgtacatatatgattatgaagcaatttgcatgaaatttacaccttttcaaattttgaaaattgccttgttgaaaaagaatcgctgtacttctcaatactacactgattaatcacagttatagagtagacataacatttttattaaactctcagtgagcaggaaaattagcacttcctgcaataacgatactaatttcattagtgaacgttttcatttataaagtgcttcttccttatcttgaaccttttatcctcttcttattgaccaaagagagggcatatctttgggagctgctaataaaccatattcgtaatatgatgtgacctcatcgacaggctgctgcttctagctcatcatcttccttgatcataaatacccatcggtacctcttgtcacatggtgctcttagagcttcctctttgaatttcacatgtgataagagatggtttccatcctgaagagcttgcagtgggatggttatcggaaagattaaaactctaaaactaacaggtggatataaatataaagaaaatacagtattttgttgatttatgttcatataacttctttattggtaaaagggagacaggtgagaatacaggaaatccttgtggccttgtttgccttttttagaaatttaactttgcaaacaaactcaggggaaactagtgaggtggaaataaagaatgctagactacgggtctggggcccaagtgttttattaatataaaaacttgcgtataaatgtccagtttcaccaccaaatcctttctgaaacattggtagtagatgaactaatgcaacaatttatttttctttgagacaggatctggagtgtggtggtgcaatcataactcactgcagcctcggtctcctgggctgaagcgatcctcatgccttagtctcccgagtagctgggattacaggcatacaccaccatgcctgcctaattttttttaatttttcttttatagagatgcagtatcgcttgttgctcaggctggtctcatatgcctggactcaagtgatcctcccgcctctgcctctcaaagtacagggattataggtgtgagccacgaagcccagctgctgcagttactcaaccagcttcctactagaagccaggcgtttctcaagcttctgaagacacaaaggtgaaccccagacaagccaggtttacagagtgtgcatttcagtgggggagccagccaaaaaatcagtaaacaccaagataaaatatattccagtggcgatacattttcagaaacaaacaaacatggcactgggctggaaatgaatggcaggggagaaggcgggcggggcaagctttggaaagcacgggcaggtaaggacagggtttcaaaggtgagaaggagctggcagtgtgaatagccaggggaaaagtgttttgggtagaaggaacagaaagtgaaacggtgccctggcaaggcaaagattattcattgctgaagagactatgttgcccagatgacttgttcatgtaatctgtgatttttaaatttagaattgaggtttgaagggaagtattgctcctttctttatctgcaatgggaaagcttactgtagttacttacagtagaagagaaatgtacatttctgaaaatccactgaggaagaaaggggcagtgatgattctaaatgttaataatgcagacagcctttgctttatgtatcaatttttgtaaatgtgttgcttaaatagatttttatgagccagtaatggtttagaaaggtaaatgacttgcccaaggtcatacacccagtacacttgggagccaaaattcatcatagatgactttgtgaaatgtcccattaaatgtgtatatatatatatagtgtgcattacagcttaacagacacacattcatttgacacattatgttttaactttattaataagtttttgtgggcataggtcttgttttgccaacttgacatgtggattttaaagggcaagtgccttagaatacaaactgtcctataaagaataccatattatcgaaaggatgttcaaactcatcagttagaggcgttgcagttggctgggtgcagtggctcacacctgttatctccgcacttaaggagtccaaggcaggtggattacttgaggtcagaagctccagaccagcctggccaacatggtgaaaccccttctctactaaaaatagaaaattagccaggcgtggtggtatgtgactgcaatcccagctactcgggagggtgaagcaggagaatcgctggaacccgggagacaggttgtagtgagctgagatgtcgccactatactctagcctgggcaacagagctagattccatctcaaaaaaaggcattgctgttaatacaacaatgataagttatttcacactcaccagattggcaaaacgttaagtactaaggtcataacaagcactggaaggatgtggagaaatagggaattttatgcattactgaactgaaacagccattttggaaaatattttggtattacgtaataaagtagtacttagcaacttatgcaatttggttcctataaagatgccttagagaaactgttgagaactaggaaaagctcaggaatgtttctggtgcataatttgtgatagcaagaacctgaaagtcctccaaaagccgtctacaatgaaatggggaaattaatggtggcacattcctgcataggagatagcagtgataatgggtggataccagaacgtgcatcaacacagaagaatctcagcaacataattcaggattaaaacagcgtttacagctgggcacagtggcccacacctgtaatgccagcactttggaaggccacagtcggcagatggcttgagcccaggagtttgattccaacccgggcaacatactgagaccccatctctactaaaaatacaaaaattagccagtgtggtatcatgtgtctgtggtctcaggggtctcaggtacttgggagactgaggagggaggacctcttgagccgggaaggtcgaggctgcagtgagccatgattgtaccactgcactccagcctgggctacagagtaagactctgtctcaaaaaaaaaaaaaaaaaaaaaaaagcatttac

SEQ ID NO: 1368 - DNA, 20001 bp, Homo sapiens
ggacctgacccccttcagggattggttttccaggtggatggatggatgaagtcaaagagacaagcacaccccacagacacatatacatgcacacactcacagatgcacacacataggggcatacaagtacagctggccctccgtatccatgggttccacaccagtggattccaccagcaacagatggaaaatattctgggagaaaaagtgtctctactgaacgtgtacagactttttttccttgtcattccctaaacaatacagtgtaacaactatctacatagcatttacattgtattgtattgggtactataagaaatccagaaaggatctattttatttcattttatttatttatttatttatttatttatttatttatttatttatttttgagaaggagtcttgctctgtcaccaggctggagtgcagtggcacgatctctgctcactgcaacctctgcctcctgggttcaagagattctcctgcctcagcctcctgaatatctgggactacaggcgccgcccccgaccatgcccagctaatttttgtagttttagtaaagatggggtttccccatgttggccaagctggtcttgagctcctgacctcaggtaatctgcccacctcggcctcccaaagtgctggggattacaggcgtgagccaccacaccgggcctagagagcgggcctagagaggattgaaaatacacaagagggccgggcgaggtggctcacgcctgtagtcccagcactttgggaggctgaggcgggagaatcgcttgagcccaggagtgcaacatggaagaaagcgtagcgctccttgtgtacacgcagcagcaagagctcacccagctccgctgagcagcgcactttgtacttctgtacctcaggggaccaagacagcaagcaggtgagaggcggggaactgccaaggcggtccttgagccttgcaaggtgcatctccacctaagcctattcgggcatacaaacctgagctgctcccagcccataccgggcttttgtatgaactagaaaaatgtgcccaggctggacgcggtggctcacgcctgtgatcccaacacacaagaagatgtgtgtaagttatatgtaaatactgggactttttttttttttttttttttgagatggagtctcgctctgtcgcccagagcgacatgcagtggcatgatctaggctcactgcaagctccgcttcctgggttcacgccattttcctgcctcagcctcccgagtagctgggactacaggcgcccgccaccacgcccggctaaatttttgtatttttagtagagacggggtttcaccgtgttagccaggatggtctcgatctcctgacctcgtgatccgcccgcctcggcctcccaaagtgctgggattacaggcgtgagccaccgcgtccggcaatactgggacattttatataagaaacttgagcatctgcagattttggcatcccggggaggtcctggaaccaatctctcaaggataacgagagacggctgaatacatgcaggtccacacgctcacataagcgcgcgcacactcggaggagcattcgcgcacacagaggctcagcggcagcgccgcctgcagcccaggcacctggatggcgatgggcatcatcttgccctcgggtccaaagtgcagcaggcagaggggggcgcagtggtgctgcttccggccgctgagctccacggtggggatgccctccatgatgcggtagtcggccaggtaaatgttccccttctggaggggagccgcgatgggtggcaagtaggcacccacacgggaagcccgtgacccgcgccgcaggtgcacagggcgctggcgactaggggcaggggtgggacggggacagggacgcggggtgcgggcttgcctgggactggcgcgggcgccggaggtggggagagacggggatgcccgcgagggaggccgggaggagggccggggtctccgccggagcgggcctcacctccagctccgcttgcaagcacgttccctcgcccaggaacggagccaccatgtcgtctgtgacggggaacttgtctgggatccgcgtgcagcggcggatcaggccggggttgacgccgttgaggtactggtacccaaagaaggtgtcctctgcccagtgctcggccacgtactctgcgaggacggcgcgagggcgtcacaaggaggcccggcccccctcggggacggagaggcatgggacagaagaagactatgggcaccgagaggagtcggggaggaaaacgaggcccccagcctggcgctgagcggccggaggagcccggtgcgacattttccaagaagccgccagagggcgcgcgcgcgcctcgctgcctctcccgtcccactgccccgaagtcgggggcctgcctagcacgccggagaccgcctggctccccctgctcgatccgggacgccccattccataccggagacgacagatttcttgccagggaaaattttcctaatgtccttcagcctcttccacgaatgtttgcagtccaacaggccgcggactttgaaagccagtgccctaggagatgggattccaggaagaggccttcagaggggctgccaagcgccggctggggcaggtggcggggccgccccatccacttaggtctctgggtctcagggtctgtgcgtcgcaaagtctctgggtcccatgtctcaagatctttgcatctctaggtctctgggatcatgtctcaggttttctgggtctgcgtttcagctccctctgccttcctggccattccaacctctggggctgtcttggaggccgccaaggttgggggagagggaaagttcttgcaggagccctcgttctcccgtcactcacacggactcacatgggccccaggcggacgaagaaggaggccgtcttgaggaaggagtagcggagatttaagttcaggaacttggtggccttaaagttgatgagaattgggaatcccggaatatagccattccacctgtggggagaagcgcagggcaactgggatccagggggcggggaggaggcaggcgcccaggggaaaaccatgggcggggcccagcacagcttcgggtccttactcaggccggttggggttgcgatgcctccgcaccggagggcggtaactgggaatgtgcacatagctgggcaggccaggaagaaagactcgccagctgcaagggaaaccgagatgtcaccctcatgcccgtgcaccaccccagggcaaagggccagagccatcactgccccccacctccctggacccctgccgggcgcccagactctgccacccgccccctcactggtagaagtcctgcttggctctgatctcctcttttctgtgctccaggaggacggggagcgagtcatctgctgttgtctttcctgtagggagaccaaggagaggactcaagggctgacccttgcccctgcccacttcaggaagcaggagttcagcttctgtgccccaggtcgtctctgggggggcccatgaccaaggagtgggaaggctcaccttgggagagtgaaggtgcgtcctgtccggaaatatcagataaaagaatcacggacccaccctctttcctcttgctctactgtcaagctaagctctgctgctgcaaaaagtccctcctctagacccactgaaatattttttatttctataaattcatggagtacaagagcaatgttgttacatgcatagtggccaagttagggctttaggttacccatcacccaaataaagtatattgtacccattaagtaatttctcatcatccaccccctcccatcctctcacccttgagagtctccattgtctattgttttgctatgtccatgtgtacacattttttttttaatggagtctcgttcttgtcacccagcctggaatgcaatggcatgatctcggctcactgcaacctctgcctcctgggttcaagcgattctgctgcctcagtgtccggagtaggtgggattacaggtgcctgccaccatgcccggctactttttgtatttttagtagacacgtggtttcgccatgttgtccagggtggtctcgaactcctgacctcaggtcatctgcacgcctctgcctcccaaagtgctgggattataggtgtgagccaccacacctggcccatgtgtacacattttttaacacccatttatgggtgagaacattcggtatttgactttctggtctggcttgtttcacttaagataatgacttctagttccatccatgttgctgcaaatgacatgatttcatttttttcatgactgaatagtattccactgtgtatatataccacattttctttatccagtcatccattagggcacttagggtgattccatatctttgctagtgtgaatagcgccacaataaataaggcatctttttgatatgttgatttcttttcctttgggtatataccactgaaatattaataactgacagttgtttagcacttactaggtcccaggtattgggaaaagggcttgtggggtgcctgtataaactggccataaaaatatgtgacagtaagctgtggaaagtcacaaaaggcctctgaggaggaaagcgttcttatcgccattatgttcccatgctctgagcgttaacctgctgtcttatctataaacactgtgttcaaggagaaagacactcctttgaaacctggaaggtggacagacgcgcaggctcctagttaagcctgttcccactagctgctctccgataagttaaagatgtgctgtttgagcacaaaggagattcgtttaaaccgctattgctatagattacgcctgtgacgcactgcctccctttcagtgtttcaccctgaacatctgcttcttagatctaagtgactgtactcaataaatagtgtggagaccagaactctgggccttttgcagcctccattttgcaactgcctccctggcccccactctttttgcactcttaacctgtctcttctcattccttcgtcaccaccggactttgggtaccctacaggtggtgttgaggctggtccccaacaccaggcactttgtagacactttacttttattaatctaagcctaagaagcaccctatgaggcaggtgactattactataggctggtgaccccttcgtcacaactgcaaagtacagaaagctgtggaaatcaagtttgtctgtttgttccacaacaaattcattggttgacaaagcctgctgtgaatctccctgaggctatatacaatctttatttaactcactgggtctaactattcatagtttttactgggaagtgttagtatatttgattggggtgccctgtggtagatatagcacataatatatggggtatgtgtgtgatatagatttatagatgaagatatatatgtatacatatacatattttatataaacatacacacatgtgtacagatacatgtgtatgtagcttctcaataaaatccgaatttcaaagcacccctggaatcaacagtttcagctaaaggactgtatccccatgcccattttacaaggagaaacagtcgctattatgtattacgtggggacaaggctggatttgccccgtagtgggctgcttctgaccaccaacagttgttaagccttttaaaattctgttcaggccaggtgcggtggttcacgcctgtaatcccagcactttgggcggccaaggcaggtggatcatgaggtcaggaattcaagaccagcctgaccaacatgatgaaaccccatctccactaaaaatacaaaaattagctgggtgtggtgttgcatgcctgtaatcccagctactctggaggctgaagcaggaaaatcacttgaacccaggaagcagaggttacaatgagctgagatcatgccactgcactccagcctgggtgacgaagcgagactctgtctcaaaagaaaaaacaaaaacaaaacaaaaaaaaacaactccgttcagatgtcatcttattggattctcacatccaccctatgaagtaggttctgttgttatctccattttacagatgagggaaccaaggcttagaagaatttggaaatgtggccgggtgcggtggctcacacctgtaatcccagcactttgggaggccaaggcaggcagatcacaaggtcaggagatcgaaaccatcctggctaacacggtgaaaccccatctgtactaaaaatacaaaaaattagccgggcgtggtggcactcgcctgtagtcccagctactcaggaggctgaggcaggagaatcacttgaacctggaaggtggaggttgcagtgagccgagattgcgccactgcactccagggcgacagagcgagactccatctcaaaaaaaaaaatttgaaaatatgcccaaatgtccagctagtcagtggaagaactgagacctaagtccaggtccgtctttctccagcaccctggctggtggtccccaggctggcctgtgcctaccgctgcagcccatcatttcccctcaagtcccttacctcaccaccctctccctcctccacctgcctcagctcatgttgtattctggatgaacagtgctccctggagttgtgcaacccagagacctagctcgttttcatccccagggcggaagactcactcctttgagggccctatgggtgactcaagtctccctgtcctgttgcgtggcagcggccccacccaaccccattcctgcctggccaccagcatcaccctgcctgtcccctgcttccatgtcacccagacctgtcactgcaggaagatgctctgtgtccccagtgagaccctccccttggcatgctcaccatctcccaggctttcctcgcctctcctttccccagctcaggccctgttccccaatcctgggggaagattccagcacagggcaatgagaaacggaagagaggtagtcagctgcagggaggatggggcttcgggccctgggtgtcctcagctcagcctttccctcccattcgcctcaagggaagccaacagacactcaggtggtggaactgggagataagagaggacaggcccccagtcctcatgcagcaccacaaattaggaagctgaccccagcccaccacacaaggggctctggcaggggtgggtgcaaggagctcagccactccggtcctatgtctctcccatgggagtaaccaagcaagtggaaaacccactgggcagccttggccagccttaaccttggagaaaccctgacagtctatctgaataacagggcccctattagatagatccttactggattaaggggggccttttggagtaacagtgcatcctgttagagaaatatggtgtcctgttgggaaaatagggagtcctttggagcaatagaacatcccatcagtctaaaaaatgctcaattagaaaactggggctcatgcctgtaatgccagcactttgggaggctgaggcaggcagatcacctgagttcaggagtttgagaccagcctggccaacaaagtgaaaccccatctctactaaaaatgcaaaaactagcatcaggaggctgaggcaggagaatcgcttgaacctgggaggtggaggttgcagtgagccgagatcgtgccattgcactccagcctgggcaacaagagtgaaactccgtctcaaaaaaagaaagccagggcgtcataattataagaccgcagcaccacggagacctgttgaactcaaagggcttctaaatgggatagcaaggtgctggttggaataatggggcatcctgttatagtaacagaatcctgctggagtaacagggcgtctttctggagcgcatatgattggcatcataaataggcctcctgtgagagtcctgagcctgtacttagcatcacaaggggtatttttaacgtggccgggcatcttataggagtcagggaggactggagaggtagcggggagcgcactctgggaatgctgtctgctgccagatggggatgctgagggtagctgctgggcctcaggcacctctcttcctccaatgtgcagccccaagctgagctcagggcagcagcactgactgagggaaatgtgtgacagtggcaggagagcccaggagtccctggtggggctgggcccccctctggcttgatgggagcctgggtgccatgccagggtagcaggctggagctagaggcctcacggccataggatggagcagggtgatgagggcttacctgtggcctcccggagtgccagggtctcgtagccatccatccactggtaggcggggaagtggtagatacggccgttgggggcacagatctgcacatagttgcagtaccaagggtccttggggaagaaggcgtaccgctctttgtgcaggcggatgatgatgagctcacccaggtcctgagggcactgcacggtgtactggcccacctaggcaggatgcaagcctggctgagtgggcaggacttcaccccggctcccaggccgcccacccctctggcccctcacctaggccctgctcatgctgcgcaatgctcacctccctggactgacggagggacaggatattgacctgatcattgagcttccttctgacttctccagcttgggggtctcctactggattcctctacccagggctatgtaggactccagcccctccttctctccatccccagctcctgtcttctcccactcccctctccaggcacctgaggttgcaggaacccttcagacccctggggacttgggtaccactctacagttttcgagtggggagaggcccagccagccccttctcccattcatcaatgaagatgcagatattcagaatggccacatagatagagtgacctattaaggtcgcctagcagcaggtggctgggtctgactgaaaatcaggtctgaggacccgcaaagcgtgccttccactggacaggctggtctgatgccattttaagtcacagagaatccagtgcaaatgtgagacagttaggaggcagctgaattaggaagagtgactgagaatggaagagagagggatgcgggagagggggtaagacagaaaggggaggagagcaaaggggaaggaaagcaggtggaaaggattgagaaaagagagatgcaggataggcagagacagggagagagggctgaggaagagggagagagaagaaaaggatggggagggagatgaggaatgcctgaaagggttagagatgaaggagcaggatggagaaggatggcccagagatctgggacatgggcgaggggctggaagccagctctggacaaggcgtgtagagccactggggagcccactgccttcggagctgtgcctcagctctccagcctctcctcgccaagctcagctcacctggctccccctgcgcaccttcacccctcccggggccacaaagacacacagacacacacagacacacacagacacacacacacacacacacagacacacacacacacacacacacacacacactcttaccgccccagttgcaaagtctctcccaaagtggttcagcagctgcttatggctctctccttgtgtccccacaatggtcagtgagatggagtcccgtgttcccgacaagaggtcggtgcctgtggccaccctgactttgtaggtggccatggctgctcttcaggaggcaagaggggcactcagtcccagacaccgtggaggggccacacgaaggcccaaggcaggcaagagaagccaggcacagagtggagtggacagggctggcctccgaggtgcagtggtgaggtggcgaggtggggtgactaggcctgccagccaaattctggaaaagctgctgcccttggtggccggggtgggtgccgggcaggcccaggcggagcccagctggtggtgagtgagcaggtgtctgggctccaagccttctgggagctggtggggaggaagagcaggcagggcactgggcctgcctctgaaagggcggatagaagatgccgtggatgaaggcgccttcagggtgggggagccagtccagcctgagccagggccctagggaagttgcgggagggggcagggtgtggtccccagatctttatcagactaataagctccttcctcctgccagtccccattggctacagtgccaggcacccctactaagcagggccatgggcagtgagtgacttgcattggttctgaggccactggtgggcgggggagggtagggggaggggcactaagtggcagcgcagctggccagcctccaggccattcctctctgggaaatgggacaggtagtggccacagtgagaaagctggcctgtccttctgccccagggcccagagtctgtgactggaagggtgggaggtgttgaagctagggctcggggaccacatgggtgcccaaaggcctgaagatgctgcggggaggaacgatcagggtaggagaaggggatctgttgcttcctgtggggccaggatccactggtgagggattggagttggatataaaatcagaagcccaaaaaaaaaaaaaaaaaaactaaattagaagacagagtgaaatctggggcataagaattaagttaaatagctgggcgtggtggctcacgcctgtaatcccagcactttagaaagccaaggcaggtgggtcacctgagctcaagagttcgagaccagcctggccaacatggtgaaaccttgtctctactaaaaatacaaaaattagccaggcgtggtggcatgcgcctgtagtcccagctacttgggaggctgaggcaggagaatcgcttgaactcaggaggcggaagttgcagtgagttgagatcgtgccaccgcactccagcctgggcaacagagcaagactccgtctccaaaaaaaaaagacaaaagaattaagttaaataatggattaatatgatcaatattttgtggtataatcataaaatagaattctacccaggaataaaaagaatgaactgcaatgcggatgagtctcacaaagatgatactgagcaaaaagagccagacattaaaggggatacgttctgttatccattgataggaacttccagaaccagcaaaactgagcaattctcagacaacctctactggtgagtatccctggcagagggaggccatataggctgctggaggtgttcttatcttgatctgaggggcgtctagggtacttcattcatttcattatgtgttatcctttaatttcataaagtacataccctcacttccctcccaaaaaagaatgaagctaggaagagggctggaggcagggctgagctccagtggaactgtgtttgttgggaaccaggtcgttcctccctcagatatgtagtgagcacggtgcacggcgttctaggcactgcagaggcagagaagaaatgaaacatacatggagcttacggaatagctgggaaagaagtgaaagaaacagtaaacaagaatttgttcactataattttggatactaagtgctctgaagaaaataagcgtgggaggttgggattgggaactagttgctgatagaatcacagaagtcagagccgcaggatagggagaaggtgttaggagtaaggtgaagagcattatgagagagtcagagatagactctccaaagataggatttgggacccagggagagtgaggaggcaggcacgttcctattccctttttctggacctgtcctctttcctttcacctccgaggagcagcttctgtcaaccaggaagcatagccctgctttcctccctgatggcacgcttccatcaccatcgaaggaaggtcattcaatgcccaggccaagttagggtcagagggggctgggattgtgagatgaagagaaggttccagtaggttccagactggatgtggaatggggtcgaaactgcaattcaggtttaggttagagacacagatgtggctggagttggggattgaaatgatcttttccagacccaaatctgttcacatcactctctatgttccctcctcccaaccctgatcaagcctggcagtggctcctctttacctttgggacagtgacaccatcccctcccgtggcccccacggcctgcctgattggcttcacccctcacattcccctttgctctcttctgtctgggaccacgtgcctttcattcattcatcaacagacactggccgaacccctactgtgtgttcagcgctgtgtcaggtcctgaaaatacaatgcgatcaaagcaaacccctgcacccatggagcttgccttcaagtgagggaagcagacaatattacctagtaaccaaatacattaaatagtatgttaaatagtgataagtgctgaagagaaaagagagaacagggaaggataatataaaaaatagaggagtgccgggcatggtggctcatgcctgtaatcccagcactttgggaggctgaggtgggcggatcacctgaggtcaggagttcgggaccagcctgaccaacatggagtaaccccgtctctactaaaaataaaaattagccgggcatggtggcgcatgcctgtaatcccagctactcgggggctgaggcaggagaatagcttgaacccaggaagcagaggttgcagtgagccaaggtcatgccattgctatcaagcctgggcaacaaaagcgaaaatccatctcagaaaaaagaaaaggaggatattttagatacagagtggccaaggagggctccttgggaagaagacttttgagtaaagacctgaaggaagtgaagtcagctcgtcaccatcccagggccttggcacatgctgttccctctctacctctcaaactgaggtcacgtttcctcttcctcctgatcttagctcaataattgctttttccaggaaagccaaatttcactatacatggctctcacagcactatagctaacatctttgattgatgtctgttttctctaataaattagtccatacttttttttggttttgtccccatctcctggtgtcatacttggtacctgggagacaccgaaaacatagttgaatgggttaatgacaaggacaaggtcagggctggggattgaatcgatgatggctttggagttatggtgaagatccgaagagagctgacttgggctcagggtgagagaaggggcaaggcgtggtgtaggggagggaaaggggttgggtggggagggagggaggagaggggagaaggctgaggatgagggttgtgcccagctctgggtggcagggctggctgtcctgggctgcagacagaagccgtccagctggatctcccccctgggatctccctcctcaaccacctcgatgactcttggaggatgctgggagcctgaagatgcaaatcttaagatgcaaattccatgcaaattctcccagcttcctctttctaatctctcccctttgccctgtgtccccagggggctgctgaggcttggtgagaagcagggcagtggactgggcaaactgagtcatatcctgctaccaataggtctcctccaacccaaatcccagggtggccctgggtttgctcagggctccagtgtggagtgggaattaggttcctgagggagacggagatggaggcagggatgctgaggatgtcaatgtggctggggcagggacagggacgggatcaggcatgaggatgtagatggggcactccccagctatgaccaaaacgtagacgcgtgactcttgataggtgctcattgggctgaagaactggttctcctggaccaggggcgggagccagtgaggaggagaggtttctgggaaggattcacactcactggggttgctaactaggggccatccacacaggaagctgagttctcactgctggggtatcccccgtgcctgaccccaccccaagccctgcaaggcaaggagcaactaactcctggggacccactctcctaagacacagagaaagaaaaatcaaatcacgccactcccctgcttaaagttcaccagagcttaaaatggggttgtccgtagaaatgaatccaagggccaggcgcggtggctcatgcccataatcccagcactttgggaggccaacacaggcggatcatgaggtcgggagttcaagaccagcctgaccaacatggtaaaaccccgtctctactaaaaatacaaaaattagccgggcgttgtggcacgcgcctgtaatcccagctattcaggaggctgagacgggagaatcgcttgaacaggggaggtggagattgcagtaagccaagatagcgccactgcactccagcctgggcaatagagagagactccgtctcaaaaaaaaaaaaaaagaaagaaagaaagaaagaaaagagacgaatccaaggacttatcatgtctacaagaccatgccttcccgacacctttttccagccactctggccttcttgctgtacccagaacatgtgtccttcaggacccttgcatttgccattcctgggtttgtaatacccttcccccaagctgttcaagctgtttcaaccaagctgttcaagctgtttcaagagtggttttgtttgtttgtttgtttgtttgtttgttttgagacggtgtctcactctgtcacctaggctggagtgcagtggtgcaatctcagctcactgcaacctccacctctcaggctcaagcgatcctcccaccttggtctcccgagtagctgggaccacaggcgtagtccacctggctaattttttgtatcttttggtagagatgggattttgccacgtggccgggactggtctcaaactcctgagctcaagcgatttgcctgtctcagcctcccaaagtgctgggattacaggagtgagccaccgcacccgaccctaagcgtgtgttgttcatgtcatccaggtctcaactctagtgtcacctcctcagagtccctccctgaccaccgtccctcatgtttccccgccctccgccctccatcatgctaccctgccacctggttgtatctccaactgcacttgccaccgcccaaaaggatctttatctgtttattgatgcgtttattgtctgtctctccagcacccataagaagggtgaaagaaggggttgtgcctggggagctcacagctgctctcccaaaatctagaacagcatctaggcagacaagagccacgaagcaaagcgatgctaggatgtcaacgctggaaagggcttttcaggtcttctcgtcccactcatgtatctgacaggttgggaccactgaggccgagggacttgctcaagatcagctggggaaggaggctggtgtgcttcccattataccagttgaccttttagactgaccaaaaaacagtggagggcagagtgtaagctgaggggagctcctgacctcacagggctccagaaacttgatgtgagcctcctccccatgtcctgtccccagagtcagggcaggacatcctaagtgtaccaggtgtgtctgcccaataaatctctttccaagctgcctttctggaaaaccagattccaatgacccgccctggtccctccctctccggctcaggggcatttttcaggataggcatgcctactaatgctgcctttgtggaggcccaaggagtgttcatcctcttgggggacagggtgcctgagcatgcccatgcccttttcactgctgcttccaaccccagggtcaaaggggcctgcactgcgcacccaacaataatactggcagctgtcacttactgaggagctatcacgtctctgtcattgaatcagatcctttgcatacaccattttaaaatatgaaacaggccaggcgcggtggctcacgcctataatcccagcactttgggaggccgaggtgggtggatcgcctgaggttgggagtttgagaccagcctgaccaacatggagaaaccccgtctctactaaaaatacaaaattagccggggtggtgtggtggtgcatgcctgtaatcccagctactcgggaggctgaggcaggagaatcacttgaacccgggaggcggaggttgcggtgagccgagatcgtgccattgtactccagtctgggcaacaagagcgaaaatccgtctcaaagaataataaataaataaataaataaataaataaataaataaataaataaataaaacaaatacatagctctatttaaaatgcttggcagccaggcgcaaggtcaaaggggcctgcactgcgcacctagcctcagcctcaccctcacccctggtggccacaagggggcgcccctgagtatttcttagtcctttgatttgttctacagtgaacaaaactggtgatttgggataagtccttaggttgcaatctgcatgtgagatatctgcaaacacacctctttagcacagtggtatgaggatcctcttctccaaggatcacagatgcagaaagtgaaaattcaacagccaaagacagccttccccaacacacacacagacacacacacacacacacacgcgcgcgcgcgagcaaagggagaagtggtttggttgacaacagagaagattcttgggctgggatgtaatgggacagttggccgccccagaatttcaatatgccagggctttgggatggcaatttagttagggaggaaatgtggttaggcgtggagctcttcgtggagctgcggttgtactgaaaacacatgttgttttcttttcttttcttttcttttctttgagatggagtctctgtcaccaggctggagtgcagtggcacgatctcggctcactgcaatcttcgcttcccaggttcaagcaattctcctgcctcagcgtccggagtagctggaactacaggcgcacaccaccacacccagctaatttttgtatttttagtagagacagggtttcaccatgttggccaggatggtctcgctctcttgacctcatgatccacccgcctcagcctcccaaagtgctgggattacaggcgtgagccaccgcgcctggctgtatatttcttagatgatttaagatatttcttagattcttagatgatttctttgttttcttagacaatggcagccccagccaaggcagcctgtggatccccactaactccaggaacgaacactgaccatggtctgcactggggctgagacacactgcagcccgcaaagcccccagccacgtgaagctctgggtgggtcgcctattacgttgacactaaaaccatctgatccccctaccacgggcaccacagggatgggggagcagttaccctgtcattgtccaaagacactgtgatcccgccagagagaggccatgaccagggttgggtcaggcacagaatttgactcaggtggcagaggaaggaaggaaggtgggctggatctgaggtctggggaagcagaaaaccagggtgttgggcggctgtggattaagaagaccggggagactgacttgaggctgcacagatctctatgtttaagggctgtggggctggaagggagaaaatcagactccccatattaccagccatgtggccaggatcaactagactataccacagtaacaacccccaaattccagtggcttcacctgacaagtttatttctcactcagtccatgtctggctcagtcagcgggggcctcttctacagtcccttggacacacaagcaagtgccatctcaacatgtgcttccggaagggagaggcagagagaaggaaatcaggggtctccgtgtggcctggagacgatcctcatcccttctgctcccaactcaaccaaaactcatcctgtgactgtacccatccacaagagggccagaggctgagccttccatgtgtccaggaggagaactggatttcggtggcaacgttaacaattacccagactctgaggcttcacaaaatactcactattccacttctcagtcccctgaatccagacattccctcacctcctgatgatgcactctggaaggtgagggcaggaatatatggcttggctggatagtgcgttgagccgggacacttctgtctccagaatagatgatccacggatccactgctgcccctcactgcaatcccctggcacccccaacctcacccacccatacacacacacacatcaaagcagcaaaacaaaatgagagccaaatattttggtttttattgaactcactgggctcaaggacagaaagaaaaaaatgggatgaaagggagtgggatgaaaggggagttggatgaaatctttggagaaagacagatctccacaaacaccccaggcctgggaacctgttcctgagaacagccgttaggggtccaggcaagctgccctccaattcttcccctccccttaaaggtgctagggacaaaggggaccacatgttagacccaggcacacagtccttctgtgcccagtttccaggcttttccagagaaggaagctgggctggtggctctaggcttggaagaaagagaacgtagaaaggcatggtaggagaaggagtttggggattggggaggatgagggagaaaagctcagaaacccaagctgggcattccaagaggctggaacaagaggctgccccaagtggggcaagaagtgaagcggttccttcctttcggaggggctattgtgcattggactttggtcagcggcttttaacctggacgctgctgtgctggtctctcacagctcagggcccagtttgtatgatgtcagagccatcttggctgcaaaagtctccatgtgcagaagagaaggttcaggtgaactgagaacagggaggatggaagggtctggaggacctgaggaactggtcctcctcatgcttggacctttctttcttcttgggtggtatttgggggtggttagatggagacgctgttctcaatgaggggagggtccaggtaggtgtagggcagtgccagaccctggttccgctcctggatgtcccttgagatctgggccaggcggctctggaaggcggcgatgctccgcctcggggcctcctctgtgaagtgctcatctgggtaggtgcccaggggcctctgggaggacatcaggtaagaggtcaggatgacattcagatgggatggggaataacggaggaccacatgtaacagcaaatccagtcaaggtggcttctagtagcacaacccagttgcagccattgtaaacacttgccccaaactgccaccccatgatcctgacacgaggccccccagcacccaaaccccaaacagagtaggggacagactgtgacgtaggagccagccaacccaaattcagtactgcctctgctggcaagcctctgcctgttactttgactctttgagactcaattcctgcatctgaaaatggatgggttgaactagaaaaaaaaatttttgaggcaaggtctcactctgttgcccaggctggagtacagtggtgtgatcatagcccactgcagcctcaaactcctgggctcaagtgatcctcccaccttggcctcccaaagcactagaattacaggtgtgagccaccgtgcctggcctagacctttaaaggtccctttcatacctgatccaactgctctgtgaactaaaagaacgaaccacacctttcatacaaccgagatcaaagtaaacactgcccaggaaatatacccaagaatataacaattacttcataatttcacaaaattcaactcctaaaaacaaccagcatcctggttctaaggtaccttcacaatcaaccatcgtgatggaacttttgccaacacaatcaccatcatcctccactgccacactttacagcacagccaatcactatcgagaaatatcacaatgagctccagtcactgccatcctgtgtacaggactgtccctccctcatgatcatatcacacaaccagctcatcacgacaacgcagaggtccagcctcctaaccagcacacacttcccatttactagaaccttcatataattgttgccaatactactgatcttttttttttttttttttgagaca

SEQ ID NO: 1369 - DNA, 40001 bp, Homo sapiens
gttttaaatgataaaactggacacttctaaattgcctctaggtcaaagaaaaataatcacactggaaacattttaaaaatacttagaactgaagctgggcacattggtgcatgcctgtagtcccagctactctggaggctgaggcgggaggattgcttgagcccaggagtttaaggctgtagtgcactatatgttggtacctctgaatagccactgtactccagcctgggcaacatagcaagaccctatccctaaaaataagttaaataaatacttagaactgaatgacgatgaaaatattacatatcaaaactcgtgggacacaagtaaaagccatacatagaaggaaatttgtggcctcttaaatgctaatctgagaaaagaaggctgaaaattaataaactgtctaagaagttagaaaaaggacaataggggctgggcacggtggttcacacctgtaatctcagcactttgggaggccgaggcgggtggatcacctgaggtcaggagtttgaggccagcctggccgaaatggtgaaaccccgtctctactaaaaatacaaaaaattagctgggtgtggtagtgggcacctataacctcagctactcagaaggctgaggcaggagaattgcttgaatctgggaggtggaggttgcagtgagcggagattgcaccactgcactccagcctgggtgacagagcaagactgtctcaaaaaagaaaaaaaaaagggcaatagattagtccctacctcctaaaaaaaggagataataaaaataagagccatgattaatgaaataataaatatttgtcagaaccaaatgaagccaaaaaatggttatttgacaacataaacacatatctggcaagatagataagaaatagaaagtacaagtaaataatattagggtcaaaaaagagacataactacagatgcagtagagattatgaaaataacatataatactgtgaataatattaggctcataaattttaaaacttagatgaaatggccatttttttcctggaaaaaaaataacaaaaccagctcattccaattatgtacaaaccctttcagatgactgaagaagaaagaatagtccccaactcattttatgagggcaccataaccttgatatccaaactagataaagatagaagaaataaaaattacaggccgattttatttgtgacgctagatacaaagataggaaaccaaaaatgattatacattatgaccacttgggtttaacccaggaatgcaagggtaatttggcagcagaaaattctatggtgtcattcatcatattaaccgtgtaagagtccgacaggacgcttaaaaggcatttcataaaattatcagtgtttgggggcgggggggaaatctcttagaaaactaagaatagaatttccctaacctgaaatagagtatttagtaaatgcctataataaacacttaattttaacaaagaaatactaggaagaatcctatttattcgtttatttatttattttgagacagtctcgctctgtcccccaggttgggttgcaatggcgagatctcggctcattgcaacctcacctcccaggttcaagcgattctcctgcctcagcttcccgagtagctgggattacaggcacgtgccaccacgcccggctaattttttgcatttttagtagagatggggtttcaccatgttagccaggatggtctccatctcctgacttcgtgatcggcccacctcggcctcccaaagtgtagggattacaggcatgagccaccacgctcggccgaagcatcctttttaatatcaggcataagctacaacatagatgaaccttgtaaactttattctaagtgaaacaagccagttgcaaatcacccctgtattgtgtgattgcatttgtatgaaatgtttggaacagtcaaattcataaagacagaaagtcaactggtggctgcttagggatggttggaaagaaatagttaagtgactgctaatgggcatggggtttgtttttggggtgatgaaaatgctgattggggtgatggttgcacaactctgaatatcctaaaaaccactttaaatgagtgatttgtttgggatgtaacttttttctcaacaaaggtatttttgaaaaagcatgtgaagagcagggtgtttccaagagcagttaattttaaataaacacatatggattcaaaaaaaaaaagatcaggcacaagacaaggatgtgccttgttaccacttctattcaccattatatcagataccccagccagaatattaagataacaacacaatttaaaaacattgtaaaggaagaagaaaaggccattattcaaagagtatatgcttgtctatacagaaaactgaaaagaagacacaaagaaattattaaaaataggccaagcacgatggctcatgcctgaaatcctagcaccttgggaggctgaggcaggtggattgtctgaggtcaggagtttgagaccagcctggccaacatggtgaaaccccgtctctactaaaaatacaaaaattagctaggtgtggtggctgatgcctgtaatcccagctactacgaaggcttaggcaggagaatcgcttgaacctgggaggtggagattgcagtgagctgagactgcgccattgaactccagcctgggcaacaagagcaaaactccatctagaaggaaaggaaaggaaaggaaaggaaaaaggaaaggaaaggaaaggaaaggaaaggaaaggaaaggaaaggaaaggaaaggaaaggaaagggggagggagagagacagagagagaaagaaagaaagaagaaagaagagtgagcgagcaaaagaaagaaagaaattattagaaataagattggcagttaagataactggctctagaatcactgtacaaaaaaatggattccgttgctgtacaccagcaactaacaaaatacatatttttttaaattacaagataattgttgcaacataagctaggacagtaaacataaaacatttacaagacaatatacagaatactgtaaaacttcactgaaaaacatagaaataattggcaagttatcccattttatggacaaaatgtattataaaaatatcaactctcttcaaactgacctataagattcaatgcaatcctggagaagcacttccaaaacggcagagtggagaccccccaaaattcattcctccataaaagcagtgagaacactggcaaaaaaaataaaaaataaataaaataaaaacctttttagaactctgtaaattaaccaaaaacttgcaacaatctcaggagcatttattcaagaaaaaatgctgactctcagtaagaacagtgagttctgcagcatttttaacttcccctgttctcatctccctctccccagctctgaggtagacttgaaaatcttacaaccatggtagctgtgcaaagcagcaatgttgcagccactggaggaggcaggtggttttggggcacccccaaaggtcccatcccagagaactgtcactatttgactgcgctggcaattccctggaaaagccccattcacagatgtttttatttgacctgactcagagcttgccctactactggagtatttgttgaaagcaatcaacagcaattgtttaacagtgcagctgcctctggcaaaatctgggaaatgagctagggggctttggaaagctctgacatagtcctggagatctagaagagtaggcacatgttcatgcccgtgaaagacctgacaaggccccagtctctcacctcaagctgaccttcggcatgtgctcaagcaggaagtgaaagttaaggcagagatgtaaactaactagggcaatcagagtgtttgtcaacacacacgcacagttccctggcaaagtgcagggagatcaattggtttgggcatttaaagaacctctatttaaacattagctgaccactaagctaaaggagcacagacttccttggccacacaaaacaaataatacagacttcatagaattagtacaggaaagccactaaacaaactaaacagtagcagcaacaacaatatcaacaaacagcagcaacaacaaacgctgggaagggggtgtgaatctgatttccaaatgtaaaatgtcctgttttcaactacaaattatgaggcactcaaagaaacagtatatcccacacacaggaaataaaagtcaatagaaattgtctcagaggaagccagatgttggacatactaaataaagactaaatcagtctttataaacacgttaaaagaaaaacatgtctcatagcaaagtataagaatgaagtctcaccaaatctgatgcgaccaaccccaagaaaaaatcccaacaaagttgtaagtggaatttgctcaggtgtttcagtactgtatatggaagagcaagggactgagaatatacaagatactcctaggaagaagtgtggccaggcacagtggctcacgcctgtagtcccagctactcggaaggctgaggtaggaggttgaggctgcagtgagccaagattgcaccactgaactccagcctgggcaacagagtgagaccctgtctcaaaaaaaaggaagtgggtgggcagaggtggtggtgtggtttttccttatgaaggatcaaaatgcgtcctaaagctatgactgggtggtactggtgcaggtataggcaggtcagtggaaatagatctgcacatatgtggaagtatgatttaagacctagatggcattacaggtcagaggagaaagggggagccctttcaatacatgttgctggcatagttgataattcatatacaaaaataaaatagaatcctttctatcttgtacataacacaaaattagttccatatgaattacactttatcagctaacggaaattttctagtttgatgaatttttattctgaacaagtgttgaattttatccagtgctttttctgcatctattgagatgatcatatgtctttttatcctttgtattgtttcatggtgaatttcattggttgatcttttaatattaaaccaattttccaatcctagaaaatactccactttgtcatatgcattatcttacttgtacactgtgggttgaatttgttaacattttgtttagaactttgcatctatattcatgacagaatttgtcctgttattctctctttctgtaacgtctttgtcaggttctagtatccagttatactagcctcacaaaaagacttagaatgtgtttccagctgggcatagtggctcacacctgtaatcccagcactttgggaggccaaggtgggagtatggtttgagcccaggagttcaagaccagcctggccaacatagcaagagcctatctccattattattattattttttaaagtgtttcctcttcctctatgctattaaagagtttatgtaatattagtactgtttcttccttagatgtttgaaataatttatctgtaacatcatctgggcctagagttttctttgtaggattaaaaatttttttacagctttatcgagatataattgatatacaataaagtgcacatatgtaaacagtgcaatttgagaactttggccatacatatagacccatgaaaatacatctccacaatcaagataatgaacgtcctttactcccagaaggtttcttgtggccctttctagtcccttcctcccatccatccactgcctctaggcaaccactgacctgctttctgttactatagattagttttcattttctagaattttagaattttaaataaatggaatcatatagtatgtactcttctttgtctagatgccttcattcatcttaattgttttgagattcaccatgctgttgaatgtgtcaaaagtccatcctggctgggtgtggcggaccaagcctgtaatcccaacagtttgggagtctgaggcaggaggatggctttagcccaggagttcaagaccaacctaggcaacatagtaagaccttgcctctacaaaaaaaaattaaaaattagctgggtgtggtggtgtgcacctatagtcccagctactcaggaggctgaggcaggaggatcacttgagccagctgaggaggtggaggctgcagtgagccatgatcaccccactgcactccagcctaggcaacagggcgagaccctctccaaaataaaataaaataactccatcctttttattgctaaataatattttgttgtatagatttaccctaatttatctatttacctttgatggacatttagttgttttttttttcagtttttgtctattacaaataaatctgctatgaatattcatatataagtcttggcatgaacacatgctttcatcttcctttggcgaatatctacaagaaaaatggctgattatgtggtagatgtatgtttaacactttaagaaactgccaaactgttttccaagccagttgtattgttttacattcttaccaataggtctgggttccaagtgttccaccttctcactaacatttgctattggtacttaatgtggatttactttgcatttccccagtgactaatggtaccgaacatcttttcatgtgcttatttgccattgtagatactctttggtgaaatgtctgtccaaatatgtttcggatttgagaaagtcagaaaaatctgactttgctgatttttcattcccctattagaaacctctccctatggcaatcctgaccctaactttgtgcttagattcagcaaatgtcctttggaccaaagaggctgttgatcttggctcacctaagcaacattcttcctttttttagttaatctaattttatttgctttcccagatcattgatgcatttaaaaatatgattattgatatggtttggctgtgtccccaccaaaatctcatcttgaattgtagctcccataattctcatgtgttgtgggagggacccagttggagataatgaatcatgggggcaggtctttctcatgctgctcttatgatagtgaataagtctcatgagatctgatggttttataaaggggagtttccctgcacaaattctcttttcttgcctgccactatccatgtaagatgtgactttgctcctcctttgcctcctgccatgattgtgaggcctcctcagccatgtggaactgtgagtccattaaacctctttcctttataaattacccagtctcagttatgtctttattagcagtgtgagaacagactaatacaattattataatttatctagtgtttcaagctgttacaacagaaacttatcactagtttcttgcattctactttaaagcagaagttcctcagatggattaaatacttaaatgtgaaaaacaaaactttaaaacattgaaaagaaaatacagatgaaaaggccgggtgcggtggctcacgctggtaatcccagcactttgggaggctgaggtgggcagatcacctgaggtcaggagttcaagaccagcctgaccaacatggagaaaccttttctctactaaaaatgcaaagttacccgggcatggtggtacatgcctgtaatcccagctacttgggaggctgaggtaggagaatcacttgaactcgggaggcggaggttacagtgagccaagatcatgccattgcactccagcctgggcaacaacaccaacgacaacaaaatgtaaaaacacaaaccccatagggccgggcacggtggctcacgcctgtaatcccagcaccttgggaggccgaggcgggcggatcacgaggtcaggagatcaagaccatcctggctaacacggtgaaaccctgtctctactaaaaatacaaaaaaattagccaggcgtggtggtgggcgcctatagtcccagctactcgggaggctgaggcaggagaatggcgtgaacccgggaggtggagcttgcagtgagccgagatcacgccactgcactccagcctgggcaacagaccaagactccatctcaaaaaaaaaacacacacacacaaaaaaaccacaaaccctaaacttggagaatatgtttccaacacatataactgacatttaacaccccaaatagataagatactcttataaatcaataagttaaagaaaacatctgagtagaaaataggcaaaagacataaacttgcatttcacagaaaaaaaattcatagccaatcaacttataaaaagatgcacaatctcattagtaatctacaagttgaaaccacagaagttcagagagtggcagtctcttggaaaggggtagcattatgatcagggagaagtccatggcaggcttgttgggagagggagtggcattttatttcctggtggtcattccaaattttataattatttattaaaccatacatgcatgctatgtgccctttctaaatgtatttgcagtctacagtaaaaagaatttttaatgttctttaaaagtaggcatcttttggccagacgcggtggctcacgcctgtaatcccagcactttgggaagctgaggcaggcggatcatgaggtcaggagatggagaccagcctggctgacacggtgaagccccgtctccactaaaaatacaaaaaattagctgggcatggtggcacgagcctatagttccagctactggggaggctgaggcaggagaatcgcttgaacccaggagactgaagttgcggtgagccaagatttcaccactgcactccagcctgggtgacagagcgagactccatctcaaaaaaaaaaaaaaaaaaaaaaaaaaaagtaggcatcttttttctttatatcaacatacacaatgttatacgcctctttgacctagaaaccattttgtttcctgaaggtgatactgcctagttctagtagactccaccctggctcaccatagtattttaccatttttttcaaaaggcaaactcactgacaacatttgttgcccgttgggagaagtcccgctgcctccccagtgcaccaacatcagcaggatttaggggttctgaataaggatgcctctcaattcaaaccactgggtcaacagataatcagtctaaggtaaaacattgtcgttgtcacccatccccagcccaactttccttggttctgggctgttctgaatcccacaactgcagagcctgccttggtggcagaagaagatttgattaaacctgctccttctgaggcagggtctttcaccatttttaagtcatggacccctttggcagcccagtaaagcccatggacctcatttcaggataatgttttattttttttgttttgttttgtttgctcaggctggagtgcagtggcgggatctcagctcactgcaagctccgcctcccgggttcaggccattctcctgcctcagcctcccgagtagctgggactacaggcgcccgccaccacccccggctaattttttgtatttttagtagagacagggtttcaccatgttagtcaggatggtctcgacctcctgacctcgtgatccgcccacttcggcctcccaaagtgctgggattacaggcgtgagccaccgcacccggccagattaatgttttaaatctgtaaaacaaaataagcaggattataaaggaaaccaattataccgtaacaattatattacagctttaacataaataaatcaaattggaaatctagtaataaatgtgcttctttattaatgcattaaataacacgatctcgtggcggaactaataactggcataatttccaaatagcgacagatgcaaatgacattttgagttacctccaactgctgtaatgtgatgtaaaaaatacctgtaaatttattggtgacaaaatcacaagtactgtttgttgacactactgtgatgtgttgcctacattgattattcatggaaatgctaaatttcagttgaagatgagtgaaaaattagatgcatatctttttcctctcaaagttcagggactccgggttaagaaccctgaggtgtaaatggacaccgactgccactagggggtgctggtattttaggaagaggcgtttgctcctccagaggagagagggtgaactccttgagtctctttgcccttttctctggcgggcttcagaactcacagccctggaacatctcctcctggcctcccagccacctccaaaccctcacaagcacatcctgttgacagtggaggtgcaactcttggtgtgaccatctataactcatgcagaggcctcctcagtgaatcctctgaccaccagcactcagaggggtgtacggcccagtgggtaccactcacagcacctgagcctaggtccttgcagtaaccacagtcctgactctaggccatcggggccagcaagaacccacaagacactgcaggctctggttctgagcagactcctcaggccctgcccggcttccttctgtggttggtgggcagccaggcaggtcctgatgaaacctgaggagggccaccagcctttctcccctccataattgggggcccagcagaattggataatggtctgcaagttacctgaatcttgggctgagacaccgtggtagtcagagctgccgagcgttcacagatgtcttgcctgattcctctcaggatgagagtggaaataactttctttctgggcagagtttgatgatattgctacatcatcctctgtaggcaaaacagcaagagtctgctattcccaccttgtgcttgcactggtaggagagccagctttgaaaccactcgaggggcagtgtgacagagtgacaaaggagactccagacaacttgaatcagaaaacccacccctgaggccgggcgtggtggctcacacctgtaatcccagcactttgggaggtccagtggggtggattgcgtgaggccaggagtttgagaccagcctggccaacatggtgaaaccccatctctactaaaaatacaaaaatttgccaggcatggtggcgcatgcttgtaatctcagctactggggaggctgaggcaggagaattgcttgaacccagaaggtggaggttgcagtgagctccagcctgggtgacagagtgagactccgtctcaaaaaaaaaaggaaaggaaaggaggaagaaaaaagaaagaaagaaagaaaagaaaagaaagaaagaagaaagaaagagaaagaaagaatgaaagaaagaaagaatgaaagaaagaaagaaagaaagaaagaaagaaagaaagaaagagaaacaaaagaaagaaaagagaaagacagacagacccgaccaggcacagtggctcacacctgtaatcctggcactttgggagaccttgatcacgaggtcaggagattgagaccatcccagccaacatgttgaaatcccatccctactaaaaaaagtacaaaaattaactaggcgtggtggcatgagctggtagtcccagctactcgggaggctgaggcaggagaattgcttgaacccaggagacggaggttgcagtgagcagagatcatgccactgcactccagcctgggtgacagagcaagactctgtctcaaagaaaagaaaacccaaccctgccacttacttaggttccgtttaactttaggtgagtcatttagaatccatgcctcagtttcctcgtctcccaagtggagataatagccctgaccttatagggttgttatttgggttaaatgacatgctacacagaaagcacctagaagagtacccggcccatagtaagtaccaagtaagattttgctattattaataattggtatgaaattgataaaatgaataaaattctttctctccttgcctccacttacccaaacaccaactccactttctttctcccatcatgactctgtttgctcctacaaatcagattctttttccctttttaaagaaagagtctgatttcccagccttggcaacatagcaagacctcattgctacaaaaaaaaaaaaaaaaaaagccaggtgtggtggcacacacatttagcccagctacttggaaggctgaggtgggaggatggcctgagtccaggaaggggaggacgcagagagctgtgattgagccactgtattccagcctgagtgatagagtgaaaccctgtctcaaaaaacaaggtttattccttttcaccccaaacttgtccctgtccctccctcatgaccttcctgggaagcatagtaaaacatgcatcagggcaagagcctggagacctggggtttaattccacttctgggcttcccctccctgagcctcagctaaacatccaaggatccctttgttttaaaatataggttgtgttggctgggtgcagcagctcatgcctgtaatcccagcactttgggaggctgaggtgggtggatcacctgaggtcaggagtttgagaccagcttggccaacatgatgaaaccccgtttccactaaaaatacaaaaaaattagccacgtgtggtggtgggtgcctgtaaccccagccattcggaaggctgaggcaggagaattgcttgaacccaggaggtggaggttgcagtgagccgagatcttgctattgcactccagcctcagcaataagaccaagactctgtctcaaaaaaaaaaaaaaaaaatgtaggttgtcttattattcaggtaatgccgaggacagcagatcaggagacaactaccattgaaaaaagagtttgctactcacagttccggagtggaagggacatgccatgccacacagggccacacgggggagcccagggttgggcaagaggcagaaggaacaagaggaaatcagggcaggggccttaactatggtttcggagggaaaggcaggcaaggcaaggtttaggattggcaagtgtgagtaattttggcgggctccaaggtataggggatttctctagttgtctgacacttggccctggggtgactaggacaagtcgtgagagtttgggtgtgggctctggattggttggtttgcatatcaaaggtgtgctcacagcgtagtctttgccatctctagggattaactaaccctggaagggacagtccctccaggatcagcaaaccccagaccccaaagcatcaagaatacagaaaacaagaagacgtagttaatatacccttctactatgaatgtggtttcatcagccactttatacatgtccaacaatacatattgctgctatgacatcatgactttttatcttcacaggggattctgacataggggttaaggataccgtctctggagtcagactacctggatccaatggtaacctctctgtgcctcaatttgtagctccctcattttatagctgtgggatttgggggcaattacttaacctctctgtgcctcagtttcctcatttgtaaaatgaggatgctagttccttatttcttagcacggtggccattagaaaaactatacttgtaaagaaagctcttagaacaggctgggcatatagggagcaatcaatacctgacaactattgtgatttcttgatcatgtcaagctgccttccagattagagttttcacctctgctgttccccgcgctgggaaggctctttcccactctcttcacctgggtaacaccttctcttccctcatgtttcaacttaaatgtcacttcctcagcgatgcccccacgtcccaggcccctagcctacccagcctttgttatactctgtcacatggcccctgcacttccttgtaatgctcatcatagttgcaattgcacagctgtttgtgttacagtttattgaacatctgcctgcctttccctgtagaccgtaaaccttaggagagcagggactgtgtctgtctggttcctgctgtgtccatagtgcctggcataccaaaggtggtcaataaatgtctgtgcactggataaaccacataggtttacagctgcaggtgcatggatgcctgggtcagaggccatctggactcttgtctaatggcagaaatccaaagtcacaggcttctgacccctttgtttgatgatgggcttctgatgaagggcttctgggcccttcagctgcccttttcaggccagggagtctgggagggaattcttgaggatcaaaatccatgttgtagatgaccagctggcctggagacatcaattggcagaagtgatggaatgtgtacggaaagatgcagctgccctgctcaggagggacttcatccttgctttgctaaaccagctgaattccaggaataccagcgaggggattgggtcatgtcatacctgcctctcgagacaagcaagccgaaagctgaagggggcagggaggtgctagaactgcagagagaaaggaagggccagatgtacggaccggaaaaagccctgtagcaggtggaggtgaatataattaatggagcccagtgagcaagtctgcacatgccaacgtcaaaacctcatcccaaggagccatggtctcactaaccccatccctgagagggcagagcaagaatagtttgagattgacatgccaagcaaatgtatagcaggaaattctcctaagccaggggtttggtcagaggccctggcccctgtggctaaaatcaggattatgtctgtactgatttacttcccagctgggtttcaggaaaagcctcaaaaagaccacagggttgtgcctcagattggcacatgaggccagcttcccttgggtctgtgctttctggacaaaaagctaatacgaagggagatactcagaggaaaaggccccatcccacagcctccctctctctatagccccctttgagtcttggcaagtgtatttgtgacagctagaacaaatcaaatgtattttacaagtttagcctcaagcagaccaagtgccagctttggtagacatgtccaaagggattttgaccctggactagtggttctcaatggagatgctattgttcatttagagatttggggggtcgtggctttggctgtcatagtgattggcagtcactactaccatttagttgtcagggaccagaggtactatatgtcgtcaatgcatgtaagcaaccattgtgcacaggaaagggttgtcagccttcccctacaacttttagataccccactggatattcatgtagataaaatataatctgtgctcagagcctacctttattttgtttatgtacacaaaggtttggtttggttaggttttcacaattttaacatacactgcagtttccaggaaggcaactttaccaagtgctgttgcctactttggaaaatcacgttacctggggcaatgccactctaggtgctctaggtgttggaattaccagagcaacacatctctatcagacctcatttgttactatggtgttcttggtaatgctacacctaggtgcaagcagctgactacttcaatatgtcatctaacatagttgtgcccaagcatttacatattggaatgtgtgttattttattttatttatttatttttgagacggagcctcactctatcacccaggctggagtgcagtggcacaatctcggctcactgcaacctctgcctcccttgttcaagtgattctcctgcctcagcctcttgagtagctaggactataggtgtgtgccaccacatccggctaattttttgtatttttagtagggacagggtttcaccatgttgtccaggctgatctcgaactcctgacctcaagcaatccacctgcctcggcctcccaaaaatgacgggattacaggtgtgagccactgtgcccagcccatgttattttattatacttggcttcttcttcttcatattgtgttgatatagtggaggaaattatggatgttggaaggcaatatgataaaggggtgtgttatatattttattgtttttaattatttatttttttgagatggagtctcgccctgtcgtccaggctggagtgcagtggcgcaatcttggctcactgcaacctctgtctcccgggttcaggcgattctcctgcctcagcccccaagtagctgggattacaggtgcccgccaccacgcctggctaatttttgtatttttagtagagttggggtttcaccaagttggccaggctgttctcaaactcctgacctgaagtgatctgcctgcctcggcctcccaaagtgctgagattacaggcgtgagccaccgcgcccagccaagggtgtgttatagaatatttgttacaaaaaaagaggatgatgctgtggaaaaactcagacaggtgcatcactgccttggttggatggcagtacatgagtccacatggagctaacgctttacccaaaccatgccctttatttgtagacatccactattttctctaaatagaagaaaactttttttagtgagtggagctgattagaaaaaatttgttccattatagttgatatcgttatatataactcacagatggacccacatcactagcaaactatttgtatcgtttctccaagcccagcatttactgtgcgagccacctgggggccatttttgttgcccgaggtggtgcgcctgcgccacctggtggactacgggaaagtagcagatcggtgagatgggttgaggcaccttcatttgcagatgggtaggcaataataacatgaatattatcagctaatgcacttatagggtgcctataagtgcattaactcctgcagaactcacaaaatctttatgacatatagtcactgttatctcctttttgcccatgaggaaaccgaggcaagtagtgagtagagaggcagagctgggatttgaagcctagtggactggctccacagttgctgcttttaatcaccctgctataagctgggcatggtggcacacagctgtagtcccagctactttggaggctgaggtgggaggatcacttgggccctgagatggaagttgcagtgagctgagattgcagcactgcactccagcctggataacagagtgagaccctgtctcaaaaaataataatacaattaaaaaattaatcagtctgctatggacttgcaagtagctgctctcttgggagacactattctgagagtcaaaggctgtactgtgaacatagggctgccttcagccatctctttcagggcagtagggttacaaagacagagagaaaggatggtgtgctcagtggctcacacctgtaattccagcactttgggaggccaaggtgggcggatcacctgaggtcgggagttcgagaccaacctgaccaacatggagaaaccctgtctctactaaaaatacaaaattagctgggcgtggtggcgcatgcctgtaatcctagctactcgggaggctgaggcagatgaatcgcttgaacccaggaggcagagatttcagtgagccaagattgctccattgcactccagcctgggcaacaagagcgaaactccatctcaaaaaaaaaaaagaagaagaggaggactagaaagagagtacctagtattaggacatggtaagatctagaagagtcttgccattgtatggaccatggcaatctttgtgcctactgtgtgaggagggtgtttcattcttttggcaatgaagggctctagaatggctgaatccctaattatgttgcaagcttcgtgaaggaaaagtacacattccctgttcacttctgtgtcaccagtatttaccccaggacctgacaggtattgaatgttcaataagtatttttatttatataacatctgtgttgagatattcatataccataaaattcatccatttaaaatttacaattcaattgtttttaatatattcacagagttctgcaaccatcactgtaatcaattttatcacccctaaaggaaaccaggttactattagaattcattccccgttacccccaactcctatctctagccctggcaaccacaaatctactttgtgtctttatggatttgcctattttggacatttcattataactggaaccatacaatttttttttgttgttgttgttgtttgtttgtatgtttttttgagatggagtctcgctgtgtcgccaggctgcagtgcaatggcgtgatctcggctcactgcaacctccgcctcccaggttgaagagattctcctgccccagcctcctgagtagctgggactacaggcgcgcaccaccgtgcccagctaatctttgtattttttagtagaggtggggtttaaccatattgaccaggatggtctcgatctcttgacctcgtgatccacccacctcggcctcccaaagtgctgggattacaggcatgagccactgcacccggcccacagtcgtattttttgactggctcctttcacttagcataatgttttcaaggttcatccactttgcagcatgtatcaattctttattcttcttaatggctgaataatattccatcgtatggatatattgcattatatttatccaatcattagttgatggacatttgggttgtttccagtttacggctattgtgaataattctgttatgaacatttgtgtataagtttttgtgtggacatgtgttttcatttcttttggatgtattcctagcattgcagttgctgggtcatatgtaaatatgtaactttacatttaacctttgaggaactgccagagtatttccaatggctgcaccagtctacattcttaccaacgaggtataagggttccaatttctctatatcctcgccaacacttgttattatctgtcttttttattacagccatcctaatcattgtgaattggtttttcattgtggcagggctgttgctttttaatcataggcaaataaacacccagcctattgaagctggatggtaccacaacaaccatgtggtccaatttgttcattttataggagaagcaacgaacgtgttaagagaataagaaactatctcaaggtcacacttagtaaaggaggcagtaacagaacctatagatttttttttcttttaagaaagaaaggaaattaaagccagatggcataaaaagagagatagagaaagagagtcttctataaaacctaggagaaatttctttaaccataaaaccagaagatgctgggtgcagcagctcatgcctgtaatcccaacattttggtaggctgaggcaggaggaccacttgagtccaggagtttgagaccgcctgggcaacaaagaaagaatcaaggctgggtgcggtggctcacacctgtaatcccagcactttgggaggctgaggcgggcggatcatgaggtcaggagatcgagaccatcctggctaacacggtgaaaccccatctctactaaaaaaaaaaaaaaaaatacaaaaaattagctgggcatggtggcaggcgcctgtagtcccacctacttgggaggctgaggccgaagaatggcgtgaatccaggaaggggagcttgcagtgagccaagatagcgccactgcactctagcctgggcaacagagcgagactccatcaaaaaagaaaagaaagaatcaaaaagattttttgattctacaaaaaaattgaaaaattagccaggcatgacagtggtcccagctacacaggaggcgacggttctctatttattccttcagtcattttaatggttattgggggaggtgtgtcagtggaccatcttggaccaaggtttggatcccttgggcccaagagttcaaggcttcagtgaactgcgatcgcaccactgagctccagcctggggacagagcaaggccctgtcaaaaaaaaaaaaaaaaaaaaaaaagcacaagacagacaatgaatcaataactaataaaggatagtcataaatagttagtcatggatcctctactacgtcttaggtgcagaacacggtaagtgctttacatttgcttccctgtttaatgctagcaacatgcctattttagagagttgaagtgtaaataaaggattatgaccctagactcttatatctaactactgtctgtgtataaagtaacagacaatctgagacatgcgaagactcaaaaaatccaccgtccatccacccttcccccaaggtttactcaaagtagcatttcagtggtgtgagaaattaatcaaagtaaggaactcaggaatgaggaagtcatttacgtaaatgaaatgacaataaacaatgtaggcagaaaaactgagttagaaggctgggtgcagtggcttacacctgtattcccaacactttgagaggccaagatggaaggatcacttgaggccagaagttccaaaccagcctgggcaactcattgagaccttgtctctacaaaataaaaagtgttttaaaaattagccgggcgtggtggcatgcacctgtggtttcagctactcgggagactgagatgggaggatctcttgagcctgggaggtcaaggctgcagtgagccatgatcccgccactgtactgcactccagccaggatgactgagcagggcccggcgcccccaccgccccccgcccccacacacacctgcgccaccaccgccccccacccccacacacacccactaccaaaaaaaagagaaaaactgagttaattatgaacgtagtttgaaatcacaatgccaatgtcaaaaaatgattcttcaaagagcaagcatatgatgtaaaattttaataatggcctgaagctaggatcctagtttatgccggcaaacctgtgtcctccagcagccttaagctcggcagagattcccaggcgccggcctcgcgggtgaactgtcacacgtacccagagcttggaggaggcgcgccgggggagtgttgtgctggggattcccaggccggctcctgcttctcgcctgatgaatgtggagttccttcagccatccctcggatcctcttaaacttttctaagtttcaggagtgtgaatgacgcattcccctagtgttaagtggcgacagttctccctctattttatctcttcagtcattttaatggtcattgggggaggcgtgtcagcagaccatcttggatgaagggcaaaaagaccagttagcatggaattgaggtttgtcgctggtgatggcagtggggacatgatcgcacgtccttgggtcagacttctcagctctctcctccccatttttacccccagcactcggtcaaacaaacagacaaacaaaaagacccctgcaactcccagacaaaccaaagctagagtgtgtaggttgggtggctttctgttggatagttgtgtgtcccaagttacacgcatcctatcttggcccagctccactggagcccgagcggcggggcgcagggtgcgagcgggaggctggtgttctgcccgcgatgggcaggggagccgggtggccgcggggcgaggagccgcgagggccgggccggcgtgacaccacctggcggagtctcggggaagagtcttaaaggcgcgcgctcctccgtgccccgcgcactcgaacgggagccgcggagagctcgcctcccgctgccgccggcgcctcggggaggtaagtgccacccgcggatcccgagtcgcggccgggtgggggcggcccgcggctgccccgcgctcgggaagctctggctggggctgcggtcggagggcggcgcccaagttttcttgaaggcctcggagggcagctggagcggcgtagagcctgcgcggggatggcgggggtggccgcgggccggggccgtctgggggcggccatcccgggcggtgcgtggaaaagtaggcactggtgcgcggcgaggggcgcacgccagagccccagccccgcgtcctgcgcacttggcgcgctctggccgcggtcccggcgagccccagcctgctccgggccgcgaccccggctccgcgccttcctgcccgcccgggtcctttgtagcccgctggccccgcggtcgcgcacggtcacgccggcaggtcgcgctcggcggccggccaagccagccccggccctgccgcgcccgcgccccgggccaccccgcccggccccctcggcgctgcacccctcgctttccccatctccagccgctcgctattttcacacctcccggtgccccggccccggcgcctgattcagtgcttagtaattaatttggcgtttcagaatggtcagcgggctggataatgggtgcattcatcccccgggctaatctgaacagaggtgggaagaaaggctttcacagacagaaaatgccattcgccgagcgctcaaaggggctgtcactcccagaataaatcgccgccgcgcccgccggctcctctggccatttccatacagctccggcccgcgccgcggacccgccggcctcggcctcggctcccgggaatcactcactcgagtgccttcgacgggaaagtcgggcgagagctggacccaggcgggggccgagggaaacggggaaactggagactcgggtgaaggccgcaggggacaaagagattgattagaaaatcaaacgcgcatctagaaggaggcgcaggcgactgctcaaggcgcggacggcggagctggggctcgggagcgtccgtccaaaacccccgaggttcgccaaagaggagggcccgcggcccagaccctccggagcgtgcccgaggcgacacggcaagcttctggggctcccaaattgtgaatggagttcaatgcacaagcatagatagtagaaacagggtcgacctgcacagactttttattccgagttccttgtgctatcagccccgtcgccctcgcggcctggaaggtgacacggtgtcttccccggcctcctgctcgccacccctgttgggaccctcgggtccgcctggggacatctgctgagcgggtgacggaggctttatcctttgatcccttctggatccggtgacgcgctaagtgttgggcacgtacggcctacggagtttgaatgctggggccttcctgttgcggcacccccagcccactggtgcagcgggatcgtgcgctcccgccgcagccctaatccagaggaccgcgccgcgccagcgccttcagccaggctgtggcgcctccagtgggtagggctggctcggctctagccaggtgaagctccagactctggattttcccgtcttcggggttcagcgtgtatccacctcacccggccgacttggccctgggccctttcacccagtggaatcctgccactgggagaagagaaagagctgtggctctatggcgaaatcttagctcggttgagaggcagaactgacacagctgggacgaaggggagtttctggaatggccagatgcgtgtcccaggtgtgtaggggagatggaatctccgtactactcatcaacttctgagtggaagtcatccctcccctctgtgtctgtttcctcatttgcaaaacaaggataaaatgagatcacatgtggccccaagtaagggggctctcagtagaaggatcccaggcaccgctcccaccactgaccaccaaccttgctgcacctcccccgcatctctccacgtcttcaccaacattctcctgggagctttagcgactcccagattttctctcaggctgcctccacccaccccttgtggctttcgggttctgatatccagctgtccttgaaatcacgctttctaagagttggaaacatccttccacagattctagagccattatacagatagtgatattgaggcctaaagtgacttgcagttgtcacccagctaattagagggcttgagccagaatggatttcatggcaaacagtgaatctcggactctgggcatcagacttccaaccgcccccaccccgacccaacacacacacacatacacacacaccctccctcctcctccccaccgctgccccacagcttccctacgtctggggaggggcccagaaggctgcattttaaacaagcatcctgaagcatgttgatgcaggtggtataaggaccatatttaggggaatgcagcccaaatcaggttctttacctagcaggcccttctctcccaggaccatgggctttgcttgttctatgtgcgtcacatatgatctgcagaacagtcttttcggtgtcctcccagactggaggccatagtgggtgaggtctatttctaggagatgctccagtatcctccagaatgtgcagccaatgagggagcggcagggggtgaactgtgcacccagccagatgaggagaggccagagtgcaccgcaggctgcctggatgttgagtccccaaacccaggggccttctcttaccaatgtgctttcacagctggacctaacactgcacactgcaggccccacacagacagtacaaatgtgcccagaggccccccttggcaaggcaaatctgcccacgccagggacagagcagccggccatagggggacccatgccagcaataacccaggtgtgagctgtggcccagaatgccagcacctgccccttcagcatgctggggtttggaggtgtgaagtgggcggtggaggggcaaagagaaggcctggaaaagtggaagaaagtgggtagggggaggagaagccatcaggtacgggggtggtgggtagtgggggggacaagtccctatttatgtaagccatttgtagctgcgaattgtaaaactgggcaggcttctctggagtaattcatagtgtttggacaagacaaacattgttctgctttaaacaaacctccagaaaggtcagcttggttcatccctttgctgcgagtcgctgagactatccagatgatgagaaaatcagatcttcgctgagggggcccaggcaggaggtggtggactcctgagccctttggatgctgagcgaggacacccagtgcagggaggggccttggctctgttgaaaaggctggactcccaatccggagccaggagatgtgaggtgtgtgtgtgcacatcacagattgtgagattttgatgatggcaaggacatcatccacattctagggccaagccaacatgacgtgcaacatgaatcttctttatgtggaagaagaattgatgggaaatgaaggttcatggatgcagaaccaaattaacccaactaatgctatgcccagatatggccctggacaccaagaaatccatgttccttgcatatggatgccctggtagggcccttctgtgttcatttagcaaacatttttgagtgatcacaatgtgtcaagttttgtgctgggtactcagggttacagtagggaacaagaaagatatattagtagcacccactcttggggcctatagttctgggttatcctctccttccctgtcttccctaagaagagaagctgttcacaatttcacttccagcttctccaccgccatcatggcctcaccaagccccctggccaagacccagcataccagctccctccacggggcctgacagtaagtgctcaagaaatgctagccgccatggttataattacgagtacaattgtgattacgagactccattgttttcttttcttttcttttttctctctctttctttctttctcttttttctttcttcctttcctttctttccttccttctctctcttccctttctttcttccttcctttttcttcctttctttctctctgtttcttttctttctttccttccttccttctctttctctctttcttttctttcatcccttccttccttctttctttctttcccttcttttcctttctttcttccttttttctttctttctctttctctctctcttttctttctttccttccttccttgtctttctctctttctctcttcttttcttctctctttctttttctttcttcccttccttcctttcttcccttccttccttctctttctttcattcattcattctttctttctctttatctttctttcttttttctttcttccttccctccctcccttccttccttcctttcttttcttttatttcttttctttcttccttccctcccttcctaccttccttccttccttctccttccttccttcctttctttcttttctttcttccttccctcccttccttccttccctccttctcctttcttccttccttcctttcttcctttcttccctcctttctttctttcttgcttgcttgcttgcttttagagatggggtctccttctgtcacccaggctggagtacagtggcatgatcatgcctcattgtaacctccaactcctgggctcaagctatcctcccacctcagccttccaagtagcagggaccacaggtgcaagccacaatgcctgcaaataatttattattattcttattatttttgtagagataggattttgctgtgttgtccaggctggtctcaaactcctggcctcaagtgtcctcccacctcggctccccaaagtactggaatggcaggtgtgagccaatgcacttgacttagactctgttcttgagtgatctatctgaccctgagctgaagtggatactttgtattgatatttactattcattctcattgtcttattattaatggcttattaacaatacattattgatgctcattaacactaaagcccagtgtctctgtggtgccagtcatcactgtcctgtacatgatctctgtttgccctgtagtaagcttggtgatggcagtatcactggatttgctggttctaggcaactttttaatttaagttaattaattaattagtttatttatttatttatttttgagatggagtcccactctgtcccccaggctggagtgcagtggtgcgatttcagctcactgcaacctcggcctcctgggttcaagtgattctcctgcctcagcctcccccagtagctggggttacaggcatgtgtcaccacgcccagctgatattttttgtattttcagtagagacagggtttcaccgtgttggccaggctggtctcgaactcctgacctcaaatgattggcccacctcagcctcccaaagtgctgggattacaggcatgagccactgtgcacccagcagtctatgcaactttatgaaaattgtttagggctttggacactttagggtcttctgcatatggttttttactcaatactcctgatatccatggaaggaagagagggcgggagaacaaggaaggaagattactatccacatttttcagaagaggaagttgatacttacagaggtgaagtgatttgcccagcatcacggagatgttaacggaggggactatgtctgactagggtacaatccaaaccccagctctactaaaaatacaaaaattagctgggcatggtggtggatgcctgtagtcccagctacctgggaggctgaggcaggagaatcacttgaacccaggaggcggaggttgcagtgagctgagatcgcaccattgcactccagccagggtgacagagtaagactccatctcaaaacaagacaaaacaaaaacaaaacaaaacaaaaaaagctctgtcttgggacttttgcacatgccattccctctgcctgaatgtacacttcccccaaataacatctgtccccagagcttccttcctcacttcactcattctgctctactgggtccttcttagggagtccttccccaagtacctgcttgaaatccaaacagtcctcttgggcctgcatcaccctgctgaccacccatggagctccctgcaagcagacctggaaaccagcgctctctgggcgaccccataaagcaggtgcttggccagaggctaggaagtggctccctgggcgaggtcatgtccttcccaccttctgcgtagtttctggcattattctgggggctggcatggtgatgctcctgcctgatatcagcatccacaggtgagggggacattccttccttccccaccaaatcttagtttcctttgccatcttattatggttgaataatccatgcacttaaccattctgtttggaatcaatgatccatgtctgttttcatccttggagttaaatcctctaaattttctttctgtgtgatatataaaccagcaatacctcattttactgacatttgggggaaataagctgttctacataattggtttttgcagttaacagtagcttactccttgaagcatagaaactttttatggaatcatatttcatgaaaaacatttttccatcaaaatcatgacttttttcccccgcctaagttagcggaattgaatacagcaggtgttccctaggtgtggctgaatgagtggcccccaacccgttttgatgactcacagccatctctggaaacagcagctcctgggcaatttgctcaacctccctgacgtcagtttcctcactcgtaatctggggaactttggatgagatactctctaagggccgcctctgtccttctctaactctgctgggctctcatacagtaaagcccttgggaatttttggtggttgcaggaccagtcttgcctccctgaatggtggctgggataggattctactgtcagctgtcacttctcagtgcatccatgttcagcagtcaccatgtccccaaggatcttaagctgtggctctccagtcccctggaagaacagaagatgtctgacctaaggttataaagtcttgtaaatgaagaactcctggggtccctgcagactgaagtcccctgtgtcttggctactgttctctcaaatgcccaggaggctattcacttacttctggactgtgatctgggttgtaacgggtgctgcaaccgtggcctctagagaagaggtttacaataccttaatacaaacagcaagcacttggcaagcttctgttgactgctctgaactcagtgttgtggggagggaaggagcagtgagatgtggtcacttcccgtaagaagaaaacccaaaggaagacttcatgaatgttttaagaccagcgtgttagtggtctctcattttgttcctttcatttgccccaagcatgtcttttaagatttgaagaagactcttaattctggcatttctgagatttgctgggatattagtttcctgcggctgctgtaacaaattcccacaaatggttgcttaaaacaacagaaatttattctctcacagttctggaggccagaagtctgaaattggtatcaatgggttgcaattaagggctgtagggcagcggtcctcaacctttttgggaccaaggaccagttttgtggaagacagtttttccatgggcgtgggggtaggggatagttttgggatgatccaagcgcattacatttattgtgcactttatttctattattattacatggtaatgtgtaatgagataattatacaattcaccatcatgtagaatcagtgtgaggcttcagcttgtttttttgcaactagatggtcctatctgggggtgatgggagacagtgacagatcatcaagacttagggccttataaggaatgtgcagcctagatccttctcatgtgcagttctcaacagcattcttgcttctgtgagaatctaacgcagctgaagatctgacaggaggcagagctcaggtggtaatgcgagcgatggggagtggttgtaaatacagacgaagcttagctgccttgcccttgctcaagctgctcatgtcctgctgtgtggcctcgttcctaacaggccacagactagtggtagttcctggtctgggggttagggacccccgctgtagggaaggatcctttccttgcccttcagcttctcatggctgctggtatcccttggcttgtggctgcatggctccaatctctgcctctgtctcacgcagctttatcctcttctgtcttgtcagatttccctctgcctgtctcttgtaaggataactatgattacatttagagtccatcccgatatgccataacaatttctccatctcaagacccttaatcacgtcagcaaagacccttttacacccatataaggtaacattcactggttccagggattacagatatggatatcttttgggggggcattttttttgagacggagcctggctctgtagccaggctggagtgcagtggcacgatctcagttcactgcaacctctgcctcccaggttcaagtgattctcctgcctcagcctcctgagtagttgcgaatacaggtgcgcaccaccatgcccagctaatttttgtatttttggtagagatggggtttcaccatgttggccaggatggtctcgatctcttgacctcgtgatccacccacctcggccccccagagtgctgagattacaggtgtgagacactgcgcctggccctggggggcttttttagctcaccgcacagagctggtcaccactttaactgtccataattctgtggtctttagtcaattaatttgtagtgcactcctattttgtgccaggcagtctgttaaaccctggggattctgagggaaaagaatagttccttcctcagacgctatgaaaatcagagctatgtggaaaagaaggaatctgggccttaaaggtatctaagatggatcttgatgagctcaaattccccatcaaagtctgcaaggccctgcttggtctagctctcagcctcccctctgagctcatccctaccactccccatctcattacttaaacaagctctgggccaggcgcagcagctcacgcctgtaatcccagcactttgggaggccgaggtgggtggatcacctgaggtcaggagttcgagaccagcctggccaacatggtaaaacccatctctactaaaagtacaaaaattagctgggcgtggtggcggatgcctgtagtcccagctacttgggaggctgaggcaggagaatcacttgaacccgggaggcggaggttgcagtgagctgagatcgcaccactgcactccagccagggtgacagagtaagactccatctcaaaacaaaacaaaacaaaaacaaaacaaaaaaaaaaaaacaagctctgtcttgggacttttgcacgtgccgttccctctgcctgaatgtacccttcccccaaataacatctgtccccagagcttccttcctcacttcactcattctgctctactggatccttcttagggagtccttccccaagtacctgcttaaaatccacctcccctcctggcacgtcctgttccctcccctgctttgtttgtgcttctgatgtaccacagtggagttgctattgtctgggtcagctcagccaccacaaggatgttgagatgtgataactagaagttgtcagaagatcctaaacgcatcctgtttcatttccaattctcttcctgagaatgtagtttgctttttattttcttttacttttcttagtagcacattgggcttaatttcaagtaaatcagaatgggggtgggatggctctttaaagggggatgtatacattctaggagccattttttggttgtcataatgactggtgtatggtgtgtgtgttgtgtgtgtcaggggtgggtggaacttgctggcatttagtggacaggggtcagggatgctaagtgtcctgtggtagccaggtctgttctgcccagggaagaatcttcctaccacaatgccaataccacctctacagagaaacactctttttttcttttttctttttctttttttttttttttttgagacagagtttcactcttgtcacccaggctggagtgcaatggtgcaatctcggctcactgcaacctccgcctcccaggttcaagcgattctcctgcctcagcctcccaagtagctaggattacaggcatgcgccaccacacccggcttattttgtatttttagtagagatatggtttctccatgttggtcaggctggtcttgaactcccgacttcaggtgatctgccctcctcggcctcccaaagtgctgggattacaggtgtgagccacctcgcccggccagtaatatttttctatcatcttcactgataacctttcattctctaagagtattttaaatgatgtctcccagatccatcacctgctaacctgttccctggcccattcacacaaggtcttgagattctccagttcatcctcttgctgttgccatcagtccagtgtcatctctaaaccttgaggtttcacgaggggattccctccttcagagtctgtgtaaccggtaaacaagctgagccccaactctggctcagaggccccccactattttctccatctggagcaacatccttttctttgcaccctttgttccttcctcaaggcctgtcttccatccatgacaaagcctccctacacagtgacccattttctttattttaatagcatttggggtggaaccttgtcaaaagctttttgcaaatgaaaataaattacatctgctggttcccccatccacaggcattttcaccccttcaaagagccctggtagattaaaggatttggaggatttggggtttgtatgggcttctatgcccagctcctgagttctcagccaagacacctgcaaagggggaggcctgagctgaagatacagataaacgacgttggggaaatggatatctccaggaacgcttcccactagattggcctgctccccatgttctaaagccttttccaggacagtcacatctcctgaaatcctgtccagggacctgggattccctgagtaatcctccatgcagcctatcaggtgagctgggctctagatgccttgaaatgaaagactgtccctcgtacttctagggtaagagatctggtaggcagacctgagaattatacatatgaaaaaaagcaaaaacaaaacaactcaaaacctactatacattgaacatccatctactctctgccagggtctttcctttcagatccaagttttaaaatcgccgaccaaccctataaaggtgaatgcagtgaccccatttcaccatgaaaaaaatggatgctcagatgggcaagcaacttgcccagagtcacaccattaggaagtggcacactggaaccaaggcctgtccaagtcaagttctttcaatctgggaaggaaacactatgaatccaggccactgctcaccctcctggagaggccaaatcctcctggtcacctctgcctgctgcaattcccaggctgtactactgggagtactgggaactgagtcatctagggtctgtcctcttaactggaccagaggtgttaagaagcacagtccatccagaccacacagctcatactcttggtagaccagaagcccatccttcctctcagggatgattgagacccagtcaagcccatcttacccacaggttctgactaagagctccaaactctggacctagattattttagttcacacactgcttctctacctaccagtgatgtgatcttcagcaaattatttctctgtgtctcagtttcctcctccagtaaaatggacacaataatatacctatcttacatggtgtttatgaagattgtgaactaaggaatatcaaagtgcttagtagatgcttggcacacagtaaatgttacacataatgcttgatttaaaaaggaaaactcagccaggcacggtggctcatgcctgtaatcctagcactttgggaggccgaggcaggtggatcacttgaggtccggagttcaagaccaacctggccaatatggtgaaaccccatctctactaaaaatataaatattagatgggtgtggtggcgggtgcctgtcatcccagctacttgggaggctgaggcaggagaattgcttgaacccaggaggcagaggctgcaatgagccaagatcgtgccactgcactccagcctgggcatcagagtgagactctgtctcaaataataataataataaatacaattaaaaaattaaaaggaaaacccttggtcacacccaagacaaaggcacccccggccaccccttttctcctaagcctttgttctcttcttgtcctccctcctcacaaacattagcctgtgccatctggtgcccccgttcctggagtgtaccctcccctgtatcctcgtcctcctcactgattgctcctcccaccctcatgctcatcccagttgcactgcagtccttctcagaggtgctgtccttcttccaaaccacacatccctaagacccaggagtggggcgctgttgtcctcctccattcccaatgctccttccctcttcattaaaacaacaacaaaacaaaacaaaactccgggccgagcgtggtggctcacacctgtaatcccagcactttgggaggccaaggcgggcgaatcacctgaggtcagaagctcgagaccagcctggccaacataatgaaaccctgtctctactaaaaatacaaaaaaaattagccaggcatggtggtgggcgcctgtaatcccagctacttgggaggctgaggcaggagaattgcttgaacccaggaggcggaggttgcagtgagccgagatagtgccattgcactccagcctgggcgacaagagcaaaatttatctaaaaaaaaaagcaaaaacaaaaaaacccccacaaaactcctgttcctttaaggccagaaccacacggctgtcccaccttctacatctcatccttagaatgacctcccagtcaatttcactcttttctttctttgaagacaccagcactggtcagtcttcgtctctgccccaaactctgatgctggttccaaaggtctttagagcccaggtggacagcccgtccagcaccgtggccgtctcgtctctaatcaccctccattctgcctcacagcagaagtccccctcttattgtcctcggaaggccttgtcatcccccagagctgttccacctctggaatcctctagttttggaccacaacctcctcagttattccccacctcatagtcttctcttttcttgaatcctttagctatccaacagaatttcctgtgataagggaatttttctttattggtgctgtccaaattaggggcaactaggcaactaagctctccatgttactcatttttaattaattcaagttgaaattgaagtagctacatgtggtgactggctaccatattgaacagcacagctctagcccctggcctctctgtttcctcttccatcctgtcctgttttccttctttctttggcattgtcgccctggcccatcatatcagccacccactcccctttccttctgtcccacctcctggaaaacactctcaacttgagattaatccaactgtctctttctctaggtctatccaaaggctgctgggcgctgctggggaagagggcatgtgtgtctcatggccttgctggctgccattctttctcatagatagtcacaaacttcaataggccctttaattctgcccagcaagcattatcctcttctctctaatgacctcaagcctccagtgctcccagctcctcccccatcctcagcagatggtgtcacttcctatttcattgaaacaagagacacttggagaccacctgaccaccagttttacaagcatagttttatctgtcttccacctctctcctcctgctggctccagttcctatcaacatttaggcatggtcaaatagccttatcttacaaacaacaataaaaaatcccaaccttccctcaatcctatgtcaccttcctgctgtgaccctctatctttcctgccacttatattcacactttcttgaaagttgtctacacctgctatttccactttctcacctcccgttcactccacaaccccagacagcctggcttctgtccctaccactccctgcaaccactagtcaaggtcaccaatgacttccttgtagtttgatccaaaggacttgtttcagatcttatcttgacctttaaggcatgtgactcaacactgctcagcacccctccttccttgcaacgctcttacccattggtttctataacacccgagtcccctggttttcctcctcctcctctggctacttaaaagttttcttgaaactgccgcattctccccctcctagggtgatccgtctggcttcacaggtaagacagtgtgccaggaacggtgtttccgcctctcaacgcattccttgcagaaacacctggtgatttgctttctcacccaaaatctgcactgttgcgttttgaactccagtttgctctgtggatcccgctgcttagagcctgacatgccttcacgggtgtgtatttatcaccgccactttaagaacttctcacgacacttggacatctgtttttttcatttgtcccctcaacagacaggctgcgttaggaaaggacactgatgaattagaagggatggaagaggctgcagagtggtcagaaaacaatgtcctatgggaaatcattaagataactgggaacattttgcccagaagagataaaactgagggatgatagaggactggtttcaagaatctgaagaggcagagaaccttgatctgggctgctgtgtagcgtagggtttgggccacctgcagacttaacagagaggggggtttggaatggacgtagaggagttccaccgtattacaggaggttctagacctcctggatacaaggtgagtaagacagtcctgctcaccaggaactactaaagatgataagcgtagacctaagtgaccacaataaaactggaaggtgaccccgctcatcctctcctgaagacccctggcctaagctcagctggcaatgtagaaaagccacactctaccaagagccatttcaaacttactgccatgcaagggccatcaaaagctctgtggacataggctgggcgcggtggctcactcctgtaatcccagcactttgggaggccgaggcgggcagatcacttgaggtcaggagtttgagaccagtctggccaacatggtgaaaccccgtctctactaaaaatacaaaaaaattagccaggtgtggtggtgggtacctgtaatcccagctacttgggaggctgaggcaggagaatcgcttgaacccgggaggcagaggttgagaatgcgccattgcactccagcctgggcaatagggcaagactccatcttaaaaaaaaaaaaaaaaaaaaaggctctgtggacagaaacaacattcaggaggaaggcttggaaagcacttctcaatccagtcttgtagatgctccaaaaggtaccccagtcagctgagcaccccaatttgcttcttttccattcctctttgctggaatgtcttttcctgacttgggttttgatgcgatgccatcagcttacattcagggggatcacagaaactgtccaaccgagctcactgttgtgactgttttggggatgttgtcagggacgtttgctcattaccccatactgtgttccctttctgggccacgcccccacaagaaattcctatctgattttagtaccaagaatagttgtaattcccttgagcagtaggtctgtttttatctcatggacactgggaattgtgtaatgaacatggtctcctcattttagctgcaggaaagcttagggacaaatttgtggcccactcagaagaggtgtagaggttggaactccagggtgcattggacctgtatcctcctctcgactttgtctcccttcttagcttttctttgttctcttacttcatattttactgtgcaaaactgagagcatacaagcaaagataaataaaaatcacctgtaatctcattattccgagataaccactattaactgtgttgtctttttatgcatactttttaaaaaattaaaatgacattatactgtgtgtttttaatttgcttttttcatattataatatgtcatgaacatctttccctgtaattaagtgttctctaaatgatttaaaatttctgtatagatcaagcgacctcatactaacagctaacatttctatatgcatgtactatgtgcctggttttatgcatatttacatttgcatacatgagaaagcctatttatatgtgttacagacctgcaatatgtatgtctatatcccatcagctataatattcaaatgtgtcaactcacgtgatgctcacaacccagtggggtagaaagtattatctcccttgtacagatggaggaaaccaaggcatagactttccatagtcacacagcagaggcagaatttgaacccaggtaccctggctccgaagcgtttcctcctaagagctatgctgcctttcagtataccattgcgatttcacaggtcaccatggttaaccatttcatttatttcctttgacctcacttttaatttgttattgtgtcatattttatgtacccttgtaagttacctgaaatcctttctgccacaaggtgaggtaaggcataaataaacagtgcagagtgtggtaaacggcacaagaaggcacagctaaattgctaccccggggtaagaagatgaatccaggctgtcctgcaatggaatggatttattttcttgagctgtggtgagctcccatccctggaagagctggcttgggtggccgtctctctgggaggctggggaaggccttcttccaaggagacggagctgggccagacgagccccgaggccccttcttagattctcagggtttatgaaaatgccaataagacaaactgaggcacttaatggagctaatgcagcaaggcagcccttgggccggaaccaggacctggggcttttcatccgggtctattactggaccacacatctacaagtaacaaataaacgagcagagattccgttccaaactctcggcccagtgtattcctttcccagagctctctggctgctgttgcaagatgaccaaaggatgctgtcactgtcctcagtctttttattggggcgatggagaatgaggcaaggaggggctgggtggccccgcagatgccccatgacaccatcattcggcaaggttatgcatttgacgaatgccctgcagtggaaggagcccaggcttctcttcctgtttttgatgtttacttgggggttgatcttgtgcgagtttcttcagctcccgggaccctcagtttcctcatctgcaaaatggagttaatacaacagcaaagctgctgtggaggtcccatgagctattacagggctttgcacccttaaaaatgcggttgaggaagtaccgatacgcctgcctcaggggatctggggagggctgggctgtccccatgcctgagaccaggcaggcccgtcttggaggggcggtggccagcgtccaggtgctgccagcttcctaccccttcagcctcctgcccaccactgctcccttggctagaacgaagccgcgttcccgacagacaggctcacgcacggtgatatccgtgggagtgcgggcgagcagcccctcctcgccggaccccgggggcttcgggcaaaaatggagagcaggcagaggtcacatcctcctcctcttcctcacgctcccgggctgcgtgcccacaggggcacagccctgtgcgcggtgccaccgggggccatcaggctgggttagaggaaggcccgacctccgcgcagcaaagaaaacaaacacagatgtgtttggctgggaccgggagggagaaagtggcccccttcccccgcccgcgcgctcccccgggcgtgaggctctccgggcggcgcggggcgcgggcgaggctgacagtccccggcggcccctcctcccccacggggtgcgcgcctggcccggcccagccccctctccggggtttccccgggtgctctcctcgctttctctttgtctctgctgttctttctcgggctcccgggttcccacccgcctgtgctctccctctcgggcgtccgggccggttccctttaactttcttctttcccggggtgaaaactttgctcggagctggcggcagctcgcggacgttattggccggcgccccgcccggcggccccgccccccgcccccgcgctcccctccgcccctcactcccagcgcgagtggcggcggcggcggagccttcgggggcgagcgcgcgtgtgtgtgagtgcgcgccggccagcgtgagtgtgtgtgcgccccgggcgcgggcagggcagcactccgagctcggcgggagcggcgggagccgggcggccgcgtagtcactcgggcgagagaggcggcggcggggccgg

SEQ ID NO: 1370 - DNA, 53162 bp, Homo sapiens
agtgtccaaattcaccccagaccaattaaatgagaatgtttgaggatgggacccaggcatcagctttttaaagatctccaggtgattctaatatgcagctaacatttgtaaacctctgctctaagttgttggatagcaggggaagtgggctagttgtaaaacctctgtcaaccagctgtgtgatcatgggcaagttgcttgacctctctgaactttattttccctgctctaaaatgggatcataccttcttcacatgatagaatgaggcttattgagaacattatcagaaagagctcagtcaattgtaaagcatgatataaatataagataatattttattctctgacttggttatcagctcagaagtaataggtggagctgggggtcaggcagagcaatgttgagttaatggttaacagagagaaaataaaagaagctgattggctggaataggaatggcagagagaagatcaaagggccccctaaaccatttgcactaaggcaggatctacccctgtaggattccagggtgatgctaatgcctgagattacatcttcatcttattcctaaagctctgttattttctgtcttttttttttgagacagagtcttgctctgtcacccaggctggagtgcagtggtgcaatcttagcttgttgcaatctccacctcctgggttcaagctattcttgtgcctcagccttctgagttgctggaattacaggcgtgcaccaccatactcaactaatttttgtaattttagtagagacagggtttcaccatgttggccaggctggtcttgaactcctggcctcaagcgatccacctgcctcggcctcccaaagtgctgagccactaagccgggccaagctctgttattttctcactgggtactgccagttatgaagagccagagatggcaactgtctgggtgagaggtctgaccagatgggaaggagctgaagagattcttcaggctctgctgggaagctttcagccagacagggtcccttccctggagtcaccctcaccagcaacttaaagaatgggaaattctcctgggcttgaacacatgggcccgtcaggccaggctgctggccctggagactttgtgaggggctaagcctgccctggtgaggaggccaagggggctgtgagcctgggctttccctgcccttccttaacaaagaccatcgccctcccaccctctgagtaaggaggtcaacacacaattgtgcagcagcaagcagagtggaaatgcttctgtgggactcagtctacctccagctgagtgccctcaactcttctactcagactttccctttcaacccaccaacccttcatccttccatagtgtgctcagtaatggatgttgagtggctgagaaagtcctaacttgcaatgagctccattcactgatagatcttgacatttcatgatgacagttttttttttttttgagacagggtctcactctgttacccaggttggagtgcagtgacacgatcttggctcactgcaaactccatctcccaggctcaagtgatcctcccatctcagcctcccaagtagctgggaccacaggcacctaccaccatgcccagctaatttttgtatttttcgtagagacaaaattttgccatgttgcccaggctggtctcaaactcctgagctcaagcaatccacccacctcggcctcccaaagtgctgggattacaggtgtaagccaccttttttttttttttcttaaaaaaaaaatcttttgctgggcacggtggctcacgcctgtaatcccagcactttgggaggctgaggcgggtgaatcacctgaagtcgggagttcgagaccagcctggtcaacatggtgaaacctcgtctctactaaaaatacaaaaattagccaggcttggtggctcaagcctgtaatcctagctactcgggaggctgaggcaggggaaccatttgaacccaggaggcggaggttgcagtgagccgaaatcgtgccactgcactccagcctgtgtgacagtgcgagactccttctcaaaaaaaaaaaaaaagaaaaaaaattaccttttatttgagacagggtcttgaactcctgggctcagtgattgtcctgcctcagcctcccaagcatctgggattataggcaaatgccagcacacccggccctttctgtttttaaacaggtgtctgatttcccacctccattccttccacagcccagagaggtaggacatcaactcttcagttttctatctactcacaggtttgatctttaacctctcaagaacaataagccagagaaacagagataagcgttgagttgggattcaagtttacttcagctgtttctgcctgatccacacatcctagggctccttcttaagtagttccttgcaacttaaagtgtatccaaaagtgatactcccttctttttttttgagactgagtcttgctctgtcgcccaggctggagtgcagtggtgtgatctcggctcactgcaacctccgcctcctgggttcaagcgattctcatgcctcagcctcttgagtagctgggattacaggtgcccaccaccatactctgctaatttttgtatttttagtagagatggggtttcaccatgttggccaggctggtctccaactcctgaccttaggtaatccgcctgcctcagcctcccaaagtgttgggatcacaggtgtgagccactgtgcccgcctcctttttttaattttgaaaatttcaagctttcagaaaagttacaagaaatagtacaatgaacacttgtatatccttcacctagattcatttgttgctagcattttgcccatttgctttatctctcctcctctgtgtttgtacacacacacatacacacacacacgcaaacattttttaaaaattattttaatttttggctgggtgtggtggctcatggctataattccaacactttgggagcccaaggtaggcagatcacttgaggccaggagttcgagaccagcctgggcagcctgggcgaaaccctgtctctataaaaaatacaaaaagtagccaggcatggtggtatgtgcctgtggacccgctactcaggaggctgaggtgggagtatcacttgagccagggaggttgaaattgcagtgagccaagatctcaccactgtgctccagcctgggcaacagagtgagatcctgtctcaaaaaaattattctggccagccacgatggctcacgcctataatcccagcactttgggaggccgaggcaggtggatcacttgaggtcaggagttcaagaccagcctgaccaacacggtgaaaccccgtctctactaaaaatacaaatttagccaggcatggtggtgcgcgcctgtaatcccagctactcgggaggctgaggcaggagaattgcttgaacccaggaggcggacgttgcagtgagccgagaacacaccactgcactccagcctgggcaacagagtgagacttcctctcaaaaaaaaaaattatttcaatgtttgctaaatattttgaaagttagttgcaggcatcatatttctaatattacttcaccatgtatcccctaagaatgaggacattctatataattacagtatattaccatgcttgagaaatttaacattaggctaagcacagtggctcatgcctgtaatcccagcactatgggaggctgaggcaggtggatcacttgaacccaggagtttgagaccagcctgggcaatatggcgaaattttgtctgtacaaaacttacaaaaaattagccagacatggtgacgcacacctgtggtcccagctactcggaggctgaggtggaaagattgcttgagcccaggaggttgaggctgcggtgagccaccatcatgccactgcactccagcctggatgacagagcaagacactgtttcaaaaaaaaagaaagaaagaaatttaacattaatactatattgtgatatatattccatattcaattttcccaattggcccaattatgtacttgactagctttttttttttttttttttttgagatggagtctcgctctgttgcccaggctagagtgcagtggcacgatcttggctcactgcaatctctgcctcctgggttcaagcaattctcctgccttagtctcccgagtagctgggattacaggcgcctgtcaccatgcctggctaatttttgtatttttaatagagacagggtttcaccatgttggtcagactggtctcaaactcctgacctcaggtgatccacccaccttggcctcccaaagtgctgggattacagacatgagccaccgtgcctgcccttgaatagctttttgaacagattgcatttagcggttcagaccctttggtctcttttaatctagagcagtttttcagaccattttgatcttttctgacatggatatttttgaaaagtccaagccaattgtgttaaaactataattactttatgctatttgaattctacacgtgatcttggtcctagagtgtaaattttatctgtgctgccaccaggtggcgcacttggtaggtcctggtcctcaaaaacccttgtgaaagggcaacttaaggcaagaaaactcgttttgtctcaatcaactaaggctgttatttggtaaagcatatgatgttggcagtgcccatatatttataaaggcacgtggtgtcttttccataatctggggatcttgctaattaggattatagtttcgtagacctgtaatgggtcccaagattctttctttttttttttttttgagacagggtctcactctgccagccaggctggagtgctgtggcgtgatcacggctgactgcagcctcaaactcctgcgctcaagcgatcctcccacctcagcctcccaaagtgctggtattacaggcatgagccgttgtcctggccaaggttctgcatttctaacaatggccaagtgattgtgatgctgctgatttgaagagcacgctttgagtagcaggggtttagaacaagcctatgaagaactataatctatttacaattagtggcttctgttcttgagacaaaatctcactctgttgcccaggctggagtgcagtggagccatcacggctcactgcagccttgacccctgaggctcaggtgatccccctgcttcagcctcctgagtagctgggatcacaagcatgcaccactccacctggctaatttaaaacatttttttggagacaggatctctgtatgttccccaggctggtctcgaactcctgggctcaagggatcctcccatcttgccctcccaaagcgccttgacctcccaaagtgctgggattacaggcatgagccatcatgcctggccactattatatatatatatatatatatatatatatatatatatatatatatatatatatatatttaaacaattttggcccccacagtggctcatgcctctaatcccagcgctttaggaggtcaaggcggacagatcacttgaggtcaggagtttgaggccagcctggccaacgtgctgaaaccccatctgtactaaagataccaaaattagctgggcatggtggtgcatgcctgcagtcccagctacaagggaggctgaggtaggagaattgcttgaacccgggaggtgggggttgcagtgagccaaaatcacgccactgtggtccagcctgggtgacagagcaagattctatcccacccccccaaaaaacaaacaaacaaacaaacaaaaaacaattttataactttatttggtatatttgatgattagcagttagttcacattcacaccgactgtagatttttttaaagtggtaacaggtacgtaggcaaccgaagtatagagcttgtttggtaaatctttatcttcattacattttctggacaaccgaacatggatacagtatgagacgttgcttattcctttggcccagacagctttgttgagcctggtatcaaagtgtgcatctggagttcccatctccttcagggcaagtttccggagctctttgagtgcctgaggggaacgcttcttgaagcccactccatgaatgcacttatgaatgttgatggggtattctcgggtcaccatctcgttgatggcggaatgacccttcttcttctcatcacccttctttgcaggagccattctgccgggcccaagttggaaaggaaattggccactattcttacatcataatcagtagtaaagctagtctcatcttccactacttcccctcttcctccctctactccagccccttggccttgcttctttcccagagggcctcgaccctagctttcccttctgcctcgcatgccattcccccagatatccttctgcttgactaatttccttgtctcctgcaagttcttagctcaaacctttcttttttgtttgtgttttgtttttgaaacagggtcttgctctgtcacccaggctggcatacaatggcgtgatcatggctcactatagcctcaacctcctgggctcaattgatcctcccaagtctccatagtagctgggactacaggcatgcatcaccatgcccagctaatttttgtattttttgtggagacggggttttgccatgttgcccaggctggtttcaaactcctgagctgaagtgatccacccaccttggcctgtcaaagtgaaaattcactttcttgatgaggctcacccagacatccttattaaacactgctgcctcccccaccccctcacaccctcccttaacttgcttgattctttgtttcctccagccttctccaccttctcacatatcatataatctacctcctgcgtttattgttcatttctgtctccccctgctagaatctaacttccatgagggaagggatctttgtctgtctattgtcttcactgatattttctgagcacttagaacagtgtctgcacatagtaggtgcatatgaaatatttgctgaatgaatgaagcttaaaaggaccttcaagataacagagtccaatcccctcatttcattgatgaagaaaggagccctaggtctctgggcaagacgaagatttgcccagggtcacatagactgtgggaatattcttcttattcttctaaatgaatacaatctaaaagccggactggtttctatcagttaattttctaagctctaattttattttattttttaatttgtgttaggtattttccccaaaggatctgaagcagtggacaagatgagaggtaatatagaatggaacagttaggagtccaaatggaagagatatcatctaaaggaagagggagtcagcctaacaggcactagatcatagttaattactctaatgggggcagaatttggctctgagtcctctggcagctgaggttaaacgggaagcacgtgggactccataacgttccttgtctgagctaaggaagactgagtgctccgcagggactcacatccaggaggaacctggtcctggagaaccctgtgtaatatccctttggcctcacattggacaatgtttaccaaaaaaacccaaagtcatggttgaagaacattgttgttttatctgcaaagactaagggtataatattaaatcacattataggctgggcatggtggctcatgcctgtaatctcagcactttgggaggccaaggcaggtggatcacttgaggccaggaattcgagaccagcctggccaacatggtgaaaccctgtctctgctaaaattacaaaaattagccaggcctggtggcatgagtctgtgatcccagctacctgggaggctgaggcatgagaatcgcttgaacccaggaggtggacgttgcaatgagccaagatcacaccactgaactctagcctgggtgacagaacgagaccctgtctcaaaacaaacaaacaaacaaacagaaaaacacattatagttcttatggttcaggtgaattatattgtgatgatccaactgaaaatgaagatgaaaactaaagaatctagaataaacatgtctaggaatatcttctgtaattatccaccaacgtctcaaatctttgacaaacattaaaccacaggcaactcatggtttggatttgttgaatacatcaacaaatgtttattgagtttctactataaaccttctcctctttcctttgctgactctctgcctggaactccccaggcccagctatctctaaggcagaggggaagagcacagagaccagaggggaagccagctctgtttcttcaagttacataaagtcttttttgtgtttctgagatagagtctcgctctgtcacccaggctggagtgcagtggcgtctctcggctcactgcaacctccgcctcccgggttcaagcgattctcccccctcagcctcctgagtagctgggatttcaggcatgcaccaccacgcccggctaatttttgtatttttagtagagatggggttttgccatgttggccaagctggtctcaaactcctgacctcaagtgatctgcccgcctcagcctcccaaagtgctgggattacaggcgtgagccaccgtgcccggccaagttgcataaagtctttgccagagtttatcattaaactctgactgcacatccagcaaattcaccttttctggccactaggaagttgtcctccactgcagagcagggacaattactgacttctgctgaagccttttcaaaaacctagttcttttacagagcctcagaacatcctatgaatattaactaatatattttaataaatgtcaatacaatttttcttttagaccccttgtcttttattattattattatttcaatttaaagattttctagggcatgtttttctgtctggtacacttgttacaagtagaggtcaccgtggtcatcttcaactgtcactccccaccaacccctccaccccacctcaccttgccaagttctgcctctgtctgtcacatatgtggcacacacatgaaatatttttctccacctggcattggttctgccactttgacaacccttggctgtgagagggcccaggggcttgactctgcaacatatcaagtggcctcagctaccaactgagaaacttcccccttgacaggcatgactagaaaacctgatttctctgggcaaagcctcgcacgccccagggaccatgtctgtctggttctgtgatgtatcccctgtatttagcctaggatctagacccttcataggcacttaagaatttcttgcaaacaggccaggtgcagtggctcatgtctgtgatctcagcactttgggaggctgaagcaggcggatcacttgaggtcaggagttcgagaccagcctggccaacatggtgaaatcctgtctctactaaaaatacaaaaattagctgggcatggtggtgcatacctgtaatcccaggctgggttctgccccagtcaaatcccaggcttttgcctgaatggcctggattagtctgtttcaaccacatggatcagttggttccatcttgaaaaaagagactggactggggctgccatgatcctgctgtgtgcaaagcactgtgggaagggctgccatctttgaggcctgggtaggcttatggtaggctttgcagaagaacttttagtctgtatcagttctttggggtatctgcttgcctggcatcttccacacagccatggaattgcagagcttagcataaaccagacgcttgctgtttgttgaataaactctgataagcaaaggcggcgtgttcaactatgtggagtcatgctgtcttaattttcactttttgattcagctatcacagcccatatgccaacatctccacaaaacagagagaagcacctgtgttagtcttggcacaagatcgctgtgagggcaggatgggggcatccttgttctccagtgcactgtgcacatgcgtgtgtgcatgtgtctgactgcatggacatgtgtgtttatgcacatgtctacctgtgtatactcggggactaaggtcctcacagtcacataaccttaagatggtgatgtgaggccaggtgcggtggttcacgcctataatcccagcactttgggaggccgaggcgggtggatcacgaggtcaggagttcaagaccagcctggctaacatggtaaaaccccatctctactaaaaatacaaaaattagctgggtgtggtggtgggcgcctataatcccagctactcaggaggctgaggcaggagaatcacttgaacccggggggtggaggttgcagtgagccaagattgtgccactgcactccagcctgggtgacagagtgagactccatcttaaaaaacaaacaaacaaacaaacaaaaactattgcaaagaccctcgcaaaaggacaaaagtgtccttttagcactgtaaattggtaaagaatacgccctcatgcccttgaggatcttttgcaatgactacagggtcttctagatgttggatccgcttcctgagtagacctgtaacactagaaagggaagcctcctacaaacatctcacaatctagcaactttccccttgacaggcatgaccggaaaacctgacttctctgagcaaagccttgcaagctccagggaccatgtctgtctggttctctgatgtatcccctgtacatagcacaggatctagacccttaataggcacttaagaatttcttgcaaacaggccgggcgtggtggctcatgtccgtaatcccagcactctgagaggccgaagcaggcggatcacaaggtcaggagtttgagaccagcctggccaacatggtgaaaccctgtctctactaaaaatacaaaaattagctgggtatggtggtgcatgcctgtaatcccagctattcgggagcctgaggcaggagaatcgcttgaacctgagaggcagaggttgcagtgagctgagattgcactgctgcactccagcctgggcgacagagcgagactctgtcaaaaaaaaaaaaaaaattcttgcaaatatactcaataagatgaggctactgagtggctggttaggctcactcaccagctatgctatccattcctgcttgccagcctcaaagaatatgattaaaagttttatatagagggcatgacttatcaactccaaacttggttttgcgacaaacatcacattatgtcactgtcattaaatgaaagagaatctgcctctgagctcccattctgccagactattgggaaagttaatgtttgcctcaattggaaaatccctccttccctctagggtggcacaagaatctggaaggctcctgtggttcctagaaaacagaggaaggggaagggactctggttatggtcactgttcaagctccttgaagtccaggcttccaaggtccacagaaggcaggtggtccactggctcccggccacatgaggtgcatgggatctctgccaaggctgtaagacccagggcctggggtccagcctatctgggtacccagggcctgtagtctagccttcctgggtgccccaggcatcagccatttccctgacagactctccatcacctggaggcagagagtggatccctgcagctttctctttctagttttggggacactttattatctgctgctccacctctgcccattcctgctctacaacctctcctggggtgagaagcacacacaaactgggatttctagaggtctgtgtggcagcagggacaggaaggatcccagggagattaacagcaaattaattctgcaaatggccctgccacaggggcccaatggaaggacagcctgcctcaaatctaaatcattgtggtcattctctaaataatcaaaacctcaagtgtttaatctgcaaatgccaagggtctattgaaatgactgtagtcaagagcttcctgatgaaaagaactttttatttttttatttttatttttattttttatttttttgagacggagtctcgctctgttgcccaggctggagtgcagtggtgcgatctgggctcactgcaacctcttcctcctgggttgaagcaattctcctgcctcagcctccagagtagctgggattacaggtgcacaccaccatgcctggctaatttttgtatttttagtagagacagggttttaccatgttggtcaggctggtctcaaactcctgaccttgtgatctgcctgccttggcctctcaaagtgctagaattacaggcatgagccaccgtgcccagtctgttttttatttttatttttttgagacagagtctcactctgttgcccaggctggaatgcagtggtgccatcttaactcactgcaaccttcacctcctgggttcaaccgattctcctgcctcagcccccccaagtagctgagattacaggcgtgcgcaaccacaccccagctaattttttttatttattttattttttatttttagtaaagacagggtttcactatgttggtcaggctggtctcgaactcctgacttcaaatgatctgcccgccttagcctcccaaagtgctggattataggcgtgaggcgccgtgcccagccgaaaagaacttttaaaatttgctatctttttcatcttaaactaaccctgccagagacaccatctgcaaactgagctcgtcttggcccagggatacacacttttaatcaacggctggcggtgtgatgggcttctagagacggtgttaggttccgctttagggtctgtcgttgaaaggcactgaaatccactctttttcctttcctagaatccagtcccagactctgtagaagtcttgggaggagactgggagatttcctcatgctgcaaattctggcccaaacaatccagtccctgaggagggtgtgttggtgtaccagaaactgatggaacagcacccggcaccatgccagaccctcctgtgccaagaggttccaggaaaatgagcatatcctaggattgggaggaagtaaggcagcaactggggactttttcctaatgagtccaataaatccttggaaaaataatccaccgagggtcaaatatacatagaaaacaactttgaaggcttttggaggcttttttccctaaaaagagagaaaagtaaaaaatattccaggcattggctttcaaaaacaaacaaacaaacaaagaacaaaacaaaacaaaaaaaccaaaaaacaaacaaaaccaagaacaaccctgggaatataaaattcttcaagatatgcaagaaacatataaacttcaggccaggtgctttgacatgcgcttgtagtcccagctactcaagacgattgtttgagcccaggagtttgaggctgtagtgtgctatgatcacacatatgaacagctactgcactccagcctgggcaacaaagtaagacttcgtctctaaaataaatacaactaaattttaaaagagaagtttataaactttagttatgtattctggccaattaatgggagggagacaaagagaaaaactgaactagaggagaaaaaggaagggaaaggaggaagcagagaaagaatgagagaggagagtgagggagaactctgaagaaggccagagaaagaaaacaacaggccgggcgcggtggctcacacctgtagtcccagcactttgtgaggctgaggcgagaggatcacctgaggtcaggagttcgagaccagcctggccaatatggtgaaaccccatctctactaaaaacacaaaaattagctgcgcgtggtggcacacgcctgtaatcccagctactcgggaggctgaggcacgagaatcacttgaacctgggaggcagaggttgcagtgagccgagattgcgccactgccctccagcctgggagacagagcaagactctgtctcaaaaaaaattttaaaaaaggccgggcatggtggctcatgcctgtaatcccagcacgttgggaggccgaggcagtaggattgcttgagctcaggagcttgataccagcctgggtaacatagtgagacctcatttccatataataaataaataaaatagaaaagaaaacaataatatttcagagatgccgagacacaaagcacaagagaacagagcacagtgagagaacactggcctgagaaggctcaaaagatgatgctgagaagatgatgttatctgaaggaaaatcaccatctttctgccttccgatttacatgagcatcttagaaacctgggaagtcagagctacaaggacctgagctcgtctagtccagtcttttctgtactgggttgaatagtgtcaccccaaaatcatatctgcttggaacttcagaatgtgagtttatttggagacagggtctttgtagataatgttagtgaagatggggttgtattggattcgggtgggcgctaaatccgataactagtgtcctttttttttttggagacagagtctcgctctatccccgaggctggagtgcagtggtgcaatcttggctcactgcaacctccgcctcccggattcacgccattctcctgcctcagcctcctgagtagctgggattacaggtgtgtgccaccaggcctggctaattttttgtatttttagtagagatgggatttcaccatgttggccagactggtcttgaactcctgaccgcaggtgatccactcgcctcagcctcccaaagtgctaggattacaggcatgagccaccacacccagctctagtgtccttctcagaaggccatgtgaaggcacagacacgcatgtgaaagaatgccctgtgatgacagaggcagtgactggagcagtgcagctgcaacccagaaaatctcaagaattgccaggaaccatcagaggccaggagaggcagagaaggggtctttcctagagcctttggaggagcatggcattgctgacaccttgattttggacttcaggtgtccagaactgtgcaagaatagatttctgctgtttttagccagctggtttgtggtaatttattatggcatccctgggaaatgatgaatacattttcctttgcaggagaggagccctaggatgtgtgacacatccaaggtcatgtaatcgactggtggccaatcccctattccaatttagcttttatttttctttaagaattgtatttgcggccaggcgtggtggctcatgcctgtaatcccagcactttgggaggccagggtgggtggatcacttgaggttaggagtttgaccagcctgaccaatatggtgaaaccccatctccactaaaaaaatacaaaattagccgggtgtggtggcacatgcctgtaatcctagctacttgggaggctgaggcaggagaattgcttgaacctgggaggcggaggttgcagtgagccaagatggtgccactgcactccaacctgggcaacaagagcgagactcaaaaactaaacaagcaaaaaagttaaaaaaagttaatttgctttccagcattgtcatcctttctgaatgtggaaataaggtttcttttctattgccaaagttcattctgaagaaagaattcttttcctattgaattatgaaatatatatgaagggacaatttgggctttagaaatactttggactctgaagtttttcaatagatttactgctggttctttgatattccaaaatattctcttttttgtctttttttttttcttttttgtggagaatggggtcttgctatattgcccaggcaggacttaaactcctgggctcaagcaatccttctgcctctgcctccctaagtgctgggattacaggcatgagtcactgcacctggtctggtattccaaaacattctaatagcttattacttttgagagatgagggctacccccttcaaatgttgaaatcaccatttgtttccttattctgagcaattttctgaaggtaagccgagtcttgctggggatattgaatgtaaaactgtctttaaagtagatcctttggtaagaaatgtattgatcactattttggggttttaactgacatcaaataatatgaagcatatgtgagtttttaattatttagaagttcctaacccttttttggaccctatctcccttcaagaaactgataaaaggccaggcgtagtggctcacacctataataccagaatttgggaggctgaggcaggagttctatcacttgagcccaggagtttgtgaccagcctgggcaacatagtaacaccctcatctctacaaaaaaattaaaaattagctgggtgtggtcgtgggcacctgtggtcccagctttgggaagctgagacaggaggattgcttgagcccgggaggtcaaggctgcagtgagccatgttcacaccagtgcactccagcctgcgtgacagagcaagactctttatctcaaaacaaacaaagacatggataaaagctatggattctctcccatagaaaactgcacaccctcataaccttttgcacctactcttttttttttttgagacagagtttcgctcttgttgcccaggctggagtgcaatggctcgatcttggctcaccacaacctctgcctcccaggttcaagcaattctcctgcctcagcctcccgagtagctgagattacaggcatgcaccactacgcccggctgattttgtatttttagtagagatggggtttccccatattgaggctggtctcgaactcctgacctcagctgatccacccacctcagcctctcaaagtgctggggttacaggcgtgagccaccgcgcccggctgcacctactcttagagaattctcaggccccacgccttaccccaacttctgttaccagtggtgaatccaatgggtctgcagcaaacttgatgcttgccttctcaaagacagaactcagctgaggggcagaggtggttttaagtggttttaaggcacagggagagaccaaggcaagttttagagcaggagtgagagtttattaaaaagttttagagcaggaacaaaaggaagtacactacacttgggtcaggcaggcaacttgagagatctaagtgccctgcctgacccttaacttggggttttatgtatttggcatagttctgggatttacgtctcatctcccctgattcttcccttgcagcaggctgtccgcgtatgtggtgacctgccagcacttggaaggggtcgcatgcacagtgtgattactgaagttgcgcgcatgctcacttgaggcatttttccccttaccagtcgtgcgttcccagaggaaggtaggtcatatactggttaaattccgccattttgcctcttggtgcgcatgctccaggctgcttgcccagctcctgagatcttatcgggaagcggctgatcaccagatcagggtgttttgtatctattgagagactgtccttgcttggagctggctgcaaccaattattattttacagagacagtttaacaaccacctgaccatcacctgatggtagcctgacattcctgtgggggccctcacctgtcctgctcatgtttgcctagctccctactctaacatttccactctgtggaccccaggttgagatcttctgcagggaagactgtcctcaaatagcctgctggggagacatctccttcccgtttacctttccatttgcccttgcggtgttaggcaaaggctgaagctggcctctgtggcagagggtttcttcccaacacgccaatgacgctggtggagagtcttaaaaacagctgtgctggggagagttcttggtgtgtacctttcagagacctcctccttaagactctcaaagactgagtcaggccagtgggagcctggcagcaattcttaggggacagtgacagctttttgaggaggactaattggcttctagggctggaggccacttgggtctgacagactgccctgctgccatccctccagggcaccccccactcccttgcctcagggccttcctgcacttcttccttttgtcctcaatgttcttcaccccaccttttccactggtaccctctgcctatggtcaaggctttggtgagacccactttcctcttagaccttcctggatcccccaaagtctgtgttggaagcccctcccatgtgcccttgtttgagcttttaattttccaccatgacgcttgtcacactgctttgtaattggctctctgttagtctgcatctctactgggttgtaccttccaggaggacagctgccatgtgactcttgtaatcttcccaccgccaacacccagcacagcgtcaggaacacagagcatgatgagcacaagcttgttgagcaaacagacaaataactggatgcttctgtgcagagtttctcaacctggccattattggcatttgggacttgatcatgcttggtcgtgggagacggttctgtgcctgtaggatgtttaggagcatgcttggtttctacccaccagatgccgggagcacacccacccagctgtgacaaccaaaaatgtctccagacaccattccaaaaccagcgggagacaaaatcgcccgacagtcgttgctttagtgagtgaatgttgacctaagcgtcacttcgcctgtcttgagtctaggtcggggagtgggttcagttagccaatcagagaacgctgatggggcgaccagtatatgctcatgaaatgggtggctgacctcttggggtcagaagagggaaaagttttactgtgtgttggctaaggaccattttaagtccttcagtgaccgattaccacatgagaacacaagagggcgctctaactaatgagttccgcggccgagaaaactcctggagtgggtgctcctgggatgcttcaggtttagacaccggggttacggcagctgccgaggaaggctaaagccagcgtcctggattcagacagaccttttagccattaaatccactaagaaagatccctgcgcatgaagtttcctcctcggaaatataggcagaagggaaagtaattttaaactcatgtgtgctccacaggccgggggcggtggctcatgcctgcaatcccagcactttgcgaggccaaggagggaggatcacttgagcccagaagttcgagaccagcctgggcaccatggtgaaacctcatctctgcaaaaaaaaaattaaaaattagccagctatggcggctcacgcctctggtcccagctacccaggaagctgagatgggaggatcgcttgagcccaggggttcgaggctgcggtgagccattgttgtgccactgcactccagcctgggcaacagagcaagcccctgtctcaacaaaacaaaacaaaacaaaaaattcagtcgtgctgcataagtaaggcaccaggagtaggaatagggtctttgcagctcccgtggcaattgcccttctctggtggtggcaagggactaaggaactccctggacacaggggatctggctgtccccagatcatcaacagagacatgaaggtcgttagaggtcgtctgatcctttgacctcaatctgagcccaccactcagaaaacctggaaattgtatgacattttcgtgatacaactcggtgtgtgtgtgttggggaaaggaaccaacagctttcatcatattgtcaaaagagtctaggctgggcatggtggctcacgcctgcaatcccaacccaaaggcctgtggagcacacatgaggacaaggcgggcagatcaccaaaggtcaggcattcgagatcagcctggccaacgtggtgaaaccccatctctactaaaaatacaaaaattagccaggcgtggtgacatgtgcctgtaatcccagctactcgggaggctgagacaggagaactgcttgaacccaggaggcggaggttgcagtgagcagaggttgcgccgctgcagtccagcccgggcaacaagagcgaatctccgtctcaaaacaacaaaacaaaaacatagacctgctcggttctctctgtgacttcagaggcccaaggagtcctcagcactatagatgcatgtggcccctcagaagacaacatttcacagatctgcaaagagcaaaggtcaaatttatttaatacaacatccacgagggtccctgcagctgtgtcactgaggcaaacaggaaaagtgattttggctaggcgtggttctcatctgtgaaattccacagcgcaatgacagcagcctctctcccacccactcaagacactgtcaggaatgtcttaagacctcaggagaccacttctttagcaagcaattttgttttttgttttttttgagatggattctcactctgtcactcaggctggagtgcagtggcgcgatctccgctcactacaacctccgtttcctgggttcaagcgataatctcacctcagcctcttgagtagctgatactacaggcatgcgccaccacgcccggctaattcttgtatttttagtagagacagggtttcatcaggctggtctcaaactcctgacctcaggtgatccgcccacctcagcctcctgaagtgctgggattacaggcgtgagccaccttgcctgccctggcaaggaatacatttttaaaaattagtaagaaacatacacatttcaagttttcaattaagaataatatttgctgatggcaccatcttcctgtctttcagccttcagcatggtagaggaaaagagaaagagtgtagacaaaaacagttgaagaacatctgtgcttgttccaccttcattttctgttttgtgcgttgcctgaatgaacggtgtcttcaggttggtatttcacaggcggtgctcccaagtagtctggttttcccatttgtggagggcgaggtcatagaggggacagggggaggctgtctggtcagcactgtgtatttccaaagaacaaggactagccaaaactacaagcctttgaaggaccaaaggaaaagagaaaaaaccagcctctaaccaggccatgcgctagaaatgattgagtataaaaaagaaaattggtttctgtgtatgagggtgcatggaaaaggtctttatctctgcacaaaacaaaatattcaagtttcagaatatcccaatggccttgccctggatctcctcttgtgctcttccaatttccaaggatgttccaacttggtggaaggagggtatgtgggaaattcaacagcccctctgtatctctttctacccaacattaacttagcaggatggatttaagaaccggcagcttagcctgaggaattgctgtgttctgtgggagcagggcaggttcataaataagtgcacagaggtcttgaaatacagggattatctgttcttctcggaacatggatgtccttccagggatgtgcatctggccttgctgtctaagttccatcaagggagccttccgttctctgtagcgacaagaaacaaggcaagttatgatcacacctctcaagattgaagattgccctggtggagagaaatgcaaaatgacagcacttctcaaagaaaatgcaaagcagggctgtcacacactggtcccccaccctgcagggttctctctgtgacttcagaggcccaaggagtcctcagcactacagatacacgtggcccctcagaagacaacatttcacagatctgcaaagaataaaggtcaaatttacttaatacaacacccaccagggttcctgcagctgtgtcactgaggcaaacagggaaagtaattttggttaggtgtggttctcacctctgaaattccacagcacaatgactgcagcctctctcccacccactcaagacattgtcaggaacgtcttaagacctcaggagaccacttctttagcaagcaattttttttagatggattctcactctgtcactcaggctggagtgcagtggcgcggtctctgctcactacaccctccctctcctggctcctgcccgtatgtatttctccttctctccatgcctgctctgtagggaccatagcctctgtccctgcatacatgttggacatcaatcacatcagtccaccaagtaacttcatcaagcacccatgtacgcccagcacagcgtcccaagggtgccccacttacccacagaagaagaaaggcaactttgtaagagatctgacttctagctccagttctgtctctagctaacgtgagatgtacccgtttgaggcctgttttttaattttgaaaatgaaggactgaacttagatggtccaactgaaatgttttaaaatgatatgattctaccttaaaaagagaatgaaattctgatatattttcaacacaggaaaaccttgaaaacgttatgctaaatgaaataaggcagacatgaaaggacaaatatatgattccacttatgtgatgtacctcaaatagtcaaattcatagagacagaaagtagacagtggttgctaggggttgctggaggggcaatggggagttagtgtttaatgggtacagtgtttcagtggctgctctgcctatggagtagccattcttttgtttctttacttctctaataaacttgctttcacttaaaaagaaaaagctctggagatggatagtggtggtggttgcacagcaatgtgaacggacctaatgcaactgaattatacactttaaaatggttaagtatacactggaaaatggtgaatttgccgggcgggcgcagtggctcacgcctgtaatcccaacactttgggaggccgaggcgggtggatcatgaggtcaggagttcaagaccagcctggccaacatagtgaaaccttgtctctactgaaaaatacaaaaattagccgggcgtggtggcgtgtgcctgtagtcccagccactcgggaggctgaggcaggagaatggcgtgaacccgggaggcggagcttgcagtgagccaagattgcgccactgcactccaacctgggcgacagagcaagactccgtctcaaaaaaaaagaaaatggtaaatttaatattatgtatattttatgacaattaaaaaaaaggattcctggctgggcatggtagctcatccctgtaatcccagcactttgggaggccaaggtgggtggatcccctgagtttaggagttccagaacagcctgggcaacatggcgaagccccatctctatcaaaaatgcaaagaattaggcatacatggtggtgtgcacctgtagtcccagctactcaggaggctgaggtgggaggatcacttgagtctgggagatggaggttgcagtgagctgaaatagcacccctgcactccagcctgggtgatagagtgagacttcatctcaaaaaacacacaaacaaacaaaaaaagcaaaaaaacacccacaaaaggattcctggattccttctgccatcctgtagtgctctttaacagcttcaaatggtatttgtgtcacctatccacctatcagtgcctggacccttatctgacccacactgttctctatgctggggatgcaagaagctgtccccaagaattttatattgtatcaattattgataaacaacaccactatgaagtagaaggtataagaggtctcaacaaactgcagaaggggttcagaggcactgagagggctctgggctgggcagtgggggattcacagaagcaactctggagtcagcctaaagattggattttgacaaatggaaggagcccttggagggaaaaagagcagggcctgctgggagataccagagtagaggggggccctgggcaacagtgggccctgaagagcaggcagcacctaagtccactattctggaccctccatgtgcacaggacactctgctgcaggtggaactcagcaaggcagaagctggagatggaggatgacccagggtcttgggacctccacagccagcctggctggcttcctgagggtgagctgggatagtgtctccattttgtttcagccctgctgggtccaaggacccttggggaacaggatgcagggccgaggtgccccaactagaaagccaaggctctggcccctcctctgccaggagagccccatgcaagtgggccaagcaagccgtgctggccccagaggctggaggcctgccagcgccggcagccaccctgccctatttcctctgctctgcctggatgggggagacatgactctggtgtccagcctttctgtgggccccagaccaagtccctccccagacacctccgctctctctctgtgggggcagccaatgcctggggcaccattgcagaaccaaagccacagacaggaagggctgggccacaatcaacagggccttagggattttgaagtaaaggttaacacgctcacatccaaggtctgggcttgctgtgcttaaatcagaagccagccatcagccacccaagtgcagttgtgaaatcgccctgccttgtacccggaatatggtgtggtctccctcaaaggtcattttgatttcaacacaccctgggatctctagttcctgcttctacaaagtgctcctgtgggcacttgcaatagaccaggtctatgccaggtgctcattcaacccttgcaacaaccaagtgagggagtttatgattcccagtttacagattaggaagtagaggtcttgagaggccaagaaatttgcccatggtgacatggctaagaagtgggaagtcaagtgttaatgtgggtctctgattcctaagtcaaagcctggccttggttgaatcctatgccttgggtaagcaactgctacattctccatatgtggcagggtcatttcatggccaaatcaagttaagtcccccatccacacctactattgcccaagtgatgaaaagagcttgagatcaaccagcttttatatggtggtttgcagcttgcagcttttatatggtggttgcagttgctcatttcatccttaaaatcctaataggttgctcttatcatcattgtcatcaccatctccactttatagataaggaagcttgagcttgaggaagacaggctcacccaaaagacagctggaaagctggagctcccctcccatcccctgatcctagcacctggacagtttccactgtagcccagctgcctcctggcctccaggaaggggggaggcgagctatagctgccaattgcctttctttctgtaagaaggcagggtcctttccaagatcccaagactctcacaagtccagattcacccctttcatttaagtacagggtgttctcttccatgctatctgtctgcgtcggccacacacacaatttataaacaaggtaaaaatggcagaggaaaaatgaagtcagaatgtgccattgaagcaagtcaaacaataccaaattagtctttggctacgtggctatctcattgttaagatatttcctccaatgttttcagaggcaacggccattaaacaactgggaatgatcgccaggtttgatttcaggaaggaaatctcctcccatttccccactgggcaattcaattaattttctcctgacccacaccagctgattattagggaagctatacctgcttcttttataaacaaaacccatttgcttaaaggttcaaaattcctttcccaacggctggaaaccctgtgctcccatcaaatgactctattcttttttctggggggacaggaccagtcatgggtgagctctcagaaccatcctgggagcagactttgaggcccaagggccagcttctgggtaaagttctgtctggcctggagctccaagcctttgtccagagacaccctttggatccaagacaaagtaaataagttggtcctacagggtgttttgggtggacccagccatgtttatcgcttcaggagaacacatctgtgtcccgcactgcccagggagcaaagacctcattttccactctctcaaagccattattgctgggacagcaacttcacatcttggagggagtctctgtcgtgacagaggactggccgcagagtatagaggcctgggctctgttcctcactctattagccatccaggtgaccccagacacgctattctaccagtgcaggcctcagtttcctcatctgtaaattgggctccttgtcccagtgacacgatagtctctgatttcaggagtctgagtgggttttggctaggaaaaaaaacaaccattcatttcattcctcttttccttaaattcatagctttcttccataaaaagaatgtcagtggcttcctgtctgtcaaaggcataatgagctctgttttacaagagtccagacatgggcaaaacaaaggaagccaggggcccactggaagagctaccagaaatcttgctgaaagttcttcccagacctaaaagaagtttatgcggcaaatgcctcatttcttcagatattagctgcccagttaactcctgcattgctgggtagctcacaaaaaggttgggattggaagacacgtctttgcaaaagttgaacgtgggcctctgtgtctttcataaaccctcccatctgccaaatagcagattcctaactccatttcctacagaatgaagcttcttaacaaggcatgtaaatcctttggatttaagccctgacttatctttctcccgtcacttgtcactgtcacactcttcttttcccatcccacactgcttgaaactggtcatccctcacccttgtgctcctgctgatctttctccctcaatgctgccatcactccattcattcttcatggcccattccaaatgattccttggggaagaggccactagctaggtctctgttctgtgttcccataggctctggcatagctcactttgctttatgataagtgatcacatgtctgattccctcatcagaaggtgaactgaggtcaagaagcttgggtgtctcctgcagctgatggcctggtgtgtagggggtaattagaatcggctaaattgcaatgagctgtcagctgctccactcctccaagcatacaccctagatctgcctcacttccagagcctagactttggcgttaaacgaaatgtgtgctttgcttgtttggcgctaagcaccccagagtcccaatcccttcacgtgtgggctgagatgtaatgatggaaattgcaggagagaatattcgaaatcagaactggccaaggctagtcagagaagcccagggcttctggtctgaaacagactagggagcggggaagaattcatgtgaatgcaggacgtgggtgagtctggaaatatttcactgttcagtggagtacttttaaatataatgtatatgaaatgtgtacttacagagtatctgctttccacggcatctacaaaacaaaggatgacatggcagtgagcaacgcaaataacccagttcaactgccccaacaacatcacagggtcaggagcaggtcgagaaaagagggaggaggcgagagccaggagacatcagccggcaggtgcccttagaggtttatggctcctttgtgcaagacagcttccccgggaccctctagctccacatgacatgcgcataaagtccctggcacttcatttaaaattttctttattttttattttttgagacagagtctcgctttgtcactcaggctggagtgtggtggcgccatcttggctcaccgtaacctctacctccagggaattctcctgcctcagctggcactatctcggctcactgcaccctccgcctcccagattcaaggaattctcctgcctcagcctcccaagttgctgggactacaggcgcacaccaccatgcctggctaattttttttgtattttttgtagaaatggagttttgccatgttggccagggtggtctcgaactcctggcctcaggtgatctgccaaccctggcctcccaaagtgctgggattacaagtgtgagtcaccacatctggcctcatttaacattttaaacagttttttagaaatgtagtatcacggctgggtgtggtggctcatgcctgtaatcccaacagttggagaggctgaggcaggcggatcacctgaggccaggagaccagcctggccaacatggtgaaatcccatctctactaaaaatacaaaattagccaggcgtggtggtgggcacctgtagtcccagttactcgggaggctgaggcgggagaatcgcttgaacctaggaggcagaggttgcagtgagctgagatcgcaccactgcactccagcctgggcgacacagcaagactccatctcaaaaaaaaaaaaaaattagtagcacatatttttttaagaaaaaaatgaaaactatggaaagtaggaagtagcagataaaaatgatatctggcctcattctccaaaccctgttgatacttttttttttcctagtcattttccactacgatttggcttttttgggggtggggagcagttataattatacagtatatgccattttataacttaactttttcatataacatggctttataaactttttctgaaaacttcttaagcataattgtccaattagctactaaataattgttaaatggatgtacaactattgacttcaccaattccttactttaaaaatgtaggtgctttccaagtttttgctcttttcaataacaccaccggtatcctctttgggaataaagctatttctagatttcatactattttgtcaatcccttccaggagcaggctcaacagaggaggaggcagaagcattgccaacgctcttagcagatctgggcaactgtttccccttcccctcaggagtctcctctcaactgtgtgggagcccacaccaccttctttttttttttttttgagacggggtctagctctgtcacccaggctggagtgcagtggctcactgcaacctccatttcctgggttcaagcaattctcctgcctcagcctcccaggtagctgggattacagatgcccaccacaatagccgggtaatttttgtatttttagtagagatggggtttcgccatgttggccaggctggtctcaaactcctgacctcaggtgatccactcatctcagtctcccaaagtgctgggattacaggcatgagccactgtgcccagtctcacaccaccttcttggcaggcgccatgctgtgtttgcctggccctgccagtctgcagttgcgcaaatggtcccaaccggatgtcagcaagaggacagtgaggctgagaaaagccaatgagagcaggaagctctgcataggtggtgggtgatccctgcctgcattcattagagatggtgtttcctatgagaggcaagtgacgggtatggcttgcccttctggaaaggaccaggaccccacccaatggtcagtggcccacatgctggggcagatccccaaacagctgactgtggaccctgacttgaagacagagaagtcatggggacctcacctgctgcctgggggagaccccaagaggagatgtgggcattggggatggttgctgttctcgaaggtggtggagggaatggtgggagggccataagtcctcagtcttatcgagaaaagtacgccaaggggcctcagtatagacccagccccaagctcacatacagttcctcctggacctcgggcaggctcagggcctgtctgtcacagcgggggtcacaatccttctgtttctctaatttagaaatatcctgtttccccaagtccacctcaccctaacaccctgtcttatcacaagtccactgcccctcccccatagagggaacagagccagaagttcctcaggggccctttttctgtcctggctgggccagaggctggtgtcaacagccaaatgatgaatcagcccaacgctaatgttgagccattgtgtcaacttccatgcattgagtgaggttgaggacagcacccccaatgcaaatctgacctgcaaggacccaaaggaccccgtgattcctggaccctcctagtcccctaagggctctggaacctctttcccaacagcgaaagaacctcaagtaggcattttctaaagcaatctgaagacaaaatgtgaaaaactcaaatacggatggaacacttactccatgcacacttgcagttcttgtttttttggtaacagagcaatcatcaccaaagttgaattggaggtagcatccattttttcatggggatactttttcaccatcttgcacgctgaagtaggaaatgcctccccaggggcagggttggcagtgccctctggcctcactggctctgggcctcacaggatgggtggggactgatcctcaagtgctcttctcttcctcccataggagacttggcacagaggcctccttttctttggttctttctcagccatttcctgtcacggctactctcggcccagctagtcttggtatactgggtggcaggggatgcggtgaggaccagggtttctgcctccctaagaaacaccctggaagtctgaattccaggcaaatagaaagtagaaggtggactgggcgcagtggctcacgcctgtcatcccagaactttgggagaccaaggccggtggatcacttgtggccaggagttcgagaccagcctggccaacatggtgaaactccgtctctactaaaaatacaaaaattagctgggcgtggtggtgcatgcctccaatcccagctacttggaagcctgaggcatgagaatcacttggacccaggaggcgattgttgcagtgaaccaagatcgtgctattgcactccagcctgagtgacagagcaagacttagtctcaaaaaacaaaaaatagcaacaaaaaagtagaagatggaccattgagtgagtagattccgtgatggggaggtgggcctctggctcaacaggtagggctggtgcccagagcaagactcagcacccatccagagccacagtaatcaggtgggatgtgccttaagtcacctcccaagacagagggcaggcaaaagctggtactggagaggaaaaccagctctcctgttggaggagttgcaggaggtgaattcctctggccagggtttctccatggtggccctgttgaaattttgggctgggtggtgttttgtggtggggagggggctgtcctgtgcattgtcgcatgtttagcggtatccctggcctctctccacgagacgcagtagcattctcttctctgttcaccacgctatgacaaccaaaagtgtagtacttagtgccactgagctggatacttagagttaaaatggtaaattttatgtgatatgtgttttaccacaattttaagaataaaattgtaaaaagtaaaaaaaaaagtgggctgggcattgtaatcccagcactttgggaggctgaggcgggcggattgcttgagctctggagttcaagaccagcctggccaatgtgacgaaaccccatctctactaaaatacaaaaatattttgctgggtgcggtggtgcatgcctgtagtcccagctgagtcagaggggcctgcctggggaggtggaggttgcagtgagccaagattgcgccactgcactccagcctgggtgacagagagagaccctgtctcaaaaaaaaaaaaaaaaaaggtggaaaaaaagcatagtgtggaattctaccatacatctctaggccacagagagtcaatagggaaactgagacacacaggatccctgccagtgctgtgtccatcccctaacgtggggaggcagctgagtggaaggcgcctcatgatacaacaattaaaaaaaaaaaaaaaaaagctgtgcttagagccaaaagccaagactggaaagaccaggcagctcccccactgtctgcaagctttcccatcaaactcaagtcccctgggccagcgcccagctctctctcctcggccctggggctgctccttggaggcaggcctgccccatgccctattgcttatctaggggagggcttattttgtattactcagggggtgaaagggggtttaagggccagaactgtgccctttaagccatttcccaaaataggcagccctgaaatgctgcatgctagaagatgatggggaacatgaaggggaaaggtcagcaaagactccgctctgcacccagctggctcactgatctcacagacctaccccacactgggccccaatttttttttttgagatggagtctcactctgtcgcccaggctggagtgcactggtgcgatcttggctcactgcaagctctgcctcccgggttcacaccattctcctgcctcagcctcccatgtagctggactacaggcgcccgccaccatgtccagctaattttttgtatttttagtagagatggggtttcaccgtgttagccaggatggtctcgatctcctgacctcatgatccgcccgccttagcctcccaaattgctgggattacaggcgtgagccactgcgcgcggccctgggccccctgttttattgggggtcactcaataccaccttccctctaataagcacagtgtttctgggttttacctgcccaccaatgctgcaagatccctccaggatttctggagggtgagaaagaccctactccttccaacaagaagcagagccttagcgtggcacaatcagaaaggaacatgctgcatcaagagtggttctcaaagcccgggccccagcgtgacggcagcagctgcgtgtggacacctgttagaaatgcacgttttcggcaccgctccagacctagtgaatgggaaattcacagggagtggggtgctgccaaactattgatgttttaataaagcccgaggaccactgacctgcctccagcccatacctcatctcacagagaaggtgaccaaggtcttgagaggctctatgacttgcccagggtcacacaggccacagtagaatattactcttcatgtttaaagtagataggatctacttaggaggctgagaggggaggatgcttgaggccgggggacagaggttgcagtgagccaagatcatgccactgcactccagcctgagtgacagagccagaccctgtctgaaaaaaaaaaaagtagacaaacgttctccaattatgccgataacatgaagcctaaactaagaaagatggaaaacagaaaagaatgcagtcaattggtttggcaacaaacaatggacagcaattggtaacaaaccaattaagagaaaaaaagagagggaacaggaaggctttgaagagcatggcttcagccaggccccctgggttcagtccttgctctgccactggctgtggaacaaggacaaattagttaacctctgggcccgtttccccatctgcagagcaagaataataatagaacccccatcaactgttagatgatcttggggattaaggtagggctccaagtgtctcacacagagggagtgctcaatacatattagctttaactgtgacagaggaggaagggacccgcccaaccgcaagataattagagtatagggagaaaacaatcaacatggaacaaaagaaatctgcagtctacagaggtggaataatatccagaggaaagagctgctgaagaatttggcaatgatgaagaatctggggatggttatgatgatgaataagaaatgatgatctggccgggcgtggtgtctcacacctgttatcccagcactttgggaggccaaggcaggtggatcacctgaggtctggagttcgagatcagcctgaccaatatggtgaaacaccgtctctactaaaaatacaaaaaaaattacccgggcgtggtggcagtagctgtggtcccagctactcaggaggctgaggcagaagaatcacttgaacccgggagctggaggttgcagtgagctgcgatcgcgccactgcactccagcctgggtgacagagcgaagaccctgtctcaaaaaaaaaaaaaagaaagaaagaaagaaagaaatgatgatccttaacagctctgggctctggggaagacttgaacaaagagaggctgaggatgagtgtgagagaagcctaagcgggtgggttactgctggctgaaggatctggctctttggagaatcatctaactccccccaggcagagaggagggaatctctctgattttatgtagggagtgaaggaaaagagattacttggaagatgttttctattaaggaagtcccagagaatttaggagagaaattcctcaaatgggatgcctgctctttagcaaccagtaagaggaaaagaaagaaaagctgagcattcaggtggcgcacgcctgaatcccagcactttgggaggccaaggcgggcagatcacttgagcccaggaattgggcaatagcctgggcaacatggcgaattagctgggcatggtggtgcgtgcctgtaatcccagcttctccagaggctgaggcgggaggatcgcttgagcccaggaggtggaggctgctgttcactgtgatcgtgccactgcactccagcctgggtgacacagtgagactctgtcttacaaaaaagaaagaaaagaaaagaaagaaggaaggaaggagagagagagagagagaaagatagaaagaaggaggaaagagaaaaggaaagaaaggaaaaaggaaagaaaggaagaaaaagaaaaagagagagcgagagagaaagaaagagagagagagaaagagagaaagaaaagaaatcagccatgtcctgcaggctcctctcctcaaggaagcactgacaaacaggaaaccccttggcttccaggaccagaggcttccaggtgggttggaggcacagctgcaggcagctgcaggccccaagggctacagcctgtgcaagaaccagggctctctctaccttcacccctgggcaggttagagacctggcaggttccctaatggtctgccagtttagagacaaggttgtagagcgacagagccctgattgactccaggtggcccaggtggtgctgtgggagggtcctggtctcggagtcaggggactgctctagtagtaccctgggcaagacactgaactctatagggctcaagttcctcctgtgtttttaaactgaaattgattaagtgctcactctgtggcagggataatacagtgactgtggggataaccagcaccatctcccatgattctatctcatttaaccccatttgcatttaacagttgaagaaactgagtctctgaggggtaagacatcttggtcacagtaactcagctgattgggggctgcctcagaacggggactgggatgtctcccaggaaagcctgtgctctacaccgcctcaaatcctacaagagtgggtttctacgatgcctatagtttctgcctgaggggtcaggttccaacagcccggactgagtaatctagaaccaacctggagaccccgagagaacccacttgaacagccagctgccctaaagcagatgaaggaaatcagaatatgccaccacaaaatatgcccctttggcataaggattgttttgagctggttcagatgtagaaggaagtcttcccagagcttgtttatctgactaaaagcagaaactacttcttcctttttttttttttttgaggcagattaacaagagaaaaacaaagagggtctctgtttttctcttgttaatctgtcttgtgtaatttgcagggccccagtcagaaaacctaagagagtaaaggaagaaaattaagttttttggaacccacagtctcattctgtcacccaggctggagggcagtggcacaatcacagttcactgcagcctccacctcccaggctcaagcgatcctcctgtctcagtctcctgagcagctgggactacaggcatgcaccactatgcccagctaatttttgtttttatattggttttttaaattttttaaaatttttttttttttttttttttagagatggggcctcactgtgttgcccaagctggtctcaaattcctgggctcaagcgattctctcacctcagccttccaaagtgctgagattacaggcatgaaccaccatgcccagccctaaaagcagaaactcctaagaaaacacacctgctgtaaatgcccccataaaatatttgtggccacttgattgactttctcagtttgccactctgggaagccaaaaaccatttttcctttgtcttgtcatttgtctacaaatttattgctctttgttaagaagctttatatatttatatttatttttattttttgagatggagtttcattcttgttgcccaggctggagtgcaatagcgtgatctcggctcactgcaacctctgcctcccgggttcaagcaattctcctgcctcaacctcccaaggagctggggttacaggtacatgccaccatgcctagataattttttgtatttttagtagagacggggtttcaccatattggccaggctggtctccaactcctgacctcaggtgatccacccgcctcggcctcccaaagtgctgggattacaggcgtgagccactgcgatcagcctaagatgctttatagaccccaagtgctaaccacccctttgagttactcatcattgatgtttctcctgtgtgatttgcgttatgtatgttaataaactctgttttcctcttgttaatctgcttgtccaattcgcagggccccagtcagagcacttaggagagtaaaggaaaaaaagttaagtttttccctagaatccacactaaggtgcccctcaccacctataaaagggcctccaaccagtagcctcagatgatcacagacttcgctggaggcctcgaggcagaggtggtaaggagctggcctcctgcagcgaggatccctgcagcttccaccttctaccacccgactttcccaaaccgaagacagtacacctcagtgatcaagagcgtggagtccactccggggaggaacgattctcaggggcttgcttgctgcgtgatcttgggcaagcgtcttaacctctctatgccttagtatcctcaactgtaaaatgggatttgtggtgaatcccatggacaaatcccattgaaagacacgatgtacttagaccacttagcacatacaataagtgctcaaataggagattttgcttaacgaaagcaactgaaagtgaactcttcagcagtgtccaagaaagcgaacactctcagggaccaccaagaaagtagaaggggcatttttgtacaattgcacaatgggagcaaccttgaaccctacctcgcttataactttcccttacactagacaaatagagaacggctatttattgtcagatttgcattttgttagctctgaatatatggagattgtgaaatgaggtatttgagctaaaaattccccagagaattggtttttcaaaaattattcagggtcaagttccacaagggttgagtttctattcttcttgtagatataccaacttttaaaagtgaattaagaagtgatcgctatttcagataaaaagcagggtcctcagagaattggatggttcttctaaaacagtgctttttgcctggcacagtggctcacgcttgtaatcccagcactttgggaggccgaagggggtggattgcttgagctcaggaattcaagaccagtctgggcaacatggtaaaacctcatctctaccaaaaatacaaaaacttagctgggcatggtggtgtgtgtctgtggttctagctacttgggaggatcgcttaagccttaggggccggggggtgttgcacggagttgcagtcagctgagatggcactgctgtactccagtctgggtgacagagtgagactctgtttcaaacaaaaaaacaaaacaaaacacaaacagtgcttctcaaatattggcagcatcagaaacatctgaagctggctaagttcagattccagagactagttttgtgggtctgggctgggcccgagattgctgctgctggtttgccgactgtactcggaggagtcatccttttatatttatttatttattttgaataaataaataaagcacttactgagtgcttaatgagccaccacgcctagcctgagtagccaccctttgcagaaatgtcctggaccattttaatgattccctttccaagaacccacttaaatagaggtctgctgtacaaagcgagatactcacacagtcactatttcccccacaatgtttacgtctttcggattgctgacttaccttcagaatttaaaagttgtcattgtgtatttcatttcaccagaattgaatacagttattatacccccccaccgaaaaaaaggacttgttgagctcccccagttccgggtctgcttaagctctgtgctcagctctgggggaagccctttcatgagtaagcagtgggtcgtcacgggaagcgaagtggggccagccgaaccaaaggaaatagagcagatccgcaaacccacacccactcccaaagtcagtctactgtcagaaaagctgaagctgctgggcgcggtggctcacacttgtaatcccagcactttgggaggccgaggcgcgcggattacctgaggttgggagtttgcgaccagcttgaccaacagggagaaaccccgtctctactaaaaatacaaaattagctgggtgtggtggcacatgcctgtaattccagctactcaggaggctgaggcaggagaatcgcttgaaccgggaggcggaggttgcagtgagccgagatcgctccattgcaccccagcctgggcatcaagagcgaaactctgtctcaaaaaaaaaaaaaaaaaaaattagctgagtgtggtggcaggcgcctgtaatcccatctacttgggaggctgaggcaggagaatcacttaaatccgggaagtggaggttgcagtgagtcgagattgcaccactgcactccagcctgagtgacagagcgagactccgtatccaaaaaaaaaaaagagaaaaaagaaaacaagaagaaaggctgaagctactgggggtctccaaagcaaaacactcgacgtccaagaccttggggaaccccagccaccagggcctgtgtggggagcaggtaagggtcaccggctggggtcagtaagcattcaagaagcgctcgttgactacatgaatagtaaatgtgacccgaggtgactttttaagggtggtgggagagaggaagcccacagcgctggtgtaagaggtggcaccccttttttggccttctttgcttcttcttttctctgcccactcccaaggccccatcagtgattctagggggcatcccccaggctggggcactggagaccctcactcaccagggacagctttccggacttcactgtacactgtctctgtgtccttctttcctagatctggaaaaaggaccaggcataagttagtagctgcctctgggaacgaggtcagtccactgcagtcataggaaaaggtctgaggctctgcaggcaaggctgtaccccaccactgcaccccaccagaaccaggtccagaagcacccagagaccttgtcatttctgatgttagaagatcctggctgggcaaggtggctcatacctgtaatcccagcactttgggagggtgaggggggcagatcacttgaggtcaggaggttgagaccattctggccaacatggcgaaaccccgtctctactaaaaattcaaaaaattagccgggcatggtggtgcgtgcctgtgatcccagttactcgagagctaagggacgagaatcgcttgaacccaggatgcagaggttgcagtgagccaagattgcgccactgcactccagcctgggcaacacagtgacacaccacctcaaaaaaaaaaaaaagaagaagaagaagaaggtcttggtctaacgagcgtcactcccagtctgggaataggaggtcagcaggccattgtggagcagggccacatgcaccagaggaaccctggacctgaggggccacggatggagaggcccccagcaagggcctgcagcctccagcttgctggccccactcctcttcccctgccaccgtgacccttgtccagacattctgccaggtccctcaacgcagggttgggctatggcctcccaatcacctgagagcccagaccccgggatccagaacaagatcctgaggtctgggttagagcctgggggttgtcagtgaccctaggaatagctgggactgagaactcttacagagatagacagctgggctggctgttttcactgctggctcctgggcctcactgcagcttctggttggattggtctgggggggtccctggtgctggttttttaggatctcctcaggggccctaatatgcagacagggctgagatcctctgggctagaccctctcaatatggcagcatgatgactgacccagggtgtggcgtatacctggaggagactcaagggcgcccttcctgccatctgtttaccttacactggggtatgggcacaggatgtgtatacaaaaatacacacacagcatatacacacgcacactcatgcacacaatgtgtatacatgctatgtataccctcatacagtgtataggatgtgtctacacacattgtatacacactgtatgtacaaacatgcaatctgggtgtgcacacactcatgcacacagggtgtgcacacacatacatacccaccaaccctgaggaaacaggatggaacctggccacttcccagctcctgtcacctgcacaaaggcccaggaagcctcactgtagaaaagagcctgatgtcgtgtgggccactgttctccttttacagatggggaaaggaagccccagatagggtaaggggcttcctgtgccatggtcagtgcatttccctccttggagtgaatggctggggtgtgaccctggactctacctgcactgagatgcccttgtctcaccatgctccagggacaccccactctcacttcctggccccacacacactcctccacagccagcactgccctttctccttgccccatttccccacgaccctggtggagcttcacgcatgtaccaacacacccacactcactctccctctgtgccctgggaagttacagggccccctgagctccacagcatgttggtgacatttgtccacaacacaccgatgtgacttgttcccaagtccgtctccctggcagaccccgacctcctatggggtgacagctggggtcttggacatgtcccattcctaggcttgctcagctgcctgggggcacctgtccaagtttgaagtgacagtaatggtggtggctcctgtgtcaggaaccatttgtgaggagaaagcctgggggtgggtcagatccctacagttgaacttggggcatttggggtgactagggccttacactgacttccccagggcaccaaacaggatttggaactcagtagagtggctgagctaccagggcaccacactgctgggacagcagagatgcccacacacccctcactctctttctgtggcaccagatgtgggggcctcaagggaagctgtagggatccccaaccctattgggggatcctccacatccccaagacaccctctgcttgatgtcaggcctggccaaatcactcactcagcagaatcctagacacctagtgtgaaccccgcactgtggaagaggaaaggtgatcgggcctggtcccagctttcaggagctccaggctgtgaggcagacaggtgcacaaacaacgcagacactgcaacaaatgctatcaaacaccatataccaggcgcatggtggggtggtcacggccagctcaccctccgacccaggcccacagtgggggctggggcaggtgaggaataaatggagggagagggcttggtgtttgggcctgggggtttctgcttcttggtggagcttctagagttgcagctgcccccaaatctgcccagttaagtgatgggtgggcaggcagagttgcagctcatcactacctctcctccccacccactccacggcagcagctgcttgctaatgagtaaaccaggctggcaggctctttgtctctgctgtcagggatgtttccggatggggctttattttggcttctgtttttctctgtgttaacagagaaggagatggcttcaacgtcatggggttttcccagcaattagtctcagagcaaacatgcagcaaaccaggatttactgagttccttcctgcccctcctccaccccaagtgaccacttggtcggctgccactagggtcagagctggatgtggttcccaacccctcctccataggaggaggaagtcttgagagcagggaactggcttggtcaagaccaggtcaaatgtactcaccactggccttgtacccacaaagccccttttcgtacctggtaatacctggctctccacccacaggaaggcagagagggaacacctgaggctcaggcctgacttcccacactgctccttagctgccaaggaggaggacgggtctagaaaactcaaattgaattcccaaaaagctctccattgcccccaagtgaccctctttacgggtctacctggacctctgcagcccacacagcttttgtgcaaatggggaaagagggaccagttaggtgatggcatccctgcagctgcacagcttggcaaggagggcacatgctgaccgcctctgcttcacccaatcctggagggtctcgatacctccttatttttaaattttttgtagaaataagttcttgctttgttgcacaggctggtcttgaatgcctgggctcaagtgatcctctcgcctctgcctcccaaagtgctgggattacaatacctccttcttgtcccttcaacccttccccacctttgagcaagaaaaagaaaaccagggccgggcgcagtggctcatgcttgtaatcccagcactttgggaggctgaggtgggcagatcactgaaggttaggtgatccctgaaggttaggagggctttgctgcagtgtgttcctggctgcctctcaggctgtccctccacaagggagggtctgtatgtgcttgtgctgcctgcgtagggccttaatcacaatttgttatctcaacgagtcaatcactctacaatgaaataaagaggaagaggccaggcctggtggttcacacctgtaatcccggcactttgggtggtcaaggcgggtggatcacctgaggtcaggagttggagaccagcctggccaacatggtgaaaccctgtctctactaaaaatacaaaaattagccggggatggtggtgggcgcctgtaaccccagctactcaggaggctgaggcaggagaatagcttgaacccgggaagcagaggaagcagtgtgccgaaactgtgccattgcattccagcctgggcaacaagagcaagactgtcataaaaaaaaaaaaaaaaaaaaaatgaggaagagagcttcaggcctgccgcgttccccacccctctcaggtccagtctagacttggaagtgagttgtgcagattgggcagtacacaacccccgggggccattctgttggtaggctatgggaatgtgccccagtggtgcagcacacagcccagcggctctacggggcatccctgtaaggaaagttctgtgcatacagctgctgacactcagcccaggctcaaaaagagaagacaaggagaagtccaagactcctcccagatcatggagcaaggggtgatttcaggaccccattgccatgtggtctggctagtggctggcacggcctggaaaactgcacccattcagcctgcacagtcaggaaaactaccccaggcctgcctggctaggtggatgcagcctggggttagcctcagaggaagggagacagatggcaatgatcccagggagcttcccagctgggcaggaaggttctgagactgcttcctttgagcgtgcaggagccactgtttcctttgagcgtgcaggagtgtgcagtgacccccggggactgtgtactgcccaatctgggttcgcaaaggaggaggacagttaggagatgcatttttaatttttttttagacggagtcttgctctgccatccaggctggagagcagtggcttgatcctggctcactgcaacctctgcctcccgggttcaagcgattcttctgcctcagcctccccagtagatggattacaggcatgcgccaccacgcccagctaatttttgtatttttagtagagacagggtttcaccatgttggccaggctggtctcgaactcctggcctcaagtgatccacctgccttggcctcccaaagtactaggtttacaagtgtgagccaccgtgcctggccaggagatgcatgttttttatggtgcccaaaacaaacgagattgatgttctagcattttctatggagcagcccactctgcatccatttccccagcatagaaccagagacagggacttccaggccagcctgcccttgagagaaccacatacacaaaaacaaaacccaaggtgtaaaatcagtgccactgctcacacggacagggatcttgtgctttcaaaagcctttacctaagtgtccctctaaatggcaaagcactcgatatcttgaaacatgcatttgattgacacacattcagtctgcacaagcaactttaggaacacactgggtttggcagggggtctacctctggaagggacaaattgctcagtacttcctaattccctggcacttagtaagtgctcaataaatcttacctattattagtagtatcataacgaataattatcaaaaatggccaggtgtggtggcttcgcctgtaatcccagcactttgggagacaaaagtgggcagattgcttgagcccgggaatttgagaccagccagggcaacatggcgaaaccctgtctctatttttctttaattaatttttaaaattattgaggccgagtgtggtggctcacacctgtaatcccagcactttgggaggctgaggggggtggatcttttgaagtcagaagttcgagttcacgctggccaacatggtgaaatcccatctctactaaaaatacaaaaaaaaaataaataaattacccggctgtggcggtgcatgcctgtaatcccagctactcgggaggctgaggcaggagaatcgctttaacccggaggcagaggttgcagtgagctgagatctcgcaactgcactccagcctgggcagagagtgagactccgtctcaacaaagaaaaaaaatatatatatatatatataaaataaaaaatatataaataatataaatataaaaatattatatataaaatatataaaaataaaaaataaaaatatataaaatattataaaatatatattatacacaaagaaaacatatattatatattatatatgtatttatatttatatattatatatattatatattttatatatatatatatattttttgagatggagtctcactctgtcacccaggctggaatgcagtggcgcaatctcagctcactgccacctctgccttccgggttcaagcgattctcctgcctcagcctcctgagtagctgggattacaggtgtgcgccaccagagccggctaatttttgtatttttagtagagatggggttttatcatgttggtcaggctggtctcgaactcctgatctcaggtgatccacccgccttggcctcccaaagtgctaggattacaggtgtgagccacagtgcctggccttttctttttttcttttaaattattgaaattttacagctcagagacagggccagggccaggggcctttgctccttccagtcttagcaggccggtaggtctgctaatcacttcctttggagcgactgagggtgcacagactcttctcactgaacacagcacccccgccaccactggggtttaaacccaagccaaaggcaatgcctggggactcactcgagtggcacttacctttgtgagactcagctgaggacacttgaacttccgtgtactgcacgtctgagttcagaggctctgctcaaagaaaccacagcagcttgttgtttaggtggaatctcttgtgggcacctcagatcatagaagtagagactttcttttcttttttttttttttttttgagacagagtctcactctttcacccaggctggagtgcagtggtgtgatctcagctcactgcaacctccacctcccgggttcaagtgattctcctgcctaagcctcctgagtagctgggattacaggtgtgcaccaccatgcccagctaatttttgtatttttagtagagacggggttaatttttgtatttttagtagagacagggtttcaccatattggccaggctggttttgaactcctgacctcaagcgatccgcccacctcagcctcccaaagtgctgggattacaggcataagccactgcccccggctagattttcattcaggttattaaagtattctgtattttgagggggcagccagacacaggcttaattccattcgggatgaggaagggagtacgaaccccgcactggtcccagaggcagatacagggcctcggggcccatggtttcctccctgactcctctgttaccaggatgtggagggaccctctggcctaggtccctgtttctacagtggggggacttggaacaggtcagtagagacagaaaacagcccagtatcagccccagcagttctcccaattcagtctcactcaagatgctggaagccttctccacagccacaggcaaacaaagctacctccaagactgagaggatttcgggaaatggggaacaggggtcactaccctaaaaatacttggagagtgtgaggcatacacgtgaatgaaatcactcagggtactaaggtgaaagctagaaaagtagtttgtcttcaagtcaaaaataacattactgttttgtttttaaagccctaaagaatagggattctcatcagctaccaaaacaatgattctgcagtcaaagatacatttcaggctgggtgtggtggctcatgcctgtaatcccagcacttcgggaggctgaggcgggcagatcacctgaggtcaggagttcgagatcagcctggccaacatggtaaaaatccaccaatactaaaaatacaaaaattagctgggcatggtggcacacacctgtaatcccagctacttgggaggctgaggcacgagaatggcttgaacccgagaggcggaggctgcagtgagccaagattgtgccaccgtactccagcttgggtgacagagtaagactctgtatcaaaaaaaaaaaaaaaaaaaaaaaagagccaggcgcagtggctcgcgcctgtaattctagcattttgggaggccaaggtgggcagataacaaggtcaggagtttgagaccagcctggccaacacagtgaaaccctgtctctagtaaaaatacaaaaattagccgggcgtggtggcaggcgcctgtagtcccagttacttgggaggctgaggcaggagaattgcttgaacccgggaggtggaggttgcagtgagccgagatcgcaccactgcactccagcctggctgacagagcgagactcttgtctcaagaaaaaaacaaaaaaaagaaagaaaggaagagaccttaacagaatcctttctctttgttaggagccttagctcccatggcagcagcccagagcgaaaggaattttgaaaaatgatttagtccaatccctcagtgcttcaggcagaagagagcaatttattgtccattgtctttaaaaatcaccacctcaatgctcaagaaaaaagaggttccactgccttacccagtagctcattatgagtcaggaagttgttttttgagtataacccagttcttccctactttgatttaggtgactttcccactgaggacactagatagcatctctggtgaaagcagctagctaccttcattgacacatcggctgggtacagggtcattaagagaggtgggaaattatccacagtccttcaagttttagttttcttttcctatgagtcttttttttaatgtaaaagttggttctaataaaaacatgtaattagataattacctttattatcatttattggtttcattgcatggtttctgacatcgtcattgtgacctagttgaaaaataacaattagggtgagtgacaagggaaattctagttttctaaaaccttttaaaaattcagtacccctaacaaagtcaagcctgatttattcagtgtagtgacaaccagcactgtctctgggtcctgggtcccctcgttggccctcctgtgggctccatttgacctgctgtgtagtctttttctttttttctttctttttttttttttttgaggcaatgtcttgctctgtcacccaggctggagtgcagtggtgcgatcccggctcactgcagcctcctcctcccagattccagcgattctcctagtctcgctttgttgcacaggctggtctccaactcctggcctcaagtgatcctcccacctcagcctcccaaagagctgggattataggcatgaactaccatgcctggcctgaatatagtttctttctttctttcttttttgagatggagtttcgctcttgttgctcaggctggagtgcaatgttgagatctcaggtcactgcaacctccacctcccaggttcaagggattctcctgcctcagcctgctgagtagctgggattataaacatgtatcaccatgcccagctaattttttgtatttttagtagaaacagggttacaccatgttggccagggtggttttgaactgctgacctcaagtgatccacctacctcggcctcccaaagtgttgagattacaggcgtgagccaccgcgcccagcctagaatatagtttcttaaacaatatatttgctcgtttctatttactgacacattacttttattactacaaatattttattttccttttttaaagtttatgattcagtactatatgaattactcaattcttaaaacatatttctcaagcaaaatatgtctctgtaaaaagtatatcctaaaaatttcttattttgtgagacatttatagaattagaaaagaacatgagcattctatgaccaaacctgctgataaagcaagaaaagtggctgggctcaggggctcacacctgtaatcccagcactttgggaggccaaggcagaaggatttcttaagcccaggagtctgaaaccagcattggtagagtgccatctctacaaaaaataaaaattagctgggcatggtggcacatgcctgtgatcccagctactcaggaggctgagatgggaggatcacctgagcctgggaggtagaggctgcagtgagctgagattgcaccactgcactccagcctgggaagaccctgtctaaaaaaaaaagaaagaaagaaaagaggaagagtgttccaaatttggtctgggacaggaccttttgtgatgtaattatagccccctctgggaagtaagtagcatccctgctgaaatgcttgagcaattttcttactaacctgggattaagaactcctaggactggctactcattcagctgagctgaccctgaagctactgatgagccttatgaatagatatttcttagttggaacactttatttatgcctttactgagagaatattgaaattgctttccctttgtggcaaatttgaagtaaaactgtcttgtgcttgtaataattccatctgagaagatgttttaccaatgttttcattcaatatctggtctctgtcttgaaaatggagaattataatattacgctggagcaatgttcaaagtctttgaaggcattatgattattctccatctttcttctacggggagtttggaaggtgacaaagttagaataaaatatgttacctttccttttacgtttctgtatattacatggcccagtggctgatgagatgaagtaccctgttgaagccagggtttctcttccaactgtaatcccaccacttacatattctgcttctgagagggctaaggaagtatgtagcaagttgggggaaattagaaatggcaggagaacatgactttaccgtaatgactgttagcttccatattgggatctgacattttctcgttgttggagttcagaagtggtactgctggccttaaaatgaaatataaaaacagaaaacaatatatagatatatttgttgttgttattgttctaaccccaaaccaccaaagtaaacaagggaagatcatgagaaaaccaggaagagttttccaaggtaaggaaaactttactctctcatttggaaaacaaatattttttggcagctccaaggattatgtaaaaaaactttttttttttttagacagagtctcgctctgtcacccaggctggagtgcagcagtgcaatctcggatcactgcagcctccgcctcctgggttcaagtgattctcgtgcctcagcctcccgagtagctgggattacaggcatgcaccaccacgcccgggtaatttttgtgtttttagtagagatggggtttcgctggctaggctggtcttgaactcctgacctcaggtgatctgcctgcctcagcctcccaaagtgctgggattacaggtgcgagccaccatgcttggcggtgataaaactttttcctattaaaataaacatcaggaccaaagcacacatgaataccaggagtccttcacaggctactaccaagcccctgaaattcttatcccacgctactgtttctctctggaacagagcaatcatttctatacttttggatttgggatttcaacaacagtaaaggtagtaaaaccattttttaaaggccaactctattttgtcaaattttaaaaaatttatctactaccattataatttcataaagaaagggagatttcacaaataatcatgtaggaaggacatgatctcagaataaaagccattccttcccatgaaaggacaattggcattcttccacggagatacacacacacacacacacacacacacacacaactcacacacacaactcacacccaaggaaggcctatatttttctaagtttgccaagagccactgaaaacttcctaatgaccagaatctccctccagacatgtccaccgtgctcacagagcagccgcccccttcttacaaatacactcacctggacatttccactggcatctgcttggctttaaaacagaaaacgaaaaaccaaagtcagtatacagtacccacatccataccactataatggccaaaacgccaatggcttttgcactaacctaatagatagaaaacacttttcttttctttttgttttactcctagtaagctgtgaaggaacactcttttcagctacgtttgacttcccagaagattgaatacccagaaaaagagagaaaaagaagccaaatatattcactcttttacaaaagacagaaaagaaagaggtattctcttggtcttataccaagatatttccccagaaacatgatatcttgactattttagccagaagtgatttttgttagtgaaatatgatggaaaaagagacaatgatatgggaaccagattagccagataagcaggcagctctcttcctctctctctcttttttttttttttttgagacagagtcttgctctgttgcccaggctggagtgcagtgatgtgatctgggctcactgtaacctctgcctcccaggttcaagtgattctcctgcctcagcctcctgagtagctgcaattacaggcacccatcaccacgtctggccaattttttgtatttttagtagagatgggggtttcaccatgttgtcccggctagtcttgaactcctgacctcaagtgatctgcctgccttggcctcccaaagtgctggaattacaggtgtgagccaccgtgcctgaccactctctttgattccagataattacaaaaagtaaaggcgaaatcaatccctgcgtttgtaactcgaagctggcctaagatcaacgccagggtgtgctctatcttccttgatgggtggcagctttcctgacaaaaaccagggcccctcctcaccccatcttcccctcccatcctgggcagcagcaccagaggctccaaaagaacctaccttatcccacaaaaaaatttttgcaggatttactgatgctctgcccttttccttgagtcttggacagctgactctgattcctggttatcagcaggtggtcctggctgctcagccgggcttacttagctaaccacaagcatagggtagaagtcacagcacaaccaccaggttaattacaaagcattcaatgtgtgtgtgcaacatgtgggtgttatgcgcatgtttgtgtgtctccaagacgcttgcaccccactctacacacattacaggactaggtgtggacaaatctacagaaatggcttcttctaaccacacaaagatgcaatttccccccaaatttatcttttctggtttgcccaatgaggaaaataatagctttcatttttgcctagctgaatccaggggtcagaaaagcaccacgcatccctggctggtttcctggcaaggacgaccagtcagtatggaaggaaagaactatgctcacccttggctttcctcagaaaataacatttggccgcaatgatcaagagagcaatgatcactccgatgataaccactgcaataagtcctttcttccatggggcaagaatgactgaaaacaaaacaaaacaaaaaattttttttgtatataggctcttcctctgccaggaagaaataatatcaggcttaagcaacaaaagtcagtctgattctcacagctcttgtaactggcagcttgccttagcatccatctacctctgaggggttctgcactcagagctggtgcagaaatgattgtttctgctacaaatagaggtcagctgtggtcctcaaggagggaacaaaccagctttgctggggtagactcttttctttttctttcttttttgaaacagggtctcactctgtcacccaggctagaggctgatgacagctcactgcagcctcaacttcctgggcttgagcaatccttccacctcagcctcccgagtagctgggactacaggagcacaccaccacacacagctattttttgttggtttgatttttgaggcagagtcttgctctgttgcccaggctggagtgcagtggagcaagctctgctcactgcaacctctacctcctgggttcaagtgattctcatgtctcagcctcccgagtagctgggattacaggtatgagccactgcgcccagcctatttttgtactttttgtagagacagggtttcaccatgttgcccagg

SEQ ID NO: 1371 - DNA, 20001 bp, Homo sapiens
gcgattctcctgcctcagcctcccgaacagggcttttctcccgtcctttcccctcccctttctccctaaggatacactggtgctatatgggtaaggctgggctggaaattctataaagaggcccatcccttaagtgttttctagagagggagaggagaggagcaggggcgggctggcagctgcacagggtgctggttctccggacatcgccatctgagggcgtgtggcccacacgcgtgctgcacccttgtcctgggttccctgtgtggtgtgcgcacacactcacctgccccgagaggtcgcattcctgatcaaaaaccatgtactcgtcctccttgctgtacattcccaggcccaccttgagaggtttgtcactggcatcgagccggaacttcagtttacacaggctatcgaagagtttggacaggtggcggctcacctgggaggaggcaagaagcgggaattatgcaacgggggatttgaaaggcatgtgcgtggcttgggctttccgtgggtggttttaggcatcgttctttttggaatatactccccatctttgatcaacgttgactaaacatgactaagtcaacaaaaggaaccagcgaagactgctctgagtcaggacacagaaaccaggccaggaaccgcagcccttctaagccaaacatccattctggaagatttctttttggtggggcatggtggctcacacctgtaatcccagcactttgggaggccgaggcaggtggatcacccgaggtcaggagttcgagaccagcctgaccaatgtggagaaaccccatctctactaaaaatacaaacttagccagacgtggtggtgcatgcctgtaatcccagctacttgggaggctgaggcaggagaatcacctgaacccaggaggcagaggttgtggtgagccgagatcgcgccattgcactccagcctgggcaacaagagcgaaactccatctcaaaataaaaaaaattaataaataagatttcttctttttgagaaggttctgtcccagatcccaagccacacactcagtctattcttgcatatcccttcttcttgtgtaacctctaaccttacggtcaaaataaaatgcaagcgctttcccttcacctagttaattttttttttttttttttgagacagagtctcactctgtcgcccaggctggagtgcagtggtgcgatcttggctcacggcaaccctctgcctctcgggttcaagcaattatcatgccacagcctcctgagtagctgggattacaggtgtgagccactgtgcctgacctcttttctcttttagaatagccccaaggaggcacctgttccttgctcttgggaccctgagatttaaccagctgaccagagcaagacccactgagaggtgtgtctttcagaaacagtgtcttactaagcctctggcatacgacccattttctagaaggggaaaatgaggcacagagaggcaaattaacttctcaaaagccaggccaagtgcagagcaggatgtgaggcgagtcctgccacgtttctgccatggctggggaccccagggcagcttctggtgcagagggcctcctggagatgatggggcacgtccaaggacacttaccccaccctagggcggttgaggtagaggtgcccacctggggtctggcatgatgttggcttaaacaccggaatgcaaggggccccgcctacctccacggggtcattgccattggagagaatgtccaggaggtcagccgaggagacaaaatagaaccgggggaaagccagtcttttcgtctctaaatactctgccaaagccttttcacagatggccaagctgggaggaaggaaggaagtagaggaggccggtgaccctactctgtagggatgtctgccacccaccctgtcggcgaaggaaactgatcatcctggagatgcctggactgctgttcacaggcctggtttaattcagaatctcctaccggaggctctcgtttctttgccatcccctgaccttgtgggcactcctaggcaagagggagcatcatttattctccgggtcattgcttccttcaaggccaaggcatcacgtggtgggatgaggccggggagtgtgtgctccccagggaaaggcaattgattaacccaggacccatggttttgccctgtcctggccagcaggctgcacaagacttaagttccgtcagacttaagacttagggaatctgcaccactgactcccctggtctggataggtgtgagccgcacctcttcttcagggcctccagtttattgtagaggccgggtttgctggtggcttccaccacgttgggtgttttcactgcatcttccatcaaggcctgggaagagaaggggatcgccaaggcattagggatcgccacacacagtcatttctgaagtgcgtgggaaccaccgggctgtgctcaccttgaattcctggttgatgtcgtcaaagcgctgggagtcccccgggagctgggtgcggatgtcttcggagccgatgaagatgctctccaggtggctccaggttcgctggacctcaaaccagatggagatgacggagtccgccgtggacagcttctgctgccagcttgtcacctccttcaggaagtgggccaggtacttggacatcatcaggttctgcagctgcacctggttgtcctccagcgtctccaccagcacctcgctggacttgagcatcatggtgcctgtccgcgggtgcggctcgtgctggaattccatcatgctccaggtactgtccagggctttcagcaccttttgggggaacagaaaaataaggtcactgagcatttggcatgcaaagctcaggcaggacccagagtttccaggacatagactgaagctccatgatcagaaagcaaaaaggctcaaaccaacgtattcacaggagccaaaggcagatccaacccgaaccttcatcccccaatgatggatgcatgcgatctctgtccatataatggaacataagccactaaaggaatgaagtacagacacctgccacaacgcggataaacctgaagaccctaggctgagtgaaagaagccacacgctcagaccacatagtgcacgcaaaggagatcagaacgtgccaccccaaaatatgccatcctgcaattgacaattttgagtcagaggcacttgaagggcagcagatgcaggactctctctctgagcctcatgctgttcctgggaagcaggagatgcaattcccaggtgaatgatgctcttctgataccagaatgaaacgatcattctcatcactaggatgggaagtggaggcggaaagaatcctgtctgctcagacccttttagaacagctctcaccttccagcctcttacacagattacttttctacaacttacgctttctgcaactcagtacttaagtgttcaactctaactgtgttttggagtcttcctttcctcccataccacagaaaacttggatttaaataatttgcatacttttctcctcttgatctatcttacgtcaatggaattctcagacccagctggaaaaaaccctaaaagcatagtgaaaatgttgcctcctctacctatgatgccattcctatgaaagtgtggaagagggggatctatagagggggaaagtggattagtggttgcctagagctggagatggggacatgtgagaggaaaggggtaggggatgatggctaaaggatatgggtttctttttgaggtgatgaaaatattctaaaatttgttaattctattttttatttttatttttttaaaaattataattttttttagggacagggtccagcccaggctggagtgcagcagcatgatcacagctcaccgcagcctccatctcctgagctcaattcatcctcccacttcagcctcccaagtagctgggactacaggtgtgtgtcatcatgtgcccagctgtttttttttttttttgagatggagtctcactttgtcacccaggctggactgcagtggcgcgatctcagctcactgcaacttctccctcccaggttcaagcgattctcctgcctcagcctcccaaagcgctgggattacaggcatgcgccaccacgcctggctaatttttgtatttttagcaaagatgggttttcaccatgttggccaggctggtctcaatctcctgatcttgtgatccacccaccttggcctccccaaagcgttgggattacaggcgtgagccaccgtgcccggtcccccgctaatttttttaaatttatttattttttttgtagagatggggtctgcctatgttgcccaggctggccttctcttgaactcctgggctcaagcgctcctcctgcctcccaaagtgctgggattataggcaggagcccccaccctctgctgttgaatatgtgctgattacacacttgtaactatgctaaaagccactgcacactttaaacaggcgaactgtatggtatgtgaattatatctaataaagtttttttgttgttgtttttatttttgtttttaaagcaagtcaaaatgtgacaattcaaactcacaaaacaggctgaggagagagatttgaaccgcaaaaggagttttcctggatactggaactgccggtagccagtggcgcattaacaagttcaggtaccagctgggggccatcccccacccatccccaaccctcccgtcagctgcggagtcagaagaaacaactgacgtccatggaggagtcagacgggaccacagacaaagacgcttgaggcaaaggaaatgcgagttctggttatttacaaaatgttccaaactattgcatgtacggggcgggcagagctatagccgcaaattgggttttctaagaaaaattccagaagtaggctggcgcagtggctcacgcctgtaatcctagccctttgggaggctgaggcgagcgggtcagttgaagtcaggagctcgagaccagactggccaacatggtgaaaccccgcctctactaaaagtatgaaaattagctgggcgtggtggtgcacacctgtaatcccagctacttgggaggctgaggcaggagaatctcttgaacccaggaggtggaggttgcagtgagccaagatcgtgccactgcactccagcctgggcaacagagagagactctgtctcaaaaacaataaaaaataataaacaaacaaatagattccagaattattttttaagatttgtcacaggttgggtaagaaaggcccgccagacttcccgtgagagccttggggctgcaggacccctctgggcgctctcagtggttggagggggcagtttcaggctgatcccacgttgcacagacagcaccgccagcacggcctaccttttccatgcccgactccttcacggccttgtccacgatgttgcggacctcatcctcgtaactgtggaggttcagctgcagtaaatctgccagggtcgtctcttctgacattttaaatttcacctaagggaaaaaaatccaggcaggattcatttcaggtcatgtgcactctgcagtgggcagacgtcatgatccttcatggagagccattgccggggcacgatcccgggctgctggagggagggaggcgagctctgctctgccattttcagctctgagacttgaggaagtgacttctccaagcctcaccttccttccctgtaaaaccgcataagagcagaacgcacctgcactgggcggaattgcggcccccccgcaaaattcacatccgcccagaaccttcacgtgtcaccttatttggaaatagggtctttgcagatactaaggatcttgaggtgagttcatcctggattttccggtgagacataaatccagggccaagtgtcctcgtgacaggaaggagagggacatctgaggcacacaggaaagagggccttgtggagaccaaggcagagacaggcatgatgcggccacaggccaaggaatgcctggagcccccagaagctggaggaggcaggaaggaccctcccccggagcctctagaaggagtgcagcctgctgacaccctgatttcagagtcctggcctccagcactgtgagaaaacacaggtctgttttctttctttcttttgagacagagtctcgctttgtcacctgggctggagtgcatcttggctcactggaacctccacctcccgggttcaagcgattctcctgcctcagcctcccaagtagctgggactacaggcacgtaccaccacgtgcagctaatttttgtatttttagtagagacggggtttcaccaagtcagacaggctggtctcaaactcctgaactcagatgatccgcctgcctcagcctcccaaagtgctgggattacaggcatgagccaccgcacccccggctagatctgctgttttaagcctcctggtttgtggtcctttgtcatggcagccccaggaagtgaatccaccacctttggcagctgccgcattcacaataggcaaagcgctctgtggcagtggccgaatcacaggtactgttactctagtaccagatcaccgttagtctagtacgaacataccaggtacttgcctagtgccacccacttcccaaatcgcttccacgtcccttgtctaatattctttttggtgtcacatagtcagatgtttctgagcattgattctgagcccactgtggaattttaaccaacagatggaaccttgcatctctaatcacatttggggacatatgtgcccgaggctcaccaagacctcagctgtgcccagctcctttcatggagatatttagctggttgtttatcaccgcccaagcgtctctcccagggcacccggaaggggcacatgaacctgttaccaggcatccgggaaattttttgtctcaacactcgaaaggcacccccaggggctggctcccagacacccagatccctggggagcaagtgggtgcccctgtgccctcagggtggcctgcatagctgggtttgcttttccttccttgggcctagggagcagaagggccctggacagtgtggtgggggcggagcaggagcctctaacactcctcctaggtgggcaccctcctgggctggctgggacttaatgagagatggagggaaccatttgtccccattctcctacttcctgcataggtacggatctcttgggaagccgtgggctaagcattgccgctgtgcaggctttgggccatgctgcccttggtccttggggtatgttctcaccgttgttcttgcattctttcatgccaagacctgtcccagcctttctgcttgtcttcacagttctcactcccaaggcccaagccaaatttcacactcactcagagcttttccttcccttcccaccgcttgaaggtggcaccctcctctaggtctcaggatcatcactaaatatctcctgcacttggcattcaaacctgattatggaggttggcagaatttgccaccaaaatacgccactttggcttaaggtttattttgagctgaaggcacttgagaagaagcagatacaagagaagctctctgtcctccccctatttgcctacaagcaggaaataaatttgccaaggagtcccaccgccccctctaccaagaatgatagaagttaatcaatggaggccaggtgcggtggctcacacctgtaatcccagcactttgggaggccaaggctggtggatcacctgaggtcaggagtttgagaccagcttggccaaggtgaaaccctgtctctactaaaaatacaaacaaatcagccaggcgtgatggcatgtgcctataatcccagctactcaggaggctgaatcaggagaatcacttgaacctgggaggtggaggttgcagtgagctgagattgtgtcactgaactccagcctgggcaacagagagagactctaactcaaaaaaaaaaaaaaaaaaaaaaaagaattaatggagacagcttcagccccttatcagcccagaggaaggggaggaatctacacaatgcaccttactgaagctcacctcatcctgctgtaaagcaaaaataaaatcctaagcccccgaacaaattgaatgaaccccccctctgctaggggcattccaaagtaaaccggaaaaatgagttcaggccatgacgggaaggaggctgggggacaggcctcattatacccccctccctttgggattcaggcacagctgaccagcattaacatcaacacagagaacctaagactgaccaaacagaatgtttgtagcaacatgatacaacacatgacagatagcaggccctgaaagaaatcgcagtattttaccccaaaatatgtttctttgacatagtttgaaatagtcctgcaaagctgtctcttgtaggggaaatctgcattctgtagagaatccccttctctttcctggtcttttcctattttgttagagacacagtttcactctgtcacccaggctagagtacagtggcatgatctcggctcactgcaacctccacctcccaggttcaagcgattctcctgcctcagccacgcaagtagctgggactacaggtgtgcgctaccacgctcggctgatttttgtatttttagcagggatggggtttcaccatgttggccaggctggtctcaaactcctggcctcaagtgatccacccacctcggcctcccaaggtgctgggattacaggcatgagccaccgcacccggctttcctctatttaatctgtctctcatcagtctaatttacaggagccccagccagggaacctaagatggatagatggaaaaataatttttttcctctgctgtaattgtcagtactattatttctctgcttccttgagagcaggggccatgtctcctgtctctctgtatcctttgcagctaggtggggcctctgcagagtagctgcttaaagtcattttgttcagtgttggctgagagaggggagcgttcctgttagccttctggaggtgtcaaggccagtgcctgccagtactgtgggatattcctggaaagattcaggtgctaagactctgagttcctggggtcatgaggaccctagcgaagctgttcatttgccccaaacttcctgagccttatgaacatgcaacctacaaccagaacggcctacctaatttgcagagcccagtgcaaaatggaaatgcgggaactcctgttcaaaaattactaagaattggctggcgcagtggctcatgcctgtaatgccagcactttgggaggctgaggcaggcggatcatgaggtcaggagttcgagaccagcctggccaatatggtgaaaccccgtctgtactaaaaatacaaaaattagctgggtgtggtggtgggtgcctgtggtcccagctacttgggaggctaaggcagaagaactgcttgaacctgggaggcggaggttgcagtgagccaagatcgcgccactgcactccaacctggtgacagaactagactccgtctcaaaaaaaaaaaaaaaaaaagaaaaagaaaattactaagaattttgagatggtgaagttgagatggtaaacggagcctgccccaccacccccaaccagcgtggagcccagtgtgactgcgcaggtcacttgtgcacgaagccagccctgcccacattggctttaccagcatcgggccctgaacaccttggctaggcagctcaggccagcccatcctgcagcagagctggccgccaggggcggtcccctccgcccaccatggtgcatggtacctgggtggcctgcatgagctgctgccagtggcgttcccgaatggcagggttctgcagctcgctcacggcacgcagggacgtgatcacgtttttcacggtgttgtcgagccccacgaaggcatcccaggttttcatctccttgtccaaagacctcatgtccttggcaaacttcttacaatctatgtccatctgctcaacgttgatatctttccacttggtggtcttccagtcctcgatgctggtatttacctgaaacgaaaacatcccgtttctccttccactctcatcaaggagaattcaggaagaaaaccctcttacctttctgcacttactcgcagggagcaaagcccagtgaggaatatttagaactaatacccgagatcagtaaagtgattagatacaagaaaaaacaaccgtggcgtcacaaaaggtaagatttaaaagttaacagttggccgggcacggtggcccacgtctataaccccactactttgggaggccgaggtgagcagattacctgaggtcaggagttcgagaccagcctgaccaacatggtgaaaccccgtctgtactaaaaatacaaaaattagctgggtgtggtggtgcacacctgtaatcccagctacttgggaggctgagacaggagaatcacttgatcctgggagacaagggctgcagtgagccgagatcatgccactgcacttcggcctgggtgacagagtgagactccatctcaaaaaaaataaataaaaataaaagttagcagttaaaaggcattttagcaaaaggctgtgttagggccctgctgttgctggccaggacccagttttctctcacttctcagtatgtccatgtagcttgtcttggccaaggaaaggtgagtgatgcctgacaatacccagcttggcattccccttgcctgccttggcaatcacaaaggggcatcgccgaaatacagcctgcactgtggaaccagtccttggcaggtagcttcccaggaaacaactgcttggaactacagcatgcactttgcatgaatgagaaatacacttttgttcagtacacagagatgtgtggggttgttaccgcacagtaacgcagcttccactgactggtaaaaagacaacagaagaaacttcactcacaacaatatgaaacaaaatatacaaactacccaggaataaccccaccaacagtataaacatgaaaatggctgtgaagctggaaactgctagtcattgagggaatgagagattgttgacatgggcacttacagtgagaagatctggacttgagaaacatctgagcttgagaacgtaaaaactgggagtgttcacaagatgtttgccttgaagatacgatgatttgaaaccttaatctacacaggagttgatggctttttctggcaggttcgagattaccctgcatcctattatcataaaatgtcttggctagtgtgttttggagagtttttcttgaattatcctgactgcaaatgctgtcatctcctgggaaatgtggactttattctcctgtctacacaaacaattttttgtcatgggaaagcgtatatcccattctctcagatgcctgctatgttctgtaatgccactcatgtaaaagaaacttgaggccgggtgcggcggctcacgcctgcaatcccagcactttgggaggccgaggcgggtggatcacctgaggtcaggagttcgataccagcctgaccaacatggtgaaaccccatctctactaaaaaaaatacaaaaattagccgggcgtgatggcaggtgcctgtaatcccagctactggggaggctgaggcaggagaatcgcttgaacctgggaggcagaggttgcagcgagtggacatcacatcactgcactccagcctgggccacagagcaagactccatctcagaaaaaaaaaaaaaaaaaaaaagagagagagacagactcaaaatcagttaattgttgaaaaagtatcaagaggccttcaatttgtaccttctgttaaggcctggctgtaataaagcctgtgtctccaaacatgtttctccccctgtgtaagaaatatgtagacttggtatggtcagcatgaagacatttactataatgtattttaaaaattaaataaaagaagagacagagcacgctcttgtatgggaacatggaatactgccaagagattaattttcctcaaatgagttaattcaattccatttaaagtcataatagcttccttttggaggggaggaagatttgacaaatgattcttttgtttttgagacagagtctcactcactctgtcgcccaggctggagtacagtgacgtgatctcagctcactgcaacctccacctcctgggttcaagtgatcctcctgcctcagcctccccagtagctgggactacaggcacatgtcaacctcacccagctaatttttatatttttagtagagatggggttttgccatgttggccagaccggtctcaaactcccggcctcaagtgatccgcccaccttggcctcccaaagtgctgggattacaggcgtgagccaccgcaccaggccggatttgaaaaaagttcattcaaaaaagtaaaagaggaaagagttcaactatttttgaaaacagatgagtgacgaggagacagaaaggcagaaaccaacatatgcacacacacagaagaagaaatacttgggaaaaagaggccctgtgcttggagtccagcctcccttcacacactgagacttggcctgtccttatctttctgctgcctaggaggccacatggcagcctacagagacatgatccagactgccctcgtttggcaaattcccaggctcccgaattgcctcctcttctccctgaatatcaccctctccacaacctacccaaattcccatttcctcagggctgtcttagcatctgacccaaacaaaaagcctgctggcattctttaaaaagttgtcagttctttcagttctgccaagatggagcagccctgttacttccagcttctctctcttacaactgaaaaaccttggacatatcacaacaaacaagaccatggaagattactcatatattgaggaaatacataagacagttatgttatagttaagaggggcagaggtgagggcaaagagatctaaatggaagtgaggtttctacacacaaaagtgacaaaatgttgatatcagtgactgtcaaacagccactaagaaaactatataaagcgctatgttcagaatcactctaaataaatcaggatggatcctaaaaatgttaaaataaaagagagtcagaggaataagaaacaaagggaacaaacagaaaacaaaatggcagacataggctgtaacatgacaataattaccttaaatgcaaaatggtctaaacagatcaattaaaagccagagactggcagagtggacgaaaaaacatgacccaatcatatgctgtatataagaaactcagttcaaacacaaaaatataggtagcttgaaaatttaaaaatggagaaagatcaggacgaacactagtcaaaaacaatagaaaaaacagaagtagctatactagtatcagatcaagccaaccttagagcaaagaaaattcctagagacaaaaggaacattacataatgggaaaaagggtcaacctataagaagacaataatcccaaatctgtacacaccaagcaacagagcctcaaaatacacaaagcaaaaactgatggagctgaaaggagaaataaacacatctataattatagttggagagatttcagcaccccactctcagcagtttatggaactgctagacagaaaattagcaagactataaaaggacagaacaacacaaccaactgacaggatctaattgacacgtataaaacactccgcccaacagaagcagaatacgcattctgttcaagtgcccatgggacattcccccagacagactatatcctgatccataaaataaagcttaatacatttaaaataatgaaagttatatacagtgtgttctttgaccataatggaatcaaactagaaatcaataatagaaaggaaacaggaaaatctctaaacgcttagaaatttaaaatacaggccaggcgtggtggctcacgcctgtaatcccagcactttgggaagccgaagtgggctgatcacaaggtcaggagatcgagaccattctggctaacatggtgaaaccccgtctctactaaaaatacaaaaaattagccgggcgtggtggcgggcacctgtagtcccagatactcgggaggctgaggcaggagaatggcgtgaacccaggaggtggagcttacagtgagccaagatagcgccactgcagtctggcctgggtgaaagagcgagactccgtctcaaaaaaaaaaaaaaaaaaaaaaaaaagaaatgtaaaatatacttctaaatcatccatgggtcaaagaggaagcctcaaaagaaattaaaaaacacacagaactgaatgtaatatcaaaatacgtgggacgcagctaatgtagagagggaaattttatagcacgaagtgtttcctttagaaaagagaaaaggtctcaaatcaataatccaagtttctacctcaataaactagaaaatgagcaagataaacccaaagcaaaggaaggaacaaaataataaagaccagaaactgatgaagtttaaaataaaacagcacaaaagttaaacaaaaatctttttctttgaaaaatcaataaagtttataaacctctattatgaccgacaaagatgaagagtgaagacataagtcaccaacactaggaatgaaatagaagataccactgctgagcttgcagccatctagaggatagtatggaactagtataaacaactttatgcttgcttgaattaaacaatttagaagaaataaaccaattcctcaaaaaccacaagctaccaaaattcactaccaagattttcacaaatttgaaacagaccaacgtgaacaagcctgtatggccattaaagaaattgaatttgtaactaaaaatctcatggaaatggccgggcatggtggctcacgcctgtaatcccagcactttgggaggctgaggtgggtggatcacctgcggtcaggagtttgagaccagcctgaccaacatagtgaaaccctgtctctattaaaaatacaaaaaattagctgggtgtggtggtgggcacctgtaatcccagctactcaggaggctgaggtgggagaatcgcttgaacccaggaggcagaggttgcagtgagccaaaatcacaccactgcactccaggcctgggcgatagaacgaaactctgtttcaagaaaaaaaaagtcagtgtaatcaattatcttagcagactaaacaaaaatcaatcatatcagtaaacacaaaaaaatttgacaagatctaacacctgttcatgatgaataaaaagaaaaggaatagaatttcctcaatttgaaaacttacagctaatatacataatggcaaagtggttttcctcttagattgggaacaatgcaaggatgtgtgaactcaccactcttattcaacagagtactggaagttcaggccactgcaataaggcaagaaagagaagtaaaagacatacagaatggaaaggaaaaataaaactgttcctatttgcagatgacattattgtctatgtacaaaatccctaaggagtctaaaaaagccatcctagaactagtaagtgagtttagcaaggccacaagagaaaaacaaacacataaaaattattcacatttgtatatacccaaacaaacatgtgcaaaccaaaatttaagatgcaacgccacttattaatacaatcacttctaaaaagaaaaggaaagacacatgaggtataaatgtaacaaaacatgtataggatcttaaatgctataacaaaatgaaatcacaaaaaaatcaaagaagagccaaataaatggagagatacattatgttatggactgggagacagagtcaacatgtcagttctctccaaattgattaatagttttaacgcaattcctataaaaaccccaataaggttttatttttttataagcataacaagcttattctaaaatttatatggaaaagtacaagtcctagaagagcaaaccaatcttgacaaaaaaggataaagtgggaggaatcgctctgataacaaaccttactagattgctctaggaatcaagactgtgcagtatcatggagggacagacacgaagaccaatggaacagagcacagaacccatcaacagcagcagtctaaggtgcccaactgacttttgataaagatgcaaaataaattaaatggagcggggccaggcgctgtggctcacgcctgtaatcccagtactttgggaggctgaggcaggtggatcgcttgaggtcatgagttcaagaccagcctggccaacatggcgaaaccccatctctactgaaaatacaaaaattagctgggtggagtggtgtgtgtctgtaatcccagctactcaggaggctgaggcaggagaatcgcttgaaccggggaggtggaggttgcagtgagccaagatcgcaccacagcactccagcctgggtgacaagagcgacactccatctcaaagaaaaaaagaattttttttaatggagggaccgacttgtctacaaacatgctggagcaattagacatccataaacaaacaaaaataataaatgaaccttaacccaataaacctcactccttatacaaaaattaactcaaaatggctcatagacaaacagaaagcagaaaactataaaagcataggagaaaatctttaggatctaggaaaagagttcataatctatgaaaggaaaaattgataaaatggattatacccaagtttcatattaaaaactttaaagattatactaaaactggccgggcatggtggctcacacctgtaatcctagcactttgggaggccaaggcgggcgcattgcctgagcttaggaattagagaccagcctggtcaacatgatgaaaccccatctctcctaaaaatacaaaaattagccaagtgtggtggcgtgcgcctgtaatcccagctgctcgggaggctgaggcgagagaatccttgaacccaggagacagaggttgcagtgagttgagatcgtgccactgtactccagcctgggcgacagagtgagactccgcctcaaaaccaaaattatactaaaactcttgctcagcgaaataccctgttaagagaatgaaaagacaagttacagactaggagaaattactcgcaatcacaacctgacaaatagctagattctagaacatataaagaacgctcaaaatttaacagtaaaaaacttagttttggttgccgggcaggaggaaggtgctggctgcagagggaaggagctcccagtggctgtggagaacccagcccagctgagccgagccacggccaccatggcggctaccgaggacgctcacgagaaccacagtacctccactgagaatgcagacaagtccaaccaggaccctcagtatgagccaatagtttctactcctgagcaagaaattaaaatgctagaggaagaggaagagggactttttaatatgtgagtgcaactattctgatttgtttcagggaacaatcttctggaatggaagggtggaggcactggcaacatcaagctcctgaagcacaaggagaaaggggcctcacgaggagggacaagaccctgaagatctgccagcccctaagtcacacccatgttggagctgaagcccaacgcaggcagccactgggcctgggtctgcaacacccacgccgacttcacccatgagtgcccaggccagagctgctggccggctgcttcctgaatgctgagcatgcacggaaattccaaagttcagagaatgcaaaaaagacatcaaagagagacaaaagaaaggaccaggcaaaaacaataatgccgaaaaagtggtggaaaagctagaagctcttttggtaaagaggagaccaaggaagacactgaggaaaagcattaaattcttcctttctttcctttttctttcttttttttttttgagatgtggtttcactcttatagcccaggctggagtgcagtggctccatcatagctcactgtagcctccacctcctgggctcaagtgatcctctcacctcagcctcctgagtagctgggatcacaagtgcacaccaccacgcccagctaattttttgtatttttagtagaaacaggggtcttgctatgttgcctagtctggtcttgaactcctgaactcaagtgatccacctgcctcggcctcccaaagtgctgggattataggcatgagccactacacctagcctcctttttctatttatttgagatggagtctcactctgtcccccaggctggagtgtgatggcgagatcttggctcactgcaacctccgcctcccgagtagctgagattacaggcacctgccaccatgcccaactaatttttgtatttttagtagagacggggtttcaccatgttggccaggctgctcttgaactcctggcttcaggtgatccacctgccttggcctcccaaagtgctgggattacaggcgtgagccaccccgcctggcctcctttttcaattttaccctgcctctccttttcagtttgtttttattgtattttatttttacaagggactgtatatgaataactggattaaaaaaacttaaaaaaagtcaattggaaaaaaaaagtcaactagaaaatggataaaagacatgaatatgcagttcaccaaggaggatatatagatgtcaaataagcccatgagaagatactggaggctgatgcctgtaataccagcactttagaaggctgagacggatggatcgcttgagcccagaagttcaagaccagcctgggcaacacagcaagattccatctctacatagaaatgtaaaaattagctagacgtagtggcgcaagcctgtagtcccagttacttgcgaggctgagaggcaggaggattgctcgagcccaggaggcagaggttgcagtcagctgagatcgtgccactgcaccccagcctgggcaacagagcaggaccttgtctcaaaaataaataaaaatactttttaaaaaagaaaatatgctggcatcgttagtcagtaggaaatacaaatgaaaccacaaaatctttctcatagattgagcctctgatggtctgaatattccccccaaaatttctctgttgaaatccttacctcgtattaggaggcagggcctttgggaggtgatgaggtcatcggggcgtggccctcaggaatgtgatttgtgctcttatttatgtgtttattttttgagatggagtctcactctatcgcccaggctggagtacagtggcacgatcttggctcactgcaacctctgcctcccaggttcaagcaattcttctacctcagcttcccgagtagctgggattacaggtgcacaccaccacgcccagttaattttcgtatttttcgtagagacggggtttcatcatgttggctaggctgttctcaaacttctgacctcaggtgatccacctgcctcggcctcccaaagtgctgagattacaggcatgagccaccacaccgggcctgattcatgctcttataaaagggaccctggagcgatttctcagccccggcctgctccacttccaccacatgaggatgcagtgagaggggactgtctatgagccacaaagtgcgtcctcaccagacattacatctgccttgactgtggacttcccagcctccagaacggtgaggaataaaatgttgtttatgagccactgagtttatgggattttgttagagcaccttgaacagactaagtggtattccttacttaaaaaaatttctttaaaaaaggtgagatgtgagagagaatgagaggaggaggaaaaagacgaagggaggggaaaaaagaaaggggggcagtcaaaggcgagcccccacccacatacagagagaggtgaacatatcctgctttagcggagggaccccacctcgcgatctcagggcccttcggatgcctccacccaacaccagaaaccttcttgtcacattcttacaaccaaagggtgcccagagcctgccctcttgttgccgggggcagctccctgcagaatcccgggccccacccacgcggcgtgccctgcactca

SEQ ID NO: 1372 - DNA, 62579 bp, Homo sapiens
agggctatcaagtgcttctagtccctcccagatgcttcccaaccctggagcagcacctcagtagagcagcggaagaccgcctgtggcctctgggaattgctgataccgagcagagacagtccctgaccagagacgtttaggaatgtgatggtgggtgctgctaaggatgagagagttattcagcccgggtggcacagggaagggccagcttagcaatgggccactgggcattaacgggagtggggggcacatttgtggcaggagtggatttgtgagccagggcctccagtcttcctgcattccctctacagctcagggcacctgccatcctggctgccctcaggtcccttggaaaagctgcccaggaaccttggtaagtgttaggaacgtcatgtgttacttctttcagggtcatttgcatttaaaaagcggcattctggagaaagcactgtttctaaagtggaattttaagctttgaggctcctcggtaggaagctgcctggtcttcaaatcccacctcccatatggatgcagctctgcctacagcttttcctggtgatggagggcaggcccccctctgggtgcaggcggctggaggagcaggggaagcaggagctaaggaattccccatcgcttggctgcctcttggaatctctcacagccccatcccctgtgggagagaggcagcaattagcataactggaacagactctctttgtctacatcccagactgtgggattcaggcctcccccagagacatgctaattatgtggaagggaccctgggtgcctgttggcaccgatgctggctcctaatgctgctactttccgatcagaaaccaggtgtaggtggagccctggcccaggcttgtgcattgatgaatgctctcctcatccaggaaacctgctgcatgggccgctcgagctctttcaaatatctttctcctgcaaatttctacagctccttgtggtcagaacaacttgctagctcttggcattatcttttattgtctcatccgggattggttttgcttcccctctaaattgcagttcctttacaggggaccttgttttatatttaataaatcaatcaaccaaccaatgaatatctattaaagaaactatttgccaggcacagtgccaagcctggagatacaaagattaataaggccccacctggaatgaggcgtgtgcagcccagcgggggtgcagaggttacagctgagtgagctgctgtgtattccagtgaatagagggaggtactgaatgctctggggtttctgagaagagagcactgtaatgtgcccgggaagggcaggcaggtggggaggagctgaggaaggcttcctggaggaggtgacatctgaacattattaaggatgagtaggggtttatcacacagctgtttcagacagggaaaggcatgtacaaaatcacatgagcgggaagggtttgaggctttcttggaacgacaggtagctaaggtcattcagctatggctagacgatggagcatagctgggccatggagaggcagagaggcaaagtggagaccccgaggttgggtgggtcctaaaaggctctgtcttccaagctaaagagtttaggagctgacttgagggcactgggcaaccagtgaggaattttaatgagagggtcatgtggttagaattatgttttagaaagagaatgtgcgttaggctgttcttgagttgctataaagaaatacccgactgggccaggtgcggtggctcatgcctgtaatcctagcactctgggaggccaaggtgggtggatcacctgaagtcaggagttcaagatcacgctggccaacatggtgaaacctcatctctactaaaaatacaaaaaaaagaaaaagaaaaattagctgggcatggtggcaggtgcctgtaatctcagctactgaggaggctgaggcaggagaattgcttgaacctgggaggcggaggttgcagtgagccaagatcgcctcactgcactccagcctgggcaacaagagcgaaactccatctcaaataataataataataataataataataataataataataaaacttcactaaaaaagaaataaccgattaggtaatttataagaaaagagatttaattggctcacagttctgcaggctatataggaaacatggtggcctctgcttctggagaggcctccgggagcttttactcatggctgaaggcaaagtgggagcaggcccttcccatggcggggagcttggggaaaggtgccacactgtacagcaactggatctcaagagaactcactattgctaggtgagcaccaagccaggagagatctgccctcttgacccaaactcctctcaccaggcccatccccagcactggggattacgattcaacatgagatttgggcagggacacatatccaaactatatcagagtggctgcagtgtggagaacagactattggggtgtctggaaatgcggagactaggaaggtatcagaactgctgaggagtgagaccaaggcagggacagtggggagagaaaggaagctgtgaggaagagggggtttggggatgattccagctcaatacctggggttggagccagggtacatggtggtgccatgggaatggagaccgaggagacatagaaagcacagtcatggtggaggaagggaagctctcttcctgacaggttttcccctgggaaagatatccacagagtggcagccacccctctgctttctgtgtctgtggattggcttggtggagctaactcctgggaagttagctcccaggagttagtccagacatatgggtctggactgaaggagagaccttgatgttggaggtggtgaaacctggtgccttagagaagatgttttggagaccgagctgaatttgaatcctggctttgcctcttcctaattatacacattcgaagaagacataacatacgctctgtctgtgtgttgtttgccttgtttgttaaaaaggagtctaagtactatcttgtaagattatgggaagactaaacaagataacgtacatgaagtgtttagcacaatgcctgggacattataggcactcaggaaactgttttaatcaatgggggttggggggggtgggtggtagttgaagctggatgcgaatacaatgaccctggggaaatagagtagcatgaaaaaagaagagaaccaaaaagagaaccaccaaggagttagcagccagggaggcaggcggggtagggagagggaggccaagaaaggaggagagagtaaccaagagacccagatacattagggggcttctaagatgcaggtgagctgtctggatcatcaatgatgaggtgactggtgattatagaacaatttcaatggagtggggaatgagtgtggataatactttcaaaaaaccctgctatgaaggataggagataataaaatgaagaaaaaagggacaggtgtagggaaggcttctgttttaaggcagattttgtacatgtctctgtcctttcactttccacattttactgaaattggctgtaggtggatgtctgccctgcagctacccctcagcacccctgctcactgctccccagcctccccttggcacccctgctcacctcagtctgggctgcacactgttgtcttagccccgcagtcctctgaagagctttagcaaagcacccacatggttagctggggttgctggttgtgtatgcatcttcccccacgagactgtggggagcatagggactaggccttctgtgacttcagccgcctgcacctatcccagggcctggcacaaaatacgtgctcaatagatgtctcttgaaccagcttgtgtgagcaaggtgttggataaaggctcctgctgccagtcactgcctacctggggtgaactgtgagtgtcctggggttggaggtgaaggacatatggtgactctggtgtaaccgagaaaaatggtgcaagagcaaagggatctgaggttgctctgatcattgacctaaggccaatgtcttgtgaatagatgcttaagtgcgagctcaagcacattcccctcaggtacatagacccagaatagcttacttatttgttcccataactggtgttgtgggtggcaagggtgtgctgagtcttgtccttaccgggccatgaagaatcttaaaagggaagcagaagttaccagtgttgatttcacaaataggtgctaaccactcacaaataatatttccctcctcactgatgcctagaattttcctggtctctgtaagtgtgagttgcaggggcggggacacatcttaagtgctgtaataatctcagtctcctcatctggaaaatcaaggtgtcattccagctttcggtggctctgattctgctttcaggtccgttcttgagagtgggttttcatcagaagggcctggaagaatgttaagcaactgagagggaaggagggattctttggagggcaaagggctctgcctccctccctgcccccaggccacttgccatcccattgaggagtgaggatgaccacagcaagtcttaggtgattagaggtttaggtagagccatgtatatgtgctccaatgagaagtggttgtttggactagaccagttcagacctgccctgaaagtagcccataggccaatgaggtgggctgagaactctctggttctaccctgtgctgtaaccaacctttcaaggtaatctagcaccagagcagacccaaaactgcagggagaaaaggcagcctcctgggtgcccttcctggtgcatccttctctctgttctacagcaaagcattgaaggagcttctgcctgcaattggcaccgtgaagagcttaacccacgaaggcctggttttgagtcttggtgggtggagcagagattctgataaaactctgttctctcttttctttagccttgaagtttcaggcaggaaagaagagaagatgatgcatcgctgggctctgcaaagggcctgttttctaaaggcatttgcctctctgtctgtgcctagccttgggctgggcaaagaggggttgcccctaacatacttggtgattggctggataaattgtaagctgaaaaaacaaagtggttttcacgtttcctaaattatttatattgaaatttgccatttcaatctgactctgaaggaagctcagattggttgtttgaacagggagctctgtgctctgggtccttttacttttgcagtgggatgtattcccagaccacctccatcaggccggctggagagcctggggatcccagggcaatgtttttccccacctggctcagatcaggcagggagagcatgttttgtgacttgctcagagcttgttccaggaagtgttcttatatcctgaaatggaagagaccttttctgatacactgttgccaaatgggcttggagagcatgaaagaattacagcatcttcagagtctgtttataacttcagatgcaaaaactacactctgtaaaggggaggccgtgcactttttaggaaaaagctgtgaattaaggagtcaggggctgggtgcggtggctcaagcctgtaatcccagcactttgggaggccaagacaggtggatcacaaggtcaagagttcaagaccagcctggccaagatggtgaaaccccatctctactaaaaatacaaaaattagccaggcgtggtggtgggtgcctataaccccagctactcgggaggctgaggcagagaattgcttgaaactgggaggcagaagttgcagtgagccaagatcgtgccactgcactccagcctgggcaacagagtgagactccatctcaaaaaaaaaaaaaaaaaaaaaaaaaaaagagtcagaagacctgagtggttctgctacttgagatccatgcatgcttcagctaccccggtctcagttttctcatctatgaaatgggaacgataatacttttcctagcttgttttgaggatcaaatgaaataaaaatgtggaagggcctgaggagctggcacatgctgttctgatgtaagagttgactcttttgattacagaccagctggactcttcctacctgatatctgctaaagcagaccacactggcttgcaaggggtgtggggtgtttgtgggtgtagggtgctttctgctcaatttgggggccctccagcttggcagcaccatctgttgccttgtgtctcttgcccattcttccctgagctagagccagttggggcttcaaagctggcaatgtggggctgggtgcagtggttcatgcctgtaattctagtgctttgggaggccaagacaggaagattgcctgagcccaggaattcgaagctgcagtgaactatgactgtgccactgcactccagcccgagtgagagcgggaccttgtctcaaagaaaaaaaaaaaagaaattgctggcaatgtttttctaatttctgctgagtgagcaaaccaagtgttcctgggactgcactcccagtccctccagaaggccattgttggggaatgatcaggaactggcctttatctctgcgacagtttatagccagtcaggcattttattgtttccccagttacgacgtgattggaatgtggccatctcttcggagcactcctggaggttgaattaataaaggggataggccagggagtcctgtgctggacaatggaagctgcagacttgggatcgcacaaactcccagaagttcttttttggaagggaggcagctgagctggaaagggttgaaaatctggagttctcctttcgtatctggctgctgggagtggggtaggttgggttagaaatccctagccatcatcttgttaaaacactcctgtgaagcaggccagtgccagggcagggggtggtggcttcctggggccatctctgagtggtggctgagccaaaatgttggaacgaggatggtagaattcagccaaaatacaatccgtttcacacagagagcaattttgaacaaagatacaaaaatcaaaaccatcaggtttttgctcttaaggaacttacggtaaagaacaatgaacagagccacttggatggctgtgatctgtggtggaatgcgatagctagtactagggaggtaccaacgcgtgtgacaggggtttagggtattgttgggagagtcccagaaatctgttgtgggtgcctgcaccagccgagggcatctgcagagccacaccaagccagttgtgcatttccatggagatccatgtttttgcctccatgagctggtagcctgaaggcatgaattcatcagtctgagctgtgagaagaatgcatcctcctagagctcgagcagtccctctggagagaagctgctatgtcatgggccagatccgatgcttcctggggctggctacatgccttggaaggcagttgcccaagggactgcaagtctgtcacccctgtgatgccttagacattctccttgatttgaaataggccttcgccaaagagaaagacccttccctgctaactgtgccctggattccacaacctgctcatcccaccaaacgttgtctcccatatatctttaacacctcccctctgggctagctttttctatctgcatttaacattttcaaacctcattcatttaaaaaaatgaataaataaacttccttcccgctgccttgccttcacagccctatgttgctacctttctgtttctcataccttctggaaggtgttttctaaacttgccctttccacactaccttacctctcattcctgccttaactcacagctgtctggcttgtccttctcctcaggaccaacactgctctcagtgaggtgccaagatgcctgtgggtagggccaatgttcatccttctagatagattcttgacagaggtcaagacaattctcttgacctcttttttgtacatgtgaaggtttgttgtattggtgaactcttgtcccaggggtttgttgtacagatgattttatcacccaggtatgaagcccagtacccaatcgttattttctctgctcctctccctcctccctctccctcctcccacttcctcccactctccacgctcaagtagaccccagtgtcttttgtttccttcgtgttcatggggtctcatcatttagctcccgcttataagtgagaacatgtggtaatttggttttctgttcctgctttagtttgctaaggatgacatcttccagctccatccatgttcccacaaaagacatgatttcattttttatggctgcatagtataatattccatggtgtacatgtaccacattttctctcttttttttttttttttttgaaaaaaaatttttaccttaccccccaggtttcgccttttctttatccagtctatcattgatgggcatttgggttgacttcatgtctttgccgttgcgaatagtgctgcaatgaacattcgtgtgcatgtatctttataatagtttatattcctctgagtatatgcccagtaatgggattgctgggtcaaatggtagttcagcttttagattttcaaggaattgtcacactgctttccacaatgggtgacctcttgtttctcagaaaaaaaaaatcccattcttacggtctgtgatccacacctgttcgtggtttcctgggtctccaacttcctctcctcagtctcctttaccaggctctgttcttgcatcctaaacactctcttctctctctctttttcctacattcactctcagctgtttctccaacataatatacaaaccaccaccaatccctcattcctaactggacatctttcctgagctcaacccagctgtctccagacacctaaactgagtgggtgagacttagtgtgcccccctctccctttcctgtgcctcaatgagcagctcaagccagaaggagtctgtgactgaagtgtgtgcttgtctctgtgtggtgactgatgagtacaggacgctccttggaacccatgatttcttccccatcctctgagagcaggtttggaaaggagagagagagagagattgagagagagaaatgggggagggaggagagaggcatgagacggagcaggttttctcttttagaaatgaacatgttttattcatgtttgcgactttgtaataatgaacggttgtcaaggcaggatgctggcagattcctctccaagaatgcccttggggctgaacccaaacaggaaaatcatcttgaccttttcctgagattagatctgggtcgggcacctcatcagagagttgatttaacagctgaagtcccctgacaagaagtggtgactgaggggagggctgggcaaggagggagggtttttaaggaagggctgggtgtgtgaatgttgccaccgccgggcggggctctgtagccctcatgagggtggacgccatgctccccatctcctagcacaaagcttcagggaaacagaccctagaggacctggcaggctggggagaaaggaggcgagaggctgtagcagtgacataggctaaactgacctcacccccagccgggagcttggaagctgcagtgccacgtgggccttcaggctgctctggtggctgtgaccacaggctgcggaatggcttcttggcttctctatggctccttgctgttcctggttttgaacagttgggatgactccttggaaggttggcttgtggcctctacctttctatttattttttatgtttgtattcttttttagcccttacatcatttgtaaggcctctcctttactaatgcgttcttgctccttccacctttccccccatgttcttctctgatcccagttaccttttcctagtggaacttggtaatgcatcccctctggctctaacctggatcgcgtctcctaattgatgtctccagttagagacctctgtcccaaggcttggcttttaggaggtttccttcgcatctttttcttctgcacaatgttccttcacacagttataagacctcttcatgccacgcctcaggccaaatgtgtttagaagctccctgcaaacgtgatggacccattctgaacaactcactcagggacctggtgctctcccaggcccttccctattttaaacttgtctgcagccacagcacccctgctctggcccctgaccttcccccaacttcagtgtgtgtgacacacacgtatgcacactcactctcacaaccttcttgcctggaatgcactccttggcatctagtcctgacttctgcattgtcaggttatgctgggactccatcctctctcagaacctcagttcccccggagaaaacagaagcttggaccagatgagctttactgggatccccttcagcactgagattctttaactttgtgactatagccgtccccccttatcctcagggggatccacattccaagactttcggtagatgcctgaaactgtggttagtaccacaccctatatatgatttttttcctatacatgcattccttttttttttttttttttttccagacagagtcttgctccgtcgctcaggctggagtgcagtggcatgatctcacaatctcactgcaacctccacctcccgggttcaagggattcttgtgcctcagcctcccaagtagctggaattacaggtgcctgccaccatgcctggctaactttgtatttttaatggagaaggggtttcaccatattggccaggctgggctcaaactcctgacctcaagtgatcctcccacctttgcctcccaaagtgataagattataggtgttagccaccgtgcccagccctatacatgcattcctatggtaaagtttactttataaattagacacagcaagagattaataacaataaataataaaatagaacaattaatatgccagcatcattactcttgcactttccggccattattaagtaaaaagaagggttacttgaacacaagcactgatacttcatactgacacagtgatatgataagatctgactgctacccagacaatctgagcctgatgctaagtgactaaaacagggggcagcctatgccggacaagagatgattcatgttccaggtgggatgaagcaggatggtgtgagatttcatcacactactcagagggcgagaaatttaaaacttttggattatttctgaaattttccacttaatatttttagaccacggtggacctcaggtactcaatgggaggatcttagaaaccatggaaagcggaatcgtggataacaaggaaagctaacagaggctgggcacggtggctcatgcctgtaatcccagcactttgggaggctgaagtgggcagatcatgaggtcaagagattgagaacaccctggtcaacatggtggaatcctgcctctactaaaaatacaaaaattagctgggcgtggtggcatgcgcctgtagtcccagctacttgggaggctgaggcgggagaatcgcttgaacccgggaggcagaggttgcagtgagccgagatcacgccactgcactccaacctggtgacagtgtgagactccatctcaaaaaaaaaaaaaaaaaaaagctaacggagaatacggacttggcctcagatacatctgtgttcctgacagcagcaacacagaaactgctggacaggccgtgtagggtttgttactctgtcccactgtgagagcaaaaggtctcgatggtgtgggtgtctctgagtacaaagtatgccccagatgaatggaaagaaggcgtgttccaggggtgtacatggaggccatttctgggcattggatgacagcagaagtcagagtctgagcagagctcttcactttagatgatgccagtgaccttgggatctgcaatctcacgccataagcctctgctctcttgtcttagcttcttattctgtaaaaatggggagaatctgtgaggttaactatggtagtgtggtgtgagtgcctgtcatataaagggcactcagtaggtatcagttttctgacctccttctgcccatccttccttccctacacattctcagggaagacagtttccccttgactcagcaccaagtttgagacaagtaatcttctcactttgtgggacagatattttcttgttccacctttccgctcgggtttagccctttagagacccagcataaagtttcctgtctgactacccactttgggatggccccaaccttcgtttccatgttctccagcttcacaacctctctcaccgatttccatcatcgaccagtcctgaccttgtgggtgagagggagtgcttccctctcagggaggcatggcctccctggccaaaatgtaaacttgttcatttcaggaattattttttctcctcttaaaggccctgccacgtgtgactcagacccagggttgttcctgagcgagacctcagtggtaaatcacaaggactgggctccagcccacacagatgctatcctctttcttctgtgactgtgtcttagcttaagtagaaaaaaacagagaaacaaaggcactgtctcattctgcgcagctgttgtgcccaggggtactggtctaagcctcactcttcaaatccctttgcagcagaaggtagaagaatttaggcaaatagaagctccaaagaaaataaggtcatggtttaatgaccccaggcttgtcttgaatgagccagtgggtgacggatttccacattacctctggcaggtgaggttcatgggcaaacacattaaacaggaatgagaatagcattcagatttccatcattaaatatccataatatttgatcttgtgaaaataaacaacaaagtgctagaagagaggtcctatggaatagcgaaagttgattcatctgggccaaaggtgaccagctagtgtggccaagagcgtgacagcaggaattcaggctgcacgatgcttctctgggagtgaatctagtttgcccagtctgtgttctgggcccagagtgtgtccttagagggcggcccgtggcctgaacaagagcattgcggatttgcctgcaacctcacctaaatccagcaattctgaactcggaatagggaaacacggcatccgattcccaggggagcttgtgaaacacacacacacacacacacacacacacacacacacacacacacacatttccctacccatgtggttgtgtcttggtaggactgtagtgtggcctgagaatctgcatgtttactgaactcaccaggtgattctgccacatagccaggtacaggaaccacagctctaacccagcatgaagtgatcggcggtggatacatcaacttccaaattggcccccattctgttccctctctgtgcttctccactgcttctcagctgccacgctacgctctgtgtgtgtgcccgtacgtgtgtgcatgctcaagagtgtacagttctcagatccaccctccctacaatgaatgaaactctcccacagcccttccctgccagttttgagaatcactgctttcctcatttccacgtctcaggctgcataggagaggaagttcatctgtgtgtgcaccgggctttgggatgctgttcctttgttggagggagcagagcccttccatggccttgggggacatttggaaatgaaaggaaaaggtgcaccccagaggtggggctgtctctggcctggacacgtgctctgtggaccaacagttttgccattgataggtggtcttacagggggttgtataaaattcctccggaaatgctgggcatggtggctcacgcctgtaatcccagcactttgggaggctgaggcagttggatcacaaggtcaggagatcgagatcagcttgaccaatatggtgaaatcgtatctctactaaaaatacaaaaattagccaggcatggtatcgcattcctgtaatcccagctacttggaaggctgaagcaggagaatcgtttgaacctgggaggcggaggttgcagtgagccaagattatgccattgcactcctgcctgggtgacagagcaagactctgtccccccccccaaaaaaaaatcctctggaaagaaaggtgccgcgttagctgtgaggtgtgcccacagtgccagcccacaggggctgctttctgcttcgggtccttgccccttcctgggaatgcatgggtaataaaaggagcagaactggcactcagctcagtcactgatgacagatgacgctgcttacacagtgggaagggctctgagccagggtggaagggcccacaccgtgccttgggggatttactgttgaggaaaaactcgggggccttttgtccctaggggtgccccagaaagcctcctcaaccctgtttctccaggcccacaggcacgccttgcccactccacatgcttgcctctaggccagtccctgcccactcctcttcccttgatgttctgtgctccaagtcccctctcctttgcctcagaagacaagcatgggcctcttgtcacctgaagggcttcctgcccttgccacagggaggacagaggtgtgtaatggcacaaagggggcattgcagagcatgcgccttgcctgggttgcccccagcgtggcccctggctcctgacttccttccgagattgaagaaggaagtcatgtgcacagaggtcagtaacagccctaccagccccggctccctgtgtcaaaaatgcaacagctcacacctcacttgtctttccacatcttctttcctgcctgtctattcttctatcctgctgacttttatttttattttttataaagtccaattaatcaattttaaaaaatagattgtacttttggtgttgtaactctttctcgtgcactcactctctcactttctcgctcgctctctctttgagacaaggtcttgctctgttgccaggttgaagtgcaatggcatggtcatggctcactgcaacctcgacttcctaggctcaagtgatcttcccacctcagcctcccgagtagctagaacgacaggtgtgtgccaccatacctgactaattttgatttttgtggagatggagtttcactatgttgcccaggctggtctttaactcatggcctcaagtgattcttccacctcagccctccaaagtgctgggattatgcatgagccactgcacccatcctcggttggctttttgagcctctttctctttgtttccccttttggatcaatagtgaacacgtgggggctaccctgcattctgatgtggccaatccctggtcctggccccctagattaatgccctgagtcaatcagccatcctccagaccatcctcaatcttatccctggtcctggccctatcctttgaatcttgctgacctgagtggaggaagtagacagggaaggaatctagctggggaggaggaaggagagggcttcttccttgcctccactcaacagctctctttgctatgtccttcgagtgctctctgattaagacggcctggctcaggcccctcttataccctgttgctctcagcatttacatatcatggccatgactttgcaggttgacaggaaaccaaagcttcatgtgagcacattctatcatcccagttagatcaaagagggcaggagatgcaccctgcactcactagtgccctgcacactggcagaagtccagctgcttggctaactggttactcctggtgagacatttcctggcttcctgggaggcactgaaggcagtttccaccagaggcttggtctccaggaaagccaacgcaaagaagagctagctctcttggtgggaagaattcctgggcttataaaggaagcatttcaatgaccaaagcactctgtttactcattcatttattctttcattcattaattcctagtaggcctactcagtgccaatctaggtaatacacagtccctgggagcttaccatcttgttgggaagatgagacttgaaacaatgggacaaggcaaataagattaaatgccccagatacttgatttgaatcatggattgaggaggtaagagaagaatggtggggctataggagagggtaggtgctctctaggaagcaagcggtttcccagccctggaagaaagggtaggatttagacatgtagatgagaacatggaagaccttccagacacaagaaatgagcaaaacctcggtgttttgcagtgagagcagagggcattctggggcagtggagggagcttgaagaaatcagtgtgggttctgtgctgctgccctggatgcagcaggccggtgggccatgctggccattccaagccttgtctgggaattgctctggtaaccaagaatgcactgagagtgacggacgtgctgaggctgcactcccctcttcccatgccctatgagcaggcccaggcggggccgaggccccatccaaaccactcttgtcttggttccggcccagaagtagcaagagaagctggaaaggcaaagcttcttgatttccactgctttctgagctggccaggtggaaggcagccagggaggagcagctggcgacagcccgcctgactgcctcggatggcaggcagctactcaagggaacaattgggcagaagcagggggcaggggggtcagggaacatggaccagtggaattctgaacaaggtcaaagtccaatttggtacagtgcttgattaccaatttaaatctcatctttccttccagagtggctgccccctgcaggagaggccagggctgccacaggggaaatttgcattttaggattccaagtgcagggtgccctggcagggctgtactcagccggcggtccaacgggtgctcgcccttgcacctggcagtcgcatgttgaatatgctcctattttccctacttctggctgcctgtatgcttgggaaacaaacacaaaacgaaaaactcttcttacctcttgcagtcaggggaggatcccaaagcatgcagggtgggaggtggtggggtctagacagtgggtagtgatcgtaggtttttcacacctgaggctggaagaaagtgctaagggattggcagtcaaatgggcagcagggcacttaagggggtgatgtggaatggagcccatagaaagaggcaggaatctggggtgcagtggtggctcaagggtgggttctacagaaatggttgatcgattgattccaggcatgtaattcggtttgaaaacaagctcctctttgagactcttcccttggggcagttggttctcagtctttgacttcacctgggatgcttttgaaaatattaatgcctaattgttaatggcctggaaattctttcctactttattttattcatccattcattctcatcaagaaagcaaacctatgctttttaaaatttttaatttttgctcctaaaaaagcaaacccaaacctgcaaattctgatttagcaaatccacaacttctgtctcttcccatcaacaccagtacctctaccaccattaccaccatcccaaggtaaggtgtggaaagctcctctgccctggcatgtcctacagaactccctggggtgggtctttttgttacccctttaccattaaatcaacacacatttattgggtacctaagtgttggtgagaatggctgcacagcctaaagtctaggctgcttttggtgtttggtttctttcagctgtataggactttctgtgagaagagggagtatgtggtgcaatttgttcatgacatcagagttcatggggacaatgacctgcttgcagagagtttgcttgctggcatatccaaaggcaatgcctgttgcaatcttttagctgctgtggggctgggcatcaggactggattacccaacaccctgtgaccaggagccttgtgggtacacacacacacacacacacacacacccccacacccttccttacctgaggcacctgaagatacattttgtgcatcctgcagttaagttgatggtcaaccaggcctagctggcccagactccatctgagtaatcctgggactcatggagtgcacttagatttattgtgggccccaggggttcatcactctccccttttcaggtgacaatggggacagaagctgccgtgatggggaccctctgttatcttttcttgtctgactggaaggagaaaggaatgcctgaaatcagcctattgcagaggacagtgggctccctcaggactcagagtcctcaggctctcactggtgtccatggctggcaggatgtctgggaggctactcagagatggccactagataaccaggctacatatgatatttgctgggacacgttccccacgtggaaactccagccccacccagtcccatttgccactcaccttggaagtgttaggagcttttgtgggggcacatttaggccccactgcagatcagaaatcctcagtagctccaggggcccacagcgtaaagcccagaggccttcgggtgccatccaggacattttgtcatctcctcccaactgtcctctccagccccttctgcctttcctctcccttggatcttctgctcagactggccccctctctgcccacctcacccctgactcacctaggatgttccccaggcctttgaccccatgtgccgttagtaccgaaggtgggggagcactcgctttctccctggatgcccaccaaatcccgccacacattctaggaccagttctaggaaacctgcctccactgggagtgatttctgggcgtttctccagggtggtgccttgtattaatcacctctgcatctgcagtggttggtatggtgtgaagaagactctcaagaagccctggctggatcaacactcgcacacgaatgatctctgtccttcctgcagcactctgccttaggtgtgcttgtttgcatgtgcgtgtatcatcttaaccacctcatgagctcacggaaggcacagccatgcatttcactcctctacgacctcacaggcagccggacctcttgtgcatgcaagtgttctgtgatagatgtgttctgatgataaggaagacagacattgaaagtagctttctttctgctccctgatttggaccctgggctccagccaagcctgtttcttcactgtccctgtcacatgctccctgctcccctgggcgatcacatttgctcattctgtactctagtccctacttttgtccccagtcctggttattgtccccaaggtcagactgaaccccacctcatccataatccccacctccagatctcttgggaccggaagactgcaaagatgctcagttcaccaactggagtacccaagcaataccatagttcttccttttctgtaaaatggctcaatgctgacttcacatccccatcatactgggctgtccagaaattcaacccaggtctttctttggtcaccctctggtcccccactgggttggctaaaggctcccagcccctcttgccatgggtccttactggtcacagtggaggatgcccctgcctggcaggtgtggcctctgtggatctactgtgctgtgtcttgctggtcacctttgagttacgggcttctgtggtgagcccagtgcccaaggtccagcctccctgctgtgccataaaagccattccttctgagagcctctcagtgtgaggtgctttcggggagcaggttgtaagtttctattgatttggggacccacaggccactccctaattactgattttagtctaggaacatcccactcctcaagtcccgttctcctcaactttggaaagttcagacaccccgctgcaaaattctcccaggcaaggaaattgaagccaccacctgtgagagctggggaaggcaagggcaaagacaaaagaggggcatgggcactagttcaaaaattcctgtgcctggcccctctcttctgagctccatttgtattaataaacactctttgagtgctctttactttttaaatgcaatactcttgtcccgcgaatgaaagtgtaaatcctgtgagatccattccctggtggatgagacctattttctcatatttcctccttagcaactcgtgcagagctaagtgcacggtaagggagtgtcagggcttgttggctgactcttgtgtccagagctcatcagagaatgactccggctctgctccagcttctttgaaagcgaggcttttgcctcggcagccctcactgcttcctgtcctcaagaagacatcagctctactcatagctgcctctcctccccaaactcttcctgcctgtggtcctctcccaccagccccacgatgttcgccttgtcctggagtgggggaagacagcccacagcaaagagacacgcttccttctacatcctggctgggatgcagaactgagtgatgccagtcccagccccttgtgcggtaggaaggctgcaggtccttgggagaagttttgaaatccctttctcttcctctcctggtgggactgagatattgataaaaagtctcagcaataaggggagagaacacagcgaaggagaggtctgtagtcacagctaatctcaggctagttctaggcattcttccttccttcatcctttgagcctgacctccctccattccctcccgcctttctttcaaactcaccttgactctctattcccagctccccaactcaagtcatcaatgttaacagactagtgcccatcccactacacctttcttcatacatgtgcacacaatcatacaaactcatctataggttaactcatggtggtgtatttttttttaaataacatcattctatatagactttctgtatcttgctattcttgcataacaatgtcatattaaaatccctccaggttaactggcataaatagtatgcctttttaaatggctaaatactattccttgaaatggctacaccaccatttattaaacaggtttctattgataggccatcagactggtttctgttttatgcaatataaacaatgcttctgtgttgattttttttttttttttttttttttttgagatggagtttcgctcttgttgcccaggctggagtgtaatggagcaatctcggctcactgcaatatctgcctcctgggttcaagcaattctcctgcctcagcctcccgagtagctgggattatggcgcccaccaccacacccagctaatttttgtatttttagtagagaaggggtttcaccatgttggccaggctggtctcaaactcctgacctcaagtgatccaccagcctcggcctcccaaagtgctgggattacaggcgtgagccaccatgcccaggcaattggtgctttttaatgctatggaatagattcccatacatgatttctgattaaagggaatgcatgaaggtacgatttaggtacagtaaaattaacccatgttcatgtagatttctgcaagtttgcacagacacatacagatcataaccaacaccataatcaagatacagaacaggtccataacctcagaaagttacttttttttttttttgtagtcaatttcttctccatctcccacccttgaaaccactgatctgtttctatagttttgccttttctagattgtcatagaaatggaatcacagagtagacttttgagtctggcttctttcacttagcatgataagatccatccacaacaagactcattcattcataacaaaattcatccatatcattcatttataaaacgattcacattgttgcaaatatcagtgatttgtttccttttattctgactagtattttactctatggatgtactaatggattatttatccattcctcagttgagagacacttgtgttgtttccattttttgacacttaaaataaaactgctataaacattcatgtaaagtttatttatgtggatgtatggtttcatttctcttggttaaatttctagaaataggattgcggggttgtatgctaagtatatatttaattttacaaggaactgccacctgttttctatggctgtaccactttgaattcccaccagcagtacatgttgttctgtgtccttgatagcacgtggtgttgttattttgattttagccatcctagtgtttactggtatctcattgtggatttaatttgaatttccctaatgacaagtgtcatcaaacatcttttcctgtgcttaattgccatctatgtttcttctctttctcaaagattcttttcaaaccttttaccttttttctttattcaactgcttgttttcttatttgagaattctttatgtaacctggatacaagttatttatgtgtttgcaaatattattttccagtgtgtagcctgttttttttttcatcctcttaagtgtgcttttaaaaagtttttagtaaagtctaacaacaatttttgtcttctctggatcatagttttgatacagcacctgagaaatatttgcctaacacaaagtcatggagattttcttgtatgttttcctctgtgttttataattttaggtttatagtttttgattttatactttggcatatgattcatttttaaagtgaatttttgaataaggtaggctgcatgggttgaggttaattcatttgcatatggacatccaattgtttgacaacattggctaaaaggatcatcttttctcattgagatgacttcatacctttgtaaaaaatcaactgaccatatttgtttgggtctatttctggactttctaattttttccattaatatatatgtctatgctttctctaataccagatattttttagtgtattttttttttttttttttgagacggagtctcgctctgtcgcccaggctgcagtgtagtggcgcgatcttgagttactgtaagctccgcctcctgggttcacatcattttcctgcctcagcctcctgagtagctgggactacaggcgcccgccaccacgcccagctaattttttgtatttttagtggagacagggtttcaccatgttagccaggatggtctcaatctcctgaccttgtgatccacccgcctcggcctcccaaagtgctgggattacagatgtgagacaccgtgcctggccttagtgtacttatttttaattttaataaatatatttttataaagtattgttcaattgctttccaaataggctgaccgattcttcttttcaatagaatatatgaaagtgtcctattcctacatatttttgagcaaagggtatcatcacacattattttttgccagtatcctgggttagaagtatctcagcattacttcaattctgaatattttcttttaattagtcctctatattacactggggtagagagaggcagaaggaaagagcagaggtgaagttaagcttacaacataagcctactgtgacccacagtttgtgctaggtctttttttctatgttagattttatttttaatttgaacacttttttgatttaatttttttgtgttaaaatatatataacataaaatttacccttttaaccatttttaagtgtacaattcagtggcattaaataccacactcacattgttgtgcaactgtcaccactatccatttctagaacttctttttcatgatcccaaacagaaactctagaactttttcatgatcccaaacagaaactctaggactttttcatgatcccaaacagaaactctcgaactttttcacgatcccaacagaaactctagaactttttatgatcccaaacagaaactctggaactttttcattatcctaaacagaagttattaaacaatagctcccatttccttctcactccagtccctggtaacctgtactctactttctgtagacagtgtaggtgtaacaatagggttttttttttctctacacattcagagaaatttctctagtaacgaacctagaaataatcctgaaattatagtattgacaacaggattttggcaggttgagaaatgtgctctcaacaatcagccacaaaatatggagtgctgggaatgtctgtttttgcttagaacctctccaagtctagctttcctcacctgaaaggtcctgcctaaatcacatttatagtgagaacacaaccatacagacatagagagctatatgcacattatgaacctttgttttataccaaaaaatttgtgactagattgacgctatataaataaaattttattttgttttatttaaaaattctttttgagacagtgtctccctctgttgcccaggctggagtgcagtggcgcgagctcactgcaacctccacttcctgggctcaagcgattctcccacctcagtctcccaagtagctgggacttcagaagtgagccaccacagcttgcctttttttttttttttttttttttttgagatggagtttcactcttgttgcccaggctggagtgcaatggtgtgatctcggctcactgcaacctctgcctgccaggttcaagcgattctcctgcctcagcctcctgagtagctgggattatggcacctgccaccatgcctggctaattttttgtatttttagttgagacagggtttcaccatgttggccaggctggtctcaaactcctgacctcaagtgatccacctgccttggcctccaaagtgctgggattacaggcatgagccactgcgcctggcctccgctaatttttttgtattttttgtagagacgggattttgccatgttgctcaggctgtaaaattctgttttagatgggctaagggagttatctctttggagaagtcctgtaattaattcttttgttaaatggaggattgctcaccattgtgtctgctttgaatattcaactattaatacattttgatatggtttggatgtttttggatgtgtgttccctccaaacctcatgttgaaatgtgattcccaatgttggaggtggggcctggtgggaggtactggatcatggggacggatccctcatgagtggcttagcaccatccccgtggtgatgagtgagttctcatcagttagttcatgccagatctggttgttggaaagagtctaggacccctcctctctcttgctcctgctctcaccatgtgatgtgctgatcccactttaccttctgccatgagtgtaagctccctgaggccccaccaaaagtcaggaagatgctggcaccatgcttcctgtacagccgtcagaaccttacatcaattaaacctcttctctttataaattacccagcctcaggtatttctttatagcaatacaagaatggcctaacacatttgtttttttctaaggaccaactaaacagaacactcactggctgactttcatgaaagcagatgggggattgagaccagagtctaacaggatcagacagtgattggcccatggcagactctgggccatattaggggtgccaccatgtacccccatgctcagacagtgcttggcccatggcagatctcctgcagaggcatttgtgaaggactggatgctggcttacctgtcaggcattattccttgtgggtattacttcaagtaattcttacaagagtgttgtaagttttatattgttattatttattttctacagaagaattggaaagcagtgctcagggcctctaggagttgacctgaggctgttaagtgagatctatttacaggacttgtggctaataggagtttagaaacttcttttgggctctacacagcctgactgtcaaaggtgtatttttcactgtccaaagtctgaaagtcaggctctgttgaaggacatgcttgtgacatcaagtgggaaacaatggtggtcattcttgggggcagagtggtgttgagaaaggagctccgaattggaagtccaaaatctgagaaacaagtgtgggacagcccttagcatctgttccacactctgctcctgatggctgtcgggagccttatctcagtccaggcttccctaccagagggatttgtgacctgggcaagtccttttatcttttaggcaattgtccagcacttcctccctgcctctagaccaatggaaactgaatttctaggaggagtccacgtctatgtttttaaaagtccccaggagattctagtgctcacagggttgagaaccaatggaaaggggaggaatctggaggcctcgagtgctgagatgggaagggaacccccaaggaaatctcagggaagacaggggaaggcttcaggggatacaggctgactgcacccagttgtaattatgccctgggtagggactgggttggggatggggataccacactttgtagcaggaaagaacattcccagagacttgtcatggacctctgcgacctggcacgcctcccaagcctaccttctttgccctgctccccagctgcacccagttctcagctgggccccccagtgggaggcctgggcaggcctcaccatctgctagaagcctccctgcgtgtaggccctgctggtcttcctggaggctgacctcccctgcaggcgttgggaccatttagtgtgacaccttatccttggtattacccacattctaattgtcctatccacctgtatctgtctcttgtgtgttttttttgtccttgagatctgggacagagtcctgcagtgcaaacagcatgggccttggaggcccccacacctgcacgtgcattgtcacttattagcagtgtcactttcagcaaatgattaaccaaagcctcctgccctcatccttaaaatgggaacaatgctgtcttcctttgaggttgttgtgaagataacacgaagcaatgtacataatgtccttggcacacagtaggtgatcgatacatacatgttgattaaccaagcatttggataatcattgccgtaattataaccaacattggggaacattttgcctgtcttttcacagaataaacctgtgagtttttattagtcttgttttgtacacatgggaaacggggttcagataaattagaaggactcaaggcacactacgcaggagatgcaggactgggggtgcacccagttcttatcccctcagatcctctgccttctctaccctattgctccctgggtggacatgataggtgtagggtcagctgtcgctgctttggctctgtgagagcaccacctgtggttcccagctccccacctggtccttccagcagaactcaagcttgggaagcttggccagtgcgcacagctgcagggggcatggggaagggccctgtcatgtttgccgcagcctctggtcatgttctgatgttttctgctgtgttatggatgcacgccactcctgttcacgtcgctgagcagggatggggcactgtaagccctttccttctcggtgctatccaagcctcacatctgagctgccagcgtggtttgaatcatcacgtttttagtgacggtgctgttctcttaaaggcaagggtggagatgaggagggtgagggaggctggaagagggaggaggaggagaatgatggtgttggggcctttctggaaaggaactgaggaaacaggaacctcctgttcttctgctccggctggcccaaggccaccgtgatgagaggctgatgagatccaactctgagtcagcagaacccagaaaggtccctgtgggtcccctgctgactcaccatgccccttcctcacaggctctgaccagcagtgcatggagtggccaagctgcagtgtccaggccgggtcctgacttcctgggccatggggaggaagctgaggaattgaaggacactcaggattcactgaaggggcttcccagattttggtcatagccgcagcaatgatctcatgggattttttcctctttacattttatccagaacagaaaagattgctccacccttacaatcctgcctccattgccaacctttttcctccccctgccctggctgtgccacctggtacagcagcgtctgttgcaaagagggtgccctcacattggggtaggtggctctcagcagctcagctcacaaagatctcaggcctcacccagggaagcagagggaagctccccagtgctcccagacccctttctatgccactagcccctttgttctcaagacaggctgtagcccaaagagctgcccctggaagcatgctggcgggaagctgtgcatcatgggagctgagaaaggggaaaacagcctggcctgggcttgaaggaggggtgagaggagccagcaggtgaatggagctaaggatcatgaaatatccccgagggcaccccagcaccaggcttgtcttcctcttcctccaggaggggcaagttataggggggtccattgagagacagacagttctcttcctctcctatcctctgcttggtcagtggggccggcattcctggggaggtgggtgtggctggggctcctccgggtctcctcgtgctgcggcagcagagtgtgatttgagggcagggccagagtgaagctggttttgcctggacctccactcagtgggaactgaaggcccccagcttcagggggcttctttgaataggaaaggggaatgccaaggggcagaagaagaggaaagaaaagagggcagtttgatctggtgatgtgatttgtatcttggggacagctgtacagaaatacacaggaaatgggaccctgcctcgaacctttctgtgttcagaaaggtcagtagtgacctacatgtaggcaggtgaccaggtagctgcccacaccagcagctatgtttgaagtgagaggaaagctagttattagttggagtaaataaatgttaaattttttgattggagggaaaaatggaggagtgtgtgtgttttggggtggtcttggggaagaacctcagtgggctcagccagtgtcaaagaggacaagtgtcactacatatgttgtggggcgggagtattaagctcatagaatgtggcaggagagggcaccttcctatgcccaggtctagcagccagtttaacagagaaggcaaatgaaggaccagccagcccaggggtgcctggcgttctgtagatggagagaggaagcagaagtctctatccagaagcctgtattctacaatgatctctataatgcttcatggttcttgaaacacattctccttcattttattatgtcatctgctgtagactgtagcttcttctacagtaagagcaggggctgctcttacgcacatgggaggtgcttacatgcccagcattaagcattggcccagaactgcataaatgatcagctcctggtttgatgaactttggtgtgtgaagccagggaacctggagttttgaaatgagtctttaaagccttagaatcagaacatattattttaaaagggaattatttattttttaattgacaaaaatcgtatatatttgtggtgcataacatgatgttttgcaatatgcatacattggccaggcgcggtggctcacgcctgtaatcctaggactttgggaggccgaggcgggcggatcacttgaggtcaggagttcgagaccagcctggctaacatggtgaaacctcgtctccactaaacatacagaaattagctgggcatagtggcatgcacctgtaatctcagctactcggaaggctgaggcaggagaatcacttgaacctgggaggcggaggttgcagtgagccaaggtcgtgccactgcactccagcctgggcaacagagagagactccatctcaaaaaaaaaaaaaacatatactgtggaatgattaaatcaagctaattagcatatatattacttcacatgtttatttgtggtgagaacacttaaattcttctctctcagcaatcttcaagtatgtaatatattgttattaactgtagtcaccatgtggtacaatagtgtaccacatggtacacttgaactcctgtgtaatggaaattttatgccctttgtctaacagtaccttcctcaaacctcctaccatagtctctggtaaccatcattctacttcctgcttctatgagtttaacttttttagattccacatataagagaggtcatgcggtatttgtctctctgtgcctggcttattttacttaatgtaatatcctccaggatcatccatgttgtcacatatgacaggatttccttctttcttaaagctggatggtactccattgtgtatatataacaacatcttttttttataaattcattcatccattgatgtacacttaggttgattccatatcttgaccattgtgaatggtgctgcaataaacatgggcatgcagatctctctgacgtatcaatcagctcctggtttggtgaactctagtgtgcaaagccagggaacatggagttttgaaacgagtctttaaagcgttagaaccagaccatatcctttttttaagaaaattattttttaaattggcaaataaaaatggtcaaataaattgacactaaaatgtcctttgcctatatgcctagtcgtgggattgctggatcatatggtagtcctatctttaactttttgaagtacctgttttccataatggacgtactcatttccattcccaccaacagtgtgcacatgttcccttttccccgcatcctctccaacatgtcctatcttcatctttttgatcatagccatcctaaccggtgtgaggtgatagctaattgtgattttaacttgcatttccctgatgattagtggaccacattgttaattataaattttatttgcactgagctttgaatgaaagcaccttcctctctatcatgttttctcaattgtcctcttatcatctcattccattcattttcccaaagctgtcttagctgctctatatttttttgaagattttaaatttaatttttattatagtaaaatatgcataatgtaaaacttaccaaatgaacaatgttttttttttttttttgagacggagtctcgctctgttgcccaggctggagtgcagtggctcgatctcggctcactgcaagccccgcctcctgggttcatgccattctcctgcctcagcgtcccgagtagctgggactacaggcgcatgccaccaagcccagctaactttttgtatttttttttttttagtagagatggggtttcactgtgtttgccaggatggtcttgatctcccgacctcgtgatccacctcggcctcccaaagtgctgggattacaggcgtgaccacgcccagccccatatgaacaatttaagtgtacagttaggaagcattaagtgcaatcacattgctgtgcaaccatcaccaccatccatctgcagaactttttcatcttcccaaactgaaactctgcctccatgaaacaacagctccccattttccctcccccagctctggcaatgaccattctgctttctctccttatgaatttgattattctaggtatctcatataagtggagtcatatagtatttgtcctttggagtcttgcctgtcttatggttggttttaatttcattgagacagtcttggtctcatccaacaaattagtctattaagcacctcctgaaataaccacagctaatgttcactgggcacctaccttgtgctggcctgggcgccatgtaagcactgcacaggtattatcctctactccttatgggcactttgggcagcgagtgtttgaggaatgtgaggcacaactaggataacagggctgcagggggaacccaggccgtctgactcccgagtccagcatttcccactctctggccaagtcctgggttctgggatgtctgcttcatggccccctcaccaagccatggggcccccagttaatcacatccctgagtgacctcattttcttctgcacaactgctctgcctttcgcatatccagggagacagaacacccagtctcttccgccacttgcccaaatcaggaaaaagagagatccctgacccctgcttcaactagcatctagttcctaggatgttatctcaactacctgcaaattggtcccactaagactcatttctttcctttggtctgaattattatggtggcatccgaactgactttgttgccctgggctgacccccttccagtctaccctgatgaagaagctgggagcagccaggcctggagtctcagagggggccctgcatgcatgggcttcaggccaatgtggtctctcatctgggaagtggcagggccttggctgcaatagaagagtcttcagccaggcgcagtggctcatgcctgtaatcccagcacctgggaggccgaggtgggcagatcatgaggtcaagagatggagaccatctggccaacatggtgaaaccccatctctactaaaaatacaaaaattagctgggcatggtggcgcgcgcctgtagtcccagctacttgggaggctgaggcaggagaactgcttgaacccaggaggtggaggttgcagtgagccgagattgcaccactgcattccagcctggcaacagagtgagactccatctcaaaaaaaaaaaaaaaaaaaaaaaaagaagagtcttcacccagcagtccaaaaagcaactctgatcactttctttctttcctactatggtcctgtggctcctcagaacaaaagagcccaatccttagtgctgcctgcctttccaacatcatgtggtgctccccacctcatgcctgcctgctagtaaacctcagctctctgcagttccgaaaggccactcttacttcttacaggtcggtcacccctgctggtctgtaagccccattgagcagacctatggcttaccttggtagccctggcctataactcacctgagctctgccagtgtttgttgagtgaacgagtatggaaaaagccctttggatgaggacctgagcaaggaagaaaaatttgcctccatgatgctagcatgaagcatctttacccaatgtgacaccatttctcatctgaaatacattgtatctggcctgaaatgctaatgatgtcaaaattaaacatacctatgagaatagaaatttttttctatatatttatggaagacaatgcctaaaaaattttaaacctttattctatgagataaaggatggagttgactttaaggtagaataggatcctcatttattaatttactaattattttccttgcgatagacttgcctaacaaattaggtctgtagcaaacttttcccccaccacctttcccccaccatgtgatgcctatcttctatcttcttgttccatgccacgggaagtaggtcacaaggaggggaattaggtcagaaacagcgggcgtgaggaggcggaggatggagaagggcatgctttccacaggaatcttcgagatccaggccactcctctctctccactgagggggcgtgagacagattctgagccaggctatggcagaatccaatctgagcaatgtccctttgtccctggggagagctgcaataggaagagcgggggaggatcccgaaggtttgggtgttctccatgtgtgtcccagggcactttcattttggatgaagcatcagcctgcgtggggctggggaggagcggcagccaggactcgcttccttagggaggaatatgcttgctctaggatgacaggcctccttggcaatggcaggcagagtcagttccatgggacttttgaagaacataaacaatcccctttttatgtaaacactcaagcaaaccaaagctggctgttaattgtctccctggcctggacccaaggcagaaatttggagttgcccccttcttggattaatctggaatgactccccttatatcccctcttaccctaaccccccatactctgggatctagagacgagacactactgacacttggagttgcatagttctttgttgtggggagttgttctgtgtgttgcaggatatttggcagcatccatggcctctacccaccagatgccaatagcaacaccctgctggaggccgcacacatgtttcttatgattaggcataattgaagcctgtcaggaacaatatgaacctgtgatcagttaagcagctgatcaatcattacctcctcctccttgctcttgttacccaataaatacaaagggccgtagaagctcaggaactgcctttgctcactagaagcagggagctctcttcttccccatgttgcctttccttaaaatagttattttgtttttttgttatcatttctatgtttgtcccttcattcagtcttgtaatgaaggttgcaagcagtaacagtagtgactgctgtaatgacggtctcaagtagtagtagtggcagtcagccacagcaccctgcaaactgaattgtgacaaccaaaaatgtttttagacattgccaaatgtcccctggggagtaaaattgtctccagttgagaacaactgctctaccatatacatgctaaaagcctttaataccacgtgtcaaagtttcaaagtttaaaccagtcacctgattttgactgaggatcaaattctgaacaaggaaatggcaatgggctctacagacggtgcaggtgcattgagtggcgcatgaggccagttctgctggaagctggttctgtgaccttgggccattatccttcttgaaccttacacttgctaactaaaactacagcaaaatagcagccttctctgtggtgtgtaggtgtcctctgatgataagggtgataaaacatcagtcagagctgggagttctttggaggaaatttgtgctgtggtgaggccagtttatgtttttactattcttttactcgaagcttcattaaatcaagttgttggcctagcaacttatggagacttcacagtcaagatctcctcagcaaaacctgatttcaaatattctgtcctattgtccccatatacctttgaaatatcccgggtatcctgaaatggcatttttcagcttgtctctcacctccaggggtcatgcaaacagcctttagtggcacctgcatattgcttttggcatatttactggtgaggcacagtcatcagtgggtctggctataaccctgctggcgccctgggggccggggccatgtgcaggaatctgacatgggcaagaggcacatccaaagacccagagcagcccatgctcattgtagacattcctcacaatgtagacatttttgcttaaatgagccatgagtaaagggaaaaagcactttactgtgggtaatttcttcataaattacccagcttcaggtgttcatttatagcaacacaaatggactaagatagtttttgatcacgttcatgatcggtgaacagctttcagacagttttttgtgggcatgaggaaagcaacagaggcagatggtgtcctccatgactcacaatctgagtatgtgaatgattaatgatttggggccaggctccaggggtccaaatccctatgaactgcgtgatctttctaaagttacctaaacactctgtttccttcctcatttgtaaagtgaacataaacgcagtatgtggtcataacacaggcgatgttcttagatcaatgcctcgtccataataaattctcaatccatgttagctattaattgtgttacaattcaatctgttcaacactatagtaaagctgtaagcaaaatgctaggaagtctctaagtgatgaatgtttcccaaagcaatccaggaagacttggccattgcaagcctatggccctgacaagggaaaagactcaggaaccgggagcgtagcagtaaatccagttacccagcagtgcatatgcttcacccaagtcaagctgtcttgcagaagtggggcagcctgactttccactgtgttctccccagtgaatatggcctaggcccagtgtctgctgaggtcactccacactcatggagctgggaacagctgctttcagggaaaggtcagctgttgctgaaatgatggactgtcctagcatttaaattgtttacgcagggccaggcaacgtggctcacgcctgtaatcccagcactttgtgaggccaaggtgggaagatcacttgaggccaagacttcaagaccagcctggccaacatggtgaaacctcatctctacaaaaaatataaaaattcgccaggcatggtgacacacgcctgtaatcccagctattcagaaggccgaggcacaagaattgcttgaaccctggaggcagagattgcagtgagccaagattgtgccattgtatcccagcctggccaaaagagtgagattctgtttctaaataaataaataaaatagtttgtgaggagcaaatggccagtgattcagagaaatacctactactggtgccgaaaagacctgtacaattccggtactagctttgtgagtacagctattaaagcataactaacttttacacccaggtacagcttaaaaaaaaaagagaactggcagagctgcccctagtggcaatgctcaggggtggtggaggtgcccaatggacatgtctgtcccagaaaagaagcactgacaccctgggaatggttattaatgaatcctaaatttcctttggcttttggctttcttttgcatcctctggcagtcgcattgaatataaatatcaagtgccaagacaagtcaatagggaaattgtcttgtcttttcaacaaagggtgccaggacaactggatgtcactgtgaaagaatgaagatggatcctacttcacaccatctataaaaactaactcaaaaggaatcaaaagacattttggaagagctaaaaactacaagactattggaagaaaatgtaggggtaaatcttgagaccttggagtaagcaatggtttcttagatgtgacaccaaaagcacaagtgatgaaagaaaaagtaagttgggcatcatctaaattaaaaactttcatgtttcaaaggacactattataagaaagtgaaaagacaaaacactgaatgggagaaaatatttgcacagagaaacctgtacacaaatatgcacagcagcgttattcatcatggcccactacagggccaggcacagtggctcactttgggaggccgaggcaggcgaatcacgaggccaggagcttgagaccagcctggccaacatggtgaaaccccatctctactaaaaatacaaaaaaaaaaaattagcagggcatggtggcgtgtgcctataatcccagctacttgggaggctgaggcaggagaattgcttgaatccagggggtggaggttgcagtgagccgggatcgcaccactgcactccagcccgggcaacagagcgagactccatctcgataaaaaaaaaaaacccaaagtagaaaaaaaccaattgtccatcagtgatgaatggatgaacaaaaggtgtgctatccatacagtgggatgctgttcagccatcagaaaggaaagaagtactgctacatgctccaacatggatgagcctggaaaatgttacactgagcccagtaagccagacacaaaggccacattttgcgtgactacatttatacaagatgtgcagaatagacagtcaaatccacagagacagaaggtggatcagtggctgccaggactaggggaagagggaaggggaaggactgctaatggtatggggtttctttgggggctgatgaaaattttctgcaactagataaaggcaatagttgtacagtcacaggaatacactaaaaattgctgaattgtgcactaatggtatggggaatgtattgccccctccaaaaaaagtaggaggtgctggaccaggtgacaaaagtgtggccatgccccagactttttcactagggaccctgcatgagccagcaggtgcccagagagagcccccgccctgccctcaaggcttggctgagggcttcctggaggaggagtttggctcaatgctgagctgaaccaactgcagtttttggagtctgcacgcatcattcacaatcccgtggagtattgtataagagccacatcgtaactttgtgactcgctgctgccagggccccaaggaagtgctcttcctgggcacgaacccaggaccttttagcatggcccagacatgagtgccctttgaggaagtgaacatggtctgggactggctgggcattggagggcctgtgctaacccctccccaagagcactgtcttagctgggactggggtgctgggactggcgtgctcagtgagaggtgagtggtgcccgattctggggcttttccagaacctctgtggaaagcctgaggtcttctcctttcactgctttgtccacaatctgtgttctctgctattcctggctcccagagaacacaacctcactcctgctgagcttcctgccaagcagcaagaacagcttcttgggatcttagtgtcccctctgccggcaggtgcggcggctgggggttcggctgggggtgggagtggcccggctggggcagtagtgggcgcgaatggctttggcaggcctgatgccagaggtccaggtggaggggctcctgcatctctctccccgtaacccacaggaaaacagggctaataggcagtgaccaagtgagttgaccaagtgagttggggctgctgccgcggctatggaaatgagtgcccctggggcctggcatgggacacattcaaggcctccaagtcactcttgggcaagcagataacaacacaccctggactgaagccagaggtcctcctgggctccctgcttgccgggaaacatacccttcgatctgttgaactgtcttccaacctgctgtggcagttttgccccactcctgtttgccgtgctgagtcctgctttcctcaccttccctgagcattgccctttctgtgggagggaatcagcagaaggtgcactgttgcacttcagatgcttctacctcgtcgtttcctcggaagtctctattcaatggggagctccctagactggctgctaaggtcgcatttgctttttcagaggaaataccttgtcaggaaccctacccatccttatagaacagctgccttcagctaacccctttcctcataggggccaggacaaagcatgggacaagaaattcagagtgaccttctcatgagaggctgaggctggctcaaagaattcggtgcggcagagtgaaagtcagaagacctggattttcatcccagctttgcgacttgtgagctttatgatggtcaaattgatgaagactaggcttcaggctgctcctctgtaaacgggggctgtctccctcctggggtttgtgtgaaggcaacggagacaacacttgaaagtgtcttggccgggcgcggtggctcatgcctgtaatcccagcactttgggaggccgaggcaggtgaatcatgaggtcaggagatggagaccatcgtggccaacatggtgaaaccccatctctactaaaatacacacacaaaaaattagccaggtgtggtggcgtgtgcctgtagtcccagctacttgggtggctgaggcagggaaattgcttgaacctgggaggcagaggttgcagtgagctgagatcgcaccactgcactccaggctggcaacagagcgagactctcaaaaaaaaaaaaaattgtcttgcataggcctggctcatggctttgctttcttgctttcttacctcggggctggggagtcaccgcactgtgctatgaggaaagcccctctccattcaggagaccctgctagggaggagtctgggctcccacctgtggccaaagtgaggggcgaattctttccctgtcagagatggaccaatgactttatgacaaacccagcctgtgatttttctagtctaagcattaaaagctcctaaacccagccagatctggtggctcacgcccataatcccagcactttaggaggctgaggtgggtgggtcacttgaggtcaggagtttgagaccagcctggacaacgtggtgaaacctcatctccactaaaaataggaaaattagctgggtgtggtggcgggtgcctgtaatcccagctgctcaggaggttgaggcaggagaatcgcttgaacccgggaagcggaggttgcagtgagccgagatcacaccactgtactccagcctgggcatcagagtgagactccatctcaaaaataaataaataaataaataaaaataaaaacccttaaactcttttaaaaaatagctacaaagcgcctcccctgtctccgtgccaactggggtgaggtgggagcttaatggatcctgtagatcatatacatttgaatctcaggcctagatgaaggcagagccctcatgaatgatcaggggagatatgttttctatctagagccctggacaagctagataagctatttcattatctctcattgcaagtgaggagattgttttttctgtcacttttttccgtagagtggaagccttggaaggtcttggctgtatgcaggattcacagctttgacgcatgcgtgccctaggcccaggcctcagctcctgtccctgttggtggccattacatccaaagcttcttaggtatcaagattggcagctctccccttccacctcccctgcatccagtgcagctgcccccacgatctcctgcttctttggtttcagtttgctttgctttccttttggctgcaggatttccctttctttagcaaagctcagttagtgcatttgaaagcctgttcattaccttttctctaccacttctaggtgtttttagagcagaaagctttctatgtttcctagtctgccacactatcagaaatgtaagtctctgtgatacaatttctctctattaaactagcaaaaatgtagcaggggcatgtgcaagggtgagggaagtgctcacattctcctgatgggaatctgaattgctactcaattcctgacagtattttgcaataaaaaatatgaaaaaatgatgcatgtcttttgtcccagcaatttccatttctaggaagttactctattaaataaacatggatgtgtgcaaagtttcaggttcaggatgtttgtcatagttgtatccagcctcggcatttccaaaaagtatacactgtttaaatattccagttggggaaacaaaaaggaaaaaacaagaaggaaggggaagcacttaggaaaagaaaaactttctgagaaatcttcagcaaatgaatgcttacgactctagggtcagatacatctcttggccttccgtagctatgagggaaacttggaaaatcagaatttttatttgggtacaactgaggttttgttagtaaggacgaagggaggaatggataccatagtgtgtatgtatgtatgcaagtatatgggtgtgtttattagggttgtctagagggacaaaactaataggatagatgactatatgaaggggagtgtattaaggagtattgactcacacgatcacaaggtgaggtcccacaataggccatctgcaaggcaaggagcaaggaagcctgtctgaatcctaaagctgaaaaacctggagtccgattttcaaggacaggaagcatccagcatgggaggaagatggaggccagaagactaaaccagtctagcttttccatgttcctctgcctgcttttcttctggccacgctggcagctgattagatggtacccacctagattgaggatgtgtctgcgtctcccagtcccctaactcaaatgttaatctcctttggcaacactctcacagacacacccaggaacaaaactttgcatccttcaatccaatcaagttgacaccctttattaaccatcacagtatgtatgtgtgtatacatgtaaatatgtatgtatgtatgtatctatgcatctatctattgattgagatgcttctagaagggtagatatcaagttcttttgatgtttattcctagttggaagaattttaaaggtaatttttacaatcttgtttttgcatatttgatataatacagctgcattatatttatttttaaaataaatattttaaaatttcaaatatttaaaaaatacattaagataataaaatataataagataatataaaacagctgtattatatttatttttaaaaagtcactcaagagcctgggtgcggtggctcacacctataatcttagcactctgggaggtcaaggtgggtgaattgcttgagtccaggagttcgagaccagcctgggcaacatggtgaaaccctgtctctccaaaaaatacagaaaaattagctgggtgtggtggtgcacacttgtggtcctagctacttaggagactgaggtgggaggattgcttgagcccaggaagcagaggtttcagtgaaccaagattgcaccactgcactctagcctgagtgacagggtgagactctgtctcaaagaaaaaaaatgtcaagaaaggttatagttgttaaggatggggtggcacatgatgggggtaggaccacagccagatgtggtgccagagagcgatgagaagcagagaaccacaatatctcaggagtgtgggatgaggatacagcaactgccagggtggggcactctgagtgttctcaatggattgttatgtccttggtttttaatttggggaggggtcaaaatgttgcctgttgtcttgtatgtgctgcctacaacccatttggaatatagagggcagaaggggggactctgcagcccctccagacatccctgctacgaaggtggaatatcttgattgtgcgtggatttcgttatcacccaggtagctgcttgccattgtaactgacttctcctttcagctctttaattggttaaaatgttctaagacctccttcatgttgcgtccagcctcagaaaacagatcagagttgtcctccccaagaggagtaggccacagagttattaccatgagagcagctgctgggtcttgaggatcccgccacaaaaggacaaacacaatgtgttgggaatgtcggagaaccacagttttccccctttaccaggaatcatgccgatgatggtggctgccatttattgaatgtttacagtgagtattttctcatttagtccttcaaagcacttcacaagatagattctcattttataactaagaaaacaaaggcttggacaggttaagtaacttgtctaagatcacacagccaggacagtgggaaaggggtgactgcgcgatgtctgattttgagtctatgtttgtgactattagttattctactcagggtgaccggcaatcctgctttactttggactgtcctggttccagcacttgaagtcccatattctgagacactcctcagttccaggcaaacctggacagctggatttacttccttggcagtgacagtcctctttccactgagcgctcaggggtccgtgtgttcttcacacctggatggtcacctgggtgcggttgaggctgggtattttccatagtggcccccgggcaacagtaggcacataattggtaccaaaggaaaaaaaatcctagtggagttaatgagtgaataaatgactaacgtcacctacagcaactactttcagattatgtattgtgagtcaggcactgttaggtgctgtgggaaataaataagtgagtttcagctaaataactgagtaatgtgagtaactgaattgcactctagtgtagagacttgcactgttggcggtgtcaacaaagattcatgaagggatattgcaccgcaggcttgatggctttaataacccacagcagtaacgccactctgtttcggtagatcctgaagttgataagcctaatccctcacacggtctaattcttctgcctcccagcagatgtgtgagatattcaacgccgcttcacaggcagggagagtgagtcagaaaggaacacaagctcatgatctaaagctgtgattgcatagtggcggccctcaggccacctccaggccactgttgtgttttgtggtctatataatttttttaaacaaaattgaattggtgactcacacctgtaaccccagtactttgggaggctgagcccaggagttcaagactagcctgggcaacatggcaagacttggtctctacaaataataaaaaaaaagtagccgggtgtgatgatgcccacctgtggtcctagctacttgggaggccgaggtggaagaatcacttgagctggggcagttgaggctgcagtgagccatgattatgccactgcactattgcatgacagtatttgaagactggaagattttgcataaaaatctgaatttctagtccctctcgatgaaatggaagatatgacagccctgtgttctcaatcatggctgtcacttgtgatgaggcattgacccttcagttttctcatttccagggcagtcctggcctgtgttacctgaggcatcaaaacgaagagaccacaaggtaaagaaagtatctccagtggaagaagacatgtgactatagcagcctcagggaccccaatggttgtcccatgttccaaaggatcaagaacacagttgtgaggaaaagccacctctgccaaggccagaagcagacccctttctccttcaggaatctagatgctgtccctgacttctccttttgcatcatctttgttctcctcctgtttagtcaagtcataaaacaaacttttggttttttccaattaaccatttccttcagtaagcggcaacgccactcttacaggtgttcaggccaaacactttggagtccttcttgactctcttataccccacctcactgcctgtttctgccatcctggtgcagaccaccatcagctcttgcttgggacaccgtggaagcatcctgattgctcctcctgcttccatcctcaccctgctgctgcctattcccagcgctgctggggagggatcctgtcaaaccataaatgggatagccaggcacagcggctcacacctgtaatcccagggctttgggacagtgaggagggaggatcgcttgagcccagcagttcaagactgcagtgccccataatcgtgcctgtgaatagttactgtactctggccaggacagcatagcaagaccctgtctatacaattaaaaaaaaaattagctggtgcacacctgtaggctgaggtgggaggatcacttgagcccaggagctcgaggttatagtgagctgtgattgcaccactgcattccagtctgggcaacagagcaagaccctgtctctaaatacacacacacacacacacacacacgcacacacggcctgatgcagtggctcatgcctgtaatcccagcatgagctcagtatatatttaaatacacacacacacatatatggcctggtgcagtggctcatgcctgtaatcccagcatgagcccagtatatatttaaatacacacacacacacacacacatatatataatttatattatatatattatatatttgtatatatatttatatatatatatatatatagagagagagagaatgagagcaagagcgagcgagactggtgcggtaagtagctcatgcctgtaatcctggcactttgggagaccaaggtgggaagatcacttgagaccaggagttcaagaacagcctgggcaacatagtgggacctcatttctacaaaaagtaaaataaaaattagctgagtgtggtggcacacatctgtagtctcagctgttctgggggatgaggcaggagaattgcttgaaactgggaggttgaggctacagtgagcctcaattgcaccaccacactttagcctgggcaacagagtgagactctctcaaataaataagtggtatctatctgtattatatatagatatataatatatatctgtctatctatctgaccatgctcctccgatcagctcaaaccctctgcagtttgagtcactcccttatcctcactgtggccccttccattctgtaccctcattgggctccagtcacactggcccctagccctgctccatggatctctgaataccacaagcatactactgcctagggtctttgtaactgctggaggtttctgttatctaaggctgcataacagatcatcccaaaacttagtggctttaaacagtaagaatcatctatgatctctcatggtttctgtgggatgggaattcaggatcagctaggcagggtggtcctggcttatggcctttcatgaggttgcagacagatgttggcagtagccaagtcatctgaggcttggctagtagggggctttacttctgaggggaccccctcatgtggctggcaagttagtgctggctgttggccagagccccagttcctaggcacgtggagctctccatgggtttgcattaggatgtcttgagggcatgaaggttggatttcctcagagcaaaagtgtccaggaagccaggtgaaagctgtaatgccttttatgacttagcctccaaggtcacacaccatcactcctgatccatttggtcggtcacacaaagccaccctgattcatagttggaggtgccacacgagggtgcaaataatgggaggtggggattgctgggggcatcctggaggttgcaatcatgcaggtttctgcctgtgatgtccttccctcagcaactgcaaggctgacccgtgaatccttaagattcctgctctaatgttccttatcagagaggcctcacagcctaccccttttaaataacttccctaccctcctgacattcctatcctgcttttcttttcttcacaacacttatacctgcagtgctatttccttgtttcttgtctgtctccctccagtagatgaatcctcagcatttagaccggtgcctggtacaaaggctgccaatgtttttcacacgaatgaatagcttatatgcattaaatgttatgaatgaatgaaatcttacctctttgaacaggcttcatcacatgctatcaagggcacatactaacgacacaatttatcactgttgatgttaaccttgatcacctggcggaggtggaatttgtcaggtttctccactgtaaagttactgggtttttccacttttccattctgtattgtttggaaggaagtcactatgtgtagctcacacttaaggagtgggaattatgaggactgggaaatctacataatttatttggaattcttctgcacaggaaatttatctcttctccctcatttattaacttggcaatcatttatttatattagcatggattcctggatatttattttatactttgcattataatccaatcctactttattttgttgttcaaattgttccagctttggtcattggaagctctttcagttggcttccatgctccttggccgtattcccatcagtgtgtgtgtgtgtgtgtgtgtgtgtgtgtgtgtgtgtgtgtgtgtgtatttgtagcacttcctttatggcactacaagatgcaccagactcattttggtgcatatttccttcatttcctgccccaggaggcaggaatgcccctaatgtttctaaggagccttggttccttttattgagaatggtgttagaaaccaagttatgcaaatatgcttccaattattctatgtctcaccatttcctcaggcactgccctagtctaggccgtcacctctctttgtggcaaccttccaaccatccacaaaacatactgcccctacgtttcctctacttctttctccccatcctttcttcttttaggcagaggcatcattcttagtgataaatcggctcatgtcagcctttcagtggacatcattgttctcaggatgaagttctcccgtgtatggtgtaaaacattcttcttgacctgggcctgcctacccctccagccttacctgtcccataaacccagcctggaggctgagctccagctgcactgaactactttcctttatttctgtgtctttacaaatgtccatacagaactttccactgctgagaaacaagctctgagcctaatgactgttaccatgttaaaatatcttctcgccaggcttggtagctcacgcctgtaatcccagaactttgggaggttgaggggggcagatcacgaggtcaggagttggagaccagcctgaacaatatggtgaaaccccacctctactaaaaatacaaaaattagccaggtgtggtggtgtgcacctgtaattccagctactcaggaggctgaggcaggagagtcgcttgaacccgggaggtggaggttgcagtgagccaagatcatgcaactgcactccagcctgggtgacaaaacgaaattccatctcaaaaaataaaacgtcttctctcctttcttgtgtggggttgaacaagaggcaatcatttatttaaaagcccccctgtgatatgaaaataaaatattggtctcccccaccacccagttcctggcacacagctcctaaatcccttggaatttcttgggtgataggatgtcttttgttctaatgaggccactcctgatagctagagagttcaagaagggcagttgacagaggaccaaggcatgattaaagggtggaactttcagccccaccccccgacctccagggaggggagagaagctggagataaacttaatcaccaaagaccaaatgatttcgccatcatgtctgcagaaagaaacttccataaaccccctaaaggatggggttcagagagctttcaggttggtgaatacatggagctgctgggagggccgtgtacctggagagggcatggaagccccatggcgcttcccccataccttgccctgtgcatctcttccatttggctgttgttgagttgtttcctttataataaatagtaaatgtaatgaggtgttttaatgagttctgtgaactgttctagcaagttctcagacctgaggagggggtcatgggtacccctgatttatagccagtgggtccaaagaacatgcggcaacctgagactttcaagagtccccatgtgaagtggggagtttataggactgagcctttaccatggaaggtctatgctaactctagtagttagtggcagaattgaattgagttctaggatacccatttggtgtcagagagttggagaattggctgagatgggaaaaagctcccatatatttggtattggaagtgttgagagaaaaaacaattcactgctgccctgccaccccatccatctagcttgctgtgggccaaactccatgctctgctctagaaatgcatgtctgtctgtgtgcctgcatgtccctgtgcacgtgtgtgtgctgggagtgggcccggctggtcttgccttttactgccctgtggttgcatttgcctgcctcccgccatgcagcaagtgtctcatgaaggcagcagacactgccggtacatctgaatagtcccaacacctgggaatgtgcttgcagatactcaagtatttgcagcttaaattatcatccaattgaataactaaactaaaagatgaataaatacgataaggggtaaatgaatggatgaatgaagtggttgtatctttctcctttgcccttagggtcagaagtggtttccaaatgttgaaattttgaccattgaattgagctgacttggattctcaatgttggtcgacagtctggtggcaacaggagtggcctccctgcactggtgagcactcactcccctttatgcaagcatgacagtaaggaggaaggaaagcgtgcgcaggcacgtgggaggctgccgtaagctcccaaggggagggcttctagcaaaagtgaggttttctttgcccttgatgttctgagagcacctgaagaagccacacagccagtcaagcccaggtgcttgtttctggtccagttcaaatacgtaaggcctggaggtgctctggggaggtgtgactgcaaacgctgttgggatttgaataggcagaaaagaaggtgagagaggctggggaggggatgtgggacaacctgtgtaggggccaggaagggcatggcctgaggaggggagagggcaggagatggggaacgtgacacattgtgaagggtcttgcatgccaaggtaaagagctgaaattgttcctgtaggccgtagagaactcttttaaaatggataatcaacaaataactacacctttacttttttctacaaggtaatacatgctaattatagaaatgttggaaaatatagaaaagaataaatccaaaaggaatcatgagtcagcgtatcacctagagaatgcaatgcctttgatgtatttccctccagtaacttttggtcacagtcgtcgtagtcatatgttacacgtgccttataacttgttttaaaaatatcattaatatgttatgagcatttgttcatgaagccatcttttgaaacctgatttttaatggacgcacagtaattcatctttatagccagcccttcatgtctgtgggttctgcatctgagaattaaactaaacttggatcaaaagtatttgaaaaagtaaaaataacaatacaacaataaaaataatataaatttaaaaatatagtatagcaattattttcatagcatttacattgtattagatattataagcaatctagagatggtttagagtctaggggaggatgtttgtaggttatatgcaaatactatgccattttatattagggacttgagcatcccagattttggtatcctcagggatcctggaacaaatctctctgtgaatactgagggaagactgtaatgtacttaatcaattctttattaatggttatctgattattttaaatttttcagggtatgtgaaggctcgatggcattcttgtatatacatagttacatgtacctcggattatttcttaataaatttatagaagcagaattactaggtcaaaggttctgcagatttcaaaggcctttagtgccctaggtcctagggaatgactggaagtttctgagaaaggtgatgtgggaagtgtcttcttttcttctcgtttttgctgattacttttaacttttttatggaggacaacccctgaggcttctgcctggtctgccctcctcccctgagaatgatcagtgtccatccataatccctgaggaagagggcctctcccttcatattcctaccacttgtcttcctctttagccttctctatccctggccaccacctctagggcctgggtgtgggtctgcacttggtgctggggctcaggtcacagagcactgaggctggggtggcgactgccatcctactgaacagaggtccccagccctgtgaccagaacacctctcctcccatcctggggtgtccaatgtcttcccacaattcctgctcatccctggagtttatgtgtccttcaggcatctctggttccaatttcctgcttctccagagctctccaaatcttccttccctctgtcccttccgtgtgatccctcagcacccaccctacctcctcagacaagctgcgtgtcttgtcccggacagtttaactggtgagtcagggatttatatgaggagagttgtattgcagtatcatgcagtggataaattaaaatgaaatatttctgcctttaaagtgcccccgccccactgcttcctcccatttcctacttccagccactcacagtgctgctcagctcagctcagctccgccccttgccccggatgcagtgtgggctccctgctgcccctttctcattccacctgctctacttctactccaaccagcattttacacagccctggagacagcctggggactccatccaaggggcccaggcctcagtcaggggagaagggagcagaagcattcaggcctggcagaagcagccagctccccacaacacctgcccctgtcctggaagttcttccaccgaaactgcctccctgcccagaacctcagggctcccgggagccggcacagagggcccctcagctgcagcactttaagggctggctcagtgtggcagaagggaactgcctatcctttctacctggcagggcaaccgaggggtcaaacaacataatgggtaaggaagtgcctcataaaacgccatgcaaacataaggcattgttatacaattgttttcattgggaaatgtaatttagttccaaacaaccactttcagaggaactcttggaacataattatagtggacatctgttgtttttggcctgtccaatggccctttccctttcttctggcaataataccgcccaccccccttcctctggggaagtgcaactctttaactccagacttgtgaccttgctggggctgccatgacgtgactccactgcagggtcccagggatggacgtgtgacccgggcttggccaatcacagtagccccaccccccacctacacgatgattggtccctgcaacccatgaccagggtttggtcagctgtcattctaccttgagattttgacatagggaggcaatgagaacgaccctttccttctggtggaggttgctgagcaggggtgatatgagcgtctcagtctgttcaggctgctataacaaaatgcctgagactgggaggcttaaaaacaacagacgttatttctcccagttctgcagactgggaagttcaagatcaaggtggcagcagatttggtatctggtgaccacctgctttctggctcacagcttgctacagtttggatgtcccctccaaaactcatgttgaaacttaatccctaatgtggtagtattgagaggcagggcttttaagaggtaagtgaagggctctgctctcatgaatgggttaaaccatttatgcatgaatggattaatccatttgtggatgaatggattaatgggttagcataggaggggaactggtggctttatgagaataggaagagagacctgaggaagtgggtttgcacgcttggtccccttgccatgtgatagcccatactgccttgagattcttcagagttcccaccagcaagaagatgctcaccagatgtgccccctcctccttggacttctcagactccataactgtaagaaatacattctttttctttataaattgcccagttcagaaaacagactaagacataggtggtgactttttgctatgtcctcacatggtggaaggggcaagagggtctctcctgggcctcatttatgaggacactaatgccattcatgaaggctccactgccaggtcctaattacctccctaagtccccacttcctgatacccttaccttggggattaggatttttacataggaattttggggggacataacattcagtccattgcatggtcttcaacagtcttgtcttgtcttgcccttgacctgccttccactgccatttagaggaatcctctgcagcaggaagaataatgcaaacctgggggctggcactgggaagcagaatccagaggagagtgagtctctctcggtctatcttgggagccccccgtcctagctgtccctgagacaggcactgtccttgtgcttccctgactcctttccttcagccgcagtggactttttgtcccttatatatgacagaatcctgacctgtatgaattaacccactcatgggttagaggtgcctatttatgaatatccaagtgcttcatgtgtgaatatcttacttctccaaaatgatttgaaatgtctcttgggaatgactcatcttgatttagaatagtcagctgacataagcccaggagtttgaggctgcagtgagctactacactccagcctgagaggaaaaaaaaataacagacagtaaagatatagttatatgattaaaccaaacagaattagttatctttgcaaataaccccttcatctgccttaaatcagagcatgttgaggcatgggagtaatatgtaatagatgctatgtgtatatgagatagaagataagccaacgcatacatttgtaattagattaaggaaaactgagagtccattcacttttatctttacctagaggcaattctgtttgctgtaaagaatcaagaggcaaagcctgtaagactcaagggaaaagacaaggaaaattggaacttctttttctgttctgggatcttgttctgaatgttgcttaaaacgactgagtcttattcagacactggcaaccatttcttgcagaagagatttctgccaagacaagatgcaaattgtagattggacccgttggtttgggagtctagggatatgcagaggcttcacagtggggtgctgctcagctcagcacccctggttttctggatggagtcggggcaccagttggcaggcagcccagcacagctcattttttgaaaaaccaaaatgaaacagcaacaccaccaacaacatagcatcatcttgaacagaaaaatatagcaaggagctggaagggagacagattaagcaattcaggagctaggatgacacgtgggaattttagattgtttcatctcattagcaaagataaaatgcacacatttcacgtaaagtcatccattgttaacacaaatgtatgcttctactgaaggtcaataaaatgcttaatacaatattcatgtgattaggaactcccatgttgcagaggctagaaggacacttccactctcaggctgagggtctgggcttcccagctcattccaagactgaggcagagccacctggactggtggcagtggtcagaggaaggacacaaaagctttggaacatgcgtccctcggaggctgccggtgctggctctggacatttcatttcccagtgaccttgttcttccttctcctcatctgcgaagtgtcctgtttgctttataggcttgtttagacactcagatgaaatagtggatgatattttgaaaactgtaagtgacaacagaaatgtaagatgcacttaggaatgggagaaatagatcctcagaagaaggaaaactgccaagcctaaaacactaagaagctaaagctggggtctgcatgagaaaaaaggctttagaggactaagattgcaaagccaggaggacgctgtgtttgtgctggcccttttggaatctgggtggcaactagaatcccggcagagccctgtaagtgttgctggccagacggactcttgagcgggcctgcctggtttcacactctgcctcgccactgtgaccatgtgaccttgggtgggagactttgcttctctttgcctcaaccttcttatctgtgaaatggggataaccacattcatctcagaggatagttgtgagaattaagagaatccattcatgtgaagtacttggaatagtgtctggaaaatgataagttctcaataaataagcaatcatcatttcctatcaagactgggagtcctggtcttgcgaataaccacacctgtgatctgggtcagattattgagatttctgtgctttgatgatgtgtcgggagagaagcagggttcttaacgtctgtactgttgatatttggggtcaataactgtgctctgggggcctgtcctgtgcatgataaaatgattagtggcacctgtggcctctacacactagatgcttgtcatgtcccctctttctctgttgagacaaccaaaaatgtcttcagacactgccaaatgtcccccttggatgggagatggggagaggcaaaattgccctcagttgagaactcctagactggaagcagagttcttaagctagggagctgtagatcttggggatcccaaagaggagctttgagacgtctatgaaagccccgaattcattcatgaacatgtgcgtgcgtgatatgcatgtgagtgagctcacaggcacttttctcaggagagctccccagctttataccagactctccaggcagtctaggacagaagaattctgagttctgcatcccttcttgccttgacatgggctggtccctgctctgagaggaaaggcattttaggtgagcaccaagttcctcctggtcactgtgtgaagctctctggtctttttcgttgagcttttttggataacccttttgtttctaacccttttcctctttttttctttctcttttcctttttttttttttcttgagacagggtctcactatgttgcccagcctggtctcaaactcctgagctcaagcaactctcctgcctcggcctcccaaagttctgaaccacaacacccggccatcctctctcccttttttttttaaaacaaaaaacaaaaaaacccaacaaactccctttcccctccacaaagcctgttccttctctcccatgctggaaacttcagggacttttgctctttccctgggagtctgagtaactctccagacaggcagctgttccatcccactctccctctaggcttcgtgagctatgtgcaagtggcaggggtgggtgggtggagggaggagggggaaggtcaccaggcacattccaggtgaggggcaggtggtaggacccctctttctgggtagccttggtcccatgctggctttgttcatctcccttccctgctggggttctggtccttgttatcttgggcagagccagggaagccagccgcctctcgtccaaggttactgtgctggggagctagtatttacacaactgccgggatgtgggatgaacctattgtgctctgcagccaaagctgtgctcagcctcaggatcctcaggagacgtgaacagactgaattctcagagtctctcattaagaatttggctcttcaccaaggaaatctgttcctcttccaaacagaatctgaagcttcatttagactgaattagcagtggtgagaagggaagggaggccaatgcatcccaacgttttctgaccattttttggtttaaacaaaagaatggggaggaaaataagaagagtaactccattcaaacactgtcagccagggcaggtcaggaggtcgtggaaacaaaggacccaccattgtcagatccctttcccttccttctttctttccacgtctgccttaaggaatgggtcggaaagactgatccctctccagtgtgagtccaaatctaacctaaagtatttgttagttgtcaagcctgaataaagacaggtgtagactagaaaagtggtgtgagtatgtatctaagtcacctgacattgtgattcacggcaccgcttttgcttcaacaacccaggcatttctcttcatgatgctaatggactgtgcacttgggtcatgtgggcatggaacaatctggattttaaaaatagatgaataaggcgataattatgcacctcacaattttaatctttactagtaagaaatgagtcactgcaaggtttttaaaggtaaattccctaggcaaacatttaaaaggatttgattttcatctaactttttcaatgcaccattcttcataatttgaagagtcagacaggtcatcttacgatctccactgcctcactgtcatcagccagtatttatcaaataaccaagggatttggagtccggcttttcttccagtcttctagaactcaaagcattctttttttttttttgggacggagtcttgctcttgcccaggttggagtggaatggcatgatcttggctcactgcaacctccacctcccaggttcaagcaattctcctgcctgagcctcccgagtagctgggattacaggctcctgctatcacatctggctaattttttgtatttttagtagagatggggtttcaccatgttggccaggctggtctcgaactcctgacctcaggtgatctgcccaccttggcctccaaaagtgctgggattacaggcgtgagccaccgcacctggccagcgatcttcttgagcaatctggagaagtctcttaagcttcataagcctcagtctcctcgtttgtacactagaggtaacagcgcctccctcacagtgttgtcatggtgattaaatgacacaggtaagcagtggtgttctgtatatgatgaagcatcttctaacatcaaatgttattaataagaatagaaatgatggcctctgttctatgagaagacgtctctccttagaacagactactcaatcaatgacctgagcattaaccaatttctgtggcttccttctcaaaacttcatgtccttctagtctagtagcaagtattaatgaattttttaaaaacttcctaaaatagagaattccaaatgttaacgtaattttgagacacactgttttagaaaatattacctcaaaggaaagtgaagagctctaagatatgttaacacttttgttttattaaactaaacctatgaattgcatttggcaaaattagacaattttggcttactaaggagctttatgaagatgtgatagctgtagagtgagttaaagtcatcagcaatgtggacatgccataggagaaagtcctgtgtaactaggctgtaccagtttcacaggagtagtggtcactggaggccagaactgaataaagtcttgctatagactgaacgttgttgtcccctcaaaattcatatattgaaccctagcccccagtggcagggtattttaaagtgggacccttgggaagtgattagtcaagagggtggggcctcacaggtgggattagcgcccttgtgaaacaggccccagagagttcatttgccccttccacctatctatgtaaggatgcagcaaaaagatggtgtttgtgaacgaggaagtggaccctccccagacactgagtctgccggtgccttgatcttggacttcccaccctcagaagtgtgagaaataaatttcagttgttcataagccacccggtctatggaatttttgatagtgcagccccaatagactaagacagacctagagatcatttggccaaacttacagtggtataagtggagcagtcctcccttgaagggaaggaaagtgacttgcccaaggtcacacacccagcgagtgagggaagaaggagtagatcccactggacttcttgcccagtgctctttctaccttgttctgaaatattacttctgatgcaaagtcattttttttcctggggccaaggaagtgtcaaccaaggaatctaactgactgatagcaaaccatcagggcatcaaaagaggtgcatatttcagaaaaagtgcgtttgtataaaggtggagtgatatttctggaacatttgttctttactgggcaggatttctgttgagatgctgtggcagaagcctcctgtattaactacatcttttctttattttgatgctttggcatctggggacttgctcctcccaggaatagctgattggataaataagacagattgtggtaataaactgaaatatatgctgaaatcagaattagggaagcggacattggcattgcttgatgctcaaggccggaaaccaaagcttatgttctcatgcttatcctactccagagatgccatacccttgaatatatcagctgcatcttgtaatctagaatcagaatgataccatctacctccttggggcgggggcgggggtgggcatgggaacacggtatagttgggaacccaaaggcttgaagatccaaggggaaatttgtagaatacttgttcccttttgcactttttacaattaacctaggtttgacttgagatccaagaatgaaggagattctactttttgtaattatcagaggcctgaagagtacagaaaaagtatatgaaatactaggatttggggtgagtgaaacttcatgtggaacaagagcagtgcttttgaattaaagccatgaatcagaggcctctgagcaaaacatgagtctttgggggtttatgagtttagctgatattttaggaaatccaccagaccaatactctggtaagccctccatgaaaacaagagttaactatgcattaatcagagttgtatatctatgtatttatgtatagagacagacagacagacagacacacacacacacacacagaaaaaagagaagagagagagagaagaaagatttattttgagaaattggctcacacaaatgaggaggtttggtgagcccaaaatctgatggggcaggcaaaaggcagtctgctggcagaatttcttcttactcagggaaggtcagtgtttcttctctcaaggccttcagctgagtggatgaggcccatgcacatgatggagggtcatctgctttactcaaagtccaccagtgtaaatattaatctcaaataaccccttcaggaaaatatccagaataacatttgacaaaatatctggggactgtggctcagccaaactgccacataaaattaaccatcacaaactacaagtgagaagctgagacccctggttcatggaaggactctgtggctgtggaaggcttggagaggggacaggagagtagcctctgatgggattccaggtgacctcatggtcagcatctcttactgtgtgggagctcctggggaagacttgagtttcttatctcttgcatgttcaagttcatgttctttcctcttgactgaagatggaaaaaaaaaaccaaaaccctgtagttactcagtaagttgtctgtaaaatttctgtcccttttgagagctcgaaaggtacagttctaatgaggtaacttggccacttgacttcaaggtatttggagtaggttttctctgccaatgcaacacttggcaaccattgtacaataattttgtgcttatgtccagcccaactgtgaacaatgtaatcagtgttatgaattcatgaatagaatgccctggcactataactgtccagcttccaggcatgggaaaaggagcccttctctggggcagacataagggaacagtcctagcaattctgctcacaggggtgagggtggaaatgttgtcgacagatggcaacaccataccggctcctcacaaggttctcatgaccttttaacttctgataatggcttggcccccagtgttgcctgagaaccttggagagcaagggggcaatttccgagtgggtacattcctagctaatcaaaattacctctgaagagtgaaagctgcatgtgagaggcacagaagtcatgcgcatccaatcacttcaaaagccagtcatgtagctaggggagcagattcaagccgatgtttctaccaactggtcatttcagtgagcagagactcagctgtgagctgggtccttaagtcttcagtttgccaggtaatgagaggaatacctgttttccaccaacctcctccaccaaagcacaccaaacaggcttggtctgaccactggcaaacccttctgctctcaaagctggtgtaggttgcaggtctactttctgcattgatgggcaacccattaggtcaggcatatatagggagggattgtacttcaaaaatcacagggtgaccagaggaccaggggcgtgttgtagcaacacactgtgtggagtcccagggagtgctgtacacccctcatgctcatctcccgttgcttccctcctgaaaccagcatttgcaatcctgtaccattgcactctgaaggttttttcacatcaagcactagggaagcaattctgcttcctacgtctcctaggacaagggtctcctacatgatttttcaatattagcacaatctgcaattagcgaatcccttgattatgaacattggtcagacaaattggctaatggaatctgcagaataaaagaaaaagattagatacaactcatcaataagaacagacctggcatttggtccagaaaaggtcacagtgtttaagggaggtgtgcttaattataggaaaattatgtatcagtcatgaaataaaattgcccttttgttcctgggaaatagcatggtttaaagaaggtatccagtactacctagatttgttctggtgtgcatagatttgatcctctgatgctgttcagttcaatgaattgaattgttgaatacccgctatttgcagggatcagagagaaagaaaagagaatgtcctctttcctgaaggagttaatagaattataagagggagaacaagggagggagggagggagggaaggagagggaaggcgaggcaggcagaaggaaagaagggagggagagaaagaaagagggaagaatggaaggaaagagggaaggagggaagaaaaaaaagaactataagaagtagctgagtgaaacaaccagtcagcaacataactgccaggttgggtactgtagtcagttggtattgtggaagttgtttgtttgttttgttttaagagagacagagagagaagctttgagaatgcttcattgaagaggtgcatcttgagctggtcattgaaaaacaagcaggacttggatggaggacaggcatgtgcaagacactctaggcttagcaagcagtgtaagaagtgtggagaggagtgggggtgctgggtgggcaacaaggaggacaggacctgacccaggccagtgcagctaaagcggcaacaaaggctctctggagagaaagcacaaccaactgttataatagaagtggcatctatacacgactccacattgatctaaataggtgatcaaatacatgaattcacacaggagaggagacaattcttccttatagaagaattccaaataatgtgtgatacttccatctcccagagggagactttaatctacttgtgtctctaccgggtaagtgggttagacctagtgacttgcttccaaaggacagagtacggacaaggaaaactaggagcttcacatggtagagaaacctggcaaacagcaccttagccaaatggttgaggttgacaccactagtaatgtggatttatgtaccccagataaaaaatgacaagaaggcatttcacctttacggtattttttctaaaaaacctgtaaccccagtcta

SEQ ID NO: 1373 - DNA, 20001 bp, Homo sapiens
caggaggcggagagtacagtgagctgagattgtgtcagtgcactccagcctgggcgagggagattccatctcaatacaaacaaacaaaaacaaacaaactgatggggctgaggagccactaaggctgtacagctggggcaaggctggaatggtgtgaaggtgtcgggaatgcctgggcagggcccgagtttcctgtcttatttcctgaggacgtgagaactgagcagacctccctggccttggccaggctcccgtagctgccgtggaaaggaggttaaggttggtggtgtagatgggggccctcacagtgagtccatcttggcccccagtggcctgggagccgattctcatccctactggcttggttgggaggtgctgggccacacgcctacattcactccacctctttccatctttcttttttttttttttttttttgagatggagtctcgctgtgtcgcccagcttggagtgcagtggcacgatcccggctcactgcaacctccgcctcccaggttcaaatgattctcttgcctcagcctccaccaccacacccggctaatttttgtatttttcatagagacggggtttcaccatgttagtcaggttggtctcaaactcctgacctcaaatgatccgcctgcctcggcctccccaagtgctgggattacaggattacaggcatgagccactgtacccggccatctttctgtctttctctgaagtccacttggtagccctgtgcggggcacccatggtgacgtgagagaatgccagccccgttgtcttaggtctttcacgccaggccaagcagtggtctttggggagaggagaggtctgagccgaggggtcttgaaggatgagtaggagtttgctggccgccccagggggacaggctgccctatgcggtgggagctggggtgcccagagcctcaatgcccaccccataaggcagaaccacgactcccgagccacgtgctggggtttggggtaggacagtgagtgtggcagtgagttgcgaaggaagaacttggactgtggatgcagaagacctgggttcaaatcctgcctggctcacttcccaggcggtggctccagacaagtcacttggggagcaccgttgggaggtgagggcgagcccacaaacatgcatagcttcagggtcctgctctgccccgcaccccgttccccatccaagcctcagtttcctcatctgtaaaaatgggctacaggaggcttctgcgaagtaacgcacatcaagagctttgttagcacaagctcatcgaatattctccttgttcttgttattcttggcttccaagcagccaaccagagcgggtaccaggtggggttgtaggggctgcctgatcctgccctcctcacctgtggcccaagggtggtgacctggcatcctctaggtatggggcaggcggcatgcgtgggaggctctgccagcctttttggcattttgtttgttcacttgacagacattttcttgggtgtttattgtgtgccaagcactgtgccaggacctgattcctgcccttggggcagactggcaaaagataaatgccacctgacaggtgagagagtggcaagagtgacggaggaagaactgggtccgggagcagggtaattcggagagtagagttttagtagcatagcagggagggccttcttggccaagtggcatttaaggggccacacgaaggggatgagggagggagccaggtgtgtgcctggagaagagcgtttctggcagcaggagcaacccgtgcaaaggccctgaggcaggatcgcacctggcgtgttgggggaacagcatggaggcctgtgtggctggagcagagtgagccggggggggggcgggagggaggaggggagggccctgtgggcagcggggaggactgtggcttttcccctgcggaaggtgggggccacggagggttgtctgcagaggagggagggaggtgccctggctcggcactcacgggcgctctctggtggctgctgcaggaggacagcgttttggttggtgatgagcgtgaacacagggaccgcacagacaataccttccagggtctgagagtctggaatggaatcgcccagggagacatggtggggtgcacccctcgtcctcccttctcttggatctgtttcggatgtgctgaaggattgattctgagatgcgagagaaaggaaggagtcgagaatgactccaggtttctggcatgagtgcctggtaggaccaagccaaagttaaccaagataaggagggtaggtgagcggtgggtgagcaggcttagggagtgatcgggagcttggctctgctcttctgggtatgaggggcctggggcccctgaggagacatgaaggagacaatgggcacgccagtctgggcttctagggagagaggtaatataggagttaccagcccatggctggtatttacagccatgagcctggatggggtcacctggggactgggtgtggacagagatgcctgtcctgaggctccctgaggttcgaaggtagagtgggagactgagtgggagtgactgtgaggagaggagtcggggtgtggagcccctgcaggcagggaaggagggagagctggctgggtgcctgctgcacaggcccgggggagtgggggtagctgaggctgacactgactgtgggggcgaaagcgtgcttggtttgagttctaggactgggggacaggaggtggagtgagtgagtgtagatgataccttccagtgcccgaggcaggaagttgggtcaggagagaatgttttctagagggaaaattccaaacgtgtaggtacagccccacagtgtggccaggggaagggcagaggagggctgcctggtgggctccagggcctgctccctcaatgtagcaggggtcccgagtggggccagcggacctctgggtcagccagggctcagcctggctgccagcacctccccgagctcaggaggaacagccatacccatctcttcccagacaaggaagcctcatcctcagtggatgccccctaactccctgggaccagggatgaccaagccactgagccaacccaccctcaggtgccggggcccaaggcccacacttgggggtccacggggcttctggctggggcgtctggttggctgtattcaagtgcacacacacacactgatcttccccacatggtatgttctgggtctggggacagctcacccagaccccaccccagagcctggggcggctgggcccatagggacagtgcttccatggctgggacaggaaacagtttacaaggcagctcacccctggcctgaccagcaggcacctgctctgctcagggaaagtgttcctgatgctccttggccagcatgagacaggcctgctgcacaccccgtgtcgactgggctcaggcccccgtccctgggtgctgttgcccacaaaccctcatctctgttctgtccacgctgcgctgactcctttctgggccagggtttgcatcttggcaagctgctctgctgtgcacccccctcctgggacaatgcatacctgtgttggagccttgtgaggagctgtgcacacacgtggactgccacacggactgccccttgaatgaggacttagccttggctggagctccctgcagctcagcaggggacctgaccctggggacaggggtggtgggaggtggctgcaggctctttcctccgggctgcgtcctcagggcacattcctgtttcccactcagccatctgtgccgaagctggatgtgggtttgctgcaccaggagaggtgggggttgaggtgggagtagctcctcatgtcctgtcacttacatacctggagcagtgacccttcccatgccctgaccagaaaccacaacaaccgtgacagctgcctactcgtgtcccttcctgtgcgatgcctgctcttttcgtggggggagacagaatctctgttgcctaggctggagtgcagtgattcgatctcggctcactgcagcctccacctcctgggctcaagcgattctcctgcctcagcctcctgagtagctggggctacagtagccaccacgcccagctaattattattattattatttttttttttgagatggagtctcgctctgtcacccaggctggagtacggtggcgtgatctcggctcactgcaagctccgcctcccggattcacgccattctcctgcctcagcctcccaagtagctggggctacaggcgcccgctaccacacccagctaattttattgtatttttagtggagatggggtttcaccacgttagccaggatggtctcgatctcctgacctcgtgatccacccgcctcggcctcccaaagtgctgggattacaggtgtgagccaccgcgcccgggtactttttgtattttttatagagacgggatttcaccatgttggccaggctggtctcgaactcccgacctcaagtgatccgcctggctcatcctctcaaagcattgagattacaggcgggagccaccgtgcctggccatgcctgctcttacttcctcctcctgtgactgccttcctgttcacacatttggaaaaagtagtccagaggtgaagtgacttgcccaaggtcaccccgctcaggagccttctcaagccgtgtctggctgcccagccaccaggctgcaggtggaggctcagggttgatggatctcaagctgctctgcctgcctggctgcctgggtccccttgccccagctgggacagccctgctctgaggaccagacacaggcaggtgttgtgctatccgcagtggctgtttctggaaggcaggagcctgccttcacttctgcaccacttagcacagtgcctgcaggccctgggctccaggcatctctcgactcctccacaccgttggcagccgcgttggtgcagcacccagggaaccggcgggaaggttgtgggggcagtcgtgggtggagtgtggggattcacagaacctcgccttcccgcccagtggtgctcatcggggactcaggcgtgggcaagagcaacctgctgtcgcgcttcacccgcaacgagttcaacctggagagcaagagcaccatcggcgtggagttcgccacccgcagcatccaggtggacggcaagaccatcaaggcgcagatctgggacaccgctggccaggagcgctaccgcgccatcacctccgcgtgcgtgtcggcagcctgggcagggacgctgagattcgggggcgtgggcttgcagcgcgtgggcttggaaggatgtgtaggagttgggcaggagaaggggagagtgtgctcccaagaccagggagtgaggctggaagaacgctttagccatgcgccgtgggaccctcaggctgaccagcgcccagccttcgccacaccagggtatctctgggtaccaagtgcagtgaggacctagctcaggccactccgccttgccgctgcccctgcccagccagcatcccagccttcctcctccctcagcttccctcctcactggtgcccacacctggtcccacacgcctcctgtcctcccacctgggcctggcctccattccctgcaaaggcttcccagccatcaggacccactcagctgcctttttctggacccctcccaagccccccagccattcccaccaccgtcttgagatcctctgggctccctcccatctccttcatccctcaggtacatctgtctctctgtcacctcctcttgtttttttttttttgagatggagtttcactcttgtcgcccaggctggagtgcgatggcacgatctcggctcactgcaacctccgcctcctgggttcaagcgattctcctgcctcagcctcccaagtagctgggattataggcacatgccgccataccaggctaattttgtatttttagtagagatggggtttctccacattggtcaggctggtctcaaactcccgccctcaggtgatccaccctctcggcttcccaaagtgctgagattacaggtggcgtgagccaccgtgcctggctgtcgcctcctcttttttggagacagacagggtcttgctctgtcgcccaggctggagtgcagtgccacaattgcagctcactgcccccttgacctcccaggctcaagcgattctcctgcctcagcctcctgagtagctggggctacaggcctgtgccaccatgcctggctaatttaattaattaatttatttattttttagttttagtttttgagacagagtctcactctgtcgcccaggctggagtgcagtggcgcagtctcagctcactgcaagctctgcctcccaggttcacgccattctcctgcctcagcctcctgagcagctgggactacaggcgcccaccaccacgcctggctaattttttgtatttttagtagagatggggtttcaccgcattagccaggatggtctcgatctcctgacctcatgatctgcccgcctcggcctcccaaagtgctgggattacaggcgtgagcgaccctgcctggcctatttatttatttttttgagatagagtctcactctgtcatccagactgaagtgcagtgtcacaatctcggctcactgcaacctccgccccccgccccccagggttcaagcaattctcctgccttagcctcccgagtagctgggattacaggcgcctgccaccacgcctggctaatttttgtatttttagtagagatggggtttcaccatcttggccaggctgatcttgaattcctgacctcgtgatccacctgcctcggcttcccaaagtgctgggattacaggcatgagccacgacccccggccaatttttgtgtttttctagtagagatggggtatcgccatgttgcccaggctggtctgaaactcccagcctcaagtgatccacccgcctcagcctcccaaagtgctgggattacaggcatgagccaccatgcccagccccttcttccctttttttgatgacctcacggtatcttctatttccagctcccaaactccctcctcagacccccacatttcagagctggatccagggagcagcgctggggcctccagacacacacccttcccttgaggccacaatgactgccccttggctcggccctggacgacccaccctgggcgtgatgtgtgctgttatcccgtgaggctgccgctgcccatggttgtcctccagagaggctcatgggcccctgaccctgcaggtactaccgtggtgcagtgggcgccctgctggtgtacgacatcgccaagcacctgacctatgagaacgtggagcgctggctgaaggagctgcgggaccacgcagacagcaacatcgtcatcatgctggtgggcaacaagagtgacctgcgccacctgcgggctgtgcccactgacgaggcccgcgccttcgcaggtgagcagacggagacgcaggcatcagagaggtgtctggaaggcaggaggcccctcacagtgttggggccctggccacagccctggcttcccttccctgaggagtggccttgggatgggccaggtgggtgggcggggtccctgagagcatgtgggagcctgtcaccctgcctccccactcacctaggcagtattctttgttccagaaaagaacaacttgtccttcatcgagacctcagccttggattccactaacgtagaggaagcattcaagaacatcctcacaggtggccggggaccagatgggtgtgggtagggcaccagccaggcagggtggaacacggcctctgaaccttcgcttgttttgttcgtttgcttgtttttttcttttttttgtcggggcaggatggatttttgctctttgcccaggctggagtgtggtggctcgatctcagcttactgcaacctccgccttccaggttcaggcaattctcctgcctcagcctcccgagtagctgggattacaggtgcctgccaccacacccgctaatttttgtaatttttagtagagacaggatttcacaatgttgtccaggttgatctcgaactcctgggctcaagtgatcctcctgcctcagcctcccaaagtgctgggattacaggcgtgagccactgcacctggcctgtttgatttttttccaccaccacccctaacctttgctttttaaacctgccggtccacctggacacttcacagggtcagaccaggtctagcccttgctggcactggggacacagagaccccctggccccagttcctggggatgggccctgccttaactcttggcgctgcggggaggcgggtagcctcagggacctggagccttttggcttctgggagtttacctctgagggaggagggcgcttctgatcttagggagcgagaggccggggctggctgtgaccagatgtgggtcctggctgggtgcgcagcccctgtccttgttacccctgatgtgatgggggcgctgtgggggtctggagagggcctctggagtcctgcagggaggggttcccctcggcaggcagggcacgtgctggctcaccccacgtccccctgtaccccctttgcagagatctaccgcatcgtgtcacagaaacagatcgcagaccgcgctgcccacgacgagtccccggggaacaacgtggtggacatcagcgtgccgcccaccacggacggacagaagcccaacaagctgcagtgctgccagaacctgtgacccctgcgcctccacccagcgtgcgtgcacgtcctccgcccgcccccgccacggtatcctctggcccctccctgctgtccctctgtggccggctcgttccagccctcccagtgagctctgcacggccgggccggggcccaggaaggacaggagccagtgctaccccgtcctgcccggggaaaagctagaagccccggtttgctgcacccatgaaactcgggtccccacagcgtcttggcggggtggggagggcggcaggatggacggggctggccagaggcgaggaggacgggcggacggcgccgccttctccccttttccttggccgactctagggagcgattgcctccctccctccgtgaccgggtggcccagccagcccgtcgtccccacccagaaccgtgctctgggccaaagcccgaagaaccaggcagcgggggccggggcaggcggaccccccgggctctcagcgcccacccgctcctccgcacacagcagctcgcacaggcctcccacctctgcctgttgattgatgcagggagaagcccgtccccccctctcccctctcccctcccctctcctgcacgcaacgcgccctctcggccctccctgtccccctcctctgtctcgtctccccatctggtctggaacctgtttgcaagtgaagcaatatctccgtgttttgtatatacaaccgctcttgtagcctttggtttttgttaatgtagagaaacacagattctttatacactttgtaagatttacgccaaaccccagctctcgatctcttcttctccctgtggcccctgcgctgttgccccgtccccgtcaccccgcccgttactgaaatgtataatctgacttcctgtacagaaacctgccgctgcgcctctgtcttctttcttttccgccaggcgccagctcctaggctgaggcccctctcgctgcacgttccccaatgcaggccagaccccccgtctccccagcccaccccacaggaagcgagaggaccccagcacctgccaagggcagcgtggaagtcagccagcgcagttggggtgggccctggtcaagctgcccctgtggcagggagggatggaaggctgccgcttgtccttgactttaaactcctgggtcctaggacctcaggcctgcgggcgtcccctgatggggatgggagccaagagcagtggccagggttcatcactttgtctcctgccagggcctcccctcccctggggtcctgacgagggtgacttgcccagtggatgttggtgatgccagatgtctccaccctaaactgacaccggaggagggcccagtggggaaatgccagggacagcaaaatgtgtggcatggagttcctcttcccaggatccagcgtctccctccacctcacccctgcagtgaccttgggaccagtgtgagctgccagcagctgtccaaaagctccagcctctagctgaagaggccacccacaccctgaagaccctggggacccatgagagaggacagcaccactccctcttgattctagactggctgccctgcctggagggataggggatcacagacaccttttcccagaagagctccaggtcgctgggagctgtgtagacacaggagttggaatgagccaaggtgtgcgctccaggcccagggagcagcctggcacagagctaactggcagaattggaggcacctgggcaccctgggctccaaggcccattcacagagacccctgggacatggattcccctgggtttgggcagggcaggtcatgtggtggacagaggcattgggtgctaagcaagaaagcaccttgagcttttgtttgtttgtttgtttgttttgagacagagccttgctctgtcacccaggctggagtgcagtagtgtgatcttggctcactgcaacctccacctcccaggttcaagggattctcctgcctcagcctctggagtagctgggattacaggcacatgcgaccacacccagcttatttttgtatttttagtagagacagagttttgccatgttgcccaggctggtctcgaactcctgacctcagatgatctacccgcctcgacctcccaaagtgctgggattacaggcgtgagccaccgtgattggccttagcaccttgaatttcaagcagtcaaaagatcaacaaatatttctagagccgccattatctgctaggcctgagatggggactgactgacatactctatgtccctttaagagtcagaagccagcaatgccagtttaattactctgatttcagtgatttaataagcacgtcctgctcactctgccagactctgttcttaaatcttttattattatggtaacatacacataacataaaacttaactttttttggccaggcgcggtggctcacgcctgtaatcccagcactttgggaggccaaggtgggtggatcacgaggtcaggagattgagaccatcctgactaacatggtgaaaccccgtctctactaaaaatacaaaaaaaaattagccaggcatggtagcgggcgcctgtagttccagctactcgggaggctgaggcgggagaatggcgtgaacccgggaggcggagcttgcagtgagcagagattgtgccactgcactccagcctgggcgacatagcgagactccgtctcaaaaaaaaaacttttttttttttttttaagtcagggtctcgctctgtcgcccaggctggagtgcagtggcatgatctcactacaacctccaactcccaggctcaagccatcctcccaccgcagcctcccaagtagctggaaccacaggcacacgccacaacgcctggctaatttttgtattttttgtagaggcaggggtctcactgtgttgcccaggctggtctcgaactcctgggcccaagaaatccacccacctcagcctgtcaagatgttgggattacaggcttgagccaccatgcctggcccatatggcaattctacgtttacttttcttagggaccgtgttaaatctttcacacatcattatttgttatttgcaacaacccaacgaggtgggcataatatactggccccttttacagaagttaagtgattcccctaaggtctcacaattagtaagatgcagacaggtttcaaacccagaactgtgtgtaaccgctaagttatgaggcttctctgagcatttattgagtaccagctatgagccagaaaactctaagaagtggataaaatgcccagataaaaggctgggaagacagccgggcacagtggtgtgacctgtagtcccagctactctgggtctgagacaggagaatttcttttttcttttcttttttttgagatggagtctcgctctgtcgcccaggctggagtgcagtggcttgatctcggctcactgcaacctccccctcgcctcctgagtttaagcaattctcctgcttcagcctcctaagtagttgggattacaggcacatgccaccacacccggctgatttttttttgttttttttttttttggtagagatggggtttcaccgtgttagccaggatggtttctatctcctgactttgtgatccgcccaccttgggctcccaaagtcctgggattacaggcgtgagccaccgcgccagggcaacaggaggatttcaagtagaaactgccaatgaaaaaagagagagagagaaggatcacttgaacccaggagttacagtccaacctgggcaacacagcaagacccagtctctaaaaaaataataaagaaacgctgagagcatggctcacgtctgtaattacagcacttcaggagaccaaggcaggcagattgcatgagcccaggaatgcgagaccagcctgggcaacatgatgaaaccacgtttctacaaaaaatacaaaaattagccaggcatggtggcacgcacctacttaggaggaggagatgggaagatcaattgagtcagggaggtagagaatgcagtgagctgtgatcacaccactgcactccagcatgggcaacagagggagacactgtcacagtgaatgaatgaatgaatgaatgaatggagactgggaagaagtataccaactttttaaaaatgttttatggggtgggtgcagtggctcatgcctgtaaccccagcactttgggatgccgacgcaggcagatcatttgaggtcaggagttcgagaccagcctggccaacatggcaaaaccccatctctaataaaaatacaaaaattagctgggcatggtggcaggtgcctgtaatcccagctactccaggggctggagcaggaggatcacttgaacctgggaggtggaggttggagtgagcagagatagtaccactgcactccagcatgggcaactgagtgagaccctgtctcaaaaaaaaaaaaaaaaaaaaaccacctaaaggtttgattagagtcaggactggattgagcgctgcctaactagtgtcgtgtacatacattagaagacacattacattaatgtttccctcttttgtggcattagcagctgctaatgagcattaccaagcttcataatccattagcggctacaaaatggtgatatgcaaattgtattccttctcttatttctggaatactttttttttccttttttttgagatggagtctcactctgtcgccaggctggagtgcagtggtgagatctcggctcactgcaacctctgcctcccaggttcaagcgattctcctgcctcagcttccccagtagctaggactacaggttcacaccaccatgccaggctaaatttttgtatttttagtagagacggggtttcaccatgttggccaggatgatctccatctcttgacctcgtgatccgcccgcctcggcctcccaaaatgctgagattacaggcgtgagccactgcaccgcccagccaggttacttttttttcctttgagacgggtcttttttttttttttttgagtcagtctcattctgtctcggctcactgcaacctccacctcctgggtttaagtgatcctcatgcctcagcctcccaggtagctgggattacaggcatatgcccagctaatttttgtgtttttagtagagatgggatttcaccacattggccaggctggtctcgaactactggcctcatgtgataaacctgctttggcctcccaaagtgctaggattacaggtgtaagacaccgtgcccagccttcttttttttgttttcttttttgtgtatttatttatttatttatttatttgagacagaatggctctgtcacccaggctggagtgcagtggcacaatctcggctcactgcaacctctgcctcccaggttcaagcaattctcctgtctcagcctcctgagtagctgggactacaggtacacaccaccatgcccggctaatttttgtatatttattatagatggggtttcaccatattggttaggctggtcttgaactcctgacctcaagtaatccacccacctcagcctcccaaagtgctaggatcaggaatttgacaccatcctggccaacatgatgaaaccccgtctctactaaaaatgcaaattctagatgggcatggtggcaagtgactgtaatccagctactcaggaggctgaagcaggagaattgcttgaacctgggggcagaagttgcagtgagccaagatcgttccattgcactccagcctgggcgatagagtgaaactccatctcaaaaataaataaataaataaataaataataaataaataaatgaaattatctgccaggcacagtggctcacgcctgtaatcctaccactttgtgaggccgaggcaggaagatcctttgagcccaggagctcaaaactagcttgggcctcatagcaagccccgtctctattatttaaaaattaaggccaggcacagtggctcacgtctttaatcccagcactttgggaggcctaggcaggtggatcacgaggtcaggagtttgagaccagcctggccaatacggtgaaactccgtctctactaaaaatacaaaaaaactagctgggcatggtggcgtgcacctgtattcccagctacttaggaggcggaggcaggagaatcgcttgaacccaggagacagaggttgcagtaagccaagattgcaccactgcactctagcctgggcaatagagggagactccatctcaaaataaaataaaataaaaaattggctgcgcgcggtggctcaggcctataatcccagcacgttgggaggccgaggcgggcagatcacgaggtcaggagatcgagaccatcctggctaacatggtgaaaccccgtctctactaaaaaatacaaaaaaatcagccgggtggggcggcgggcgcctgtagtcccagctactcgggaggctgaggcaggagaatagcgtgaacccggcaggcggaggttgcagtgagccgagatcacgccactgcactccagctgggcgacagagcgagactccgtctctaaataaataaataaataaataaataaataaataaataaataaaatatcattcgccactaaaatgaaccagggctcttcggaaaaatggttgagtccaggcctggggcaggcaaaagacaagacaagtcagcctggaagagtttgttgagccagttagtaaggaaatgccccaagatggaattagaaaatcaccatttggggccgggcgcggcggctcacgcctgttatcccagcactttgggaggccaaggagggcggatcaccaggtcaggagatcgagaccatcctggctaacacggtgaaatcccatctctactaaaaaaaaatacaaaaaattagccgggcgtggtggcgggcgcctgtagtcccagctactcggggggctgaggcaggagaatggcgtgaaccccggaggcggagcttacagtgagccgagatcgcgccactgccctccagcctgggcgacagagcaacgctccatctcaaaaaagaaaatcaccatttggttgctattatggtaataactgactcaggcaagggtcatcaattgatattaagctcttggaaacggcgtgtgttgaggaacaggctatttaattactttcgaagtatctccccagaaagcacttattaacaaagtgtaaagtcaggtgccgtggctcatgcctgaggttaggaatttaagactagcctggccaacatggcgaaaccccatctctactaaaaatacacaaattagctggacgtggtggtgcgggcctgtaatcacaactactcaggaggctgaggcaggaaaatcacttgaaccggtggcggaggttgcagtgagcagagagggcgccactgcactccagtctgggccacagaatgagactccatcgccaaaaaagaaaaaaaaaattggtcgggcgtggtggctcctgcctgtaatcccagcactttgggaggcggaagtgggcagatcacttgaagtcaggcgtttaagaccagcctgaccaacatagtgaaacctgcctctactaaaaacacaaaaattagctgggcgtggtggtgcgggcctgtaatcccagctactcgggaggtgagccaggagaatcccttgaacctgggaggcagaggttgcagtgagctgagaccacaccattgcactccagcctgggtgacagagtgagactctgtctcaaaaaaaaaaaaaaaaaattaaaattaaataaaatattaaaaacaacaacaacaacaaaacaccacagtgtaacatactaacctcacactggagaaactggcagacaccatttgaaccaagttagcacaatcgatagtggacaaaatcagcattgtatgcatcctgaaaacacaacgtcacatctgtttcctgccacaaatgcaaaatcatgagaaagtattagacaaatagcaatggaaggacttcctgcaaaattactagcctggaatttttgaaaaatattgatgtcatggagagaaggtaagattgataaaatgttccagaaagagagactaaattagagtcgttaacaacaaaatacaatgcttgatcctgggatggatttgggattttttgttttttgacacaggatcttgctctgttgcccaggctggaatgcagtggtgaggtaatggctcactgcagcccagaactcctgggctcaattgatcctctcacttcagcctcccaagtagctgggaccacaggaggatgccaccacaactggctaatatttttattttattttgtagagatggggtctcactgtgctgcccagactgatctcagactcctagacccaagagaccttcctgccttgggctcccaaagagctgggattgcagacatgactcactgtgcctggcctggactttggatttttaaaggactttattggaaacttttcttttcttttttttgagacagagtctggctgtgttgcccaggttagagtgcagtggcaagatctccgctcactgcaacctccaccttgcagattcaagcaattctcctgcctcagcctcctgagtagctggaattacaggtgcccacaacaaaacccagctaattatttgtatttttagtacagacagggtttcaccatgttggccgggctggtctcgaactcctgacctcaaatgatccaagtgctgggattacaggcatgagtcactgcacctggcctttgaatgggctctgggaattacatgataatattagatgaacattaattttctgattttgaaggttatactgtgattatgtgcaaaagtgtgcttatactaagtgaacatatagtgcagtatttttttaaaaattgatctgtcttagagatgggggtgggtgagtttactatgttgcccagactggcctcgaactcctgggctcaagtgatcctcttgcctcagcctccagagcagctgggactacaggcctgggccaccacacttggctaacttttattttattttattttattatttatttatttatgtatttatttgagacagagtctcactctgtcacccaggctggagtgcagtggcgcgatgtcggctcactgcaagctctgcctcccgggttcacgccattcctctgcctcagcctcccgagtagctgggactacaggcgcccgccaccacgcccggctaatttttttgtatttttagtagagacggggtttcaccgtgttagccaggatggtctcgatctcctgacctcgtgatccgcccgcctcggcttcccaaagtgctaggattacaggcgtgagccaccgcgcccatccttttaaattttttgtagagacgggaactcaccatgttgcccaggctggtccccaacatctggcctcaagcgatccttccgtctcggcctcccaaagtgctccgattacaggcatgagccactgcacccggccagtctcaaaaaaaaaaaagttaaattctgcagaggttttatttattagaggacgctggccgtctgcaggtggcgcagcagcaccccctcgtgcctggggcggggctggggcggggccagtgctggggcggagccggagctgggggcggagccaagacgcggcaggggcggagccagcagctgcggcacagcggggcctgtgcggcccaagtcgtccctgtggcctccggccccgcctcttagggcgggacgtgcaaggcgattggcgaatgcaggcgagaggcggtcgctattggtccgcggcgctgtcggctcggcgggcggtgcccggacgcaggtgccggccggagcggagctagtggcgccgacgggccgggccgggccgggaccggggccgaggcgaaccgaggggcctgtgcggccgcccggcccggccgcggatcaggtaggcacgggcctgcaggtagggccggaggacgccagtccgcgggccggccccgggttcgaggccggagctcggcacccgggcgggacggctgggctcgatcccttggccacagccttctcggggacgcggggacctcagttcccgtgtcaaggccggtgggaggtctccggggtccggcacacataggcgcctctccgagcctcggtttccccacctgtgaaactgggtcatcccattgccaacctgatggggcttctgggaggattcaggaggtggctggtgcagaaaacgcctgacacacagtaggcaactgctaagtggccaatgcccttccccaacctccttctcagagcggctctgcctgcaaaatagtaagttataatataatgacccagccactttgcacaaagatgctgaaacaggatgccctgtgctatgtgggtgctcaaaacggggtagtcaaatgggcatgttgagctcattcagttcttttgaaaccatactgagtaggtggaagcagtagaaatgtcccctgttatacagttgagagagtccaggctcaaagaggttaagtgtcttgcccagggccacacagcacataaggagtagagctgggattggaaccttgcttctcatgcagggaggaatgaatgcaataacaacctccacatttaccctaaaaaatattaatagagcttttattgagcacttactgtgtgtgccagggttgactgtgtgacctctcatcaacaactctgtaagctgatgatagtaattataataagagctaatagttattaacttcttaattttttactaatttatgaactacatatcattatgactccccgtcttttttttttttagacagagtctctctctcttgcccaggctggaatgcagtggcacgatctgagctcattgcaacctctgcctcccagattcaagcgattcctacctcaccctggtcaagtagttgggattacaggcccccgccaccgtgcctggccaatttttgtctttttagcagaaacggggtttcaccatgttgaccaggctggtctcgaactcctggcctcaagtgatccaccttccttgaactcccaaagtgcacaaagtgctgggattacaggcgtgagccactgcgcccggcctgtaacactcattttagagatgataatactgaggctgagagagtaaaacagctgcctgagaccacaatgtagggagttttagggccctctgattcctctgccctctgtttcctaccttcaggaaaaggagcctgggcaggtatggaaaagactggggggcctcagtgccaccctaaacaagcctagctaagggtgagctttactggatgaattcagcctggaggctccttctcaggagacccctccacggacagagtccaccagctccatcattaga

SEQ ID NO: 1374 - DNA, 20001 bp, Homo sapiens
tgaacaaaaatacgttgaagagtgtcttttatttttattttatttgttttagagacagggttttcttacgttgtccatgctagttttgaacctctgagctcaagcaatcttcctgcccagccttcctaaatgctagtattggaggcatgagccaccgtactcaacccatgtgttttatttttagatattcttggatttgccagttttactttttaatttctagttttattcagttttggtcagaaaacaaagtgtatgattttggtcttcttatttattgtcgttttgagacaggatcatatttatcacccatgctggagtacattgacataaatttgactcactgcaacctcagcctccttgactcaagcgatctttccacctcagcctcctatgtagctgagactacagacatgcactaccatgcctcgctaatttttttggttatttgtagtaatgggtctcactagacagggtctcactgtgttactcaggctggtgtcaatcttctgatcccaagtgatcctcccaccttcatcttccaaattattgggattgtaggtaccaaccacacatccagccagtatttaataagacttgttatgtgtcctaacagaatacatcaggtgcaaataagaacattgtgttgtttcttgcttttaactgaaaagttttgtacctatctgttaagcctagttggtctgtggtatggtttggatgtctatgtcctgcaaacctcatgctgcagtgtaatcctcaatgttagatgtgaaacctggtgggaggtgtttgggtcatggggacaaattcttcatgaatgcctttgtgctatcctggtcatgagaaagttttcactccattaattcaaatgagaactggttcatttaaagaaactgactccttcacctcacgcttgccgtctcttaccatgtgatatgtccagttactctttgtcttccaccatgattgtaagtttcctgagaccctcaccagaagcagatgctgttacacccttcttgtacagtctgctgagctgtgagccaaataaaccttctttctttataagttatacactcaggtattcctctttatgcaaaatagttaatacagtctataatgtctgttttctgttttcttattgatcttttatctgaattttctatttattattgcaaatgatgtcttgatctctacaattatgttgctatgtatttcttgcttcacctttgccaaaatttgctttgtatattttggaaacctcatgttatatatacagacacatatacatataaatagatatgatagttatagattcctggtaaattgacccatttgaccattatgtaatactgtgtttgtcctatgctagtacttgacttaaaatacatccaatataattattaccacctcatccaattgtggttactatttgcatggaatatagttttttttccattctgttactttcaacctatttgacttaatgctaaaatgagtctcttatagacagcaaattgtatgctttttaacttaagccactaagccatcttattttttctttttataaatttatttatttttgagataaagtctcactctgtcaaccaggctggtttgcagtggcatgatcatgactcactgcagcctcaacctcccaaactcagatgatctcatttcagcttcttgagtagctgggttgcaaatatttgccatcccaagcccagatagttttttgtacctttttctgtagatacaattttttgccctgttgtctaggttggtctcaaactcctgagttaaagtgatcagattcctcaacctccaaaagttctgagattacattttttaaataagtagtttaattaatttatatttaaaatgactgcttaaagatataaagttactattaccagtttcattgttgttttttttttaatttaatttaatgtaatttaattttatttcaggatacatgtgcaggatgtgcaggtttgttacataagtaaacgtgtgccatggtggtttgctgcacttattaacccctcacctcggtgataagccctgcatgcattagctatttatcctgattctctccctcccctgcaacaggccccagtgtgtgttgtttccccccatatgtcatgtgttcttattgttcagtttccacttataagtgagaacatgtcgtgtttggttttctgttcctgtgttagtttgctgaaaataatggcttccagctccatctctgtctttgcaaagtacatgatgttgttccttttttatggctgcatagtagtctatggtgcatacgtaccacgttttctttatccagtctgtcacagatgggcatttgggttgatgccatgtctttgctattgtgaattgtgctgcagtgaagatacacatccatgtatctttacagtagaatgatttatattcctttggtatatacccagtataatgggatcgttgggtccaatagtatatctggttctaggtctttgaggaatcgccatactggctttcacaatggttgaactaatttacattcccaccaaaagtataaaagcatttctatttctccatagcctcaccaacatctgttgtttcttggctttttagtaatcaccattttgatggcatgaaatggtatctcattgtagttttgatttgcatttgtttaatgatcactgatgttgagctttttttcatgttttattggccacataaatgtcttcttttgaggcgtgtttcttcttgttctttgcttactttttaatgaggttgtttgttttattcttgtaaatttgtttaagttctttgtagactctggatattagcttttgtcagatggatagattgcaaaaatgttctcccattctgtagattgtctgttcactctgacaatttattttgctgtgcagaagctctttaattagataccatttgtcaatgtttgcttttgttgcaattgcttttgacgctttcctcatgaaatctttgcccatgcctatgtcctgaatggtattgcctaaattttattttagggttcttgtagttttgggtttcaaatttaagttttcaattcatcttgagttaatttttgtataagtgtaagaaagggggtccagtttcagttttctgcctatggctagctagttctcccagcaccatttattaaaagggaatccttttcccatttcttgtttttgtcaggtttttcaaagatcagatggttgtagatatgcagtcttagatttctgagttctctattctgttccattggtctatgtgtctgtttttataacagtaccaggcagctttggttactatagccttctagtatagtttgaagttggatatcatgatgcctccagctttgttctttttgcttaggattctcttggctatatggggtcttttggggtttcatatgaattttaaaatagtttttttctaattctgtgaagaatatcagtagtagtttagtcagaatagcatggaatctataaattactttgagcagtatggccatttttacaatattgattctttctgtctttttgtttgtgtcctctctgattttcttgtgcagcggtttgtagttctccttgaagaggtctatcacttcccttgttagctgtattccttggtactttattctctttgtagcagttgtgaatgggagtttattcatgatttggctgtctgcttgtttatggttggtgtattgaaatgcttgtgatttttgcacattgattttgtatcctgagactttgctgaagttgcttattagatgaagaagcttttgggctgagacaatggggctttctagatctaggatcatgctgtctgcaaacatgtcgtctgcaagcttctgcagacagaagtttgacttcctaattgaatactgcttatttatttctcttgcctgatttcgctggctggaacttccaatactatgttaaataggagtggtgagagggcatccttgtctagtgctagttttcaaggggaatgcttccagtttttgcccttttagtatgatattggctgtgagtttgtcatagatagttcttactattttgatgtatgttccatgaatacctagtttattgagagtttttaacatgaagggatgttgaatttgatcgaaggccttttctgcatctattgagataatcgtgtggtttttgtctttaaatctgtttatgtgatgaattatgtttatcgagttttgtatgttgaactagccttgcatcccaggaataaagctgacttgattgtggtggataagctttttaatgtgttgctagattcagtttgcaagtattttattgagaatgtttgtattaatgtttatcagggatattggcttgaaggtttttttgtttgtttgtttttgttatatctctgccaggtcttgatatcaggatgatgctggcctcatagaatgagttaaggagaggcccctccttttctatcatttggaatagtttcagaagaaatagtactctttgtacctctggtagaatttagctataaattcatctggccctggactttttatggttggtaggctattggctatttgttaccgcctcagtgtcagaacttgttataggtctattcagggattcaacttcttcctgttcagacttgaaaggatggatatgtccagcagtttatccatttcttctagattttccagtttttgtgcacagaggtgtttatagtgttttctgaaagttgtttttatttctatggggtcagtggtgatatcccctttatcattttttattgtctatttcattcatctctctttatagctagtgtctattttattaattttgtcaaaaaaacagctcctggattcattgatttttttttttgaatggtttttttgtgtctctgtgtccttcacttccagtctgaatctggttatttcttgtcttctgctagctttaaggtttgtttgctcttggttttctcgttcttttagttgtgatgttagggtgtccatttgagatctttctggctttttcatttgggtatttagtgctataaatttccccatgaacactgctttagctgtatgccagagattctggtacattgtctcttcattctcattggtttcaaatagtttttttatttctgattttttttttttttttttttttttgagacggagtctcgctctgtcgcccaggctggagtgcagtggcgcgatctcggctcactgcaatctctgcctcccagattcaagtgattctcctgcctcagcctcccaagtagctgggattaccagcacccaccaccatgctgggctaatattatgtatctttagtagacatggtgtgtttcaccatgtttgccaggcttgtctcgaactcctgacctcaggtgatctgcctacctcggcctcccaaagtgctgggattacaggtgtgagccaccatgcccagccaaagcctacagcacccggtattcccaggtggtctcccctccaagtcccagcaaggcccgaccctgcttagcttccgagattgggcacggtcagaagggtgtggctgtggatgccagcctctgatttaattttattatttagccagaagtcattcagtagcaggttgctcaatttccatgtagttgtgtggttttgagtgagtttcttactcgtgagtttttttgttttgtttttgtttgtttgtttgtttgtttgtttgagacagagtgttacactgtcacccaggctggggtgcagtggcatgttatgatttcagttcttttgcatttgctgagaagtgttttacttccaattatgttacaattttttttcttttcttttttcttcttttttttttttgagaccgagtctcgctctgtcacccaggctggagtgcaatggcacaatcttggctcactgtaacctccacctcccaggttcaagcgattctcctgtctcagcctcctgagtagctgggattacaggcacatactgccacgcctggctaattttttttgtatttttagtacagacggggtttctctgtgttccccaggctggatttgaactcttgagttcaggcaatccacccaccttggcctcccaaagtgctagggttacaagcgtgagccaccatgcccagccatatgatcaattttagagtaagtgccatgtggaacttagaagaatgtgtattgtgttgtttgtggctggagagttctgtagatatctgtcaggtccacttgacccacagctgagttcaagccttgttacttttctgtctcaatgatctgtctaatattaacagtggggtgttaaagactctcactattattatgtggaagtctaagtctctttatagttctctaagaatgtgttttatgaatctgggtgctccttgaattgatctctttaccattatgtaacgtacttctttgtcttttttgatctttgttggtttaaagtttgttttgtcagaaactgtgattgcaggctgggctcggtggctcacgcctgtaatcccagcactttgggaggccaaggtggacagatcacaaggtcaggagatcgagaccatcctagctaacacagtgaaacctcgtctactaaaaatacaaaaaattagccaggtgtggtggcgggtgcctgtagtcccagctacttgggaggctgaggcgggagaatgacatgaacccaggagatggagcttgcagtgagctgagatcgcaccactgcactcgaacctaggtgacagagcgagactccatctcaaaaaaaaaaaaaaaagaaactatgattgcaacccctgcttttttttctgcttttatttgctttgtaattttcctccattctttaatttgagcctacatttgtcttttcatgcgaagtgggtctcttgaatacagcacacaaatgggtcatgactctttatccagtttgcccttctatgtctttcaattgaggcattcagcctattacatttaaggctaatattgttatgtttgattttgattctatccaagtggtgctagctgcttattttgcagagtcgttgatgtagttgttttatagcatcattcatctttgtacttcactttgtttttgcagtggctggtaatggtttttttcttcccatatttagtgcttccttaatagctctatctagcaaggcaggcctggtggtcatgtattccttcagcatttgcttctctgaaaagaattttatttttctccagttacaaagacttagtagtgttattttattgttttatttgattcttgtatctttgttcctcattttctctttttctgtctctgtgtcttttttatacttatcttgatatgcttttacttctttcttattttgttttgtgtatctattcagatatattcttggtggtatattaggaattacataatacctctaaaagataaaacagtgtattttaatctggtaaaaaatgaacttcagctggattcataaattttttctcattatatctgccctcaaatttgtcattgatgttgctaatcatatattttatgttgtatatcattaacaaatgtttataatgatttctattcttttacctttcaaattttagagaataattaaaaatgttttttgtgccattattataatgctaagaaattccatttttgtgtatgtgcatgtttccctagaaaataatgtatttatatgataaaattattatttataaaattactttatttaatcgtattattttcagtagaagcaactgctttcagcatcttttatgtttagggcatatgaagtgccaatattttttttcagaatttggttatttttgaaggtttttttctttttattgggcaggactggtattattctcacttgatagctatttttttttaggactttggctatatcacagtttccttctggcctgcaaagcttttgttgacagttcactgactatcttataagactgtgcttgtaaatgacatgccatttttatcttgcagctccattctcttcttgtctgtggtttttgaaattgtgcttatatatgtgtttgttataaatatctttgtgtgtatcctaattgtttgttgagcttcttcattttgacaatattttttctttcagaatttttgagttatattttcttttgatattttttacctttacaatttctgttttttggatattttaaatatttttttcttatcagttttttctggttttctatagttctctgtattcctattttactcattgagtattcaatttatttttaatttttaaaattaatatatacatcttttttatggtttctttctgaaaattttataatatttttgatagaaccattttgccctattttgtattcattgtaatctttgattaaaatttagacattaaataaagctacctgacacagtttttatcttgtagctttctcctggcatagtctgaaaacaattatcttggttagagatcctggtagactctcaaacatgttcttagaatgtatcttgtctaaaattttgtgtttactttttagttaaaggagtttatttctgcttcatcttaatcagtaaccatttgctctgttttctgtctgttgtactgcagtctctctgctgctgtaacaattacctttggtctcaagacccaaactataactccaaaatataccaccatttttttcagcactttatgttacgggagaccagtttctggaaaggcccctagaagcaagtaatatagatgtatgtgccagtattttacttgtttattaaaaaagaaaccaaaagttagcaatttactttgaaaggcagtatgttatattgttgagtaggaagaactgtgttgggcaaaggtaatggacttttctttttcttctgtgtctttgcattcctgtgtactcatctgtgtactcacctggggaactttacatgcttatttataagttttccttatgtattttggtcagtatgcttttattacatttatatgtctatgaaggatttagggcctgtggtattttattatggcatcttgcttatgtagtttgtataatataggttagatttgtaaagtatgtttatcagagtctagtaagttgaataatttgttgtttgtatttctttcagctatgtgttcttcttttaccagagacctttggccagagcaagacataaaagattcttttcaacaagtgatactgagaagacatggcaaatgtgaacatgagaatttacagttaagaaaaggctccgcaaatgtggttgagtgtaaggtgtacaaaaaaggttatgaactaaaccagtgtttgacaactacccagagcaaaatatttccatgtgataaatatataaaagtctttcataaaattttcaattcaaatagacacaagacaagacatactggagagaaacctttcaaatgtaaaaaatgtgatgaatcattttgcatgcttttacacctacatcaacataaaagaattcatattagagagaattcttaccaatgtgaagaatgtgacaaagtgtttaagcggttctcaacccttactagacacaagagagttcatactggagagaaacccttcaaatgtgaagaatgtggcaaagcttttaagcactcctcaacccttactacacataagatgattcatactggagagaaaccctacagatgtgaagaatgtggcaaagccttctaccattcttcacaccttactacacataaggtaattcatactggagagaagcccttcaaatgtgaagaatgtggtaaagcttttaaccacccttcagcccttactacacataagttcattcatgttaaagaaaaaccctacaaatgtgaagaatgtgacaaagcttttaaccgattctcataccttactaaacataagataattcattctggagagaaatcttacaaatgtgaacaatgtggcaaaggctttaactggtcttcaacccttacaaaacataaaagaattcatactggagagaaaccctacaaatgtgaagaatgtggcaaagcctttaatgtgtcttcacaccttactacacataagatgattcatactggagagaaaccctacaaatgtgaagaatgtggcaaagcctttaaccactcctcaaaacttactatacataagataattcatactggagagaaaccttacaaatgtgaagaatgtggcaaagcttttaaccaatcctcaaaccttaccaaacataagataattcatactggagagaaactctacaaatgtgaagaatgtggcaaagcttttaaccgatcctcaaaccttactacacataagagaattcacactggagagaaaccctacaaatgtgaagaatgtggcaaagctttcaaccgatcctcaaaccttactaaacataacataattcatactggagagaaatcttacaaatgtgaagaatgtggtaaagcctttaaccaatcctcaactcttactaaacataggaaaattcagcagggcatggtggctcatgcctgtaatcccaacactttgagaggactaggtgagcagatcgcgaggtcaggagttcaagaccagcctggccaacatggtaaaaccccatctctactaaaaatacaaaaatttgctgggtgtggtggcaggcgcctgtaatcccagctacttgggaggcagaggcaggagaatcatttgaacctgggaggcagaggttgcagtgagccaagatcgcgccattctactccagcctgggccacaaggcaagactctgtctcaaaaaaaaaaaaaaaaagaaaagaaaattcatactggaacgaaaccctacaattgtgaagaatgtgccagtgctttcaaccagtcctcgaacctttttaagaaaataatttatactggagagaaattctacaaatgtgaagaatatggcaaagcctttaaccagtcttcaactcttactaggcattaaaaattcatactgtacagaaaccctacgagggtgaaaaacatggcaaagcctttaacaagccctcaattcttaacagacataacataattcatactggaaagaaactctgcaaaccagaaagatctggcaatgcttttgacaacacctcaaacttttctaaccataaaagaaattatactggtgagaaatcttagaaatctgaagaatgagacaaagcctttaaatggttgtcacacttgattgtaggtaagataattcatactggagaaaacacctacatgtgtgaacaatgtggcaaaacttaaccagtgctcacaccttattgcacaggaaagcatttgtacttgagataaattatacaaatataaagactgaaaaagccattaatatatgttcatatctcaacaccagatagttcatacttaataaaagcattataagtacaattactgtcaaaagacctttcagaaaatacaagcttttgaccaggcgtggtggctcaggcctataatcccagcactttggtaggccaaggcaggtggatcatgaggtcaggagtttgagaccagcctatccaagatggtgaaaccccatctctactaaaaatacaacaattagccggttgcggtggtggtgcctgtaatcccagctactcaagaggctgaggcaggagaatcacttgaacttggggagggagaggttgcagtgagctgagattgcactctagcctgggccacagagcaagactccatctaaaaagtaaaaaaaaaagaaaatatgaactttacagtgaagaatatttattttgaagatgaatgttacaaatataaagtgggtagtagtgcctttacttgtatcacagatcttattgtagacattttttgtagaggaaaaactctgaagcactttcacactttgttcaatatcagggaatttatattgaagaaaaatcatgcaaatgtagtaaatttggaaaaacactttttcaaaaactacagcttagaaaacagagttcatactagaatatatttttgcagatgcagtaaaagttaaaaaaaatttaatccataagtaagtctgtgtaaatatcagaatttatggtagaaatacataaggcactgacaacatcagatatactaaatcagagggctgagtatagaaaattaaagttggtagaaaaattatttgtatataactttaagaggatcagaaggttttttgcagttataattacattcaaagtatactttatttcttgaaaaatattacagattttttgaaaagtgaataatgatgtcattcaactctgaaattcctgccgtttcttcattcctattggattcacatgtgaaagcatgggatcaattattgctgtatcaaagatatgaaagattctttctttgttttgttctgtttttttgagatggagttttgctctttcgtccaggctggagcacagtggcatgatctcggctcactgcaaccttcaatttccagtttcaagcgattctcctccctcagcctcctgagtagctgggattacaggcgcatatcaccacgcccagctaatttttatgtttctagtacagacaggatttcatcatgttggccaggctggtctcaaactcctcaccttgtgatccacccaccttggcctccaaaggtgctgggattacacaggcatgagccactgctcctggcaagagattcttttttattaggtgggcattatttgtgatcttttctattgaaaagtaaaaacattagaatgtaagatgcataatgaaaatgtaagtggagaggttctttggggttaacttataatattgagtggtgcatgaggttggtgttcagagtaatattctgcattatgaaaaaacatttaattttatttaaaatttagtttatcatactaattgtacttttatataagatgcagtacatttttaaaattttagattgtgtgaagttaatagtttaacatttttaacatgttaaatactattgtgcattcaatgaagcattattataccacaaactttaccctgttccaccttactgaagggtataggtaaaagatggtaacgatatactatttagtaacataatggattaacatctctagtaattttttttgccagtggctttaaaccgcaaataagttaaagaatattgtttctgtaggttaaatttttattttgtttttaatcatttaaatttaattttggtgggtacataatatgagtatatatttatgcacttatatggcatattttagtacaggaatacaatatataatagtagcatcagggttaagtgaggcatccttcacccatagcatttctcctttgttttacaaacaatccaaacctacactttttaaaaattttttgttgttgttgttcttgttgttgttgagacggagtctcgctctgtcgcccaggctggagtgtgcaatctcggctcactgcaagctccacttcccgggttcacgccattttcctgcctcagcctcccaagcagctaggactacaggcgcccaccaccatgcccggctaattttttgtatttttagtagagatggggtttcaccatgttagccaggatggtctcaatctcctgacctcgtgatctggtctcgatctcctgacctcatgatctgcctgccttgacctcccaaagtgctgggattacaggcatgagccaccgtgcccggccactttttataaattttaaaatgtacaattgttatttactatagagttatttttatggtcataatacaaattatatatgagtataaataaaattcatttctaaactattaatattttttccaaattgttatatatttttctttgaacatgtggcctgtctgcctgcaaacatgcagactttttgattcacatagagttaaatatgtattagtctaaagacaaactttaggtgtaagaaaattatggaataagtgtgtgtgtgtgagtatgagtttgtacctattttcagaaaagaacaatatgggaataaaaatcattttaataaggtggctactataaaactaaaaaccttaaaaaatgctgaaagcaaatgtatactttgtgctttgtattgaatttattactgtacaatccatgacttacagttctgaaccttttcatgcaaattctctgtatatacttgcctggtactcatgctagacccatactttttttgtttcttacattttttttgttttatggtttaggaagtattcattatatgagctggtctgtgattataagaatttttatgaaatttagtgcacacaaaataatttttagatgtaattccaaaagtagtgtattaagttacattttatttagtgagagcactccattttgttcttttaaggggagaacaatatataagttttcttttctttagtgattgttcctttcactttttataattgacataagtatatttatttattgagtcaatttgttcaggtaagtactggggggcttcataagtcatgaggatgtttttatatataaatgtagcaaacatacattacagttcttactgtgtaatcgatgctccataataattcacaaatattcctgctggagttagtttgtaatttcaagtcagaaatgaaagatatcagtggtgaagaaataagattgattcttcatatggagtggacattttttccagactataaaactgaatcttgctgaatttaaagagaaattctggccgaggcagatggatcacctgaggttaggagtttcagaccagcctggtgaaacccggtctctactaataaactacaaaaattagctgattgtggtggcatccacctgtagcccagctactcaggaggctgaggcagaagaattgcttgaacccaggaggcgaagattgtggtgagccgagattgtgccattgcactacagcctgggtgacagaatgagactcataaaaaaaaaaataaattctgcttcttttattttctacttctcttcagatttgtttctcgtatgtattttccaactatgtatgcatcacagcccttctttttctgagttatagctacagttttctgactgttctcttcacgccatttcatttcgcctggtattttgtagattttgatgacaaaattctatttttagtgcacttaaaaatggattttaactggtgagttcgcttatcaatataacattcagattagttaattaagataaaagccaggtgtggtggctcacgcctctaatcccagcactttgagaggccgaggcaagtggatcacttgagctcaggagttcgagaccagcctgaccaacatggtgaaaccccgtgtctactacaaatacaaaattagccacatgttgtggcgcatgcctgtaatcccagctactcgggaggctgatgcaggagaatcgcttgaacccaggaggcagaggttgcagtgagccgaaattgcgccattgcactccagcctggacaagagcaaaactctgtctcaaaaaaaaaaaaaaaaaaagattaaaggcgcacactgtccacaggcaagaggattaaattagcattgcatttctttgtttttaaaagaaaaatcttattagattcttatacaaagtgtggcaaatataaaacttgcttgaaaatatggaaattaaatttttaagagagttaatagtaaacgaatttaattttctttttttatttttactttttattttttagagacagagtcttgctctgtctcccaggctagagtacagtggtgtgatcttggctcactgcaagctccgccttccgggttcacgccattctcccgcctcagcctcccgagtagctgggactacaggcgcccgctaccgcacccgtctaatttttttgtatttttagtagagacgggatttcaccatgttagccaggatggtctcaatctcctgacctcgtgatccgcccgcctcgacctcccaaagtggtgggattacaggcatgagccacagtgcccggccacgaatttaattttctatgatataattacagcacaatttacatttccgtgcagaatcttttaagtgtggtggtaaagattgcaaaataataaaatgacctctgaatttaaaatttagaaaaatatgtcttttctatattgattttacaatttggagaaatttctcttattttttatattttttcttttagtgggagaagtttagtctacggtttttatttttagtcaccaagctgtagccaactcctgggtcattttctctgaaaaacatttggagatcatgacaagttttggattaaaacattctgttattttgcatgcaaactagtttactgtgttcacagactggccagtcatgggaccataagcaacacctgcccctttagtggctttcataccattaccaccagtaccagaaactccaggtggcccaagcttaaagtaaaaatcctaaagtacattggcttctcccatgcaatgtgctgggtccaaaccatgctgttaaatatcagagttcctatggttatgactgacaaatgacaataatagccccaaaatacatatttttgatactatttagccaagattaccacaaagatacagtatttgacacattcttattctataacattttgaaaatattttctcttgacagataaaaatgtgtactttttctgtagaacataatattttgaacatgctgttaaatatcagagttcctatgattatgactaaaaaattaaatgacaatagtccccaaactatgtattttcatactatttagccaaagtaatcacaaagacacagtatttgacacattgttattcttttatgtcttaaaaatattttctttcaacttgagaaaatgtgtgctttttctgtagaacatattttgaagtatatatacattgttattatttctaggtaattaatacctcacatagttaacatttttgtggtgagaccacgtcttatcatttttcaaaaatccaaatacattattatgaactatagtcaccatgttgtacaataaatctcttgaacttatttctcctatttgactataattacttattatttgacagactttccaaacccccatttcttctaaataccttggcatctgatggtcaccattttactctatacatcaatgggattaagatttttggaatccatgtataggtgaaatcatgaaatattaatctttctgtgcctggcctatcccaactaatataatgtcctccagcttaatctatgtaatttaaaataatataatttttttcttttttttttttttttttaaggccaggtgtggtgtcttacacctgtaatcccagcactgtgggaagccagggcaggtggattgcttgagcccaggagtttgagaccagcctggtcaacatggaaaatccccgtctctacaaaaaaaaaaaaaaaatctcagctgggcatgggcatggtagtgcatgcctgtaatcccagctactccagaggctgaggcatgagaatcccttgagccagggatgcagaggttgcagtgaactgagattgtgccactgcatccagcctgggtaacagagtgagactccgtctcaagagaaaaggaattttcttattttaaaaataatattctgttgtgtatatctaccacattgtcttcatttactcattagatgttaaactgtttattctgtattttggctattgtgaaaagtgctacaaacagaattgcaaatgtttcttcattctgattttatttgttttggatatatatccagtagtgcaattgctgttatgacatggtagtttaagttttttgagaaatctctattttgtttttcataatggctgtcttcatttacattccaaaccaacagtgtgcaagccttcccttttcttcacatctttaccaacgctttttctttttaataagagtcattctaacaggaacgagttgatatctcctagttttgttttttcttttttggcttgcctttttgtgataattgacattgagcatttttaaatatatcagttggccattatgtatgtattttcttgaaaaatacttatttcagctacttatttttaatagttacttatttttgttgtattgtcatttgagttttgtatatatttttgatattaaccccttgtcacatgtataatttgcaaatattttctccctttttttagttgtcacattctgttcattgtatcagattctgtgcagcagctttttaatttgaagtgatctgactgacttgttcttccttttgtgtcctgggatatttaggttaaatcaaaaaacttgctgcccagaccaatgttatggggctttcactctattttttggtagtagtagtttaagagttttaggccttacatttaagtggctaatttattttgagtttatttttacatatggtgtgagatgagggtctcacttttttttctctgcatgtggacataaagttttctaaacatcatttattgaagatactgttatttcccttaaaaaaaaaagtcacctgtatttaaaatcagttagctgtaaatacactgatatatttctgctctctttttcttctgctccattggcctatatctctgtttttattcaagtgacatactgttttggttaccacagttttgtagtgtatttcaaagtcagggtgataccttcttttgtcttgattgctttggctatttagggtgttttgtggtaacatatgaattttagatatgctttttaaaaatgtctatgaagtatgtcactggtattttgatagaggttgcattatatctgcagatcattttgtgtaatacaaatatttaactattaaaaatgccagttcatgaatgagtaatattattccatttatgtgttacttaatttgtataatgttctttagagtagaatgtaaggtgtttcaactttttggttaaatttacttcaaactatagttaggtagatggaatttttttgaatttcattttgagatagttactaatgtatagaaatgctatgactttttgatgatgtttttgtattttgaaagtttaataaattttgtttgtttattttttgttgttgttgttgtttcaaatggagtctcagtctatcgcccaggctggaatacagtggtgcattttactttgcaagcttttacaccatctcactggagtcagtttgttgttgtttttgttgcttgtcttttgggatactgtagcaggattgataagaaatcagagagactgatggggttgaggaggatatttattatttaggtgcactggcctagtcggattaacatccaaaggactgagccctgaacaaagagttaagttaccctttaagcattttgtgggatggcagggggagatctgtgcagggagaagcatattacagaagcgagaaacaaagacagttattcaattaattgtgacatgcattacataattttttactttccaaggaaaaacatgttttacaacttgagtttatctatctagtgaccttgcagctgcacagctagagaaacagggtcttcaaaatgcctgggaaaggaggagagataagccttgctagccacagaaaaacaggccgttaatttttaaaggactccagctctttctctttctcaggaggaattgggttttcttacatacaactgagtttctgcttacacattctttaatttcttttaatttctgttccaatactatttttttggtcacaaatttttcactttttttttttctttctttgaaacggatctcactctgttgcccaggctggagtgcagtggcgtgatcttggctcactgcaagctctgcctcccagattcacaccattctcctgcctcagcctcctgagtagctgggactgcaggtgcccaccaccacacctggctaattttttgtatttttagtagagactgggtttcactgtgttagccaggatggtctcaatctcctgacctcgtgctctgcctgcctt

SEQ ID NO: 1375 - DNA, 66379 bp, Homo sapiens
ccaaaacattcaatgaggaaagagtagtcttttcaagaaatggcactggggtaactaccatttgaggcatttgaacttgtcccatttctgtccccctgccccagttctgtagtagtctaggaaaacatcaacctcctaaccataataggtgtgaaaaccaacagtgtcacagccactcaaggagcaatgaggaaccacatgcagaaaaacgaagttggactcctacctcaaaccatatacaacacatagtcagaagtattcagaaatgtaagagttaaaattataaaactgttagaagaaaatataacagtaaatcatcatgactctagattaggcaatgatttcttgattatgaaaccaaaagcacaagcagcagaggaaaaaaatagataaattgaacttcatcttacttaaaaattttaaacaacactatcaagaaactgaaaatacagcccacagaatgggaaaacaaagcatttgcaaatcatgtaccttgtaagggtcttgtatccagactaggtaagtagccttaaacttaatgataaaaagatatccagtctattattgatttataatcctttgggtatatacccagaacttaagtataataaaaaaagataaataactcaattaaaaatgaccaaagtatttaaatagacattcctccaaaaaagatatacaaatgactaataagcatatgagaagctgctcaatatcatcagtcattaggaaaatgtaagtcaaaaccacagcaaggtaccacttcatgctcactaggatggctaaatttagagacagaaaataacaagtacttgcaaagctgcagagaaattaaaatcattatacattgctgatggtattataaatcgtttaacagttcttcaaaattgtaaatggaagttaccatatgactcaacatttctactccttggtatttatcaaagagaaatgaaaacagatttccacagaaaaacttatatgctaatactcatagtggtagccaaaatgtgaaaacaaccaaaatattcattaattaattaatggataaataaaatatatctacataatagaatgacaagaaaaaggaatgaaatactgatatatactatgattgggtgaaaatattttgctaaatcaaagcagccagtaacaaaagatcagttatagtataattttatttatatacaatgtccagaataggaaaatccatagagaaagattagcatttgccagaggttgaggtaggggtgtagggactactaatggctatagaatttcttttagggatgatgaaaaggttctaaaatgagatagtggtggtggttacatgactgtgagtatactaaaatccacttaattgtacactttaaaaaggtgaattttatgatatgtgaactatatctgtacaataaagctgttattaaatacctatgatgataaaagagaaaagaccatttcccaatttttttaatataattatcaactttggacagagtaaaacacctagaaaggatatgtttagtgtatccatgagggtcaagaaacccaacatttgatgctgttatcactgttcttgttatggtgtggggcatagttcactttcacagtgagtggggcagctcactaaagccggggctcccttgctcttctttgtctcctcccatgacaccctactccaggcacctgccataaagccttgaaaatataaggaccttaataagtaataggtgagtaaattggctaaccggtgaatgaatgcaaatcattaaagaggaatgtgaagtagtggtgttgatgatgatgatgatgatgataatggcgatgatgataataatgatgatggtgatgatgttgctgatcaaggtgatggtaagatgatgatgatgatggttatgatgatggtgatggtgatagtgataattaccatctttgtccctattaacaaatggtggtgatgataataatgatggtgatgatgatggtggtgatgatggtgatggtgatgatggtaatgatggtggtgatggtgatgatgatgatagtggtgatgaggatgacaatactgatgatgatgacagtgataagtagtagtagtatttctgtagaggctatcaagattagctttgaaagaactcttcagagataaattctaaaagccatttatgcaatggataaattgccaaaatcagtgttaaccttccaaagggttctactgtaaagctcagctctcgtacaaaagtctatggcttttaaaaatatttattaatacttttccagctgatatgtaaggcttagcaaagaggctgggcacggtggctcacacctgtaatcccagcactttgggaggccgaagacagtggatctcttgaggtcagaagttcgagaccagcctggtcaacgtggtgaaacctgtgtctactaaatatacaaaaattagccaggcatggtggtgggtgcctataatcctggctcctcgggaggctgaagcaggagaattgcttaaactcgggaggcagaggttgcagtgagccgagatcatgccactgcactccagcctgggtaacaagaacaaaacttcgtctcaaaataaataaataaataaataaataaataaataaataaataaataaaatttaaaaaagagttagcaaataaggtgaacacaaaaaagcgattttaaaaccatttttcaaattttactactctttgatatttatttgtgtcctttccttcccttaacattagtttttatattttagaggaaagaactcaggtgaagaccatagctggtcctcctgtgtcactgggttatgtctgtccttgactaccagcaaggcctcctgctattggttagatttctgatgtaccatactcttttgtcctgtcctctagtattttgggtcaagtgaagggaaagtcactgagtctgcttgttcccaaatgtctcacctcaaatcttctcctcattttctctctccacctgctttctcttcccccattgtctttttctgtaagtgagaagggtagaggggacacggagccagcccccttttcaaactcagaaaacaaggcttaccaacacacatagagaatattttttaaataaaagccagcatcaggatgggtggctgagaaagaggggtctacattagggagaagataatctttgtccctattaacattgtcagtggcagtaatttaataggattctgtgctatgtctgtaggaaattcctgatatttttcaggtatagaaatgattgcaatgacactaaatgttctttagtgtcactaaagttttgcctaccttcagtactacatcattagaagattcacctccttttcatctccgttgagtagacaagtgaccaaaatcccagcatagctatgactgtttcaatcattgaagaaaatttgctggccacgggacaaaattgcagtagaagtgactttatgtggtgatccaaaaatgagataactgtattcttctcattcctagcggaagtcaactctgcaggaagagacactgcttttgggaggcaaagttggcagttggttttctgatcttggtttgccattgaatcacctattccttgaggacaaaaaaagacttgtgtccaatgactggtcaagattcatcattccactggtccattttaaaggcttatctctcatgctatctatataactgactccaggaccatctccaccttttggaatatcctctgattacttcatttctttgtttgatttgcatttagtttttgtaagaagagcacttgatggggttattttcctcctgagcatctcacagtggtgttgctttcccagctctgtccatcattggtttgtgctcatggctctgtaatgtccctttgtcttttgcactttgcagagaagggtatggctggctctacctatgagtgcaccagggtagtaaggcaagcagaacaagaagctatttgcatctgttttctcatgaggtagctcagtccccatagttactattcctctttcctggccatttgctaccctaaggccagcaaatcttttaaacatgaaaatcttatcatgtcattctcctgatttaattcattaatggcttttcatttcctttaggacaaaactaaaaatccttagcctggacaattaggttcttcatgatcctggcctaggctagctctccagctccatctcaagtcatcactctccattgtctaggaatgctggcttccttcttctccaaagggagggagctcccttccatctctgagtgtctgagccttggcagtcgccattgcctcttccgctagcactctgtcctccaactcctcgcttggctcactgtccaggtctcagttaactgccactgcctcaggaaaattttctgtggcctcccacactgggtgccacagtaacacattgatcataaacctctgctttttcttcaaagtccttgtcaaaggtctagttaaatattaaataaatactaataaaaatatgttttcttaacataaatgtgaattccatgatgccagactatgtctcattcctaacagcatctctagcgctgggtacagtggtgttcaacaagcattttttgagtgaatgactgaataaatgtttttttctttgtccttctccataagctctaagaatcatttgtgctgggattgtgtcttaatattctcatctctatgcatggcatttttcccagagctgttggctgacgactggtcaaatccaagaccttgatctcattagcactatcctcccaccagctcccagtcgtcctagaagtgcttagaggtggaggcacagccagtgccaattccaagatttctcaaagaagtcttaggagggtaatactttcctcactgtatatttgctatatagagctagcgctacccagtgggacagtggcaaacccttttggttgcctaaccaacagctcttccccacttctttcctgttggcagggactatgtttatttgggtacccaggtctccagcatgatttttaattgggtgaaattatcccagctgcagaggaaaaccccaggtgatatgaataaatagttctcaaaatgtaatctgtagaataccagggatctcagggccctttcggggagcccttgatgtcaaaactattttcatgataatactaagaaatcatttgctttttttcatgttgacatttgctctgaaggtaaaaaagcaatggcgagtaaaatttctggtgccttggcaccgatcaaggcaggggcaccaaactatactaacagacatttcattcttaactgccatactcacagttaaaaagtttcagttttatttgagaatatctttgatgaaatagcaaaaactataattattattaaatcttgcctcttgagtacacgtcatttaattattctaagtgaagaatgagaagtacaaaaaaaatcatttctgctgcataccaaagtacaatgcatattgacatctcaaggaaaagcccttgggcaatggtttatgttgtaaactgaactagctggcttttatcacggaacactattttactttatagaatgtctgaccaattatggctattcagattatggtatttggcattttttttttcaaaaatgaagaaaggaaaatggttagtagtatttcttgccagtgatagaatttaagttttaaagcaaaattataatttttagaaaaaattgtatttgccactctgagctcaatagctctgcaacatcttaagaacttctgatgagatgggtgaatatattaacaaatatgatttttcaatattgtgtaacaagaaatgtcaataatgaaatatctgcataattcattgaaccaccgtattgccaaacaatcaatgcacggtgttacaaaaacatacctgggtaaaaattattttaaagagcaaggtcgatcaatagatatcaatgtaacagaatataaaagttctttgatatggcctcagattctacactgtatctaatctttgaaaagctaccccttgtaaagttttagtgtagtatcaaagaagaatgttcacaattgtccaaaagtattattaaaatattcctcctttttgcaactacatagctgtgtgaggccatattttttcatgtactttaaccatgcaacatattatagcatattggatgcaaaagaagttatgagaaatcagctgtctctattcaaccagacattaaagagagttacacaagtaaaaaagaatactagtcatctcatcatttttttcatgttggaacacatagttatttttaataactgcatgctctttgtattaatatatgataagtttattttttacaaataatttttttttaatttttttggttttaatttctaatggggtaaattggctgggtgtggttgttcatacctgtaatcctagcaatttgggaggccaaggcaggcagatcacctgaggtcaggagtttgtgaccagtctggccaacatggtgaaaccccatctgtactaaaaatacaaaaattagctgggcaaggtggcgtgtgcctgtaatcccagctactagggaggctgaagcaggagaatcactttaaccctgggaggtggaggttgcagtgagccgagatcatgccactgcactccagcctgggtgacagaaagagactccacctcaaaaaaaaaaaattctaatggggtaaacatatgtataaataatatataatacaaatatttattatataatatatataaatatataacaaatatatgtacttttattataggtttattatagatttagggagtacaagtgcagtttcgttacatgtgaatattgcgtagtggcgaagtctgggcttttagtgcagccatcactagtgtagccatcacccaaatagtatacatggtacccattaagtaatttctcattcctcacccctcttccaccctcctaccttctgagtatccaatgtctaccatttaatggagtaaatactgatagacataatttacataaacaaaagcttgataatatctggtcagggccaatcattgtggttctatttattaacggtgattgctttgggcataggcctgaaatgagacgtagtaaggagttctgctaggcggaaagtttacttttatagtgacacacgagaaagagatggtctcttttcgtccactagccatcactgggttggcatgtgacagctagaattgtggcagtcttcttatatgaccacaagctgacacaaagaaggtagtgaagtgaaagaatgaaagtaacgtgggacttggtcaacattgctgcactgcaggattaaccagccctggagccatcttgtccctagaagttttgttacttgtgataacagggttcccctattgcttaagctgttcgcgtacagtttcccttaatagccaagagcattctgatataggaatttgttcctaaactttaaacttataaagtaactcacaactagaataaagagtctttttttttcctttgacttttttcagtatggagctcacattcatatcagcctccaagatcattagtgctctatgcccaatctcttggttttatatattgcagttcatatgtgggtatatgggttttcctcctcctagcccttcccaccatccaaaccagcagaaaaataaatagccatataaaagaggtgaatgttatagacaacaaaaaactgccgggatctatgctgcacttcccccaaagagtcatttcagtctattaggcacataacgcatgttttaaaaaagaaccagttgtaaatacatatttgttcagatggactgcagcacaacagagagtctcccggggagagaggatgtattttacaacctgccaaaaaagatcctgcgaaaagtaaaataaggacaaacggaaaggtggagaacccctctgcccccagaaggctgatggaagcacagtccctccgcagtgttgttatggttggcctgacattctgatgcccggatctcagaggcagatctaagagccacttgtctccttgatgcctgagaaccattcagcccaaatgtgggattccaggaaggatgatggagtgagtattcaagtgaaagcagctccaggcaatgttcttgagccccaggagggggctaattcctctggtgaagctggaatgggctttttttggctgtgggggcatgaacagacgtgaagaacctcaactcatctggggttggttccagttgcctccatcaaacttaaagtagctcaggacctactttttgtgtgtgagtgaggtgtccttatgccagactactgtctattaccactgctttaaataatagctatagccaggacccctagcgccttacactggaacatgcctaggaagtggcattagctcaataattagtcccattcaggagagaaccttgtggcagaagcagtgtctagtgctgaatgtgagcccctcgaagtggggggaccttctcctatctttactttgtggatatactatgccccttcccttctgcattttgccaggattcatgagctttggggtataattggaatctccctaagagtaataacttagttaaagatgtacatttcctatggagtcaggaggaatgtgactgcagttggtcccattaagtgatgatgctaaggttgttcacctggtgaaagtggtgactgccaagtctctcccttgaggaggttccttctgctttttgtgatcagtgaatagtctgtgggttgatacttggacaccatgtaaatatcctgttccccaacgatcttttgactaatggtttttggaccttccgtaactgagtcaattattacatttttggttgcaatatggtgatttttctaattcagtcattacttctacagttattagcttatgttgataaggaactaagaatctatctccataaatttgtggattatttttctgtcagtatgctataatccattagcatcactattctttctgacattaagattgccttcagtttgaccagggagatctccttcagctttgagcacctccttattttctgttccaagatcagcttgtctattcctgcctcggactggaaatgagtcattgctccaaggatccttgtttccttccagtggggagtggcatttagaaaccacaatctgggtactggaagggctcattggtactggagggtcattgttcctaggacatttcggtcaaaagaactagaaaatgtaatgtttcttttttaaattaattaattaatttatttttttttgagatgaaatcttgctctgtcacccaggctggagtgcagtggtgctatcttggctcactgcaacctctacctcccgggttcaagtgattctcctgcctcagcctcctgagtagccagcattacaggtgcatgccaccacacctggctaatttttgtatttttagtagagatggggtttcaccatgttggccaggctggtgtcaaactcctgacctcaagtgatcagcctgcctcagcctcccaaagtgctaggattacaggtgccagccactgtgcctggccccattttatttctttctttagcaaaatcgggaattcataataagccctccagattacttctaataacataggcgttttccacacttcctctagtctatatttgtatctcctttctctcttaaggaaagttctagtttccaataacactaatatatttacttatttgctctgtgctacagtacatatacaataatttcagatttactaatcgttgatgccacaatcaacacaatcttgcaaactaaagtttaagacagctttgccttgtggtcagtagttgtcttaccaatatgttgaacgtaactccatccatgagtaaatatcaaaaaagtctagatttgataacgttgcaggggacaactggcttggattcttcaacagaatcaatattatggatgtaagaagaagaaaaaaggtaagggaaatggtataagtaacagaagacaaaagagacatggtgaccaattgcaatgtcaaatccttggttggatcatggggaaaaaaattccccaaaggacaaacagctcaatataatcatggattgtatattacataatattaatgttttgatactaaatgtgttgggtgtggtaatgggactgtgctataagttgcatttatggatgagggctgcatttggtgacaattctgagtcaacaataatgcttattgttttccttatcttccttttaaagacacaactcatgagaaattaaaacaaatacataacttcaagtttattgatagctgataggtacatacttttgatgttttatcttaaactacgtttaatctacttcttaacccattcactaattttattgactacattttatttctagagctttatcaatttgattctttttaaaacatctttatgttctattttcaaagtatcttgccttgcctccaccccaggagtttaattctttttaaagaatgtcttaagtgttgaagatcacttaaacaaatctactttatctattactctttaaattgacattccattatctcaactttgaggctctagtccacctattcattgtttccaaggatactcctttctaatctgtgctttctggtctgcttggtaatttttgattgagagttcattgccattgtcagtgtgtttttctttttttctcatgagaagcccaggtggacagtgttatgaagttattctcacagaggttttatgtccttggcttcttccattgtctagggccatcactagctcaaggcaaatcttatattaattttggagggcttagagttttctggatcctccagagattgaaaatttaaactccaaacagtcttaggctagggttttgaattctcaagcaagcatttagacccaaaccaatgagtaagctcctgtctcctttccccatgatggtccatagtttttgttttttttttttcacagagccttccttttaactgagagtgtagctttttaaggatcccgtcttcaagtagggattatggtccatctcctctccataccagcctaaggcctcatctttagtctctacatagcctttaaaactccagccctggggattgccccaaggaatactattatgggttgaattatgtccccttaaaattaaatatgtttcagtcctaaccccagtacctcaacaacataagatcaaaatgtgaccttatatggaaacagggtcttgccaaaggaaatcaagttgaaataagatcattagggtgggccttaatccaatatgactgatgtccttatagaaagaaaaaatttgggcacagagatagacatgcacagagggaggagaacttgaaaacacacagggagagtgtcatatgaagacagaggatggagtgatgtgtttacaagccgaagaatgccgaggctaggagaagctaggagacagttgaggcacggttctttccttgcaccttcagagggagcctggccctgcggactccttgtttcccacctcctgtcctctggacctgtgaggtgatacatttttgttgttttaagccccctggcatgtagtactttgctactgcagccctaagagatgaatacagaaaacaccctccccagttcctgcccctcactctgaaggcagccctgacatcagcacctcacaactcttacgtttagtttcctcttcacttccaacccacgaagattccttttttccaaccacagctttgcattgtcaatatttttggatagttgcatgctatgcagtgtttctctgcacttgtagtgggagaggtttcatgttatcttagccccccctcagctcacattatgaccttttgggcattaagaacccaagaaaaaatgagccaggcatttctagaataaaaaggcaatttcttcaagcacgccgccctctagggccatgctgagcctcgccaagggcagggcctggggcatgttgtgttgtgttggaagtgccatgaacacgaggctgacagaggccaggcaagtgacagaaatatgcaaagctggccaggtatataacaggccaactcttttgaacccctcaggcttcatgacatagcttttatttttctactttacctttctatttttaaataaatttattttatttattgttaagaggcagccttactctgtcatacaggctggagtgcagtggcatgaccatgcctcactgcagcctcgaactcttgggttcaagggatcctcccatctcagcctcccgagcagctgggactaaaggcatgcactaccatgcctggttaatttttcacattattattattttattagagagatagggtcttgttctgttgcccaggcttgtctggaactccaagactgatctatctgccttcacctccttatgtgctgggatgacaggcatgaaccaccacactcagcctgtttttctactttgatattctactgaatatcactttgtttaaaattctcatctaaggagaaccatcatgcaaacttaatgctaaatggcaactgcctccaagatctagagatactggtgaactcattgtgtctacctaaagggcagctgccactcagtacctgcagccattttgtgaaatattgtcagatctctatatctttcaaaataaaacaggaattcagatctttatgtgaaatctcctgatttgaaaatgttggcactaagaaaggattcaaaagttttaaaaaatgctttcaggcccaacaacatatattcacctactactgacttcaccagtttgctaaacacaatttgatgattgactctccaaaattactagctttataattttactgaaaagaaaactattctatgaagccatggtagaattttgcagttctctctaaacccctttgaaacaatttacacatttttctgtggcaaaaaaaaaacaaaacaaattttcaatggttgcacttttcttggttatttatttcttataatacagagaagtctttgattctaaaggcatgtgtttctttaaggaaaatgataaagaataaaattaattggaaacagccgttgcttgaccctcaagttctgaaaacagacggaacactcaaggtcaacattgaaactctgagtttaatttattctgttgtttttcttccttctccttccccagaacattccatattttgttagcttctgtcagagaaatatagcttcatttttatccacctctttgggcacaggtattagccaattgtgatgctgaagagaggtgtgattgccaagtccctgccgttggcacagtgaaggtggtgccttcataataccctcctttgcagtgaaagtctttttccttcagtattgagcagttgggtctctcagaacccaactgaggttgcccacagcctccatggatgatatgtaaaatctgctactttgtgaaacacctgtgtggatgctcagtgttggttacaggtatgtctttaaatacatgccttcttttctatgcccactgaccttctatgtagatatcctcaggacctgtgggcccctctctgactgtcaatctgtctactgtctcacaccatcattctcatgatgcagctggagtcattgatcatgaccttgtcaatcaatcaagtcaatcacaaccttgattaaaacctttgatgggctgggtgtggtggctcactcctgtaatcccagcactttgggaggccgaggttgagagttagagaccagcctgaccaacatggagaaaccccatctctactaaaaatacaaaattagccgggtgtggtggcacatgcctgtaaccccagctactcgggaggttgaggcaggaggatctcttgaacccgggaggctgaggttgcggtgagctgagattgtgccattgcactccagcctggggaacaagagcgaaactccgtctcaaaaacaaacaaataaacaacctttgatgactccattacataaataacaaagaccaaaacccacagcagagcactgaaaggcctttataatatgtcccttacctaattcaccaagctttcctcctggcatgatgcctccattcgtactgcattgagctcttttctgtctcccctgtcaaagtggcgtgttgaactgcatgcctgagttttgaagaagtacctttatgcacccaacagcatagctccacacatacaaagcaaaaagtaatagaaatagagggtgaaagtaataaatcctcaattatatttggagatatttccctgaactttctcggaactccataaactaaaaatacacagattaaaagaaaaatgagtagtgttatttaaaaaataaataatacaaaataaacttgactatatgttgagtgtatatgcacacacttactgaacaatagaaaacactattttctttttttttaagcttttattttaagctcgggggcacatgtgcagatttgttacataggtaaacttgtgtcatgggagtttgttgtacagattatttaatcacccaagtgttaagcctcgtacccattggttattcttcctgatcctctccctcctcccaccctccaccctccaatagggctaagtgtgtgctgttcctctctgtgggtccatatgttcttatcatttagctcccacttgtaagtgagaacatgcagtatttgattttctgttcctgcattagtttgccaaggataatggcctctagctccatcatgtttctgcagaggacatgatctcattcttttttatggctacatagtattccatgctgtataaggaccacattttctttatccagtctaccattgatggacattaaggttgatccgaagtctctgctattttgaacagtgctgcagtgaacatatgtgtgcatgtgtctttataatagaatgatttttattcttttggatatatacctagtaatgggattgctgggtcaaatgatatttctgtctttaggactttgaggaattgccacactctcttccacaatggttacactaatttacactcccagcagcagtgtataagcattcctttttcttcacaaactggccatcatctgttattttcaaacatgtgaaatacatacagaaatgatcatgcatttagccccaaaggaaatgtttataaattcttcaaatcagaaatcatgaagacagatcatgttaaaaatccagacttctaaaacaatccttgagttaaaagagatcaaaataaaataaattcacaacaaaaatgagagtcacccaaatattttaaaaaataaagctaatggtaacaataaaaaacttaagtaaatatactggaaaagagaaatgggtgcaattaaattaacatgcaactcaagaagacagaaaaggaacaatattataaacccaaagaaagtaggacatggttaatgataataacaaatctgaaattaatgcagtaaaacaatggctttaatacctgattctttgaaaagacaaaaatatcagatctatatggtcaagaagaaatagtatatacataagataaatgatattcaaaatgaggaggataatataacttcagataatgaggagattataaaattaagtgggcattattacattctaaaatatagtcacaatcaaagtatttctaataaatacaaattaccaagattgaatcaaatggatgaccagaaaagcccaaaatttctgaaagaaatttgtaaaaatagtgaaaataatttcttaaaaattgcatcagacctagagtatttgcagataaactgtaccaaaccttaaaaacaaacaaacaaacaaacaaacaaacaaacaaacagaaaatcctatattccagggcctggaaaaccatggaaaccttcccaacttattttacaatggtgatatttcccttccctatttctcttctacaagagtagaataaatttttaaattatatgtatgagcatagatacagaaactcaaaataaaacatattcattttgctttttacttagttgagtttattttaagaataaaaggatagttaacctgatgaaatatactagtatcagtaacaaaattcacaatttaaaatagaaatcctggtcaggagaggtggctcacacctctaatcccagcattttgggagaccaaggtgggtggatcacctgaggtcaggagttcacgacaagactggccaacatggtgaaaccccgtctctactaaaaatacaaaaatttgccaggtgaagtggtgcatgcctgtaatcccagctactcgggaggctgagcaggagaatctcttgaatccaggaggcagaggtttcagcaagccaagatcgcaccaccacactccatcctgggaagagagcaaggctttgtttcaaataaaaaagaaaagaaaagaaatcctatgtaaagatgcactaaataaaattaatctctcatttgtgaaagtcacagtaagctaagaaaagaagaaaacttaacccaataaaaagtttgagaaatccaaattcatgctgcaaaatttaaaaaaaaaatgttttatttgaagtctagaaactaaacaagatgcttattgaaatcccagccactgaatatggaaatagaattatataagtggataaataaaactaccaccatttttagctgatatgttttcataactatcaaatctaagtaaattccttggaaatatatttgaaggcaattggatacaagataaacatacaaaaatagtttttctaaacaacaacaaaaacaacaattagaaaatacattatgaacatatcccatttaatagcaacaaaaaacatacagcatctagaaatatagctaacagaaaacatgcaagacttgtaacaataaaactataaaagtttataaaggacttaaaggagactagttaactgaatagtagttagagatgagaaggctcaataagcaaagatgtcagacctttcaaaattaatttttcattcagttagctgatgctcttctctcttgggctggagactgctttcccaggaagcaaaatctgcaaccaagacttgcctgcaggtaggttatttttaggaaatgttccaacagtgcctggagtaaaagggatggaaggctaaggaataagagtgtctggtataattgccaaccgcatctcagtaagaggtttttaaaagaaacacaagaagctgattctagaatcatttcaaagaaagattggagaagaatcatgaagatttttcaaaaaggagacaagtgtccaggcgcagtggctcactcctgtaatcccagcactttggaaggctgaggcgggcggatcacgaggtcaggagattaagaccatcctggctaacacggtgaaaccctgtctctaccaaaaatacaaaaaaataaaaaaaaattagccgggcgtggtggcgggtgcctgtagtcccagctactcgggaggctgaggcaggagaatggtgggtgaacccaggaggcggagcttgcagtgagccgagatcgcaccactgcactccagcctgggtgacagagcgagactccatctcaaaaaaaaaaaaaaaaaaggagacaagtaagttaggaggactaatttccccatcaaaattccacacttaatctaagggtataaacattaaaaccatgagtattaaggaagaaaaaaaaatcaatggaacagactaaagagggaagaaatagaattatgtaattgaaagtttagtttataacaaaggtggcaaagaatgagccagttaactaatgatgaggacgactcattgttcatttggaaaattagacctccatttcataatatgcaaagtttcaccttgcattaaaaagttcataaaagttatcaaaacaatcttttgatgtaaaacatattctgcaataagatatgaatcccagagtatctgaaggaataaactgacatatttgactacattaaaacaaacaaaaatctgaacgaaaaccaaatgatggattgggagaaatatgtataacataaataataaaacattaattactattcataatttctaaaacactcctaaaactcagtaagaaaattaaataattccatggaaagatagacaacgaaaatgattaggccattcagggaacagaaaatacaaatagccaacacctacattttaaacattgaatctttcagaatatcagagaaatccaaatttaaacaagattgcccctttgtatacattagaacagtaaaattttaaaagtctggtaagtcctgagcaggctggaatacaagagaatataccatgttatctaccactcaggaaatgtcaattagcccttttagcagaaagagcctgcatttaaaatgtacacagctttcaagaaagcagttttaattttagaagtctaatctacagaaacactttcaggattgttcaaagatttatacacaagactgcacaccaaagccttatttgtaataatgaaaaatattacgagcaccttaaatatttcataagttatggtatgtccatgctatggaatactaagcagctgttaaagagaataacgggtattgttttgaaagatctttgaaatacattaagtaaaaaaaattcagggtatatgataatatgtataataatgtattctcatttatgtggaaatccaattatatagttatatacacatatttatagaaatgagtagaaaaaatgactgcaaaggtgcgcatctgattgttttacagtgcttacatctgaaagaggggcatggaggtagggttaaaaatatatttgggggttttcacatttattctgtgtatttcagtgatgtttaaattttttaccattttatgatgatgtattactgaggttaaattttttaaaaaagatatgcaatgttattactaaatattagttattcctatctttattaaatcaatgctgaacaaatatttcaacacatcagtttgaagcggcccatgatcagtgacttgtggagggcacctgcaggtctccatctgctcacactggggtgcctccaggtgggataggctaaaggtatgtggccaggccaatgggccggagccctgtggagacatataagaccctgataggcacgtagtaacacaagctcgcaggacatacatagcaccccatgtaggggaatacaggcaagcaccatagtgaaaaacagctttttgctggctcaggacaagcgaagcttccaggggtctcatgtgaaggaagtgccccggctcaccaccaagccccttggggtggctgtgcccgacctccctgtaaacacagtatgggtgagaccttcagtgctcctgacagcatgaccccaggggctagctgggagctgcatggcaggagtagagggaccaaagacagcactcggaccagcatcctggacgaacctcctgcttcatgtggatccagagccttgaaccctgtaccatccacagggcctccagcatgcaggctgacaatggctgggtgcctgtgggcattttgggaatccctgtgtcattaaaggagctgggagacaactgctctacagagcattgagaagcatatttcattttccaaatgctttaaacatcacccctccgttttgcaggcacgccgaaccaccgtgtccctgtgtgggtccttgagtgctggatagtgtcagggacctcggatgtcttgccctctcattttctttggcaacttggcaacccaaacagtcacatctactgatgagctcatccaatagaatgaataaacccttatttctgaccttagcacatatctgaatcgtcctccaattttaccctccccataatgggcctttctatttgttttctcagtgtgaaaagagatataacttgctacaaagaagcttcctgcaaaagctcactagtaaggcatgtatgcatctctagagtctccagatggtcctggatgtgtgaattctgcccattgctggccgtgaacattcaagggtacggcatgatgtcacagctgagtcacaggccgaggagttcttgagaccagagctgcattccaccctgccacttgcagactctgtagcttatgcaaattacttagcgtttctgaaaatggggatactaatttcgactctgcgtggttggtgttcagatgacagacaatgtgcaggaggtgccagcattacctggccctttaagacgctatagattacgtctattatactattatccccaggactgccacttgcaccactgggcctctttccatagggcaggtcaaggccctggtgaggaagaccagagcaatctaagaaagcatgaatttttcctctgagagacatagaaatgaacttctaaaagtggaaaaaatgtttcggtccacggcactatcccaggctctttggaactccaacagaccagctcacaaacaaaaaaaaaccctaatatgaaccaggtactgtagctcgtacctacaatcccagcactttgagaggccaaggcgggaggattgctggagctcaggagtttgagaccagcctgggcaacacagtgagaccctatctctacaaaaattgcaaaaattagccaagcgtggcggtgcatgtctgtggtcccagctactccggaggctgaggtgggaggatcgcttgggcctgggagacagaggttgcagtgagtcgtgattgtgccactgtactccagcctgggtgacagagtgagactctgtttcaaaacaacagcaacaacagcaaaaccctcattcattagaactgttttctcatattagtattattcatgtaatgttcttttgaaaataaacatttttttaggccgggcaaggtggctcatgcctgtaatcccaacactttgggaggctgaggcagggggattacctgaggtcaggtgttggagaccagtctggccaacatggtgaaactctgtctctactaaaaatccaaaaaattggctgggtgtggtggtgggtgcctgtaatcccagcttctcgggaggctaaggtaggagaatcacttgaacctgggaggcagaggttgcagtgaggcaagatcatgccccattgcactcctaaaatgtgttttcttttgggagaggaggagagagtataatgttgccttgaggataaggcaattctctcactattgcgtttctctgaccctatacggagaggcaatgaggacatgcagttcagtggtgaggagtgtatctcagggcaagcctcttgtgtggggggttgggaagttatgaggctttcctaagtcttatggaagaaattgtgatcgttgtttcatttctttgattttacagaattgttaccattttttcccctacggtatcttttgagggtgggagcagattcaatgaactcgacttacatcacgtttctgtttagtgatccgaatatgaagcaatcattcttctctgattatctgagtctttccaacccttaacaattctatggcccctctctgatgtctcctcccacaactattaaatattcctccttcctctgacttagagaagatttcctgtatttaaggtccatttggtaggtgtggtcctagtaaggagcgttttgagtacagaaaatgcaacactccccaagcttgcttaagcaagacaggggttacctgggggtctatagagttattttccaggggacatgggtaggaaatgcccccgggaagcagggggcctggaaacaggaattgagatgttccagtcaggaaatacagccacctgtgctgaggccagctggtcttgttttctgacctctcgctacacatctgtattccttgtctccgtctgtttctgtctctgtctcttcctccttctctctctctctctcttttttgggtggggggatggggggatggaattttgctgtcttccaggctggaatgcaatggtgcaatctcagctcgctgcaacctctatctccctggttcaagtgattctcctgcctcagcctccggagtagctgggattacgggcatctgccaccacacccagctactttttatatttttaatagagacaagtttcaccatgttggccaggctcctctcaaactcctgacctcgggtgatctggctgcttcggcctcccaaagtgctgggattacaggcataagccaccatgcctggccatccctcttatcttaccctcttctgccttcccaagacccagtccagcctagaccctacttacctttacaactaataggcacagagacttgactgggccattctgtgctttacttccaaatccccaagaaaaggaatctaaatcatctaacctgtcctttgggttgatccttactgagccagggaagctgcctaatctatctgtctaatcaacagccacaaggagggaaggtgcagttctttttctctgactaataaaagttccttgagggccggaaccagtattcccacgtggcctaacacccagtaggtactctgtaaaattgattgattggttgattgattatataccatacaacaggcttgaaaactcctacagtgtgagcatagctttcaaattgtcacttgtcccttctaataatgaatgtcagatgatccaagctgaacagagtgttggattcgtttattttactttctgtagaccttctgggtgaagggcaggctcataaaacatgtgtataagatggaaaacttggggtacttgcagcgatgaaatgtaaagcataatttaacattacatatagcattgaggctcttggtaggatgtgatgggtgcccagctgctgtatgttttgatgtcgttggaattgcgggtcctgtaaggcagcagtccccagcatttttggcaccaggtaccggtttggtggaagataatttctccactgactgggtagggggtggatggcttcaggatgattcaagtgcattacatttattgtgcactttatttctattattattacattataatatataatgaaataattatataactcaccattatgtagaatcagtgggatccctgagcttctctgcctgcaactagatggtcccatctcggggtgatgggagacagtgacagatcatcaggcattagattctcataaggagcgcacaacctagatccctcacatgcgcagttcacaataggcttcgtgctcctatgagaatccaatgcagcggctgatctgacaggaggcagggctcaggcggtgatgcgggcgatggggaaagcctgtaaatacagaaacttcactcgcttgcttgcctgccgctcatctcctgtgtgcggcactcgtctgtacccagggggttgtggacccctgcttcaacgcactattttctctcccagacaagatattgagagaaggggaagaattgaatggtctttcttaatcatcaaaagggaccacacattcccaacctgattctgttctcttcatggtctctctgagctttgtagagaaggaaggaaaaggtacgagaagagaaataaggaaaggcaggggaggaagagggggcctcagaagcatcttcaaagggctggatttacaccccaccgcctgtcttggtgcccgggggctgggtgcattcaggctcccagatgagccacagcccttggcctcttgggtccacaccttcatgttagccaaccctgatgtctccatcacccctagataaatggaatcgggcatggaggcatctaatggctaggcagattaatcatatgcttgcttgctttttggaaaccccagaggaaatatctgcagatttaattctcagttaaaggtggaagtgtgggtttgaatcttctatcaggcattgccccttcctactcagcatatctttggaaaggtcaactctgggaaagattggagtgtcggcatcttctacctggtgctgtataaagacttctgacctttcaatggtcctaattccccctcttccttctctctgaatattcccctcctccaccttttttagcacgattatttattaaagttgcaaaggtcttgcattcccacacacacacacatatacacacacacacacacacaaatatatatatatgccacattttcaaataatgagttaccgtaaatggcacatatgagtactcctcaaaattgtcaaggttatcataaacaaagaaagtctgagaaatggttgcagctgagagtctaagaagacatgacaactaaatgtaagtgctatcctcgatgggatcctggactagaaaaaggacatgagataaaaatgaagaaaatctggataaaagatggactttagttaatgacaatgtgttaatatttgttcattccttgtaacaaatgtactctactaatgtaagatgttaatgataggggaaatggggcatgggactctatactgtcttctcgatttttctataaatctaaaactgtcctgaaaataaagtctattttaaaaatggaaaacaaaacaaaacaaagtggtacatgctacaacctcatttcagctggacaatcacaaagtatcaccttggacatgcagctgaaacggccagggtggaggtggggacccagtgagctagtcctcggtaacaaggaggtaaccaagcaatgagctcattacgcacaagcatttcagggcttgctttaaaagccagaaattaaccattgaagatgactccatatggtcggtttccttaacctgttaacttccagagtgaaaacatggcaaaaatgattcctgaaagcaaggaagtctaggatgagctggaaaagagggggcagtttccaccagagggctactttcttttctgagacatgagagatgctgcagtagatgctagagattttccagccagtgtcaggtaggtagctcggatgagttcaggtggcccgaggcatctgacctatccagtctaattttatgcattaaggatattgaagtgggtcacaaaagaagttccatttatttatttatttatttatttatttatttatttagatggagtctcactctgtcacccaagctggagtgccatggcatgatcttggctcactgcaacctccgcctcccaggttcaaacgtttctcatgcctcagcctctcgagtagctgggattacaggtgcccgccgccacgcccggctaatttttgtatttctagtagagacgggggtttcaccgtgttggccatgctggtcttgaacttctgacctcaggtgacctgcctgcctcgacctcccagagtgctgggattacaggcgtgagccacctcgccgggcctatttattgtttttgaatgttgcatttcaatacctcactgaccacaagaaatctacagctttttctctctggattccttcaacctctcccaaattgagcgcctgtcctggcccaatcgggcaggactgaggtgcctggtggtcacctccttagaagtctgcttctaactcccctctgtgtgtgtgtgtgcgcatgttttcctttctcattgacattccagcccttgaaacaaggtcttggctcctttcttattgcaggatttcgttttgggggagctggaacacctgtccactgatcgcctgccactccgcatctgggcctggctgacaggcttgtctgctttgactaatgatgtgattgatggacaaaataaggaagaacatacaaaaaaacatttctgtctggtctggtgtgtcagcaagccttcatcaagtggctgctgaaggtatattttgctgcatggctcattacacagtaatggcattcccaggcaaagctgtttcttttcatgacacaagacagcaggcagctttatgggcgttgggcccaccgagcccggaggaaggagaggcgcactaaagagcggtcatttccaaaagtgcctcaagttgcttttttgttgtcatgaatttaatatgaatcaacacaatatgaaatgggcatgagggatcttagtgactagtgattttttaagactgctgtctaaacagccatcaaggaagaaaggggagggtgaaaccacaacattttctttctccaaacctgttgcaaaaaggagtcatctgtcaattttattgcattaaaaaagtacacagaagcatatagtccaaacaaatgtcttctttcaggctaaacatgtgggaaatgccacatagctgatgccagaatcatctcactcagcaaactgagtattcataacccccattccaatggcctgctgcggatgggggtgacattcgtaagaattacaaatgctactctgttgcctctttgtgcatataataatgatctgaacatcagttctggctggaacaggagagaagcaaagaactgcttcattcagctaacaagatacctgtgggttataacccagtgctggaggatgaaaaggaatcacgattaaaaacaagaaatagagtaggtaaattcttggcctgattttttttctcctctttctttattagggtacagttgagagcaggaacgttcggtttggtcccagagttcctacttcatttttgcaaagtattttagctgtcctcgatattatttcttctttctttttttttgtggcaaattttctttgccaaggtattttattacacatactcctctcttttctttaacttgctggactgtctccaaagagaaatgcttaaaatgaagtttcattttacaaacactttttattctttcttgctagcctgatgagtctttagtggtgggttattgtgaataatatgtgattttaatgagttgtgattagacaaaactctcttcctataataaatactagataataaattagaaaatatatatgagatctttattcctattttaaaagggtgaaagacataaatgcaaaagcttgttatgataaatataaaagataatcttttaacgtgcatttaattgactgtgcttctaagaggcggtggtttgacttctgtgctgatgttaacattgcacagctccaaccaatgcaaactggcactgggatgacagccacctttccaccagggccattagtcgccaggccttcagggggcagggattttcatgtagggcagaggcatacaaatttagaaatgaacatgtgatcaaatccaaacagtcagatgacttcctatatatacaataatgagtataaaaaggaaaagaaggagggaggtgtattttgtgtttttttcattgaaccaaggcagaagtagttgtccaacagcttttgttaatttccaagatccatccatattgttcattacatttccatatcaaaataacaaactgtagagcaaaaggctcatggcattctgttgacttaaaagttaaagcagagggaagtgcccatcaatgcagtaagagagcaggtttagccagaatgagcacaggccagccaatgccaggaacttagccatttagaattgggaggcaggtgggtggtgccatggcagcgaccatttaattaggtacacttttctaggctaaccttggagcggaggcctggtgtcgggtggggggtgctgtgtacccccacttcctgcacttcaggtctgagaaccattagcaagtcctgttttttctccaaactcccaccttttgctgcctttgtggcctggcagaatgttttgctgccactttcttgagtgacaacttcaaagctaagcagtgagatgctttaacctacacatcccctcccactgcttggacccaaaggcttcctctgcaagtgagggcctcaaaggagacctggaacctttattcttgtcctgactttctgttttagaatcaggaccttttcaaaaccccaggagcagacagagggggtgtggcatggactctatgtgagggtctctcgcatgccaaggctgcaatctatccattctccagcgaggttgtttgtttcggagctagtagctgcaggaactattggggagcaacatcatttagcagcaaagatattctttctcagcaaattgcttgaagccaaggggaagaagcttccaggttggtgatgctaagcgcaagagtggaaggggaaggaagccctaacctggggttattttctttaatcttataggagccagccacccgtacacaggctgctctatatattacagcatacattttttctgttcctaatcaggtttgtgtatcttcctggattgattttctttcacaaaactcttaatatttttccagatgcctcctctcctaccttttgtccttcccaactgccattcactaaagaaagactctttggaaaatgttggcctggaagcatgtctattcctattctagtttctggatcctgtcaacaatttttacttgtatgattgtctcattatttttattattttaattgaagtggtggcattatgcaatttggtgaagaactctccaaatccacttggttctggtctccataattcaaaacaagttatttgatgggtgtgtgacttttaagattaacgttaagattgtttgtttaatttgtgggattgatttggtagatgttttcgtgttgaaagaaggctgattggttttggttgggaaatggaattctattgcgttcccagagagtctgccatccagagctgggcagcttcctggaaactgtctgccccaagcaaaagaaagtgctgtgttggctgcctgttgtctgaagtgcagagtccgggggactctgggagctgctaccagatacttgcccccacagtgcctttgaaacactctgcaaggcaagatgaccctgggggaggagcggtccccacctgaacccacaggttggaggcttcttcagggagaggttgacatgcacctttttaatgcatacacattaaaacacaggttgagtgatgtgtggatgcagggaaggccttcctagggaatgacttcagatggcttaatatgattctcttagcctggctgctacttcagttgctggctcctaatggggtcccccttcttcacacaggcgcaactgacattatctctaacctccgccccaacgattccctgtttatcccaaattgtggaaagccttagaacttaatcggcacccacatttgcacatcccagaagagtgggagccttaatgtcctatggggcaagactttgaacacttatttcaagttatttcttccacgtctgtggtcctccccgctccctgctgatggatgatcttgagaaacgccgttaagtggtttctcagatgacagtcttgcgagattaagcgatcggttgtgctccaagttgaccagctggaaaatgccctctcatgtggacttcacctccttcctcacctcaattccctttgctctcgcttctgcttcctaggttcgtaccctctggcactttggcagcacgtgagctatgtgggtgctctggggatgaccaaagactggatgccaaatggtatcagaatgactgggcttggcagttcctcatcagttattctgctggagctttcagggactattagaggctgaatgactccatgcccagcaggtactttcagaaggacttgaggatataagggaatgggtcagggaagtgtggtacaaaaaaaaaaaaatacttgtttgtttgtagctatgccaagatatttcaaacccaaagcctgcctggatcaaacacgtgactttgtctccatggtatgtcagatggcaggtgggccaagcctgaagaggccaagacctcctcctgctccagctgaacacatctgctctccaccttggaagccccattctcatggctgcagtctttgaactctgatgaggtgtgcgaaacaccccatcgacacatcatatcagatatcttttgaaataaaaatctcctagatcagtttcaactcattccaaatgtcatatgtatcctccagggtggaaatcaatcttccctccaccctcaaatgtttgaaatgcaatgtggattttgggtgaaaagctggcaaatgttgagttggggatttgagtcagggcttgattctgccagtgccatgcctaccagggcactggtctttctccatcccatttggggtgtccctaacttcccccctataaagcctgggctcctctgccaggcattgtccccgtctctcaaccgcctctctaaattccctttgtctttcaagggtcagctcaagccctgtcttctgcatcacactaaatctgatccttgcattccatcccagttaccccccaacacatatgatgtgagcggcacaacctagccctgccttgccatattcttcaactggttcatgtgtgtgaatccatctctctagcatgcatcattcttctgtgtgcccacatgagtgtcccttttattgctaggccctggaaacttggtaaatctttatggactgatttatagacattgggaaaaggaaagagatgttcccaatatttgttctccctcctccatcttatacagagtcccttgcctccctctttattcctgccacgtgtttacttgtggagatttatgcagactcacccctgacccaggggatggcagtatcagactcaccatcggaaggtttggttaatcacctgatatttctccaaaggcacttgacataaaacaaaacaaatcaaatgcacaaatcatgtcatatataaaacaaaaatgagcaccataaaaatggagaaaaaaatgtaagctacaatgcatactaactttaacctataaataagaccagggctattttctgatcctcttttgcaatgagagctattgcaaaatgcagaaagaaacttaaaataatagcaatttaaggcaaagtgtgtgttattaaaagtttgtgatgttgaagagccaaactcctattccagtattgagatttaatatgtacttcatacaaaaataaatcatgtaatattttcatggcaggcatagaattttatggcttttatgactatcatggaattgggattcatattttatagacagctctaataacatcaagaaaatgctctgggagaaatgggggcttagagaaagacgagtgatcactcaacagaagctggaatcaagcgtaattaaagcccaaaagtaaggatgcgtctccactccatgggttcgaggcagggcccaggcaggaagagtggggtgtgggaagatagtggctccatggagagtgatcttggcaaaataggactcccctggtgctgacttacttgatcctgcaaatgtccactacggaggtaggagggcaggcagaataacttactcaagacatgaatacattaggaaggatactctcacatttgatttcctggatatctaaccatcctcagcaggggaataggctccattttttgcagggggcagatgcaattgtggagggggaccctaggaccccctacctcactcacccatcatcccagcaggcttctgtttccttgcagcaggactgtctgagaaattaaggtagccaaaaataatctaacagcaaccaccagttgtcaggtgctttgctgagctttgcagggatggtctagatgaagtctcatagccattccatgaggtggagaactggacgtaccgctctgtcttccccacctgggcactagctccctgaatgctgtgctgattggtaagcacagtggaggacctatgtcctcgatgagctaagctttgacacatgattctagaactcctttcccctctgaggcacagattgcaaaataacttctagtcctggggtaggctgaccccttattccagctgcaggtagactctgactcctgtcccgtctcaccactcggcccaggcagaccccccagtgcagtcctgaggcaagtacagcagtggtccaaagtgacaccagagacctgtgccatggccaccccgcatctgtctacaaaggatgccacctttccatgattcctggaaaccttcctttccatatcctttagatgcacatttctcttttaagctcatgatgtgctgagcttgtcccaagtgggttctagacccaactcaatggctctgtgaccttgggcaggtcccctcatgcttcccggtcccagtcacctcccctgtgagaaggggatgaccttcaggctctttgtctttgggacattgttgtggacttcaagggttagccaaagtgaaagctctctgtaaattgcaatgtgcttcaggcatgaagcgtccacacataatgacttgaattaagtgttctttttatttctttttacaaatataaacccaggcgagcataagccaggcagggggtgcaaagccggagtatgcatttggaagccttcgcctggtgtttcagcctctccataccatttcggatgcaactcctctgcccaccgaatactgctgtgcattggcgaatggtattttgcagcaatatttctgctctgctctcagaaatatgcgagtcctgcctattacagcatctgtagagacacactagggaggaagcattggctccgaagggctgagagccaagcagtccccttccctaagctgggccctggcctgccttcccatgtggcactcttgtaaggcctgacctcctcataaccctggccggcaagctgtgatgaatgggaggtcatggtctcagcagaggcgctggacacaaaggacagcagtggccctcattccctgggaacacaaggatcacatatccccataagttgaattctaggagagatggagtcctggctgggcccgcggccaggggtgtggactcttctagaggctgcagccccagacctctacctcccccagatcctggctccttctaaatggaggaagagctttcaatggctgcctgggtggtgcagctctttaggatactggaaaacctctctttaaaggttcatggtcatttgcattcttattaaattgcttggataaaatattcagccacaaccccctccatttgactcttaacttgataagacataatttgcaattgattattgctcaaacattcctggtaccacattacgatctgctcatacatctcaccctctctctgccaatttagaatgaaggaaaaatggtttctctgacctttgacctgtctgaggtgggactgttaggtcattagggccattaggaatcaaaacaccccagtccatagccaacagagacagaaatggatgtgtgcagcaatcagctgagcttattttttttttcttttcttcctcttggtaagatacaggtatttttcagagttggaagacgtctcgaataaatgagcttcgtatatatatgcttttaatgtgatttgcctgtatttatttgggtgatcacaatttatgccaagtgaaaaggttaagagtcctggaaactgaattattccatttatttgcagacatgatacagtgcagggcagcagaagggctcatcctcatcttgccctgcccctgacctcacccctgacctggagatgggcatcgcggctctgcacggagagtcatcaccttcaggggctggctcaggagccaggcaagtcccccagggcaggcagcagtgtccatctgtcatgactgacctgaataagcttttattgagtagcttctgtgcaccctcttcttcctatcccagggaccattctccaggcctatacccctgtgaattccccttgaagggttggccaatgagtggcacccataatggctcatttcttcactgcatttcagtttgcaaacttatcttcccctggattatttctttgcacccacataagagccttcgaaaaatgcatgcaggatttagccctcactgcacaagggaacaggggcacagtaaaatgtcccaccttgttggggggtgaggtcttgggccacgattgatgggcaggaatacaggtctcccaggccctggcagggcacactgtgctttctccccaaccctcagcagggccatcccccaggggccctctagcagacagtttgcaggcttctgactccaaggaaaagctctcatggtgaaggaatagcttaatgggagcattggttggagacagagtttgaggctgtggactcctcatgcccccaccatcacacactcctcctgtgtgcttagccatgcttcagggccggagccaagcctcctgcttcctctttgtgcctgaccgtccctgggctgtgtcctcttggcttgccttctcatcactttcagattaccctggagtaattggatattggtaaccaattactgaatttttcacatcagcttcatcagtgactcagacaactgcaccacagtttctttcaatgaagagaagaattataataatttgcattaatgttctatgagacgtggaaagccaaggtgcttggcctgccgagtaggggagggtggaagctggaggctggaggcctggcccttgacgcaggggtgtcaccccccagcctccctgactacaccctaaccccaaagctgtggccctctctgcccctaccagagcactcacttatttgtccttccctccttcctgatgagagagggtgctgctgcctctgggtggagaacttggggaaggcttcctgaagtcactatgtaaaactgggccttggagacaaagaatgtggaactgcagctctgggggaagatattctcatctgttgtagaagaggatgcaatggaaggcggggcgtggtggctcatgcctggaatcccagcactttgggaggccgaggtgggcggagtttttgagctcaggagtttgaggccagcttgggtaacatggtgaaaccctgtctctactaaaaaaacaaaaatttgtctctacttaaaatataaaaattagctgggcatggtggcaggtgcctgtaattccagctactcaggaagctgaggcaggagaattgcttgcacttaggaggtagaggttgcagtgagccaagatcacgccactatactccagcctgggtgacagtgtgagaccctgaccaaaaaaaaaaaaaaggcaatggaaggaaagagtgggaaagctgaggatgtagagggagttgacctcgcagacctgggcatattatccccgggcccaccttggagggcactagcagacagtcctgcaagctcatggcttcctgtgtctgtgttggagggttctctggccgaggaagtatgggtgacccatgcccagggcagaccagaaatagcatgggggttaaacagccacgagcaaggatgacagttagtgaataaataccctggcttcttccctctccgtgaggcagctccaggggctgctcctcccagccactcagaggttgcccagcaggatcgggccccagtggcccatcctggccacctgctcctaaactcaccctttgttggatttcttctcttccctaacttgtctccctactttttcaacagtgcttcctgggatcctctcccaaatcaacgcattgcccccatatccttctcttaggatttgtttctggagaaacttgaaagaaggctgctttgcatgtcaagtgcaaggtgttccgggttggggtggtattgattgactggattgctgggaatttttcagccttgggaacggccttcccttggatggggcagaggccctgcaagcccaccttcccctgatcccacagactccgcctatctgctctccccaagcccccacgcagcccacacgtgctctgggtggtgggcagcctgatttatctggagtgtctgggctaaggaagggaggtgagcacttctcgctgggagggattttcagctcatttcacagataaaatcaatcagatctaaaccacattcattgtggccatgagaagggagtctacacagcaggggccaaatgggagatcctttcctcccttcccatctggctctgccttagcctgggggcagcaggagccccaggcctccaggctgtgggaggcactgttaccttccagcagtgctgctgcagagacactggtctctgctccagagtaattggcatggccctgacttgggaaacatggacaaaagacagggctgcagctagggcatggggaagaagccaggcaggtggaaaccttccatcagtccctccaacatggatttttttcattttctggatggtaagttagccgggaacaagaagaaagtgagggtataaccacacgagcataaatgtactaattccttttgctttcctccatgatactgaatggaagaaaggagtagcagaagttggatggctgcatggcagtgcctagaagctgccctgctgggctgtctgaggccttcggctgttgagtggtggggatttctctgtgttttccaattgtcctcattgaggaaaaatgttgggccatccagctcctttctagatggcttgaggtcagtcctgcagctcaggaatggcatgaacttggacccctgttaagacttgcatctccctgcctgatctctcagcattgtccacccatggaacttaaacatctggaacatgtcttttctctcctgtagttcagtgtccccaaacagtgcagcaactccaaccaagcaactcaggaggctgagagagcaggcaccccatttcctcctccagttggaggatgacagccttggtctcattccattttccaagctgcttgcatgtgggagggagaccactgcttctgtatgaacggttttctctatagtttctttatagacccagatgggctaggttggaaaggccagtatctcctgcaagtgtctcctgttctcatctagggaaacaactgtgctttgtaacttgcacgtgaggggccaggattagtgaccttgaaggcaacaggccagtgagtatgcagggagtgagctccagctgcctgtccagcgtccatgacctttcttctagtaccagtaccctggtttattctacagaaccatcgcttccccttccacttcatgtatttcatctggaccaccccaatcatggtcagatgacttaagctacaccaatcagaacatatgggtctttaaaggcaacaattgaaagggagaagtcatctcttttccagttgctacaaagattaaaatgcaagcccagtgctctggcagccatcttggcaccatgaggcaaaggtctgcctgagaatggagctgaggcagagggaaacagagcgaacaatggagagagacggacttgaataacattgtttgagatcagggctccagatctagtcttggactcatataatgtgagcttacaaattcttttttgcttacactagtttgatgttaagtattcttgtcatttgtaactggtctacgggcaaatacccaaggctcaaaggtagcccatcatatccccatccatccgtttcaatgaaatttattccattcaattcaattcaactaacatttattcagctccttttaagccctgttctagatgctgagaaaacaaatcagatttttatccttaaggagcttatagtcaagagcaggaagcagagacattagaaattgcctccaatctaaggaagcagatactccaaatgtgctcttaaaagagtgcatacaaatgtacatattaattaatacatgctaattagaagctgaacacagtatagtgcaggaacagagaggggtaggagattaattctgactaaagaaacctaagaaggctcaaaggaggaggcaggctttaatcttggctttgaagaatgagtaggactttgagaagagaagaatgcatgagtaagtgaattaataactgaatgcaacctaggtttaaattatctgtcacgtgcatgggtgccttgtgaagcattagtaatgaagaggctttgcgtataggttatgcctgctccgggcttccaatctagcgaagaaggtaattcctgctgattatttatttatgtatttatttacttttttttttttttttttgatatgaagttctgctcttgtcgcccagactggagtgcaatggcgctatctcagctcactgccaactctgcttcccagtttcaagcaattctcctgcctcagcctccagagtagctgggattacaggggcctgccaccacacctggctaatttttgtgttattagtagagatggggtttcactatgttagctaagctggttttgaactcctgacctcaggtgatccatccacctcggcttcccaaagtgctgggattagaggcataagccatcacacctggcccctgctgataatttataatggaaagtggatcgtgtggaagaacggcttccagctagcagcctaggaaaggcatccggggaagggaatgaagaggcgccactcattcagcgatgaagtgggtcatcctaagactagagaccagtcctggaaaatattcagaattggataaatgagagaaatgggaaatggatggctaccttgagctgggacctgactgtgagaagggaagtagtgtgtaaagggtctcagagaggcttgaatgttgggctaaggattgtgatgttgtgtgatgggtgaagggaagccactggagacagtgaccctgagcatgatgccagagtcttatctgggaagatttgtctgtgcaggggagaaggagaaatcgagtgaaggaaggctgaactcttgaatgcaagtaggagaaacccaagccggactggacattcagtatcagggaaagaagtgacattgctagatattccttgcctggggcctggctcaacactgcagcctttccttcaccaatggcagcccagatttctctgcacagtgggtgggaaatgcacctctcggtgcttctgctcacatatccttgtttcagctcaagagagaaagggattctccctgctgtcccagttttctatcattccggagaagagcactgacaggtttttcttaggtcttgtgtctacttgctgagcaaggagaggctaggatggagcattagtgattagcccagcttgggtcaagtgaccacctttagccaggacacagcaaccagggatgagggggtagtccttactggagcaaagactcctctctccctaaagtgacaaatctcccaggcctggctgctggggaggttcgtgtgagtcatgaatccctggttatttgtgtctgtttcctagagctgggcttattctaggagggactaagcgggtcctgaatgagatttatgggaggagagaagtagagggttagggaggggcagggaaggtggcagtgtgggtgagtgatgagcccttggaacctggtgtctctcgcaccttccacatgagccattcaaagcccgcgatgaagctgggcatctatgtctgctgcagagtctccaggtaccttgttcacaccggagggggctacagcttctgctatttgcctttgggcacctagcccggaacctacaattttaggaggggaatggaatactcttgttagtctgttcaatattttgtaatatgacttggatgttacgtattctattaacaaaggtcataaaggaaaaatcacatttaacgggctacctccttatctcatatgaggccattctccgtggagaaatggtgctgttttaaacagtaggagccctggaggaaaagctcacccatttgggtcctagggctaacattcttacagcacaccagccggaattatcccctccgtctgaggtaccagcaattaggacagcacccccagccaggccccgaaacctggctgagagacacatcagattaatacatcaccaggtatgaaagcgcagttagaatttgactgaggcacttccagcctgagaaagggaacgatttatcaatgcaaacttaataacatctatttgaatctaactaaaaatcaatatttcattaccaaattgttagtgagaatgaagaaaaattgcggaagtcgggcagtttggtgctagggaagcgtcaggagttcaatgtgaagacggaatgattcatgaggccgcaccggagtaagggtgaacgaggacgagtgcggaaaacttggaggggccccctcgctcatgaccttggccgtgacggggggagcacgagaaaatgagagtgactgtcagttcccttcagggatggagccctccataaatcacagggagaggagaagagcaggctggggtggaggtacacgaatgggggtggcaatttaactctttggaccctgacatctaagtggcgcttcccacgatgggaagaacgaaccgaatgggtaaaatccaagggttgggggaagtggtgcctcgtggtgagtttctgcaaaacagagaagagaagaaagagctagcctgtgaaaagttgtcatccactagattcagctacactcaagaccagctcaccttccgttcccatcagaaaagtggaaatgacagcctatgtcttgtctgacatgaacataaatcagcgatttggaaggtctgttctaggtgagggtttggtgaagattttcaccctgaatatattgatccgaaaatgctgtgtagtgccatgactagtggcattcattccccatacgaatgaagtccttgcattccttcccaaatccgagatgcggattaaacctcagggcttgctgttgctttgattattgatctcgttccatcctgtgtttggtttcactgctctggccatgttttgctggcaagacattcaaagaatatgcatttgtcctttagcaaggaatggaggagaatcacataagatttgactcttatatgtaatgctccataaattaaattcgggcctctgctcactttattcattgaagagttatgcatagggacccagcagcatgtcagatgaacacctcagtgcctatctgcgtttgagaaatcatgggaaaggaggtgtagttggccctattggcctaaatctcaggcactaatttcagtagaattccttttaaaaagtgagggttagcctctcagtcccaaaagaaaatggggtgtattttgacagaagatggtaatgcactgttttactcaaacttttttttttttaaatcaaaactggtctgcatgggatccaaggatttaaagatgtgtggggggcattaagtaagctggcattgccctggaaatatgataggaaaggcaagaaaagtcttccacatccgctctttatgggaataaaacatgctctgggtcacactgtgagaaagggtggtggggtgtgtggagctcccagaattgaatttctcagcagctcaggtttcctctactcactgctaggagtgacccatgctaggctacatttcccccttgagagcggtccccaagatcgggaacctgtttaatcttgtgagtgtggagttccttgtgacccatcttaccctaccactgggacacatatggccttatgcctcacaggagcaaagctcttacatcccacacgcagtggtcgtaaaacattcggcaaacactgtttcaatgctaggaaccctactgaactcttccatgaacttcctcatttacaactctgtgagataggttctattactgttatctccactgtacagaaaggaactaggagttaaggaaatcaggtgacctgacccagcacagacaggaagtggcagagcaggatttgaggcccagttcaccctcttggcccattgccctcccgcccccacttgtgaaactgccatgaggtccaggccaggtggttttggctgtgacaatgtcctggttgtcttgaacctctttaatgggatgcactgttgtcctgagtcagtgtcccattgttgtgtgagccagcagcccatgtggtgccacacaactgaactgctgttgagtgtccctgctcatctagttcactatctgccatggagccagcacaacgattgttgctgagagccttcaggccactgcttgtacactggccccaaatacacacttgaatgacaaggagaggagtccaaaaaagagagtcgagttgccataggctctgccaagccacttctgagtacatctcaacaactgaacggctgcccacctctgtggcacgagcaatccctcagtttatggcatttgcccaagcgcgttctgcagaaatcaatgtccgtgacgtgcttcccaggatttacatgctgggaggatttcccctgtggggtttaagggccagtatctcaggggttggcccatcagtgtttgaaaatatgagctggagcggactctggaaatcaagacaagtgtacctctgagaatattatttataaaagcctttttccaaactttagagtcttggtgcattttttttcaagatggcatcaattgcctggctaggaatatgcaatagagtccctgtagaaatgacttccattcatcctcagggacctggctgtggggagcctttagggaaagcaatagggatcccctattgctaaggtatggcatccaatgactggcaccaagggtggtgaccattgctgagaattggctgtagaattcccatttacattgatatcttgacttgctagctggacagataactatttcaaagtagaaaaaagcagacaacacagtaagcatcgaatgaaataatttcagctcaaatgtcctgacgtgcacaggaggccaacactaacaggcagaaacttttaaccggcatgggagggcaacaccacacactagcacagctcagaatcagcagctgcaacccatcaactcgtggctgagcatgctgcgggaagggtttttgggaaacttgaccttgtccaagcttatcaacacctgtctgtcaatgatactctcttgcactcatcactcaccaagggccattttgagctaagtgccttcggttgcaatacacagaaatgtttgggaaagtttggatgtgttgggtatcactgaagaaaagaatatttgaacccaggtctcccagatcagtgtccataggctgctatatccacacggaagaaagtatgtttctcatgtctcatgtatgcattgtgaaatgctgcagatagcaaacaaaaataagtaatagatgcaaaatgcttaccccaggtcctggcacaaaataagtgattgatatgcaacagcaataataattgcttcattattctctaactactgcctctattcctactagtacttctcctgtaattactacttcaagttaagtccaggtttgcttcagggatccttatctaaattcactgtggccttccacaaccaaaaaggctgcgcttaaatgctacacttcatgatttgtagcatttcactctagatggctctcttggttttaagaatgaggggcattccaagagggaggactctgcagctgtaaaaaagagtggtgtctatctccaagaaatatacttctgtgaaacaaagcaagatagagaacaggaggtgctgtatgctcttatttatttaagacaagggggatgccaatatacattgtatattaaataaataaagttaaaagtcataggtgtggttataaggggaagaaagggaaagagtacaagggacagagagagaagctagacttgtctgaatagacctggtttgagtaattaatttaggaacccaatagatattttatataatgatcaaacacaattaattcaaaattttaaaaaatctattcctacaaaccaagggcaaaaaaaaaaaaaaaaaaaaaaaaagaaagaaagaaaccaaaggaaactaactacatgttgatttgattatgtaacctacagagataatttgctttaggtgaattcaaaatagcttccctaatgggttatatcctaagggcaaaaaggagctgccaacatggttttcagtatcatattattagtaatcatattggtattgtcattctgaaattctctttctttcacacatgtatgtagtaggaagaagcaatgaagtaattatgctaatgccgctagaaaagtatttgcataagaaaagaaatacaaatggaaaatcaaaattaaaacctaagtttgaatgaaaaatgtcagtttgaatttgtgatgtattttcttttgggaaaggagagttatttcctgtctgttcactgaaaagacctgaaaatgatgaccaacccaggagtgctgggaatctctacagccagattgtggtctctaaataccactttcaccaaaacgaattggggctccttagagaaatgtctgatcccagattcagggcaaatcctgcagaacacgttgtcagataagaaagcaagaaggctctccaggatgcctgacatggtgtcaaaaaaaagtaagagccaacatgaggcttctgttggccagagacatggaaatttacatggtcagagagtttcactgtgaatattaaccacaatggctgaaatcacattaaacgtgttaaaatccacttgctcgcagtaatacttaaaaaatcaaacaaacaccttattagtcacctttggaggccacatcatccattcattattgtgaaaactggcaaaggcaaataaaaaagaatccagcatttaacttgtgtttgctgtgagaactatacctcaggctagccaaatagttgagaacagaaattactctttatagaagtatggcagctcaaaaaggaagaaatgatgatagattgtttaattcccaaaaataatggatttaggttatagttattaatggctattgacacgacaagaaaagagttagttgggcatcatgtacttccaagcctgaatcatacccagcttctagatctaagtatcagtttacaggaaataaatacaggggacagagaaacatgttaaaggacacaatagagatgaaatcagcaaaatccagaatgaagaaatttctgtaggacaaatgacatgtttttttcaaaaaataaaaatatagaggaaagacagggagaaaaaatctaagattaaaaattgaataaaccaactgtaagccaacaagtaataaaatttttcctgttgtctattaagttgttttaaatttgactgtatatttgatgatactctgctctcattagataggatgtaatgttgtttttttagaagtacaaactgacatatttattgatgaaagagtgtaatagttggggtttgtttgtcacaatactttgctttggtggtggagagttggtgcaattgatgaaacaagacaggccatgatgatagataattgttagagctgggcagtatgtaaatgagagttcattatgttattctctttattgggtgtgtgttggaattttccataataaacgttaaataaacgaaagagtgtgatatgtgatataagcctttttttcctcacacatctattgcatacacatattttgtctggcaccgtgctaagatagcagatagaaagtttgctatgatgcagtcttgtcctctagggactcgtggaagttggagagacaaggctgtggtccagagagcacagggtttgctggaaccctgcaggagggcactgctgctgtgctggaaacctgctttctggtgtgatctgacaccagcagcagccaattctctagagcccactgcctcctgaggactcagcagagccacagaatgaaggaggtggaattatctctattgagatgggaacacgcactagtattactggccacctcaccgagggtactcctggccaggtaaaaatacaccttgtagaatcagatataatgcattggtgtagagaccatgtgctcactggcacacatgacaactttaataaagtccttcaattatctcacaactaactgagcattgctgctccctgatactacagggagtcaggtgggtcgaccaacacctgctgatgtaatgcaatcccttcatgggcgctcatgataattctagtttggggaagtgtgccttgaaatggaagggggaaaaatcactgcatcgggtaactaggagggctattgtgtatcccaggggatgctgtaatccatttaaggcatttttagttcttagccctagtgtgtgcctatagcctcatgctctgtggtttaggatgagctgaatggctgctcttagaggttgctctgctcctgcctaagtctccacacccaggagaaacccacaactcacctcaaccacgaagacaaatccatatacagtggcagcagctcaaagaagcaagtgacaacacagcctgtctagcactaccctgtgcagtatctgttgtgtgccaacccatcagctttgccaaagatgtctctttgtggcacagggagtctaaggtggccattttctccatttctgcttgctatgagatgcagctaaagagttcatcagtgatcaataaagagccacatgcttatgtttgctccttggatctcaaggacacttttttttttctttaaacctcacctgcttttagaggagtccctgctgggagggaaagaacaaaatactcttaaagtagaagagcttctgtagaggtccctggtgtctccttgctccctgaggacagccacagctctggcatctctacatagttttctttgatggagcctgcactcctgcaacaaaagggcctcaggtgagctctccatctgtggggcttaccccacgctctctaagggcttgggggcataaatcaagcaagtggcgattacaatagtgggagacccagctctgcctctgggcaaagtcctgcccttggggatgcagaacactgagctgttctccataaagtacagcttggaatcatggagcaggtcaagaaaatgcacacatttgaagaaaaagaacagaggacagaaggtagaggtgggctgttttccaggaaccagccagaactgttgaggggagaatgggctcatccaaggtattcatgtgcatgtatgagtcctccaagagcacagacaagtgcctgatctctcactgtgccacagccatgacagcacagagactttgacacacacttctgagcctgaagttactcctcccttctgcacatcctcttccaaattccccttcccatcttcccctctttaacatgaaagctacccttgactgtgagatagcatgaaagtttgggcaatttcttgaacacacatgaagagtccttgatgattcaagttccatttggtccccatacacaggtctttccacagacaaacgagatttcttggggatttcatatgatacagttgttccttctccatgcaagttgtagtaagtcttctggcttcttcttactttttaccaccatgttcattgtcaaggtgtcacaggtcatcactaaccgttttaatgtcttctatggacacacaactactggcattaataggccaaaaaaagcgctgcagtgaacagtctctctaagtattgtgtagaccacattggttattctgtatattggctatacagaaaaatgtgtgtgtaaatgagtatgtgcaaagtagacctatttcatgttcatagaagagtctgagaagtaaggtttttatgtgggatttcaacactttcatctcctgccttaaaagctatatggtttgatcatctgtgtggatgtgatacagaatgcacccaaaaccctttgactaaaagcttcagagtgtagctgtcttaatttggtttttaaaatacagagatatgggagcctctgcgatatcaaattccagaattatttgcaaatttcagaatatgcttgaattttgccttcttaagtatatgtagttaggaaacaatatgaaaaatccacttaatcatgatgagattaaaggatttttaaaagctgagttgcagacacatttacattccccgataatttcttaattttctttcaaatcacctttcatcttcataaaatgaactgtaaaaatccttctgaattccataatgtgccaagaaaaatggggaaaaattaaggaggcccctaccttttaatcattctgttcataaagtgctttaactgcacgccaggaaaaaaatggaggctctggtgtctgaggtattctgtgccataaactcccataatagaaacagatggtgaaactgccttggaagtgaagaaactagtgtacacgcagctcaccctaacatatgaagagattcagggctgacacatgaaggaatgcatttggcgtggtgccagcagtacactctaattcagccgtgagtgttcaagcttgagatgggagacccacaatttcaggatctggaatgccggcagctccaggatttagaatgccgtggaaggttcttgggctctttccatcctgccatggaggacggtgttctcagtgtttcaggtgaccgtgagttccaacagagagctcttcctggcttttataaatggttcataaaaacaatagtggagaaatgccaggtttgctggagcttcctttaactaagttaggatttgctttttacctagagctgccgccagtggatgctgaaagaagagaaaatgtgcaggacaaagagacatcagtgaaaatgatattagacggaaagggaaggaccctggtgccagccccacctgtgaccctagttgattggatggcacgtgcaggcaaaggagcctctcttggatatcgtgttttcccaagaaaattgaacacatttccatgttgtatcccaatggcattaatacatgcatttttttttctatgtgctgtattagttagggtgggttaaattctgttacacagaccccaaaacgtagcgatgcaaacacaatggaagtttacgtgtcctgtatacagcagtctagggtgtgcaaagtggtggggaggtctctgtccaccttgaggctccccatccagcggggtcttttcacctccagcacccagcaggtgggagggagagagcacagtggaggcccactgctgccttcagagctgattcccagagttctacattccccttcgactcataatccactggtcacaaggacttgagtgccacagccttgcacgtagacagagaagttttgatggacagctgcattgtggcacgtggatgtattaactagatgttctgtcgtcccaggagggtcttgcatgttctccccacctattcaagcctgtctgaaattgatgctctcttttcccttccaggaaatgtggtgtcctctgatcctccttccttcctgagaactggggtccttgcagatccgccaagtccagaggtgcccagtggccctgcatttccttccaccagagtcagctgaattcagatcaaaacttagaagaacgttcctccctccacgggactcagccctgaggctggggtggagctggggaccagacccagtggaaccctcattgtttatcctctctcatctctgatctcaggcactcaggtcccaaccgttctcttcctagcctctttacttctatggaaatcactcagacattgagagacccctgttgtgagaggttgggagactcaagctctacaagcacaagccaatctcagctgaggctgagcctgaactattccttgtgtccctgcaacaattctccttctcagcactggcaaatgatgtttgtttcccaaaagcaaggaacatgtgaggagcagagtgatatttccacttaggaccaaaccttccaataggtacaacttccctcatgccattagccctccttgatccagagaggagacagccaggcaactttagtctctgcagggcctagtcctaaggtgattgtgtaggatttgggagaggaaggggagagctgaccactctgatgttaccctgagatggctcctgtgccgtgactgactgtgctgtgaccaggagactcagcttacctggagtggggctgtagggacacatgagccaatttcctaccttaggctggccagaggctggtttgggagcaggactaggttttgaggggtgctaaagcttaaacagtttgagaggccctctaagaataagagtatacaattatgagtgcaaaactgctagagttcctccagggcctgtgcctggtgggtggggcaaggggttccccagagacttgagcttcataaggactctgctgtgtatggaagtagggggtagggggagaacaggcatcgtgtctaggttgtgtgcaccagccagttagtgctggtagcatgaggcagttgaggacatctggggctgagggtctttctgagagcagctgatggaggaaagggaggcccttgcagaagaaaagtctttgctgctcagggatgggactgaaaggctgattgtacagattcctgaccccttcagagctgattcagcacttctgcatcacctgaagaaagagaaagagcgctggtgccccttctgcttctccagcctgctttttctgactgaccattccctaccctggtcaccccttcacctgtggccacagacctctctccagtaggacttatagctggtttcccattggccatgtggcttccatgagagcatgcattctcaagagtaagcccaacactgtctttccaggaggctctcctcaccctcactccccaccccacttcctgtacctggaatggtgtggggaacagtacctggaatggtgtatggaagaagcctgattagatgcatggaaggatgaaaagatggaaatctttagcaggttcctattgaatggaaggatcagacactgcctcacagctgcttctgtatttatctttcttcttggcaagtcttgctttgaatagactgcaagccccctgtaagctggctgtgtgtccattgcattattgttaatctctcacagcctggtagagggctgagtgctcagaaggatctgagcagggctggtggtgcagctgactccatcagtggctgctgttgacatttctctagcatgggaagacagtggaccctcggtgtgcaagggaaagatgggctgcctcaggcatacaggaagctgctctggttgcaggtatactcctagaagactgtgggggtgtggcagccatctctgcaggcaccaggcaggggtagctaggggtcagcctcccatctgtttctgctcttcttatcctcctgttcatagccagctcccttgagagccttattcaggctccatgaggctcagttagattctagggaagcttcttttttcccattgcagaagggtcagcagtggaggacaagaggccaagtagcctcagaatattggggctccaggaccccaaagggatgtttcccaactgattctctaggcccataaacagatgggttccctgagggccctgctctgtgtctgggggaaggaaacacccaggactggttgaattccagtgagaacgatgctgccgttgatttgtggtttgacagtcaaaaataatccaagcattgctttgcatgtgatttatacaagtgtcttaattggcatcttgattatatgattgcgtgaagggctgttttcaagaaggtgtatctctaaatagaaaaaagaagaaatatacagctgtgaagtgtgcgtgaagccccccaggatctatgccttccctttgcttttatgcactgacaccacattttccagtttctgcccctagactggacctttagtgggaaacatttccccaaattgcataaatttttcctgcagacatggagcttggtttgcagtttttctctggatctgctgcatttttctctgttacacaaacttagtgatgtggtctctcctagtctgattacagctaattattttagaaatatattttaaaggcaagtgatcttaactttatggctaatccaatggagaagatctaagaaagacctgaaaatcataaaatgttccagaacattatattttatgcagtccagaatgtgacacatggggtctttaataattcactgcttgttaacattaaacaactgttaacatgctcaaataattagttatgcttgcttgacatgtttgcatctttaataattgatgcatttatcttaattactaacagtattatggtcgtaatatgcatcttttttctatcttagaattttaacaaaaactgactttttgccaaaaatgattatgctctaagttttaattactcattgtaattaaattgcaagctgcagtattttactaaaatatctttcacaaaaatatttaatggaaaagaggtgatttgttgtttatgtagccaagttagtaaatatttcataagtttgatattaccctttcagagtggatataaaatagcattactttcaagatatgagtcaatttaaaagtcttctgtagcttaagatttttctaccatttctactcaaaatgtcattcccccgccaatccaccaccactatagaaatctggtaccactctttgtgtggaagagaaaggtttctttaaccagccaggcaagtaggaacttgaacctctgtttcaggaggtggtgttgattggaaaccaatagaaaagcgatgtccacactttccctccatttcctttctccagccctgtttatgtaagctagtccagaagaccagcattggggtgactgtttgattaaaatgcaccttaataaggacgcagacatatgtcccattgtttaagctttgtccaggtgctcatgcatgactggaagcttactattgattgagaaagacctactgcttttgagaacattagcgctgtaaaagcctgggagattatgagaagcaaccacttcatttactgacagggaaactgaggcttgcaggcctttggcccaagctcacacagagtgacccaggtagataagaacttagatactcagatgacatgtccagatctctgtcttatacacctacaggcctttcctttagcccgttgggctatctttgaggattcatcagggttcctgcactaggcaaaatctatcagcacaactggtcagttccacagaaggcagggttatgggccaagaccttgccatttcttaactttctaggccccttactgggattccattcatctgggctctattttcactgttctggggctcacctaggctggaagcatcaagaagtacacgtggttgagatctgggtgatgccccaatgtgttttgctggttaattagttactgctgtaagtcatcagaggttttcaagatgcaaatcaagcaattatggggctatttggaaatgacaagcagaccaagagtaaatctcagccccagcagaatgaggcccggcttactaaggacccggaactcaacccactccagtctgcatcctgaacacacaaaactcttttcttcgtcatcaaaactgcctgacttcttggggacctaagagaggggcagggccactggatctgtagcatggggaggtgtctcagttcttcaccatcaatttcaaaagcacccagatcaattaagatgcctttagtcatagcaatgagcacaaaatctcaacttatattgtcttgaaaaatgtggaaatttactattccacaaaactaggtatccagagcagtggggaggagtgaggtagaacgcctccattcacagcacagtaatctcatcaaggacacgggttctttccatctccccagtctaccaccctcaagatctgcttcatcacaagccttggcccccttgggtcacacaatggctgcagctgttcagctaccatgttcagacacaatatccagaggaaaaaggtggcactgtctgtctctgtgctttccatgtaggaatgagaaaatctttcccagaggccacagcagattttcacctatgtctttttggctagttctgggttggacacttcctcctgaaccagtcattagcaagtggaatgaaatgaccaggattggcttaaatttgtcatccccagatagccttggcatagtggagtcaaccactgtatccaatatgctcccttatgtcaatcaatcaccccttactcagcagtcattctcagctgggtatgttcttcatgctgggtacagtgtaaggcactccaaagtagataaaataaatagacacaggctctgccctaagaaagtttttgataatagggaaatgagacatagaaacaaaccactaaatggaaacctactgcaattgtttagaagaacagctaacaaacgctgggctcagtacaattcatcagggattttctaaacatcttctatgtgcatagatatagcttaggtgttattgaggagacaaaagaacataaaaatgcattcttcctgttaaagagcttagttaaggtgtccagatatgcataccagggactttctctgtctttcccttactccagacagaagtacagatggctcttggcgagcttaaaggagtatttatggggagtaatttcagagcttctgctgggcctttgcataggtaagagagtggccattaagatgtgtctgtcagttgagaaagcttttcactctaagtaatagagaaccagattaactgtgtctaaaacaccgaagacatttattgtcacaaagtctccaggttgttactcagctcatcagtgcaatcaaggtttcagaatttttctctttcccttctctcacctttggattgctagactttcatctgtcttttttatttttttgttttgttttttccctcatggtggcaaaatgaccattgcagccccaagcatcaaatctgtattcaaagcagccagtgctctgcgggcacactttctctttgttcctgttctttttatcaggaagcaatataacttccttaaaagtccaccaataaacctcccttatatcttgctggtcagaacttggcctcctgggcattgctgtgtgcaagggagactggaagactacaatgagacgtggaaaaggagtggggtgtgaggaaggcagtggatttgccaatccatcatgcctatcacaggaggcgtggctcagtcatatgtctttctttcataacaggcaggaggaccaaaggggcacaaaatgagaacagaaagttggaggaggggacccactgtgccattcaagctcttgtgagtcattagtttcatcgtaagagtttcttttcaaattgtggagcagttgggcaaatatttctttcccctattatattttagatggcactgtctaggatagttgttggctttggttaggagtgtgtgtgtgtgtgtgtgtatgagtcaacccattgggcaatttgaagaatcaaaacaaaacaaaccgacaaacagcctcaacccctggtactagagacatctgtgcatggatggccttggtgtatctaaccctgtggttccctttccatctccatccctctacttgttgcaaacgtagggaaaaccctgggacactgagaaacaggtggggcatgggtgatttgcggggagaggggcattctttcacaagatgtggtagagatagctgagccttgtgcaagagtaagactgattttctgatcacataaaatgcaaagactcagcattagaaagtctgatgcaaccttccctaccaggataaagtctaaacaccttaacctagcactaaaaaccctccaagatttggaccctgcagcttccagcctcaccagtctgccaacagagacagtcttcatctccacatcgccctcaccctgggttcctgtgtgtcttcacatctccctgtttttattcatgccccttcccgtgtccagagctcccttctgctccccgtccctatgctaagacagttcatctctccacaccctgctggacctttcctatccctaagcacagacctcagggcctgggcctcctggagccacccactcagcagagtcacagcagcctggggccaggacttcccttccaatgactttgccacagtttggctgcacagaaaggtctgtttcctgcatgccatgtctgtaagagtcttgactgtggcccaggtgcaagagacagacatccttttgttgtgatgagaggagtgattcctagccttgccacttcttagctgtgtgagcttgggtgaattattgaacctctctgtgcctatattttgtcatctataaaatgggcataacaatagcattttacacgtgtaggaagcccaatatggccctcttcaggctctcccattctgtaaattactcaagggttgcttccacaggacagggatggcttagaaagtcccagcgtcacttccacctgtctctcctttctgcttctgatgagggcacttcacagctggcctaggcttgcttccactgcaggcagggaagacagaaggcaaggaggccttctttgcccagctctctgggcagagccttgctgatgctccatgctaggtatccactttactgctccccttgttctgagagctgcctggttctgctcaacacaacagaagggctggtctggaaaggcctcctgccttagactcccactggcccagagccaggtctttcttctgagccagtgtcagacccccaggccctaatcacccttgccctgcctgtttctcagtgtcccaggctcttccctacatttgtgataagtagagggatggagatggaaaggaaccgtgggatgagataaacctatccgcgcaaagatctctccagcactaggaaatgaggctgttggttggtttattgtcttttaatttgattcttctaattgcccaatgggttgaatgcccaaagggcattcctctttggagacttctgtgtcctttctgtcctgtaggctaacttggtccaccccgacaggctgcctcgacatcagttcttaggatgaagatgttacaggggcaatcaatgggctctctgcccaatgcacagagaggcttttgagaaaggaaaagttttattgtgagtctactggcaaggagacaggaggaaacactcactatgtctctggagctgagggctgggttggattttataaacatagaataatgaggtgtgatctgattagatcttgcaatgaggtgatgacaggcagcatgatctgattggatcctacaatgcggtgatgccagtgtttgatctgattggatactggatcctactattcatgtctgcttctcaattcagttcgcactcctcagtcccagtgcttaggttacccatggtggttgcacagttggctcatctgggcatgctcaagttatgtgaccttccacttggggtccatggccactgaacaacagctcataactttgttacaagaaagttgagccagattggcctcgtgtggttccaaagatagtgggatctgtttctcccgctataaaatgagtaaatggcatgtagtcagtggttttgaaaaattatgttaatcactgcaaacctttacaaagcatttccaggcaattccatgatggaagctggattctctgggtcaagtagggcaggcatgggcaggggaggagacgtttccctccccagcctctctgccaaccgcccactggagatttgcttgggaagaaggttctcggaagcaggttctgcaccaggatgtgtgtgcagggacatcctgaggaagggcatccagggaactggtaagggagggggaaaaacatggaagagaaggaaaccactcaagggcgagagtttctgaagtccctcaaagggtagccacagcctgatcctgctgggggactttgcagtgttagttacaactcagtgtcatacacttctaggtaagggaccgcagctttcaagcctagattaggaatgacatccaaaccccatgggggaggtgagaatattcctcagcattttatactcaaagaggacagagcaaggcttgcagccttctgagggtggtctgcccaagatgagctgctggtgctggctcctggaagagaagacccactcaagtcatgggtcacacaggaaatgatgaaattgagtccccaaggaaatccgggcagagcaatgacatcatgtctctgtggggaaggtgcctgaaaccgagcagatgagggccctggggcagggggcacagggagaggtgggctgcctctccctggacgtccacttgtctcctttgccaagcacctaatcccaaggatctgcagagcaatggagggggcagccgagaggaagggcggacagcagagtgagaatagaggctgtgcccctgcagagcacttttccacggatgtgtttttctttcagactttatggttaatttatttatctgaccactcgggaagggaagaaaagtaccattttatgagcgcaggacaaaataaaaaacaatagcacatttaggtgccttaatttttctgttcctagagatttatttcattgtattatatttgacagcagtcaacaaacagcaaataggcagccaagtgcagttctcttagccgtaatggtttgtattctctgcacaaggcagagttttttttttttttttaccgcatacatcatttggaacttgatacattgatcccaaaaagtaatatacattacttttgttctcctgacataaaccagcaaaacaaatccagtggacggagtggggtggggccagacataagggtgtgactccctttgggaggggattgctgtgagtttagcacgtgtgtggggactacccgagaatgtcagggctggtgaggcgcaagcatgtgattaggtgagggcgttgtgtgagtgttcaactgtgcagtgtgatggggttcaggattgcttgtctgtgggtctagtgggaagcaaagtgatgttaacttttctagtagatatgagaatatgcagcctgggaagtctttgtgttcgggtgcatccaagcaccctgaatctgttaaagcttacatcaatgtcgaacaagtgttctggctttaagggagtggtcataatttgggcaacccttatgccccaagattgtcagcctggaagtcacatgggggccacatctccattcatattttaattcctcctgttccatgctctgggattccagtccctaccttagaactcctttggttatctcagcaagttcctagggtgctagtatttctcatgggtttctgcacccacaagtccttactgctgtcgttgcttggatccatgtggatgatgtcttctctgcacattgactcctctggcatctcagagactactcaccttccacagctaatgctgggctggccaccaggaagggaatgggtcctttcactaatgacctccaatgcagctgaaaccaggctgcaacttctggcaagacttgactgaggggatgacagcatcaggaaatgaagtcacagcatggcaagtagatgcggctgtctccatagcccacaggctcaggcccattctgccctaagaggctggttggtgcagcctgccaacttcctgccagtgtgtctccctgtgccaggaactggcttcttttgtcctgacagtggcaaatccacatgcatgactccatttttttggagtccaggttcagtttgcaaagaggccagagaagaaaactgttcttgggctaaggccagttgctgcttcttgacgccctctcttatgacggttgacagtgggtgagtccagttccttcaaaggaaagtcttcctcctcccacctccagcttccttgaattatggccacagaggatcaatggcatgagagtgacagagactacttgggagactgcattgtttgatctgtccccccgacaataataacacataacacgctagtcttcgtcctgcctggtcagggaggaaagctttgaccatctgctccctgcaattggagtgcccccagctatgatccaccagcaatcgcttatccctgccactcagccatttatcagtactgtcctgtctaaatcccaaaatacaaaagctgtactccccctagaggaacaaaaccttctgagattcggtgctggattgatcccaaataccaatttacttcccctgaacgaacctcgagctctgcttgcccaacaatggtgagttctgctttctccaaaacactgggagaggatgtgctttccattcacaccctgcagggccattcaggtggatttaccccaaaggaaagcagatggagtcttcttcataggcattttcaaatgtcttcctattctgagagagaaaacttatggaactattgagggaacagttattccaatgctttttttgttcccagggaaaactgaaacaaaccttgtaagtcttatcctgggaaccatgtgatgtgtcaattggcttaggcaggaatttaactttcagatggtatagagcagccacagtttggctggtactgtgcctggcctttgaggctacagagataaccgggaagggtcccagcccacagggtacgagtgccaaggagagcacgggtgaggtaggaggtgggatttgactttggaggcagggctcaggcactggaccaaattgatgactaagggctggggcagaagcagctttccataagacacacccactaatgtgccatgtcagtttaccattgccatggcaacacctggaagtttccacccttttccacagcaatgacccaatgacctagaagttacctccattttcctagaaatttctgcataggtcaccccttaatttgcacgtaattaaaagtaggtataaatatgagtgcagaactgcctctgagctgctgctctgggcacactgcctgtggggtagccctgcttcacatggagaagtacctctgctgctgctgtatactgcagcttcaataaaagttgctaagaccacctgctagcccttgaattcttttctaggtgaagccaagaaccctcctgggctaagctccagtgtggaggcttgcctgccttcattacaagcttatcctcagagaccccacagtgagtggcccctgacaaatgccagaaccaggatcccagagagtgacaaggaaagggggaggcagagatagaccctggctggggaggtagctgtttgtcatgaatcttatttattgctctctactttaggaaaaagaggtacagaacaagctgtctgtgtacgtcaaagaacttaaagggccaacaagtacctctgagtccagttgggagtgaaaagaacccaaacactgatcccacttcttttttttttttttttttttgagacagagttttgctcttgtcgcccaggctggagtgcagtggtgtgatctcggctcactgcaacatccgcctcccaagttcaagcgattctcctgcctcagcctcctgagtagctgggattacaggtgcccgccaccatgcccagttaatttttttgtatttttagaaaagacagggtttcaccatgttgggcaggctggtctcgaattcctgacctcaggtgatccacgtgccttgggctcccaaagtgctgggattacaggcatgagccaccacacctggcccccacttctttttaaacgagcatgtggaaatgaccagaacttcctttattctctgcaggtaccactagaggtcagctgtggagggttacagagcagctccaccacttcatcccacacagaccctgccaaccacggcagaatggagaggagccccctgaacctccacctagccgtgtgatctgctcagggttccgtgttttgggggaggggaaagaggccgcctctggggacactccacactctgttctttctgcctcacagggtctcagaagcttccgaatgatgccccaccacttgcaagaggggcaggtggtatggaaaggtctcttcacaggcacccctctgcatgtgcggccctcagccctgcggcaggacaccatgctgtccatgtcagtgaaaagaaaggggggccagtccacgctgtgttggaacacaggccccacacatgtgggcatgtgtttctgggaaccacatggtgtcaggcccatgctagccactatcaccacccaatctctgcctggtgccctggggcttcatttggaaggagaaagaacctgggctgtcagagccgagacaagccaagctatagggtaaggctgtgggccccagataagccaagctacagggcaaggctgtgggcccctggattcccacagaggagccaaacagccaagagacgagactttatttacaagtctctctgtcccaaacagcccaggcaaaatgtcacgggtgagttgaggagccgggaagtcactgctctgccctgagtttcttcaggtacttgctgggccagggacagacctggaatggggctcatggtgtgatcattttatgagttgtggacacacaaagagatctccatcaagtcaccttgggtcacctgggatattcacagaagtcccacaccaggctccataactgtactgggaccccaagtctccccctgcattcttctttgagaagtagaccctcagagggaaagcccaacagggtaggaagacccaggttcttccactgtcatgagtgcccacagccttaggtctctgggccataagaacatacgctacctggggcttctagcccatatcagagaggggactctgagtcccaaagtcagaggtttccgggaagaaaacattgtctgtcttttcaatagagacccagaagtctctgccctgggagaccccaggtgacagtctttcagaacccctgtgggtctggcattcatgaaacctgagacactgaagatgtaactttaatggtctccactaattcatggtctgcctttatgcacttaagaagagaactcttccttcttatgacacctccatttattcagaattagcatgtaaagtcctaaattaggcattccgcactcaggttctgacagagccattactttttatgctgagagagttgagttaattttaaattattgaggcccagcacctgagtgaagtgagcgtcttcacagagattgggcatctgtaggccctgctaacacagagacacaactggaatgaaacccatttctcctctgctgaccagatgcatatacacaatggacccagagagaggtctggcattgccattaattttgccagaatggattttgggcagaaccaggcttgggtctgcctctcaggaagcagaaggccgacttacaggtgcaatctgcttgcccgacccagttatggagtggaagggccttgccttccccagcaccagtctctaacagccacagtgctaggcgctgagactgtgtttccaaggagtccttagtggcagagacacttggggtgaatgagagtcacattatagttggacaggagaaaggaaccagagcctgttgatcctattctcagtgcatagcctcctccctggcacctgcctcccagcagggcagcagagagctgtccatggacttcagaaagttgcttctggaatctcccgaggcctcctcctcattgtatgcggccagcatcctttatagggtggtcactgcaggatacctgctgttctgtaaaatgtctgtgaccttccccaccacccagggtgcccccagtccccctcgttagattgagttaagatgagccttgcatctattggacagaaatcggcaacagaattggccagctggaacacgggcagctgcctccccagctgccaaggctgccgccaggatatgaggagcttgagcctccagccagcagatcccagagatgcctgtcttcagtgcagtcctcattcctggaggaccctaactccactggggcatctgtattccaggagaacccctctcctctcccagtagcccaagttttttccagagaattcctactctcgttggcccctcccacttcctcacaccacactgccaaaacagcagcactcccaattgtctgcctgtgttgtctccagggtcatagaaggtgggatgtgggaccattctaatcagatgctaaacagtttgaaatttgcaaataatcacactgttgacattaattgctatttttactatctgcaaaaatttgacccattgtccaagtaaacctaacagatatgtggattatatcagttggggctgccaaggtgacactgtcaagttgatttcatgtcattttaatgtcttctgtaggccctatactctctcaaccagaggtcctctggctagagtggaatggtcagagcttagaagcttgttctgcccatagaggcagttgttagcctcagacaaccggggacttccaggtgagaggactggaattgttgtctgtcctggaggctgggagagtccaaagtggggacagtgtggacagcagagccatgctctaggatcagcattctgcagactgcctggagcagcgcggagcctcctaggagcttaacttgatcaactttcagcctgagctggaactaaatccaatagagattggcttggagcaagagacagctggctgcctgggccctctggacagcggccccctgagagcggcaaatcagaaacaggcgacaggccaagcccagcctcaccctggtgtggaacacaaagcagacccactgcgcattgtggaagactcctgtgggtttctgctcctgaccttgagaacaggaagaacccaaggttcccactgcacctatcccaagaagtccatggtctggctcaggccagaagccaaaggcctcctggccaccctatgctgcaaaacactcacattcatctactgggaaacgggcagcatggcaccgaggagtgtcgtgttcagttttaaaatgccacaaataacagatttatagatttttctaaatacattattttagcttgacagcattaatcattcatgcttccttctttcatttttctacctgcaatggattattgaaacagaaaataacaacgagaaaggctagcagcagtatcaaaatgtcaagtttgtacttacagttgtatgggcccagacagggtcaagagccccaattatttgtgtatgtacacagtggtatgacacgaaaggttatgtcacctgcagctattttcctgcagatttaaataggactgatattcagctgtacagtgagctgctgacatggaacagaaaattgtaaaatactgcaaactctggtgtcagaacctaaaatatgaattgggtgattgtaaggtatagctgtgggcagtgccgcatgtcgtggtgcaaatccgctcaattactttgggttattcttggcctgcactttttcatttaaacataaggcaagagtgaaatcacaggactgggctgagggtaaaatgtcaggtctgtctactttgcaagatgccttctagagaccaagagtgcacacaccaaccagcctggacagagagaacaatatgcatgtgaatctacaagggtgacctggggcacccctcggctggtgaagttggatagatgatgggacaataaaggcctattatgcatattctgtaattttttgttttcttttagaatgtagccattatatggaaagacctgcaggaacgatttgccatttggtcaataaatgaaacgttgattttttaaaaaattaattttattaaaaaaaaaaaggcccggtgtggtggctcacgcctgtaatcccaacaatttgggaggctgaggtaggtggatctcctgaggtcaggagttcgagactagcctggttaacatggtgaaactttgtctctactaaaaatacaaaaattagtttggcatggtggcacgcacctttaatcccagctactcaggaggctgaggcaggagaatcacttgaacccaggaggtggaggttgcagtgagctgaaatcacaccagtgctctccagccttggcaacagagagagagagactgtctcaaaatcataataaattttttttaaagatggaatctcactatgatgcccagcttggtctcgaactcctggcctcaagcagtcttcccgccttggcctcccaaactgctgagattgcaggcatgagccattgtgcctggccatttttttttctgtcagtgaattccaaccctatgtcttcctcacaaggattctgtgagtatctgtggtcaatagacttatggtatcatacatgggaataaagccctagaaggtactacaatatcctttcgcagacagctcaatatctcatttgatcaccaccgccacccagtgagatatgttttagacaagacaaacaaaacaaaaataggataaacacagatatagataggacatggttgagaaaagaatcaaatgttaaatgccactcagctatcaattagcagagagggctccaccccacatgcagatttcagtgccccaggtgctgtggataacttgtgagagcaccccttctgtccctgcttcaaagggcagtgggtctgcataggctaactggtcctaggaatggcacagactcttgttcctggctttcctaccactggggctttgggaagcaactagcttgttttaggtcaagattttacggtttagcttaccagtagggaggataactcaaaaggcagtgatttccaattctaacatattttgtagtgccacaaaaatgccccctctagaccaacagagatagagagaagttgacttttggacctcagcctgcctagtagctctttatcccgatgccatcctatctctccatgcatggcacccctgttctcaacttcccatgtgtt

SEQ ID NO: 1376 - DNA, 74447 bp, Homo sapiens
agtagattcatgtattgtcaggccaaatcctcctatttcagtgatctctgtcaacctttcacttaagggttttagcacctattgaccatcatagcctagatccattattttattgagcgtctttcacttttattagctgaaattctcccaaagagaaaaactctctcattaactatttgattgcactgaaatacagtttctcaggccaggaaaaagaaatactctttctcttcaaaagcttttagaataatgattggtgtcctagaggtttccaaaatttgtcaagttaaatcattataaatttatgtaatttgagcatcagaatatattataggcatataaatatttttcatatattattattattataatattgaagacagagtcttgctctgtcgcccaggctggagagcagtggtgtgatcttagctcactgcaacatccgcctcccgggttcaagcgagtctcgtgcctccacctcccgagtactgggattaaaggtgtgcgccaccacacctgtaatttttgtatttttaagtagagattgggtttcgccatgttggccaggctggtctcgaactcttggcctcaagtgatcagcccgctttggcctcacaaagtgctgggattacagtcatgagccaccacaccaggcccatatattaatactcaaattgtctcatcttgagcaagagggatctttagttaatcttgtaagtttcccgctccagacatggaaatagccatttctttaaaaacttttgcctcttttagcaggaaatgatattgtggagactgcagtctgaggattatggttgctctttaatactgagttattggttctatagcttttaagtggacagagctaggaaaaatgcatcttttaaaaagaaaaaaataggccagtcacggtggctcatgactgtaatcccagcacttggggaggttgaagcaggcgaatcacctgaggttgggagtttgagaccagcctgaccaacatggagaaaccccgtctctactaaaaatacaaaattagttgggcgtggtggtgcatgcctgtaattccagctactcgggaggctgaggcaggagaattgcttgaacctgggaggtggaggttttggtgagccgagatcatgccattgcactccagcctggacaacaagagcaaaactccatctcaaaaaaaaaacaaaaaagaaaaagaaaaatatatatgaattttagatacatccaattaaaattaaaaagtatagtgcccttttaccttttatgctgaaaatcttggctcctcattacatgtttatttccttaattcatatatatttctcacccttgacactattgacattttgggccagataattctttgctctgggggactgccttgtgtgttgggggacgtttagcagcatgcctgcttctactcactggataacagtagcgccatccctctttctccccatcatcttcccagttgtggaaaccaaaaatgtctgtagaccttccagacattgcccagtgacccttaaggagtaacactgattaatctatcttctttctttatatattaatttcaaattaacagtaatgctaatattactaataataaaaagacaactaaacgtaatttaagatgtcttttgagttttcttccttagaatatattctaatagggatatatagtcaaactactatgtttaaggttacttgaagtaattttctatgtgattatgaccctcatttgataagtaggcttgtttccaatttttttctatttttagggattgctttggcttttttcttttttgatttaatttttattttttcatatgtaaaatatgtacatgattttattgtcagaactctaaagttacagtcagagaagtcatggtttcagtacatgtaagtgaaaaaaactcagcgtagagaacattgtttagaatatactctcttttatgtgcaaatggatgggaagagagacagagagagaagtgtgtgtgtgtgtgtgtgtgtgtgtgtgtgtgtgtgtgtgtataaaatatatattaaaaatacaattggccctcggacaacatgggtttaaactgcacgagtccacttacatgctgattttcttacacctctgccacccaagacagcaagaccgacctcctcctcagcctactcagtgtgaagataatgaggatgaagatgtttaggattatccacttccacttaatgaatagtaaatgtattttccttatgattattgtaataacattttattttctctaagttattttattgtaaaaatgcagcatataatacatatacaaaatatgtgttaatcaactatgttttcaataaggcttctggtcaacagtaggctattactggttaagttttgggagagtcaaaagttagaaacatttgcaattatgtggaggattagcacctcatccccatgttgttcaagggccaactgtacatatgatatatgcgtgtatatgtactatatataaggaaatgtgtgattatatgtgtgtgtgtgtgtgtgtgtgtgtatgtatgtgtgtgtgtttttttaaatagtggaagaataatccaagaactggctgggcgtggtgtctcatacctgtaatcccagcactttggaaggctggggcgggcggatcatgaggtcagaagataaagaccatcctggccaacatggtgaaaccctgtttcaactaaaaaaacgcaaaaaattagccgggcgtggtggtgtgcgcctgtagttccagctattggggaggctgaggcaggggaatcgcttgaacccgggaggcggaggttgcagtgagccgagattgcgccactgcactccagcctggcgacagagtgagactctgtctcaaaataataataatgataacaataataataatccaagaactaataaaaatggttatctatagggcaaagcaggaattggtgtttcagggacagggtggaatctggacttccgctgctgtttggtaatttgtcagtttttatcaacttgatataaatagaagatgaggtttagtagcattaccacaatcacttctcctttccttttcttctggaatatagatacatcacaatttttagctaattcaatttcaccacttactttgttatgattgttgacatattgtttactatgaggcaagaaatgactcttaattaatatacttatataactttttgtcactcctagaattactacttgccttatttttctattttctatgtattattaatttaaatgataccctcaaaattctttgtttaaataaggaatccatcgttgttattagtttacctcattttgatgcatgaagggataaaagggaaattctaaacatcttccaaaattctaaattttaaagaggataaaagaaattttttagtttttttttttgtttccttttttttttttttttttttgagatggagtttcgctcttgttgcccaggctggagtgcaaagttgcaatctcggctcaccacaacctccgcctcccaggttcacgcgattctcctgcctcagcctcccaagtagctgggattataggcatgctccaccacacccaactaattttgtatttttagtagagatggggtttctccatgttagtcaggctgaactcccaacctctggtgatccgcctaccttggcctcccaaagtgctgggattacaggcttgagccactgcaccctgcctgtgttttttttaactagtggactatactgtagaatggttggatcagaacctagaagattttttgtttgtttgtttgtttgtttgtttgagactgagtctcactctgttgcccaggctggagtgcagcggcacgatctcggctcactgcaacctctgcctcccaggttcaagcaattctcctgcctcagcctcctgtctagctgggattacaggcacgtaccaccacgcccagctaatttttgtatttttagtagagacggggtttcatcatgttggtcaggctggtcttgaactcccgacctcgtgatccacctgcctcggcctcccaaagtgcggggattacaggtgtaagccaccatgccctggctgaacctggaagttttgtgtggggccccaaatgccagcatctgttgttccttttaatctttttatctcctatgtgtaggtacatgccagcattcatgaggctaaataacagaaagggattgttgatctcattcatgttagagtgtatggtgaatctaaatcacatgggaactctacatgcagttatgtctaggaaatgtagttttaactgcctcagcctttacgggatggaaaagcatggtgggagactggaatacatgttacttaagcagatccataactcttgccttggtgtgtaactgctccctactcagactttaatcctcttctttttagtcccactcttatcctacccactccacttttttttgagatgaggtcttgctatgtttcccagactagtctcaaattcctgggctttagcaacccttccaagtagctgggaatataggtacagcccactgcatctggttttttaaattaataaacttcatcttttaggctggttttaggttcacaacaaaactgagtggtgtacagagctcatgaaaaagtaccaagtatatggatacccactgcccaggcacacacagccttccccactgtcaacatcttgcaccacagtggtatatttgttaccatcaatgaaccttcattactgttattattatacacattattattacacaaagtccataatttacattagggtcactcctggtgttgtacattctatgggttttggtaaatgtataatgactcagatccattatagtatcttacagaatactttcactgtcctaaaactcctctctcttcctcctgtttattccttcctctcccataagctctggcaaccactgatacctttactagtcatcattttgccttttccagtttggaatcatatagtaggtggccttttccaatgggtttcttttacttagcaacatgcatttaaggttcctccatgtcttttcataacttgatagcacatctgtttttatcattgatgaatatttcattgtctagatgtagcacagtttatccgttcacctagtaaagggcatcttccaagtgttggcaattaggaataaagctgctgtaaatatccatgtgcagatttttgtatggacatatgttttcaactcattggggtaaataccaagcatgattgctgaataatatggtaatagtatggctaattttgtaagaaactgccagactgtcttccaaagtggctgtaccattttgcagtcccaccagcaatgagtgagaggtcctattgctctgcaaacttgtcagcctttgacttagtagttgcagcaggggttttttgttgttgatttttttttttttttttttttttttcagatttcctacatagatgatcacatcacctgtgaacaaagacagttgttgtttcgtttttccttcctaatctgaatagcttttatttccttttcttgttattgcattaggtaggacttctagtacaatgttaaaaagcagtaatgcgagggaacatccttgccttgtgcttgtttatccctaccttttgagcgcctagattctccaattcttgagcctttccagtgatttctggccaaatctctttgttgcttattgtcatttgcatcttcatgatactttgtagctttgctattcagtttatcctaaatgcttctcatcctgcagtattatgttaaaatctcttgttcatctttttttacactcacgtctcctttttcttatggatttaaccctttattccttcactatcattttaatggcattttaggaaggaggaaaaatacatgcattcaagcctgtgtgtttagtcacaaatgttcattttgttctctagccgtttgactccctatcagtcatttttgtgttcaccctttcattttaattattctattcattttgctgatttctgcactatacgtggacgctttaaaaatcagtcaaggctacttggacctacagatgtcagtttttgtctccatatgttttatgtagtagttaacttctcaaaccttaggaactaggaacatttactcttagctttcttttgtattggttgactaggccaacatcaaagattaaaccccacattagcctatttctgatatgttattaatagtctagtggtagaataattcacaagtaataatttctggtcctccattttagaagtttgggaagttgatgaacagatcaagaagcaacaggaaacacttgtgaggaaagtcacatccatctccaagaaaattctgataaaggaaaaagtcattgaatgtaaaaaagttgcgaaaatatttcctctgagttcagacattgttacttcaagacaaagcttctatgactgtgactcacttgataagggtttggaacataatttagacttacttagatatgagaaaggctgtgtaagagagaaacagagtaatgagtttgggaaaccattttaccattgtgcatcctatgttgtaaccccctttaagtgtaatcagtgtggacaagacttcagtcataaatttgacctcattagacatgagcgaattcatgctggagagaaaccttacgaatgtaaagaatgtggaaaagccttcagtaggaaggaaaatcttattacacatcagaaaattcatactggggaaaaaccgtataagtgtaatgaatgtggaaaagctttcattcagatgtcaaaccttattagacaccacagaattcatactggggagaaaccttatgcatgtaaggattgttggaaagccttcagtcagaaatcaaatctcattgaacatgagcgaattcacactggagagaaaccctatgaatgtaaggaatgtgggaaatccttcagccagaagcaaaatcttattgagcacgagaaaattcatactggggagaaaccttatgcatgtaatgaatgtggtagagctttttctcgaatgtcatctgttacgctacatatgagaagtcacacaggggagaaaccctataaatgtaataaatgtggaaaagctttctctcaatgctcagtatttattatacatatgagaagtcacactggtgagaaaccctatgtatgtagtgaatgtgggaaagccttctctcagagttcatccctaaccgtacatatgcgaaatcatacagctgagaaaccctatgaatgtaaggaatgtggaaaagccttcagcaggaaagaaaatctcattacacatcagaaaattcacactggagagaaaccttatgaatgcagtgaatgtgggaaagcttttattcagatgtcaaacctcattcgacaccagagaattcatacgggtgagaaaccctatgcatgtacagtatgtggaaaagcctttagtcagaaatcaaacctcactgaacatgagaaaattcatactggagagaaaccttatcattgtaatcaatgtgggaaagctttcagtcagagacaaaatcttcttgagcatgaaaaaattcatactggagagaaaccattcaaatgtaatgaatgtggtaaagccttctctcgaatctcatccctcactcttcatgtgagaagtcacacaggggagaaaccctatgaatgtaataaatgtgggaaagccttttctcagtgctcattacttattatacatatgagaagtcatactggtgagaaaccctttgaatgtaatgaatgtgggaaagcattctctcaaagagcatccctttctatacataagagaggtcatacaggtgagagacaccaagtatattaaatgaaagaaggcctcttaaattcaacccatgttttacttaaaatatcttggcataagctcaaaaaagccaggatctttatggaaaaattttaatactttgttaaaaggtgtaagactggaataaatggaaagaaataccatatacatagatggaaaaacccagtattataaaaacctcaattctgaaaatctatagactgaatgcagttccaaacaaaatcaactaagaattttctaggatctttcaaaaatgattataaaattcatgtgaaatagaagtgtatgaattgctgcgacaattttgaaaagaatagaggaaacaccctcactgtatgatataaagttatagtcatttaaaaatgtgtgatattagtacattagtaggtaaatgagcagattttaaagaatagaatatccagaagcagattcatgaatatatgtgaactcagtgtatgttagacctgacatcatgaattagtagggaaatgatgacctagtcaataaaattgctgggaatatttgactctccgtattggagaaaataaaattacaacattacgacatactaaaaaatcaatattcttttttttttttttttttttttgagacaagcgtctcactctgtcgcccaggctggagtacggtggtgcaatctcagctcactgcagcctctgctttccgggtttttttgttttgttttgttttgttttttgtatttttagtagagacggggtttcaccatgttggccagggtagtcttgaactcctgacttcaaaagtgatcgccctctttggcctcccaaagtgctggggtttacaggcttgagccactgcacctggccaaaaaattaacattctaaaggatttaaatactggaatttgaaaagccaaactgtgaaaccattgggagaaaatagatgatattgtctatgacgttgaggccaaggagctttttttttttttttttcaagacaaaaggactctgtaattccacttctaggtatatatacatcctatagaaactcacaaataatgcataagaaatatatatataatatatgtatgtatgtatagccagatgcagtggcacatgcctgtaatcccagctacttgggaggctgatagaagaagataacttgaggtcaggagttcaagaccagcctgggaaacatagcaagaccccatctcttaaaaaaaaagaaatatatagacatatatctgcattgaaaacaacctaaatattcatcagtggggtaatggatgaataaaatatgatatattcaaatgatagaatagtatacagcacttaaaagcagtgaaccagatccatattgtgtaacatggatagttaaaacaatgttgaatgaaaaaaatcaaaatacaaatgaaacattgtgtaataatatttatgtaaattggaatgaaatcatttataaagaacaactgtttctattattgaaaattgtatgtaaaactatttaaaatagaatagaaggatacacacccaattattgatagcattgtctctggagattgaatttgaggctgttgattaaaaggagactttagctttgcttgtagtttttataccttaaaaagactggtagcatataaaataaatcttaaaagctaattatacacaatgacaatatgaatgtttacttgtaatagtgtttttcttgttctttctcacaacaggccaagggaagcctgtgcccatagaaggaaatgttataatggattcatatgccctatcagatgctcaactattttatgaaaaatctctctagaaaattagtaattagaatattcttgtttattatataatgtgaaattagcacattttagcaacttgatgatgctgtgtttttatattttaacatttctgaaattggactcctttcaactgatgatatcttagattcaagtaaatatttaattattaaaaatttgaaaatcagatgccagtataacaaatgaaatgtgtttttatttactagctccgggcatcatgtctactactcacggtgcctgtcctttcagtggagccagtattattagacagcaaatttattaggttcatagctaactaattaccaatatatttagagtattgtggagagattaagatttttcctgggaaagtgactttgcaatatttgttttcttgccctgtaattttccatacaaccagcataggcattaatatcattgttaattataacaatattttgaaatgagaaatcatttatttcctgaggtggccataagcaattgtgtaaaagtgtgttggttttaatctagagaccattttattctttttacaactcttgacttacacagcccatccggttttggttggaaatggtggtgaacttagaccctgagcactaatagtagagttcctcttgaagagtctcattctctgtaataatacatgaaccaacccttacagaggtgatgtttttattatgccatctctacaatattagttgatatacattacagaaagctgctaatgcctttttaaaaaggagatagggccagacgcagtagctcaagcctgtaaacccagcgctttgggaggccgaggcgggtggatcacctgaggtcaggaattcaagaccagtctggtcaacaggatgaaaccccgtctctactaaaaatacaaaaattagccaggcatggggcgggtgcctgtaatcccaactactcagaaggctgaggcaggagaattgcttgaatgcgggaggcagaggttgcagtgagccaagattgtgccactgcactccagtctgcgtgacagagtaagaccctttctcaaaaaaataaaaaataaataaaaaggagataggctgggtgtggtggctcacgcctgtaatcccagcactttgggaggcctaggcgggccgattacttgaggtcaggagttcgagaccagcctggccaatatggtgaaagcccacctctactaaaaatacaaaaattagctgggcgtggtggtgcatgcctgtaatcctagctactcaggaggctgaggcaggagaattgcttgaacctagaggggcggaggttgcagtgagccaagatcacgccagtgcacttcagcctgggcgacacagcaagactctgcctcaaaaaaataaaaacaatacaaaggagataaaaatagggggtgtttgtgaaaagggatctttagcttttatgattgaacattaactacatttgtttgaagttgatttcacaaaagtaaatctcagactaaagatgtgaagtacaaccatgactatcagttttgattgttattaggtatttttgaagactgatggtgacttaacaacagcagggactgacttcagtgaaaacaatgacaacttacccaaactgaaatatctaaatgagtattatcatttcgtagtcccttcttcaataagttttatactaaatccagttttgctagcatacccaatatttatgtgtaaactttttttttttttttgagacaaagtcttgctctgtcacccaggctgcagagcaatggcgtgatcttggctcactgcaacctctgcctccgggttcaagtgattctcctgccttagcctcccaagcagctgggaccacaggtgcgtgccaccatgcctggctaattttttttttttttgtatttttaatggagctggggtttcaccatgttggccaggctggtctcgaatcctgacctcaggtgatccacccaccttggcctcccaaagtgctgggattacaggtgtgagccactgtaccagcctgtaaacctttttctttttttggagagggggtctccctctgttgcccaggctggaatgcagcagcatgatctcggttcactgcaacctgcgcctcctgggttcaagtgattctcctgcctcagcctcctgagtagctggggctacaagctcccgccaccatgcccggctaatttttgtattttcatagagacagggtttcactacgtaggtcaagctggtctgtgagccaccatgcccagcctgtaaacctttttttaaaaaatggttttcgcatttcgtgtatccacacaagtaaccctgtataaatatttgtgagactttttttttttgtctaaacagttgtttttatctgtgattttctttttaatgttttttgtttgtttgtttgtttgtttttggcctgtactttatatgccttaaatcctctgcccctttctttacatagctttagagtcaacagagaaatgtaaaattccacttaaggcccataaggacaaccttagatttctcttttggcctctctcaccccagtaagactggctgaacctatcaggtgaggtaaagtgcctcagagtaggtctaaaagggcgttttactgatcttgtgtcagcaagcagatgatctggtctctgtaaattcattttttccttctgtcctaaggggtagaaataataagatagatataagtgactgagacagactttgaaaaaaatcattaattaaatcatggtgaattcttcttttcctggacacacatgagttactgcctagagagtttccattctagagttcaaacttcataagaggttcagttcctgtgaatggcctcaaaacacacagaataaaacatactaatagtggcttggactagacacagcagtagaaattgatagatttcagatacattttggaggtgattcaacataatgagttcatatgaaagatgaggagtaaagagataaaggataactcctatgtttttatggaaagaaactggctggccggtggaccatttgataaaaatgcagcaggctggggagaaatattttagagtaaaggttggggatggactcaagatgtgtgatggactttcttttcagctgtttcccagaagcaggctttgagatgaggattcctatgcaagtgatttattaaggaagtgctttcagtaagaggggtaagagaatggaggaagcagaataagaaaaagaagtaagtcaagggtgtgatcgcaggcacagtcctgccatggatggtgtcatcctgatccctgtgggaactcgagtgtaagctatgcctcagacttttcaagattccaccttcaggactgaggcacttgtgctgccaacttctgagaatcttggctgctgacaactcacagctaaattcctctaaggaattgctgttggacgaaaggagctgccttatgcaaggttacactgtctcccttcaggcagcttggcccacgttgcctcagtttagagcaactctgaagagcaatcccagctctagagctccccagggaacaaatttcaactgcatcagtttaatttctctttccatccagttctgctttattcatttccttactgctgatgttcccaagagatctccccaataaaccctatcatagatttccatctcagattctcttttcctgggaaactgacttaaaacagtagacattttgcaacagtagtcctcaaattgaaatttaaaaaaaacttttttttttttttgagacagggtgtcactctgctgcccaggctggagtatgtgatgcaatcttggctcactgaaacctctgcctcccaggctcaagcgattctcatgcctcagccttctgagtagctgggattacaggtgtgcaccaccatgctcagctaattttttgtatttttggtagagatggggtttcactatgttggctaggctggtcttgaactcctggcctcaagtgatctgcccaccttggtctcccaaattgctgaaattacaggtgttagccacagcacccaaccaaaaaatatttttgattcatttgaaactaataaactcattacatgttaatacaagcaataaatttttatgaaattattttatgaaaaagaattatttccaaaaccaaaaaacataataagagcgtcattgttacacaactttcaaatactttaaattacttaaaagtagacagctgggttctcatatctgcttctacattcagtcacatgtcatgtaagactgggaaactccattcttactcatgagcaaatgagatcaaaagaaggaaaaatatgaaaatagtttcaatctcaaggccccctagggatttccagactgttctttttttttttttttttttttttttttttttaaatggagtcctgctctgtcgcccaggctggagtgcagtggcgcgatctcggctcactgcaatctctgcctcccgggttaagcgattctccctgcctcagcctcccaagtagctgggattacaggcgcctgccaccatggctggctaacttttgtatttttagtaaagatgaggtttggccatgttggccaggctggtcttgaactcctgacctcaggtgatccgcctcagcctcccagagtgctgggattacaggcataagcccacacgcctggctcaaactgttctttaactgctgttgtgacatttggtgtggtttcttcaaaaacttgatgtcatgggctaaagaggtgtataaacaggaggctaaagggaagcatgggcaagctctctagaagtggtctcagatggaggacttgagaaacaaagaagatggataaggaaaatgttaaatatgtgggtaaatagaaacaaatattggcaggtggaaaagaagagcaagattgatttacagggttttcaaaggccatgaaagtactgggaaacaatggtatataattcagtggattggagtgggtttgatttaaagtatttcaagtctctttactattaaatataaagctaatttttaagattcagattttgaaggattgtaagagacccaaaagattgccttattgagttgaggaagttccctttattcctaagtttgctgactgtttttattgtgattgggtgttggatttttgtcaagtgatttttctgcatctattgacatgattatatgatttttcttctttagcctcttgatgttatgaatgagattaatagattttcaaaggttgaatcaatcttgcatttctgggataaatcccacttgattgtggtgtataattctttttatatattattggatttgatttgctaatattttattgagtatttttgcatctgtattcatgagagatattgttctgtagttttcttttcttgtaatatgtttctcctggttttggtattaggataatgctggcctcatagactgagttagggaatatttcctttttctagaagagagggtagagaattgataaactttcttatatgtttgggagcattaatcagtaaacccatctgggcctgatgctttctattttggaaggttaatagttattgattccatttatttaatagatacaggcctgtttggattgtctgtttattcttggtgagttttgacagattgtgtctttcaaggaattagtctgtttcatgtagattatcaaatttgtgggcataatatgctttatacgcttttattcttgttcataatattctttctttttttcttttttctttttctttcttttttttttttttttttttttgagacagggtctctctttcgcccaggctggagtactgtggcacaatcttggctcactgcaacctccacctcccgggttcaagcaattctcttgcctcagcctcccaagtagctgggattacaggcgtgcaccaccaagcccagctaatttttttgtattgttagtagagacagggtttcgccatgttggccagactggtctcaaactcctgacctcaagtgatcgaacctcctcggcctcccaaagtgctgagattacaggcgtgagccaccacgcccagccaggtggagtctttagattttcctagatataggattatatcatcaacaaaaaggcacaatttgacttcctcttttccaatttggataccttttatttctttctcttgcctgattggtctggctaggatttccattactatgttgaataggagtggtgaaagtcggcattgttccaattcttagtggaaatgctttcagattttccctattcactatggtgttagctgtgggtttgttatatataacctttattattctgaggtatgtaccttctgtgcctagcttgttgaagtttttattgtgaaagcatgttgaattttatcagatgctttttctgcatctattgagatgattatatggtttttgtcctttattctgatgtgatgtatcatgttaactgatttgcatacattgacccatctttgcatccctggtgcaaatctcacttgattgtggtgtattatcattttgctgtgctattggatttggtttgttagtgcttttttgaggatttttgcatctacctttgtcagatatcagcctttagttttctttttatgttgtgtccttctctggttttggtaataggatgatcctggccttgtagaatgaactggggagaattctctcctcttttattttttgaaatagtttcaggagaattggtattagtttttctttgtatggtataatttggctgtgattccaagtgaccctgggcttttcttggttgggacactttttattactgatttaatctcactacttagtggtctgttcagattttatatttcctcgtcattcagtcttggtaagttttatgttttcaggaatatatctgttttccctaggttttctagtttgtcagtatatagctgctcgtaagtctctgacactctcttgtatttctgtagtatcagttgtaatgtctccttcttcatttccaattttgcttatttgggtattctctcttcttggttagtctagctagtggtttatcaatttgggttatctttttgaataaccaacttttcattttgtggatccttcatattgttttagtctccatttcatttaattctgctctgatctttattatttcttttattttgctaatttgtggtttggctttttcttgttttctagttctttgaggtacattgttagagtgttaatttgtaattgttctacttttttttttttttttttttttgagacagagtctcctcgctctgttgcccaggctagagtgcaatggtgtaatcttggctcactgtaacctctgcctcccgggttcaagtggttctccagcctcagcctcccgagtacctgggattacaggtgctcaccaccatgcccagctaatgtttgtatttttagtagaaatcgggtttcaccatgttggccaggctggtctcgaactcctgacctcaggtgatccacccgcctcggcctcccaaagtgttgggattacaggtacgagccactgtgcccagctaacttttttgattgcattctacatttattgctataagcttccctcttaacactacttttgccttatttcacaggtttgggaatgttgtgttttcattttcggttgtttcaagaaactttcctttggcctggcatggtggctcaccatgtaaaaatacaaaaattagctggggtggtggcacttgcctgtaatcccagctactcgggaggctgaggcaggagaatcacttgaatctgggaggcagaggttgcagtaagccgagatcatgccattgcactccagcctgggcaacaagagtgaaactccatctcaaaaaaaaaaaaaatttttttttctttcaattttcattttaattatgatctttagtggttatttgggaatatgatatttaatttccatttattggtatagtttccaaagttcctcttggtgttaatctctagttttattccgttgtggtctaagatacttgataagatttcagcttttaaaaatttgttgagacttgttttgaggcctactcgatggcctattatggagaatgttccatgtactgatgaaaataatgtatagtctgcatctgttgggtgaaaggttctgtgaatatctgttaggtgtgtttggtctaaagtccagtttaaatctaattttttaaaactctgattttttaaaactgtctaatgctgagaatgggatgttgaagtccctcattattattgtaatgcagtctctctctttagatctagtaatatttgctttatgaatctgggtacttcagtgttggctgcatatatatttagaattgttatatccactgctggtttaatcactttatggttatataatgaccttctttgtctttttttttttttttaactctttttgacttaaaaactctttaatctattagaaatatagctactcctgctcacttttggtttccattttcatggaatatctttttccatccttttactttcagtctatatgtgtcattaccagtaaggtgagttttttataagtaggatatttggggatctttttaaaaaaaaaatccattcagccattctctattttttaagtgggaaatttaatccatttatattcaaagttattattattattatgagatggagtctcactctgttgcccaggctggagtgcaatggcgggttcttggctcactgcaacctctgcctcctcagttcaagctattctgcatcagcctcctgagtagttaggattacaggcatgcgctggcacgcctggctatttttatacttttagtagagatagggttgtgccatattggccaggctggtctcaaactcctgacctcaggtgatcctcccacctcagccttccaaagtgctgggattacaggcgtgagccactgacctggctaaaggttattattcacatacgaagctttgtctctatcatattgttaattggttagggtgtttttttttttttttgagacttctgggctcaagcagtcctcccacctgagccccacaagtagctccccatgcaccaccatgcctgggtaatgttttttttatttttatagagatggagtttcactgtgttgcccaggctagtcttgaactcctgggctctaatgatcttcccctctctggctccaaagtgctgggattacagatttaaaccaccatgcccaggcttttttgttgttttatgttttttttttttttaatttgttttcttattgtcactgtggcttggtagatttctgtagtagtaccatgtgagtcctttctctttcttctttatgtgtttgctttaccagtgagttttatagtttaccttattttcatgatggtaagtgttgcagtgtttttttttttttttttttttttgcttccaggtttaagacccccttgagcttttctttctttttttttttttttcgtttctgaggcacagtttcactctgccacccaggctggaatgtagtggtgtaatcttggatcactgcaacctccacctctcaggttcaagtgattcccgtgcctcagcctcccaagtagctgggattagaggcatgctccaccacacgtggctaatttttgtatttttagtagagacggtcttttaccatgttggccaggctattctcaaactcctgacctcaagtgatccacccgcttcgacctcccatagtgctgagataacaggtgtgagccaccacacccagccttcagcttttcttgtaaggccagtctagtggtaacaaatttccttagcatttgcttgtctagaaaggtctatttctcctttgtttatgaaggataattttgcttgatgtagcattcttggctagttttctttttttcttttagcactttaaatatatcatcccattttcttttgacctataaggtttctgcttagaaatcctctattagtcttatggggtttcttttataggtgactagatgctttttttttcttctaaggattcactctttatctttgtttgacttgaaacaatgtgaatataattgtgccatggagaaaaactttttgcattttatctccttgcatattgtgagccttctgtatctggatgtctgaatctcttgttaggctttggaagttttcatccataattttattaaataggttttcattgctaaataatggtaccacaatcacctgttaatgaatagttgtgttgtttccagtttggggactatcaagaataaggctaccatgaatatttgtgtaaaaattatttgtatagatgtatgttttcatttctcttggataaataccaaggattggattggctaggtagtatatggagatacgaattttatgaaaattcttaatttcagacctgtcaattcagtctcagtagcttcatttttcttagcttgataaatgatggaaatattaacccagtggcaattttatgtacgaacactgatgaatgtcagcagcactaggctttgggcagagtgccagaacaaatggcaaagcaaagcctcaacagctgctcctggggcataattaatgaccatgtcctaaagacattttagtgttaacatataaccagctgctgtttctcctgtaactaaatttaacaactgacagcaatatgaacagcgttttatgaaatactcccaatacagtctctattaaatgaatttggcagagggctatgctatgactggtgccctatttcagagttgttttttaacattggtaatatcttttcatgcattagaaaggcccaagttggccgggcacagtggctcacagctgtaatcccagcactttgggaggctgaggcaggcgtatcacgaggtcaagagattgagaccatcctagccaacatggtgaaaccccatttctactaaaaatacaaaaattagctggccatggtggcatgcgcctgtagtcccagctactcagaaggctgaggcagaagaatcgcttgaacctgggaggtggaggttgcagtgagccgagattgtgccactgcactccagcctggcaacaaagcgagactcagtcaaaaaaagtaagaaagaaagggtggggggagggacggagggagggagggagggaggaaggaaggaagggaggatggattcaagtcacataaacatttgttagatttgcttctgaacctttgtgaaatattactttcttgttacatagtgggcagtaactttgtaagatctcaggaaggaaggaaggaaggaaggattcaagtcacataaacatttgttagatttgcttatgaacgtttgtgaaatattactttcttgttacatagtggacagtaactttgtaagatctcctaagagaaggaaggaaggaaggaagggagggagggtccaagtcacataaacatttgttagattcgcttctgaacctttgtgaaatattactttcttgttacatagtggacagtaactttgtaagatctcctggtgtccagaactcaagcttgatttctgctgtttctgaatatctcttaaagaaacaagtactggaggcagagaataacccattaagtgttctctgaactatgaggcatctgagcctatctgatctttaagtcaaaataatgaagtgagccaggcatagtggctcatgcctataatcctcgcactttgggaagccagggtgggaagatagcttgagcccaggagttcgagaccagcctgggcaacatagtgagaccctgtgtctacaaaaaatttttaaaaaatttggcggacggtgtgacacacacttgtagtcccagctacttgggaggctgaggtgggaggatccttgagctcaggaggttggggctgcaatgagccatgatcaccactccagccttggcaacagaatgagaccttatctcttataaataaataaacataaaataatgaagtgaaagtcgatacaagaggtggtggagcttgtagcagatgacaaccatgtcccctgaggtgactgatacctccagtgttagaggtggaagagcatcacctctaaataaaaatgatcttctgcgctctcctagttgggacactagtctttggggacaagcaagtactataagagggacttgtatctatacaaagacttgtacaactgggcttgaaattttcattaagcatgtaaatgttatcccactttcttgggaatctttgattattgctatggtttgaatatttgtcgcctccaaaattcatgttgaaatttagttgccattataacagtattaagaggtggaacctttacaaggtgattagctcatgagagctccacactcatgggtgggattcatgctgttataaaaggacaagttgggcatgcttttatctctttgcctgtctgccttccatgtgaggacaaccatgtatcataaatatggccagtgagatacaagcaaaaatatttgggggtaatgggtatttgaaagcattttcttccttaatttaaaagggacataatcagccaacacagtcttttcccttgatttttgtcaacagcagagaccagcattgagtccctgatatagcagcattcccttttggaaccagctagccaccttatagaaggccgaatacactgggcctgttctgtcatggatgagacagagattcattcttataagcatggacagatattctggaatagattttttttcttgcccgtaatgctgctgccagcatcacaaccatggacttacagaatgctttcatgctttctccaccattatggcatccccccagttttgtgtgtgatcaaggactttttttttttttttttttaagagtcttgctctgtcatgcaggctggagtgcaatggcgtgatctcggctcactgcaacctctgcctcctggttcaagcgattctcctgcctcagcctcccaattagctggaattacaggtgcacatggccacactgagctaatttttgtatttttagtagagacaggtttcaccatgttggccagggtggtctcaaactcctgacctcaggtgatctgcccgcctcggcctcccaaagtgctgggattacaggcgtgagccatagcacccagcctgattacaggatataaggttaatatttaaaaatcaggccacgtgtggtgggtcctcaggcagatcacctgaggtcagaagttcaagaccagcctggccaacatggtgaaagcctgtctctactaaaaaatataaaaatcagttggaagtgattgtccatgcctgtaatcccaactactcgggtggctgagacacgagaatcgcttaaactggggaggtggaggttgcggtgagccgagattgcaccactgcattccagcctaggcaacagagactctgtctcaaaaagaaaaaaagaaatggggtcttgctttgtttcccaggctggtctccaactcctggcctcaaacaatcctcctgccttagtctcccaaagtattgggattacaggcgtgagccatcatgcctggtccatcttctcatttggatagctgtaccttgctaggtagaaatagagttgtttcattgttgtaaaggagctcaagttttgtataaaaaagtgtgtagaaacttagtacccaaagggttagactaggtcagttatcagtgtattgcctctcagctccaaattaaccttttcaacaccagtctgtgaaagtggacaacttgaagcatttctcctttacagtgagtgtgatattaagctttgtcagtagagggtgtggacattgaagagggacattgaaggaagaaggggtctttctggctcaggttgcagcattttgcttttccttgctcttgcttcatggtccatcagtgggaggtgtgtatgtgagaatattcagcgatgctctgcgccagctgtgctccagagcatgcagtctcttggagatcttgcatatctggcctgggcctggcagactaccttgctgaggcccttctcatgagagaccgtgtgctccagacctcatgctcacagtggcacccaaactcctctgcatcctggccatcagccgtagcttgcttgtgcaatggggagtaatttcctgtagctgtcctgatgtggaaaccatgcatctcaggcctaaggcctacagtgccactccaactctctttgagtacctggcaacgtagcaaacttctccagcatcacactgagctacaaccacattcagtgaggtttgaaactcacccttgggaaagacctccttccaagtatgttttcttttgggtactctccctcagctctaaagggccttttagagtcctcctcatggccctatagtttctgtcctatcattgcttaataattctttatattataattctgtttaaattcctttggccaggcacagtggctcatgcctgtaatcccaacactttgggaagctgaggtgggtggatcacctgaggtcaggagttcaagaccagcctggccaacatggtgaaacctcatctctacttaaatacaaaagttagctgggcatggtggcaggtgcctgtaatcccagctacttgggaggctgaggcacgagaatcacttgaacccgagaggcagatattacagtgagctgagatagcacccctgtactccagcctaggcaacagagcaatactccttctcaaaaaaaacaaaacaaacaagcaaaaaattcctttgtggtttctgtttcctgactgtatccagactgatacaaactgaccatagaagctggctgctgatgcttaaaaagcttctcatccatccatttctggcaaaagcccatcatcattcaccaagaccttcacacttaagctttccatgatacccaactgcttaaagtctcataaggcaggacagtttgccatcaaccaaaagcataatgagttgtttcatcacaatggtcctgtctccatggcagatcataatgtccacagtaaagaatctcatctttctctacaagataggtgtttttgccccattagtgcttggaatagaacactgggcatgaaggagaatctcaacaacatgaaaatgcatatctcttaacagtggtgttgtagtttcttgtgggctaaattgaaaacccaggaacaaaataaaaacttggttgtatttgaaattatcccataaaatatctaagatgtcctacaaagcatataacatggatcagttatccaacactgaagaataatatgtatatatgtgtgtcaactgtacaccataatatccatacatggtagaaagtccacttataaaatgtaatttcatgattcatatttatatgagaaaaatacatacaaatttatatgagagtaacacatattaatttacatgaaaatgtaacatataccttatattaaatatgcatatgggccaggtgcagtggctcacacctgtaatcccaacactttgggaggccgaggcaggtagatcacgaagtcaggagatcaagaccagcctggccaacatggtgaaaccccatctctactaaaaatacaaaaattagccgggcgtggtggcgggtgtctggagtcccagcttggacccaggaggcagaggttgcagtgacctgagattgcgccactgcactccagcctggcaacagagcaagactctgtctccaaaaaaaaaaaaaaactatatatatatatatgcatatgattgttaaaaaagaggagattcatatggtctgaagttatcatccctcaggttacttaccaattaaaaaggggaaaaataactacaatggagacatgtggccattaccatcttagccaagtgatcaaattggctcactgcctcaaaaaaaaaaaaacatgtttagtactgaagtataatgattcttgaatttattttcaaatggtagagagagaatcaaaagtggcaaattgttaaattgttgacaatttgtgaatctaagggacaagcatgaatgagttctttttttttttcttttcagagtcttgctctgtcccccaggcaagagtgcagtggcacaatctcagctcactgcaacctccgcctcctaggttcaagcgattctcctgcctcagcctcctgagtaggtgggattacaggcacgtgccaccatgcctgtctaattttttgtatttttagtagaaacgggctttcacggtattagccaagatggtctcaatctcctgacctcctgatccagccacctcagcctcccaaagtgctgggattacaggtgtgagccaccacacccagccccaatacaagttctttgtagtattctttcaatgcttctggagatttgaaacttgccaaaataaacaactgaagtaaatgtgcctaggaagtgggaaggcactgagcttattggggacatacccaaagaccccactggaacagaactaaagaaccagttctctgattcgttaccataagagaggaagtttcaggagaaggaatgcaaaagttctatatcctaattgaaagagagcgaaagaaaatatctcaagcaaggaaggacaggcttatcaaggatatagttttttgatgaatgacaggtcatcccaacctcttcctgctgagggaagatttcttcatctagatactgaggtcagaagtgtgaaatgagtcctgtgggctaaaatccaggtgtcataaaaccgtgttctttctctaggttctaggggagaatctatttccttgtcttttccagcttctagaagctgcctgcgttcttttgcttatggcactttcctccgtcttcaaagcacatccccgctttcgttgtcatgatttcctctctgactctgaccctcctgccttcctcttttaaggacccttgttgggcctactcagtaatccagcataatcttcccatctcaagatttttttttttttttttttttttttttttttgagatcaagtctcactctgccgcccaggctggagtgcagtggcgagatcttggctcactgcaacctctgcctcccgagtacctaggactacaggcatgcaccatcatgcctggctaatttttgtatttttagtagagactgggtttcaccacgttgtccaggctgatctcaaactccttacctcaagtgatccgcccacctcggcctcccaaagtgctggattacaagcatgagccacgatgcctggcctccatctcaagattattagttgaagcatatctgctgcagagcctcttttgccatgtaagatatattcacaggttctgggggttaggatttgaacgtcttggggcattattctaccactttgtcttattggcataatttatgaatttcttttttcccaatcctttgacataactatataaattttatacattattgaaatcagccttttatttggaacttttgcatctataaccacaaatgaaattaatacttttcttttggcctgtctttattgaatttcttttcttttcttttctttcttttggagacagtctcgctctgtcgcccaggctggagtgcagtgccccaatcttggctcactgcaacctctgcctccgggtacaagtgatcctccagcctcagcctccccagtagctggaagtacaggtgtgcgccaccacatccggctaatctttgtagaaagggggttttgccatgttgccgaggctggtctcaaactcctagcctcaaagtgatgctcctgcctcagcctcccaaactgctgagattacaggtatgagccaccatgcccggccatgtctttaataaattttatgccacttagacaaaaattcattggagagcatatataagttggatataaatacattgaataatcattattagttcaaaaattagctaaaattcagctataaccatctgggtatggtacctttttaattgtacatactttaaaatatcttaaataaaataaagcatttcattatggttattattctgttcagattttctacttcttagtagaaatcagtgatttaaatttcattagaaaatctacagtttcctctaccatggttatagagttgtacataacagcctcaaaattcttttaaacccaggcctgggcacggtggctcactcctgtaatcccagcactttgggaggctgaggtgggcggatcacctgaggtcaagagtttgaaaccagcctggccaacgtgatgaaacctcgtctctactaaaaatacaaagaatacaggcgggcacctgtaatcccagttacttgggaggctgaggcaggagaatcacttgaacccgggaggcagaggttgcagtgagctgagacggcatcactgcacaccagcctgggcaacaagagcaaaactccgtctcaagaaaaaaaaaaactcttaaactctttatgttttttttttcgcatttctaatgtttttgctttattttgctcttgtatatcagtcttgtgtttcatttatcttttagtactaaactgtggatttttaaattttggtccagtagtttgttttctagtttgtaaactagaaatacttaagaattttttttaatgaaatgttataagtaatgtttcacaagaaagaaacgataatggccaaaaatataagggactactttttaactgaaaagaaaaaaagtcacaattacacatcctagaagttaactgctgttaacaattaactttaaagatattattgcccaagtgcctatgtttctgctatttataactttgttttttttctttttgagacgcagtctcgctctatcgccaggctggaatgcacctccttagtagctgggactacaggtgcacaccaccacgccaggctaatttttgtatttttaggagagacgaggtttcaccatgttggccaggatggtctcgatctcctgaccttgtgatctgcctgcctcggcctcccaaagtgctaggattacaggcgcgagccactgcgcctgacctatttataacttttttttttttttgagatgaagtctcactgtcaccaggctggagtgcagtggtacagtctcggctcactgcaacctccgcctcccagattcaaggtattctcttagcctcctgagtagctgggactacaggtgcgcgccaccacacccaggtaaattttgtatttttagtagagacagggtttcaccatgttggccaggatggtcttgatctcttgacctcgtgatccgcccgccttggcctcccaaagtgctgggattacaggtgtgagccaccgtgcccagcctataacatttttaaatacagtatttattttaaaaaattggtttattttagtagcacttttagtaacacaaaagtgcttttattttagtagcacttttagtaacacaaaagtgctactaaaattggtttattttagtggcacttttccaggtcctaaagtatttctcgaacatacttctgtcattaaatatccttctgcaacttaatcctcaaataatgacgttgcagcccactatattggttttccgttatttccgctgcagacccaactatccctcatccttctccagtcccttcggcatcctgagcctgtgactgcgccccttcagtctctcctaggccacatccccaaacctctaggacaggtcgtttcccagacaccctccaggccagcctgtggcccggcccgagcagaaattagtgacttaaatgttgagatgccagaagacctggactggggcatgaattcccagcccaaacttagccacccggctttatcgggattgtggcccaggtcagtgaagccccaggtccgggccgactcctaattcgtggcgtggccgggagtcgccctctcctgatccaccccagagcgcggctccctgtggagggtaccctgggtggtccgctccctggctttttacagcacttgtgagaggcctttgggcacacacacaaaccccactccctgaccctccgtttggggcgagggcggctgcagccgggttaacttcgcggactctggaagccctggcggcgggcccggccgccccttcccgggtttgcggctacatttttctgaagcctccacggccccacagcctttttctagccgtcagcggccaactattgctgcctgggcctgtgtgtttgcccagttcctgggagggtgctcgggtgcagctgggcagtctggcctcggcttcactggaggcggggaactggacatgactgtgagcgccagtgaccgtggtgcggtccaggccccgggtggcgcacccacctctggactacatttcccagggggccccgcggccaaccttttccggccgaagaaggctagtcacctttccttggcgggtgttggaaagcaaagggctggaacgtcccgggctgcggagctcgctgggttgggatggactcgttcagacctgagtgctaggacgccgaagggggcggtgaggcgtcccggcgaggagctggggtcgtctggagtttaaaagacaggtggctctcggagatgtgcgggctgcatgcccacgcttcaccgctaggggaggtcagggctgtgcgatggggaaggaagagagtgtcggggcggtgcagtcgggatgggagaagggtgtcagggccactggcccccagctcggcagagggcagtgtcgggccgcgcgcaggcagggagtgggtgtggtgtgaggctggcgctggagcggtctgggaatgttaggaggtctagggtatcgcggccctgcgtcctcttgtctggactaaaagtccgggcagttctccccggacctggattgtgggcccagcgacaggtgcttggcgatctgtgcccgctgtgcctgcggggctgtggtgggagtcctgtctgcacggtattctgtgtggctgtgcatgtaagtgtgagcgtgtgccgggtcatcgaccccatctttgggaggcctgggagggggcgggacaccctcgctgtacattctggggatacgctgggcggggtctgccctgtggatgggtcctggccgtctacgcaaaccccaactgagactagtcagtaggtagtgaatctctgtgaatggccttccctccatcgggtctatctctggtgtgtgttgagggtggaaatggttctagagtttggggctgggaagtccctgctatatccacttctctgttctttcacccagtagccaccagggatctagacccataaaggtgcccccagcctaaaggacagcagtttgagaccctgacaggtgggtccatttaagctgtgtcttggcgccacagacttttgggctcagtgtaagacgctaggcctgaaagtttcccaagttaggctgttatggaggaagagggctacggtctggggggctctcccaggacttctctctgggctcctaaggtcacctgcatttctttgtgaggatgacagagagcggtggcgttgcagcttctttggtctccctttcagtgcctggggtggggcaggagtttggcctcccaaggggttcagggagggattcaggatggcttcttaacgtttttccacatctttctttaagaacccagaagaggagagaactgctgtgcgtctgaagtgatggcggaggtaagttgcatttgacattttcttggaaaggacttactggttttcaggacagtgtcctatttcagaaatttatctaaaatatttacattcatgatttggacaaaggggaagaggggaggaaactgcatttatgtagcattttcctaaagcagcctagggctgtctattttgcaaacattgtctcatctgatctagaatttccacttccctggattttattcatgctcacaacagtgttgacagagaacatgcctcagtgatttggcagggaaattgaacaacagaattagctttttcagtctcactgatttctgcattgtcccctccatgatcatatgcaatagcctttttgcttaccaattttttttttttttttttgagacagagtctcgttctgttgcccaggctggagtgcagtggtgtgatctcagctcactgcaacctccgcctcctcggttctagtgattcttctgcctcagcctcctgagtagccgagattacaggcacacaccaccacgcccagctaatttttgtatttttagtagagacggggttttgccatcttgcccaggctgatctcgaactccttaactcaggcaatccacctgcctcggcctcccaaagtgctgggattacaggcgagagccatcttgcacggcccgcttatcaatttctttctttctttcttttttttttttttgagaccgagtttcctctgttgcccaggctggagtgcaatggcacaatctcggctcactgcaacctccgcctcccaggttcaagcgattctactgcctcagcctcctgagtagccgggattacaggcacgtgccaccacgcccggctaattttttgtatttttagtagagatggggtttcactgtgttggccaggatggtctcgatctcctgacctcgtgatccgcccgcctaggcctcccaatggagccttgctctgtcgccagttaggagtgcagtggtgttatctcagctcactgcaacctccgcctcccaggttcaagcgattctcctgcctcagccttgcgagtagctgggactacaggcgcatgccaccacgcccagctaatttttctatttttagtagagacagggtttcaccatgttggccaggatagtcgcagtctcttgactttgtgatctgcctgccttggcctcccaaagtgctggcagcaggcgtgagccaccgcgccaagactttttttttttttttttttttgagacagagtcttgctctgtcactcaggctggagtgcagtggtgtgatctgagcgtgatctgagctcgctgcaacctctgcctccctggttcaagcaattcttctgcctcaacctcctgagtagctgggattacaggcgtgcgccaccatgcccagctagtttttgtgtttttagtagagatggggtttcaccatgttggtcaggctggtctcctactcctgaccttgtgatctccctgcctcggcctcccaaagtgctggaattacaggcgtaagccaccacgcctggcctcaatttcttataacctggaatgcctacctgtccactttatctccggatagtttttcaagatagaaataacctgaatgccctcttatgattaaagtgatatacaatttttgcaaaagtttcaaaatttgagggagtcacaaagaaagtttaagtcaccccatccgtggtcccactatccagatggtcactattaatgttttcagattattttgtctgcttatatgtgtagtcatgtgatttttttttttcagagtgggttcatactactaacagaagtagctaacttattgagcatgcactttgagccacttatagttggactttctttacagatgtgatcttgtttaatccacataacaaccctattagacaggtatgactatatttcattaattctctgatgtactttttctcacattttaatctctctgaaatcaaaatggggtttacaaaaattcttggcaagtcatagtttcattgatggcatttttttttctttcctagtatataaagttataagggccttattatcagtgacatctcagactcaatgaaatagagtattattctaagttgacaactgaggaaatcaagtcactcgcctcaaagttacgcagttaaaaatggtagagctggccgggtgcggtggctcatgcctgtaatcccagcactttgggaggccaaggcgggcggatcacctgaggtcgagagttcaagaccagcctgaccaacatggagaaaccccatctctactaaaaatacaaaattagccagatgtggtggcgcatgcctgtaatcccagctactcgggaggctgaggcaggagaatcggctgaacctgggaggtagaggttgtggtgagccaagattgcgccattgcactccagcctgggcaacaagagcaaaactccgtctaagaaaaaaaaagaaagggtagagctggggtttctacatcacctactgacttcctttgcccacttgtcaaagaatgctattttttaatttattttaaacaacatttcatatgttcagcatattttctctttgtcatttatacgttgttttagaaatattttttcacagttaatctattttgtgtgcttttagattcatttagttttcataaatgtattcagataaatcaactcttttcttaaaatttttccctttttgctgtgccagatggtctttcttaccacaaaaatagaatagttacttttatattttcctaaaatactttctgtcttttatccaaacaatctagtctttaaggtgtctcctgtgatatctcaccagagaatgttggctataaaattccaaatttggagtgtttatttagattttttatgcaactttggagtaatatattttaaagagtggcatggtatttgtaggatgtgaaatttaaggtttttttgttttgttttgttttgttttttgtcctggatatgtctggatgtagcacttacttcattaattctggccagtcctcaagaattactttcactctaagactaaagaaacatattttctattctgaattaatcagtttctttctctttgatttttcttcagaattctgtaagaatttgttgaatttctcttcccattactgtagaggccaaaaccttcctaagattatcagaagatcaccacaccctccccgtccatgccctgcacactggtggggaggaagcttcagttccccttgcacttcaacccttcattgtctatttctccctgtatcttctgtcctgaaaatattaattgccctttgtccctgctaatgggaggctgtgcattgtgatgaaagggtagaatcttagcccatttctgccatttgctagctctgtgaccatgggcttcctcataatttcagtttggggaatgtgatgataatggaaattcacctgcacttacactggcaacctggggtcccccagctcctaccttctggtctccccaacatccagtgaagtgcccaatttcattgcttcttttcttttcctgttctgtgagcttatgccctagggcctcactccactgtcttttgccttgtgggagtagatactacattgaactgattgggctccctggctccacttttactctttgccaataagataatccagtaatgtcaccttttgaattttgttcagtgaatccctggtactttcaggataaatctccaactctttcacgttcattgcatatttactaaaaagcatattctgtatttagcagagcacaaagcctaatgttggagtaaagtggtgagcaaagatgatgtgtttagtcctggcaggtataacctgtcattcaaaacatttcctgccctgattcctgtggagttctccaacatcacttctctctactcctccctcagaacccctcatcagctatcccagttaactttctgctcctcagaaacacagggtgcaattggtctcccttcttacctccatcttctgctctctctacttggagtgctgttcagtgtgttttctgcttgttggaattctgttccttttctaagtcccagttaatcttccacacgttacgtgaaactttccccacacccctcaatctgagtaggtcactattttcttatttcctatagcaagattcttcttttaatgggaggcaacgtatcctgcttaaaaacccctcagttaattatttcatctgtgagaacaagtttaaatgtctcaggattgatccttcttttcagcctcgtctctctgctctctctctgactttacactagtcgtgttaaactactagcagttcccagattgcacagtctatctcatgcgtccattgtgcaagaaacacaagaagggcatttatccctcaccacccctttctctgggttctactgaacctagtcaagaacagcatctatgaaacctgtgtcagtctcatggttgcgcttggtctcaattgctgtatctcttatagtcgttttcatactatattgtaactatcttttttttttttttttttgagatggagttttgcccttgttgcccaggctggagtgcaatggcgcgatctcagctcaccgcaacctctgcctcccgagttgaagtgattctcctgcctcagcctcccgagtagctgggattacaggcatgtgtcaccacacccagctaatttagtgttttttatagagacggggtttctccatgttggtcaggctggtctcaaactcccgacctcaggtgatccgcctgccttggcctcccaaagtgctgggattacaggtgtgaaccaccgcacctggcctttaactgtctttttaaaactgctttttattaaatattgaatagtagaacatgtgtaatatattaagggggactgaacacccatgttaagaggtagaatgctaatgttagaaatcccatgtgtgctttgatcttcccaatctaaatccccttctttagctgtcagaggtatctgttattccgaatcttgtgtttggcatttccttgtttttctttacagtcttaaccatatgtgtttattttcctgttctaatttgatgtcaagaaatcatactgtttggatttttctgcaactctattacttgtcctccaacgagtgttcaagagatccattcacattgcaaacttatcctactgtatagccatccattgtaagaatacattttttcatttatattgtgtacattactccagtgaacattcttgaactcctctttttgtatcctgtgcaagaatttctgtatgtaactaaaaaaggaattgctagctcataggttatatgcattttcagccttactcaacattgcccagttgttttctaaagtgtttattatactcatttactattccttttacttcgtatcctcaccaacacttggtattattaaattttaaatttttacgcacttgggtatgagttgatatgtattattttgatttcaaatttgcatattttggtactaaatgaggttgagccccccacccccgcaactttcatgctcattggcattcatgttttctcttttctgaagtacaattttatgtcatttctaatttttctattgatttttatatttccagagtttttgttccttttaatgctttgtatgcatttcttaaatattgtggattgtcgtccttgccggttatatgtgctgtgcatgctttcttactttaacctttaaatgatggtagatattctcaattttaatgccttcaaatttaatgctgttttctttaatttatttacatcttgtgtatgaaatctctcctctcctaagagtaaagatattatccctattttctataaatgatattattttgcctttaatgtttaagtcttcaattcacttggaattaattgtagggtgtggtatttccatttggataatatctgaaacatcatttattgaaaaggccattgtaaaggattaggcaaactgcaaggtctgagggaacagtccctacaagatgccgtcactcagacaccagctacaacttaagaggttcccatgaccactctcactttagaccagctagctacaaattcaggtatttccaccaccaccacccttaggtataataattcagtagaaagcctcacagaactcaatgaaagctgttatattcacagtcatatttataacagggaaaggatacattgggttgtattaccctcccagtattgatgtttggcagtacacccagagtattgtcaaccagagaagctcactcaagcttcagtgcccagtttttactgaagcttcattacataggcatcattgattgaatcattttccatgtgcacgaactcagtttccagcatctgtcctccctccttgcctgaaagtcaagctgataccacacggctcaaagtcccaagaccgattacatggtagaagtaggtgtggccagccccaagccctagtcatctcatgagcataaactaacagacgtggtcttaggggctcaccataaataacaaagacattcctatcactcaggaaattcaaaatgtttagaggttgcttcccaagagctgggacaaaggccagacctctttttggaggccacattccttactacacagtcctcctttctatgtacttcagtggcagttctgtcataaattaagtttccctatgtatatgtttgtctattctgggctctcctttctaatctgtccgtccgtttgtctatttaaaccatactgcctaaagactgctttctagtaatgtctgatatttggtaagtcacatgcctctactatggtcctgttctctagaaaggtcttagctgttcctaggttttggcttcatatacattttagaattggcttatcaatttctgtagaaatccagttgggataatgatttataatgcattaaaccttcgatcaatttggggaaagttgacatttttacggtattgagtcttcctctgcctctaaataactctgcttacttgagtcttgtggaatggttttcaataaatattttataattagagtcttacacatcttttgttaattttatttccaggtatttttatattttgtgtttttcttagatgacattaactttagaatatagactgggtgctgtgactcacgcctgtaaccccaacacgtaaggagaccgaggcaggcgaatcacttaagcccagcagtttgagaccagcctgggcaacatagtgagaccccatctctactataaataaaaaattagccaggcatgatggtgcatgcctgtagtcccagctacttggtaggctgaggtaggagaatcactcaagcccaggaggatgaggctgcggtgagctatgattatgccactacactccagcctgggtgacagagcaagacccagtctcaaaaaaaaaagtaaataaaataaaatataattttctcattgtttctggtatatagacttgccattgatttttttttttcttaaaactcctatgacagattattgcagttgattttgagatattgattttatatccccccaccttgcttaactcttatttattctgacgtcttgtagattcttttggatgtggggtcatccaacttgatcatatcattgatgaataaagatactttttggttgtaaataattgtctttgtctattagtattgatttcttttcttcttttttaacctttattttaattcttatcttgctgcactggctccacctcccagaacagttttgaatggtgaatatgggcaccctgtcttattcacagttttagatacttcacttttacttatgtttgcacttgttttttttgtaggtgtcctttatcaggttagggacgttgctttttattgctaattcgctcttgagtttttatcatgaaggaatattgcatttttaaaatgccttttctgcatccattgaattgattggtcaggtgtggtggctcatgcttgtaatcccagcactttgggaggcttagtcgagcagatcacctgagatcaggaattcgagaccagcctggccaacatggtgaaaccccatctctactaaaaatacaacaacaaaaaattagccgagcgaggtggcaggtgcctgtaatcctagctatttggaaggctgaggcaggagaatcgcttgaacctgggaggcagaggtttcagtgagccaggatcgcgccattgcactccagcctgggtgacaagagcaaaattccatctcaaaaagaaaaagaaaagaaaagaaatgatcctaagtgttttctctttaatctgttaacgtgcctaataattttaatttatttccagtatcatgtacacctttattgggaaaaacctaacttagccatgatgtgtgatgaatttttacatattactggattcagtttgctaataacttgcttagaattttaaatctgtggcatgtgtaagactggccagtaatttcaattcttcataatgtctttatacaagttactctatcccaggagaactgtggccttggcctgtgaaccaagattgttttctacatttttaaatggttgggggaaataatcaaaagaattatattttatgacacatggaaattatatgaaattcaaattttagtgttcatgaataaagctttattggaacataaccacattcatccatttatgtaacatctatggctgcttctgtgctgcatggcagagttgaggagttgcagcagagatggtatgtcccacagagcctaagatacttactatttggcccttgacaaaaaaagtttgctgacctctggtctagcctcataaaatatatcagttttccttttctttttcccatggtaggatctgggagtactcatgttatcaatggtgtgagcaaggccactcttcagattatttgtttattccctgtcttctatgccatttactacccgcatcctccccccgcccataaggcagtcgtgttaatgtgcatcgttttcttagtatgtattcattcatgcaaaatgtttttctcttttgttaaggtccagggtggtcagtttttcaaaatcttccatatatgattgagaagaatgttatttgaattgagtgcattgttctatatgcagccattagatcaagcttaatttagtatctaaatattctgtttttactgactttttgtctgttgtatctatcagttatttctagtgttttgttaaaatctgccactgtgattagggttcgtctattagagtttctatttcatttatgcatatgtgtatgtatatataatatgtatttattatttattaggtaagcataaaattatccttttctaactgtcatctttctgaatatttatgttttggatgtgtctctaataaccagcgtagagctgggctttggtttttgacaactttgaccaactttgtccttttttttttttttttttttgttgagacagagtctcgctctgtcgcccaggctggagtgcagtggtgcgatcccggctcactgcaacctccacttcctgggttcaagcagttctcctgcctcagcctcccgagtagctgggattacaggtgcatgccgccacgcctggccaatttttttgtatttttagtagagagggggtttcaccgtgttagccaggatggtctcgatctcctgacctcatgatccccccacctcggcctcccaaagtgctgggattacaggcatgagccaccgcacctggcgaccagctttgttctttaacgagagtatttagtcatttacagtgcttgtaattactaatataattgaaggtatcatttttgtgcttttaattctaccttttctgtatttcattatcttcatttcattttcccttctatgagtttgaaagttataagctatttgtgtttatttagtggttaccttgaaaatttcaatatactttcttaacttactagtgtctaaaactaaaaaatattattatattcttggtaaataaggaagtaggatatattctaactaatcaaacaacttacattattgtcaggtatttttcttctttttttaacccataagaaatttttattttatgtattgagtgttatcttagattatccatgtatttacgactttcttggttcaccattctttcttacatgtcaagctctccatctgggatcactttcctttagatggaattaaatagtaaatttctctctgattttggtgtttgttttttttttaacatctttatttgccctcatttgtgaaaggtgttttaccctcacactgggatattccgctgtcttctggtttacatttttgttattaaatagtcatctgtcaatcagacttttttttttctgtagataatctatctttaatctcaaattgcttttcacgtattctctttgtatttagtgctctgcagttttggtgtgattgtctaggcatggatttatttttatttattctgtttaagacttattgggcttcctgaatctgaataatgccaattctgaaaatttcttagctgtcctgtcttccaatactgccattttcttaattctttctcttttctccttctagaacttcagttaaatatctattaagccatctcacattatcttcttaatctctcttctgtacatctgctcatttgtctttttgaattgcattctgcataatctctttttataccttgcagtccagtaatttttctcttcagagagatttattccagccattgtatgatttaagtatgttttttattttatatttttatttcttttcctttttttgaaatctactgtcatctttgtgaagttttcttattacattgcttccattttaaaaacatgtaatatgcttgttttataatttttggcattatctgtataatatatgaatcttttacagaggtgattcctcctgcccctcaacattttattagggaaattttcaaaacataatgaaaagttgaaacaattgcatgactgattttcctgactctttgttcatggaattatgcctctttgcatgtttttgtttgtttgtttgttttgttttgttttgttttgtttttaagacacagtctcactgtgtcacccaggctggagtgcagtaatgcgatcttggctcactgcagcctccacctcccaggttcaagcgattcttgtttctcattctcccaagtatctgggactacaggtgcgcaccaccatgcccggctaatttttgcattttaagtagagatggggtttccccagattgaccaggctggtctcgaacccctgacctcaagtgatccgcccactttggcctcccaaagttctgggattacaggcatgagcctctacacctggccatttttttttaaatttgattttttgtttaggcaaaattcacataatatatagttaaccattttcaagtgcatagttcagtgacatttagttcattcacagtgtggtgctgctttatttttgactcataggttattttccttggaattctaccccatagattcttgaggcctgattgaaggttgttcctctagggcagatctgtgtttgcttctaccaggagccctgccaaaccaggaccaccataaagtaaacacatggcaagttttttagatccaccttagtattgttatgtgaactgcaggcctgtgtgagggctggcttgtagttacagttcctcagaggaaaatgtttcccttctgccatctgccaaggttccagtcaggcagttttcctagcggaccctaggaatgggaatgccacatctggttttcccttactctaagggcgtggttctagaggtcccaggtctttgtagtatggaattaattagaccccccaacttggccagctataggcttgatcttctctccacctgctccttaatatcatgaatgtcaaagcttatggtcttctgggctccatagacattccctgggcaaaataagcctcagtggctcagcttacccctctctgttcccattttgacatagttttatctgctgaagattactttacttctctgtcagctcatccttgaattctaaaatatttttgatattcaatctcttatttttcagctggtgatttggttgtagtaactagtcccccacagagcctggtgtcctatgattgattttctttttttcccccctccgtgactgagctttttaagaggaaatgcatgctaggtaagagttatctgcgaccctggtgcccacgtagagccagagtcatggggatttgattcgtattttcggataagagaattttgttgacacagctgctcctctcttcccattcccttccgcctttgatctcccttcatagactgctgtgatctgcagtgacaaacacagcagacctagcattttccgctcccctaagtgcaggggccagctgagggttctttcaaaggatcaggaaattcccaggttgcatctacaagagccagaagttagaaggcaaccagctgcagacttggttatttctcagtagattcagaacccagcattgccactgtaactgcagatttgagtaaatgacttctcttctccaagctaaagtttcctttcagttaggattcatgaccttctcatgaggattaatatatgtaaggcaccaggaacttaaagtgcttaaagaacaatgattgtccttgagatgcagtgtgcagtgtgcagtgtacagcagtaaggttaggggtagtagcaggagagaatgtcaggcaggaaggccatgggtaatctcggtttggaaccaggatgtactggccgtgaggattcctggaactgtggtttcatgcattgtgtatctgggtaattgagccctgctgaggctgctgagagcctgctgatcctgtgggttgtctggctcagtgctggtcattctggagagtctttgcagaatgaggttttagttttagttccaaaggccccagttctgggatatacgaacaaagcccaggaagtggctggtgcatagaacaccagaatttattcctctatctctattaggcttgagggaggctggaaccctctgttgtagaaatctttgtccagagctgggcctgcccaggtatcctgtgctcctgggccttgagggctccctcaagtctttggggtgccttcaagtctttggggtgccttccatggctgagggtctcagtgatatccaggttgtacaaaagggagcccaggccctgggctctgatcagctcctgacagtggggaagttgtttcttctgagtctgttattctatagttggattccctgggattcaagaaagacaaaggtttgttcattctttctcaaatctcagagagaaagaaaacacagactctgtgtgtgtgtgtgtgtgtgtgtgtgtgttggggtaccaaaagcagggatggggtgaagggattcattctcaggcctttggggaccttgaggtcagtctgatgaattttgtcaacaaaattctcttatccaaaaatatcagtcaaatccccatgacttgctttttcttccttttttgctttctcaggctttctctaggagaaacctagggtataaattttgtagttgtaaaagctattatctatgtgttagtatgtctcctctccttcattgaatgcattctttcatttttaaattttttatttttatttttgtagagatggggtcctgctatgttgcccaggctggtcttaaactcctggacccaagcgatcctcccacctccacctcccaaagtgctaggatcacaggcatgagccatcacacttggcctgaatgctttcttttctgttttttattttaattaacaatgtattagtcccttctcgcatgctataaagaaatacctgagactggggattttataaagaaaagaggtttaattggctcacagctccagctccacaggctgttcaggaagcatgatgctggcatctgctccgcttctgggggtgctcaggaaacttaccatcctggtagaaggcaaaggagaagccagcacttcacctggccagagcagaaggaagcagggaaggtgcgggacacttttaaacagccagatctcgtcagaacttactatcatgagaacagcaacaagggggtggtactaagccattcatgaagtattcacccctgtgttccagtcacctcccgccaggccctccctccaacatcagggattagaaatccacatgagacttgagtggggacacagatccaaaccatatcagacacattgtaatcctagcactttggggtcatatttatggggtacaatttgatgtttcagtacatatctatgtggtataatgagccagtcagggtagttagtgtatctatcacctcatgcatttatcatttctttgtggtaagaacattcaaaagcctctcttctagctattttgtaatatacaatattttattgttaaaccatagtcaccctactgtgcaatagagcaccagaatgtattcctcctgattgtaactttgtacccactgaccaacctctcgcgttttgtacccccaccccgtctctggtaactactgttctgctctctgcttctgaacgccttctttttgctttagaagatttgaacagattgaacagatttctttttcctaaaacttcttggcttccccagggacttgttccccagttcttcccattccagtcagtaatgctatcaaagactgctatctcttttattgattgattgattgagacagagtctccctctgttgcctaggctagactacagtggcatgatcttggctcactgcaacctctgcctcccaggttcaagcgatcctcctgccttagcccccctagtagctgggattacaggcacgtgccaccatgcccggctaatttttgtatttttagtagagacagggtttcaccatcttgaccaggctggtctcaaactcctgacctcaggtgatccacccacctcggcctctcaaagtgctgggatttacaggtgtgagccaccatgcctggccaaggctgctgtctcttaagggcccctctgttctccaagaagtgtttaggtatttatcagcaaacctcttagcatttataagtttctttgagacaacatcttgcttggtcacccaggatggagtgcagtggcacaatcatgggtcacttcagcctcaacctctggggctcaaagagctcctcctgcctcagcctcccaagtagctgggactgcaggtacatgccaccttgtccggctaattttggatttttttgtagaaacgggatctcactgtgttggtcttgaactcctgggctcaagcaatcctcccaccttggcctcccaaagtgttgggatgacaagagtgagccactataccaggattagcattttttagatgcatgttcttccaccgagagtactgatggagtaggaaaaccaatccttgctggaaactttcatacctcccttcttggagctgtgatttgatgaagtggaaatgaatggttaagtggaatcacatattgcaaacttgagttttctaattagacaagaaaggaattgatgttgatttattgtgttgcagtctcagtatcagccagtatctctagctgtctgaggattttaggactggggatatcctgagatatgtagattgtatggagttacagtgtattcccaaggagtctgtgccagatggataaagtgtgtccattttgaacttgtgtagtatgtgcgcacctcgtgtgacatcgttgtgagtctggatctttctccatcagttctggtagctaaggaacaaggagagtatggttggggtcatttgtggtaacaggaacaatttagccagatgtataaattgttgagaaatgaccaggcacggtggctcatgcctgtaatcccagcactttgggaggccaaggcgggtagatcacttgaggccaggagttcaagaccagcctggccatcatggggaaactctgtctgtactaaaaatacaaaaattagccagatgtggtggcccatgcctgtggtcccagctactcaggagggtgaggcaggagaatcgcttgaacctgggagacagaggtagcagtgagcggagatggtgccactgtactccagcctgggcacccaagtgagactctgtctcaaaaacaaaaaattgttgaaaaataatgaatgactattataactgcaaaagaacctttagaaaacttctccaacctacttcctcaaaacaagaacattgtatatattatatgaggaatcatgcagccagtaaaattgctgtctatttaagaatttttggtgatgtagaaaactgattcaggatttaatttattgaatgggaaagaggaagaggcaatgagaagtttgtgtgcttaacatagggtgttccgtgtacttgcacgtacagtttcatttaattgggaaacaccacttacatggacttagtttattctctgacctgggtagataatggaagtgcccagaggctacctttgcaggagtaagcatgcccaagaaccatgtgggcacttcactctgatcacccctgtttccacaccgacccctccatgttgaaggagccagtatggcctgttttcctaatggaacttccctattgaattgctttctccattttcttttatgttgtcttaaagattttgtccatgaatttcacaaatggtgtatttatttttggtttcagggcttgaagttcaaagatgtggtcatttacttctctcaaaaggagtgggaatgcttgcactctgctcagaaggatttgtaccgagatgtaatgttggaaaattacggcaacctggtcttactgggtaactttatctgcccctccgtacaccccctgccccgccaaacacacaattggccttctggaattcttatgttcttttttctgagtttgtcccaagtgcttttcaagtacctggatgagttaatgtttcttgctcaccaaaagaatggtttgtctcttgtgaagttggaaattggctgttccagcaggcacctttatcttcattattttcatacctcccttcttggagctgtgatttgatgaagtggaaatgaatggttaagtggaatcacatattgcaaactttttttctaattagacaagaaaggaattaatgttgatttattgtggtgctctgaccctcactccttcttctgacccttaatctacctgctcctctttcttggtaattagggactgatttttaattctgacacccacaacaaaaccttgttccctttgtttttgagcagggctttctgatactaagccaaatgtgatctccttattggagcagaagaaagagccctggatggttaagaggaaggagacaaaagaatggtgtccaggtgagtgacgatgaactggaatggggaggccatagcaggtggtcacttagctcatctgtgagaaggcagcacttcagggattttggtaggaaagctgcctaaaaaggcttgagatctggggaagaaagtaaggatgttgtaatcccagcagtttgggaggctgaggcgggcagatcacaaggtcaggagttcgagaccagcctgaccaacatggtgaaaccccgtctctactaaaaatacaaaaaaattagccaggcctggtggtgcgtgcctgtaatcccacctactcaggaggctgaggcaggagaatcacttgaacctgggaggcagaggttgcagtgagccaagattgtaccactacactccagcctgggcaacagagcaagactccgtctcaaaaaaaaaaaaaaaaaaaaggaggccaaggcaggcggattacgaggtcaggagttcaagaccaacctggccaacatggtgaaaccccatctctactaaaaatacaaaaattagctgggcatggtggcaggtgcctgtagtcccagctacttgggaggctgaagcaggagaattgcttgatcccaggaggcagaggttgcagtgagccaagatcgcgccactgcacttcagcctgggtgacaaagcgagactccatcttgaaaaaaaaagaaagtaaagcatgtttcagctccatttactaggctctcttgctcacctcctataatacctcccccctcatttcagagaggaagtaccctctttctttccctgtgacaaccattttacttgcattttgggtccagttttgtcctgactttttaaaacagttttattgagatatcataaaattcatccatttaaagttcagtaatttttagtcagttcacaaccatcacaacagtctaattgtagaacatttgtatcactcaaaatgaaacgccatacccattagcagtcactccccaaatccagccctaagcaactactgatcactttctgtctacatagatgtgcctgttctggacattttatattaatgatatcacacaacatataatttatgactggcttttttcacttaccagaatgttttcaaagttcatccatagtgtaacatataccagtgcctcattcttttatattgccaaatagtattccatggtatagatattaccattctgctcattcatcagttggtagacatttgggttgtttctacttttaggctattttgtatgactaaagctgctatgaacatttgtatataggttcccttcttttcttcgtttgttgagtatttttgtcatgaaaggattttagaatactttttaccattactttttctgcatctattaagacatctgtagtttatgtcctttgttgtatgaatatgtttgattacattgataacttttggatgttgaacctaccttgcatttgtaggataaattttacctggatgtggtatataatcctttatgctgttggatctggtttggtcttttttgttgaagatactggtctgtagttttcttgtgatatctttgctttgtctggttggtatcagggtaatacaggcctcagaattagaaaatgtttcttcgtcttctgtctttttgaagtgttcatggaggatttatattaagttttctttaatgttgggtaagtgaggccatttgctcctcggcttttctttatgggaagatttttttgctctaattcagtctctttatttggtataggtctattcaggtattctatttcctcttgagtcaattttggtagttttgggtctttttaggaatttgtccattttgtctaagttatctaacttattggcatatagttattcgtaggagttccttataaccctttttatttctataaggtcagtggtgatatctcctatttcattcctgatgttagtattttgagacttctctctttttttgttggtcaatctagccaaagatttgccaattctgttgatcttttccaaagaccaacttttggtctcattgattttctctgttgtttttctattctctattttgttcattgctgctgtgatcttttattatttccctccttctggaagctttatgtttttgtttattctttattatctggttccttaagatatacagttagattgttgatttgagatatctctgtttttttttctttttttttttaatataggtgtttttagctgtaaatttccctttaagccctgctttagctgcatttcataagttttggtatgttgacttttcatttatctcaaaatattttttaattttcttcatgatttctttaacacgttggttatttaggagtatgttatttaattttcacgtttgtgaatttcccagatttccttctgctgttgatatctaagttcattccattgtagttgcaaaacatattttgtgtgatttcaatcctcttacatttattgagggctgttttatggcttaatatatggtctaacctgaaaaatgttccatacatgcttgagaaaaatgtgtattctcctgttgttgagtggaatgttctacaaatgttttcttaggtttaattggtttatagtgtttttcaagcaatctgtttccttgttgatcttctgcctagctattctatccattattgaaagtaaagtattgaagtcttcaatttgttcaattgtttgtggctctctttaattcttgtgttacatattttgggcctgtgttattaggtgtatatgtacttacaactgttacagttttctgactatcattatattctcttatcattataaaatatccttttttctgatttgtgtgttgttgttgtttttttctgagatggagtctagtgttgttgcccaggctggagtgcagtagcacaatctctgctcactgcaacctccacctcccaggttgatgtgattctcctgcctcagcctcccgagtagctaggattacaggtgcccgccaccacacccagctaatttttgtttcactgtgttggccaggctggtcttgaactcctgacctcgagatctgccggcctcagcctcccaaagttctgggattacaagcgtgacccaccgcgcccggccaaaatatccttttttctcactggttacaatttttgtcttaaagtttattttgtctggtattagtaatgctattttacctcatttttggttactctttgcatggtatatctttttccattctttcatttcaactatttgtgtccttgaatctaaagtttgtctcgggggctgggcatggtgacttacacttgtaatcccagcactttggaaggccgaggtgggcagatcaattgaggtcaggtgtttgagaccagtctggccaacatggcgaaaccctgtatctattaaaaatacaaaaaattagccaagcatggtggcccgtgcctgtagtcacagctactcaggaggctgaggcatgagaatcacttgaacccagtgagtggaggttgcaatgagctgagatcacgtcattgcactccagcctgggtgccagagtgagactgtgtctcaaaaacaaacaaacaagcaaaaaacagtgtgtctctggtagattgcatatacttggatcacttttttttaatccatcctgccaacctcttcttgtagtgcttaacaaactctgtagtgtttaatatgtttacatttaatacactgatggggtaggatttacaattggtattgtggtatttgttttctatttgtgttgttattgttttattcctctattcttccattactaccttctgttatattacatgaatattttctagagtaccatttttgttcctatattgtttcgtatacagtagtctttgaaattattttcttagtggtcgccttcaagattataattagcatttcaacttaaaacaatctagtttggattaatactagcttaactttaatcttacataaatactttgctccaaaatacttctgttcccacctctcttctttgtactattattgtcatacaaattacatatttatacattataagccaatattggcaggataataaccccctcaaagatgtctatatccgaatctctgaaacttgtgaacgtgttactcttacatggtaagggggaattcaggttgcaaatctgctcaacttcaattagggagaggatcttaggttatccaagtgggcccagtgtaatcacaagggtctttaaatgtatcagagatgtggctgggtgcagcggctcacacctgtaatcccaacactttgggaggctaaggtgggcagatcgcttgagcccaaaagctcctcgttttctcatttttcacttccctttttttttgtaattgcagtgtaaagaattgcttattaactatttttattttgtcatttctactttcaggacttttctttgtcctgcaatgtgaaaatacctcctattttctttcttattattttgcagattgggagtttggaagagaaaccaagaatttatctccaaaggaaaacatttatgaaattagatcaccacaacaggagaaggccagagttatcagagaaatcagatgccaggtggagagacaacagggtcatcaggagggacatttcagaccagctgtaataccatttacttccatgcagtgcacagcccatagagaatatcagtggcttcatactggagagaaatcctgtgaatgcaggaaatgtaagaatgcttttaggtaccagtcatgtcctattcaacatgaaataattcataataaggaaaaagaacctgaatgtggagaatgtaggaaaatctttaatagtggatcagacttgattaagcatcagacgcttcatgaaagcaaaaaacatagtgaaaataacaaatgtgcctttaatcatgattctggaattactcaacctcagagcattaatactggagagaaacctcataaatgtaaggaatgtgggaaagcctttcgttccagctcacaaattagtcagcatcagaggatgcatcttggtgagaaaccctataagtgtagggagtgtgggaaagcctttccatccactgcacagcttaatctacatcagaggatccatactgatgagaaatactatgaaagtaaggcgtgtgggaaggcctttacccgtccctcacacctttttcgacatcaaagaatccatacgggtgagaaaccccataaatgtaaggaatgtggaaaggcttttcgttatgacacacagctgagccttcatcagataatccatactggtgaaagacgctatgaatgcagggagtgtggaaaggtgtacagttgtgcctcacagctgagtctacatcaaagaattcatactggtgagaaaccccatgaatgtaaggaatgtgggaaagcctttatctctgattcacatcttattcgacatcagagtgtccatactggggagaaaccctgtaagtgtaaggaatgtgggaagtcctttcgtcgtggctcagaacttacccgacatcagagagctcatactggtgaaaaaccctatgagtgtaaggaatgtgaaaaggcctttacttgtagcacagaacttgttcgacatcaaaaagttcacactggggagagaccccataagtgtaaggaatgtgggaaggctttcattcgaaggtcagaactcacacatcatgagagaagtcacactggtgagaaaccctacgagtgtaaggagtgtgggaagccctttggtggtggctcagaacttagttgacaccagaaaattcatactggtgagaaaccatatgaatgtcagcagtgtggaaaggccttcattcgggcctcacaccttagtcaacatcaaagaattcattcaggacagaggagtgaatgaagaaatgagggatggctcagaatttgattgacatgagaaagttcatactgatttggaaaaaaaaacttatgattctaagtgtgagacaccttataaatgttaggaattagcagggatttatttatgtttcagaatttattacacatcatgatacaactggtgaaaaattgaagacctccatgaatgtaaagaaagtagggaggcctttttggtggctcagaacgaagtcaacctcagggaattcaaatgggggagaggagggcagtgaatatgctgagaggagttaatcattcagacctttatcagcagcagagtcattagcccttaggggaaatcagatgattcaaaatataaatgcaggccgggcccggtggctcccgcctgtaatcccagaactttgggaggctgaggtgggtggatcacaaggtcaggagatagagaccatcctggccaacatggtgaaaccccgtctgtattaaaatgcaaaaaattagctgggcatggtggtgcgcgtgtgtaatcccagctacttgggaggctgaggcaggggaatcacttgaacctgggaggcagaggttgcagtgagctaagactgacccactgcattccagcctggcgacagagcaagactccatctcaaaaaaaaaaaaaattattattatacacacacacacacacacacacacacgctgggcgcagtggctcacacctgtaatcccagaactttgggaggccgaggtgagtggattgcttgagtcctggagtttgagaccaacatgggcaacatggtgaaacactgtctctacaaaaaatatttaaaaaattagccaggtgtggtggtgcatgcctgtaatcccagctacttgggaggctgaggtaggagaattgcttaagcccaggagacagaggttgcagtgagccaagatcatgccattgcacagcagcctgggtgacagagcgagactcttgtctcaaaaaaaaaaaacaaaaaaaaaacacaaaaaaacggggccgggcacggtgcctcacgcctgtaatcacagcactttgggaagctgaggcgggtggatcacttgaggccaggagtttgagaccagcttgaccaacatggtgaaaccctgtctctactaaaaatacagaattagccaggcatggtggcgcacagctgtaataccagcaacttgggaggctgaggcatgagaatctcttgaacccgggaggcggaggttgcagtgagctgagatcgtgccattgcactccagcttgggcaacaagagtgaaactccatctccaaaaaaaaaaaaaaaagaaagaaaatgtaaatgccatatatatgggacaccaatttgctttagctaacaaagtattcatctgacaatacttgaggaaggctagagtagtatttaaaatgcagcagattctttcatcccacataaatcttgttaaatattcacgagctaattctctaaaattaactggagctgaatcaatgtggggaagaatttaaccaatgtttagtttttactcacccttatcattattactcatttcttttagggtgaatttattaactacatctacattttctcatttataaaatagtactgttagcaccatatttcttagctgcattgtgggggttaaatacatttatattatttaaagcagtgtctgtctagtattgaaagtgtgctaaatgaaggcgtttattgtttttctttgttattttcttaatcatgcattattagacatgagaggaaggacttatatttgcagtgactataggaacatattgcatcatctctttttctttattgaaggttaggtaattccttctggagaaaaatttaatactgtgaagcctttatttatagctcacccttttgccttactaggcaaataatgtgaagaaacccagtagaataaaagtgggttgctgtgaagtcaggcggaagatttagatatttatcaaaacttttcaaaaggctgggcacagtagctcaagcctgtaatcccaggaatttaggaggccgaggcgggcagatcacttgaggccaggagttcgagaccagcctggccaatgtggcgaaaccccatctctactaaaaatacaaaaaataagccaggcacgatggcgtgcatctgtagtcccagctacttgggaggctgaggcaggagaatcacttgaacccaagaggcggaggttgcagaattaaaaaaataatacagccctagccaaaatgtatttctccactagaaaattttaaagctacctgtataaataatttttatattaaaaaggatatcggcctggtgaggtggctcacgcctgtattcccaacactttgggaggccaaggcgggtggatcatgaggtcaggagatcaaaaccatccttgccaacatggtgaaaccccgtctttactaaaaatacaaaacttagctgggcgtggtggctcacgcctgtagtcccagtagtcaggaggctgaggcaggagaacagcttgaacccggagtgggaggttgtagtgagccaagatcgcaccactgcactccatcctaggcgacagagtgagactccgtctcggctgggcgcggtggcttacgcctgtaatcctagcactttgggaagccgaggtgggtggatcatgaggtcaggagattgagaccatcctggctaacaaggtgaaacctcatctctactaaaaatacaaaaaattagccaggcctgtggtgggcgactgtaatcccagctactcgggaggctgaggcagaagaatcggctgaaccggggaggcagaggttgcagtgagctgagatcgcgccactgcactccagcctgggtgacagagcaagactctgtctcagaaaaaaaaaaaaagatgtcaaggcaggccttattaggaatgaatgacaaagggaacactacatatggaaatttatagggtgtgaacaaagctatagtctcaggaaaattattttaatatgtatagaaaacagggccagttaaggactaggattcattccgacttcaccctgtgtgctcctgttcctagcaggttctcagtaaatatttgatcataggaatgtgtgaatgatccaaggagtgagagagtgaatgaataagcattcaacccttggatgtagaaaagctctaggaaaattaatggaaggcaaaaacaaaacacaaaactttgaaatgaaaagcattgcaccctatgaagaagaaactcaagcatagttgcctgttcattggtgttaaccactctccttttggcaggattgcctgctgctcttctgaatctgtaaatgccagatatttgatctcctagcttgccctgcatctggtcacacatataatagccctggatacggaagatctgtgcaaaagtctgcaaatgggcttcagttaaattttgtttcctaacaaaatgggagaaaatggtcttcttcaatacaagatgcatgtctgtatgtcagcgtgatacctggaattgtggccattttgcaagcagagaatcaagagtctgagactggcacagaataggttggaattatgtgtgtccttgacatttttgttttgttttgttttgttttgtttttgtttttcagacggagtcttactctgtcacccaggctgtattgcagtgatgggatctcagctcactgcaacctccacctcccgggttcaaacgattctcctgcctcggcctcccaagtaactgggactacaggcgtgcgccaccatgcccagctaatttttatatttttagtagagatgaggtttcactatgttgaccaggctggtctctaacttctgacctcatgatctgcccgccttagcctcatgctgggattacaagcatgagccaccactcccagccaacattgttgatatgatgaaacaatgaagaactgccctttccctggacttggtgcgaaataagaaactgcaggagtatgttgtaagtttatttttatttttatttatttatttatttgagacagagtcttgccctgtcgcccagactggagtgcagtggcacaatctcgactcactgcaacctccacctcccaggttcaagcgattcttgttcctcagcctcctgagtagctgagactacaggcgcctaccatcacgcccagctaatttttttctatttttggtagagacagggtttcaccacgttgcccaggcagatcttgagctcctggcctcaagtcatcagcccgcctcagactcccaaagtgctaggattataggcgtgagccaccgtgcccacctgcatatgttgtaagtttatactccactttttacaatatatctgaggcctggaaagttatttttaaagacatttttatatatacacacattcaactttcgtaaagtttatattcagctttttatagtacatctgacattgtagaaaagcattttcttatatatagttgaaatatatattcaactttgatttagtaaagtatatgaaaaacataatttacattcagcattttatagtgtatgtttatattcagctttttatagtatatgtgaaatcctagaaaagtattattttcctgaataagaaccaggaagaaactgattaaagagctataccacataatttctctagtactagattatcttacagtcttctacctcttcaagatacaaaagtcatggctgtgaggctatcattacccttttaccaaagttggaaaaggacagcatccaaaataagtcagctataaaaaaaagtaaagtcggccgggtgcggtggctcatgcctgtaatcccagcactttgggaggctgaggcaggcggatcacttgaggtcgggagttcgagaccagcttggtcaacatgatgaaaccccttctctactaaaaatacaaaaactagccaggcgagatagcacgtgcctgcaatcccagttagtcaggaggctgaggcacgagactagcttgaacccaggagacagaggttgtagtgagctgagatcgcaccactgcattccagcctgggcgccagggcaagactctctcagggaaaaaaaaaaaaaaaaaaaaaaaacaaaaacctgatgtgtatgcttccatgctttgcccacactaaagaagcatacccacagctagatttgttttggtaccataggaggtttcaggttggggagagtagtttgaatgacatcgtgcatacacattgaagtgtcatctcctctcctcacttggtaacataccagggacatccttcaaattaatacctgtagatcaaactagcttgaaattcttacataatggagtagttcccccttatccctggttttacagtatattgttttaattgttctattattggctattagttaacttataagttttatcataggtatctatgaataggaaaaaagcatagtatatgtagggtacagtactctatacagtttcaggcatctactggggatcgtggaacatgtaccctgcagataaaggactattctatagacaaaccatatgcagcccatttttccactaatgaaagttcagattggggccaggcatggtgctcatgcctgcaatcccagcactttgggaggctgagccaggtggatggcttgagcccaggaatttgagatcagcctgggcaacatggtgaaaccctgtctctataaaaagtaaaaaaaaaaaaaaaaaaaaagtcaagtgtggtggtgagcacctgtagtctcagctacttgggaggttcagggtggagaatagcttgggcccaggaggttcaggctgcagtgagccaagattgcaccactgcacaccagcctgggtgacagggtgagacctgtctcaagaaacaaaaaattcaaattattttaccaataattatacaccaaacagttttgttgtacatatattgttgcatgttgtacttttatatcaataaagtaggtggagtcctaccagttgaattccttgcctacaacatagtggatttaaaatatattcattaatgccttattattgtctgaaatcattaatcttaatgggaatttatgtccatttcctgacaaattcaaccaggactgaacttttttttatgttgggtgaaggaaaagaaaaagtgccttcaattttcttttcttttctttttttttttgagacagagtctcactctcggcaggctggattgcagtggtgcaatctcagctcactgcaacctctgcctccctggttggagcgattctcctgcctcagcctcctgagtagctgagactacaggtgcccaccaccacacccagctaatttttgtatttttagtagagacaggagtttcaccatgttggccaggatggtctcaatctcttgacctcgtgatccacccgcctcagcctcccaaagtgctgggattacaagcgtgagccaccgggcctggcctgcattttcttaactgccagtgagattgagcatctaccatgtctaagggtcattcgagttctgtttctgtggattgcttatttttatctcttccttttgtttacattggagtagtttttaaagcaatctgtggaaactttgctaaggagattgtattgtcatatgctctgcagtttagcctgcatcttttgccatcgtttatggcaaacagagttaacatatttttctgtgaagagccagatagtaaacatgcaaggctttgtaagccatacagtctctactctgtctttgtagtgtggaagcgcttaatacataagccaggtgttctcaaacaggggccatttcgtttctcatacctacaccccagtaggcatttggcaatgtccagagtcatttttggttttcagtatgaagggtgggtgctgctggcgtctggtgagcagaggccagggatcctgctaagcgtcctacaatgcatagtacaactgcccccaccccccaaaaaaagtctcatccagaatgtcagtagttctgaggttgagaaattctacctataagcaaatggacattgttgtgttccaataaaactttatttacaaaaaataatcagaaggccacatttggcctgtgagctatagtttgcttatctctattttaaatagctttttgctatatgataatatagttttctgtatttgttcctgaattgtctcattcaccccaaatatttttccaaattttcttctattttatgcctttaaacctttactaaatacaaataatacacagaaacaatagcccctgtgtaactaccacctaataattaagcatgttgttttattgttttgattaaaaatttataaaagaaataaatcatttcagaaaaaaaagtgtagtcttctctttttctctttccagtcctgctctttgccctgtgtctgcacagcaataacttagtgcactaatatctgtaaaaccagcacgtatccaatgtacaaggacatgatacatactattatgtgcttctaagtaacacaaatggtgatacatctttctgcaatttcattaacaatatgtgggatccaaaaccattgaaaaatactgatctaattcttttatctgctgtgttgccttcttatttatttatttattttttgagacggagtctcatctcactctgtcacctaggctgagtgcagtggcgccatcttggctcactgcaagctccacctcccgggtttacgccattctcctgcctcagcctcccgagtagctgggactacacgcgtccgccaccacgcccggctaatttttttgtatttttagtacagacggggtttcactgtgttagccacgatggtctcaatctcctgacctcgtgatccgcccaccttggcctcccaaagtgctgggattacaggcatgagacaccgcgcccggcctgtgttgcagttttatacaatttattcactgaagtccctttattagagaaaaacagttgtaaatttaaaaaactatatattttaagcactcaggatttaataaaggatttttgtaatttgaagaatgttcagtagagccaagaaagcttgtgggctttacaacctagaaaaaagttgtaagcagagaggcttagatccactacggtactgttcaaggaaaagtgtcagggctactactacccactgctcatcacctagtggttgagggcctggatgctgcaaacttccacagtgagcagttctaagcaaaccccaaaggccgaggaagctgaggggccaaaggaagaggctgaaaaatctagtttcttggaaacatttttttgtttggtttgggtttttttgttgttgttgtttgtttgtttgagatagtctcactctatcgcccaggctggagtgcagtggtgccatctcggttaagcaattctcctgctgaattcagcctctcgagtcgctgggattataggcgtgtgccacctggctatatttttgaatttttagtagagatgggttgtggggaaaagcaagagagatcagattgttactgtgtctgtgtagaaagaagtagacataggagactccattttgttctgtactaagaaaaattcttttgccttgagattctgttaatctatgaccttacccccaaccccgtgctctctgaaacgtgctgtgtcaaactcagggttaaatggattaagggctgtgcaggatgtgctttgttaaacaaatacttgaaggcagcatgctcgttaagagtcatcaccactccctaatctcaagtacccagagacacaacacactacagaaggccgcagggacctctgcctaggaaagccaggtattgtccaaggtttctccccatgtgatagtctgaaatatggcctcgtgggaagggaaagacctgaccgtcccccagcctgacacccgtaaagggtctgtgctgaggagaattagtataagaggaaggaatgcctcttgcagttgagacaagaggaaggcatctgtctcctgcctgtccctgggcaatggaatgtcttggtataaaaccggattgtacgttccatctactcagatagggaaaaaccgccttaaggctggaggtgggacatgcgggcagcagtactgctttgtaaagcattgagatgtttatgtgtatgcatatctaaaagcatagcacttgattctttaccttgtctatgatgcaaagacctttgttcacgtgtttgtctgctgaccctctccccactattgtcttgtgaccctgacacatccccctctcagagaaacacccaataatgatcaataaatactaagggaactcagaggctggcgggatcctccatatgctgaacgctggttccccgggtccccttatttctttctctatactttgtgtctttttcttttccaagtctctcgttccaccttacaagaaatacccacaggtgtggaggggcaacccaccccttcaatgggttttcaccatgttggccaggctggtctccaactcctgctctcaggtgatccgcccacctcggcctcccaaagtgctgggatgacaggtgtgagccaccacacccagcatctcagaaccatttaataaaaactaggaacagaagtcatgtcgcatgcagctgcaagatggtggatccctgcacaattaccccaaagttcctggctttatataccatagggaatttgcctaagggcgggactataataagtatggttcgtgagcaaacatcaaggttgtttgacctaagggggagaatttaaggtaagtacataaaagtacatttaaggtgttcctggaactggggctaatcaagagtcaacatggtagattagcatccaagatggagttgctttaacccccggcggagacccaagcctgcgccttgaagctccttctccaccggtagaagtcgactcaaggaggtcgtgaggacaggactcctgggggtcccgctctggggcacccgtagccctctcttccacagcgccctcctactggactcccgctgtagccaccgccgtgactgcagcaagtgcaccccctcccccaaccccgaggccgccgcgccgccaccgttgtttaaagaagcctctgcctgacttccgggagcagagcgctggacggacaagccaatgcgcatgcgcgaggcgccggctgtttccccgttcacaatgacccccacggttgcctaagaaaccagtccctgaggcttgggaaagcaggagccctccgcggcagtgcgtcggtgtcgaggctccgaggctccggcctcacctctccaggaggtcgacagaacgacaggacgttctccgaatgccaggagtcgcagagggcagagcaggatgaagaaaccacaggcggagtctaggggaagcagtacggcgtccctgcctcaggcctgcccggacggtgtgcgggtgagtctccccaaaagtcgtgcccctgtcaattcgaggacaggtctgcctgtgtgcctgtaggctactctctcacccgagggtcgttctcacagagagcagaaccccgcagcctcaggagttgcctggggcgggcggggggggatgtttgtgtaccactgctgtgtgtgtgtgtagtgtgtgtgtgtctcactttcttctctctctctctccctctgtttctttctctgtgtgtgtgtccgtgtgagtgtgttgtcacgaatgtgccctgtgcgccaaagggcaatttcttgcatgtcggcctgtctttggtgagcctctttctgcatctctgcctgggtcatgtggagatgcttcggacccagaggaattgaaatctcatccccagcctgagtggcagcttttctaggatcaagaccacacctcagccaaggacaaaagcatcagaagagctcattgtcctgagggaggggagcagaccgacgtcaaagatggttttaagtccgcgagactcttctctgacaaatgaagccacaccacgacacaggcttaaagaagaagccgggaacaggacatggcaaggatccctgtcactggaacactggcctttctggacaagtcacccgtttggcactcctccccgggtgcccgttgcggtggcactgtgctgtatcctgcctgggctctggcctctgctctgtcctccctcttgctgtgtctcccgtttctgaggggtgcagatgcttcttggtctgcctcaatgtcttcaacaaagaacactttccagtccatcagggagaaacttcaaggagatccatgtcatgattgtttccctctgcaaacttgtttctggtggattgggcacgtgtgaagatcctggagctctgggcatccatacctgtctcagacagggaagctcccttggtctccatgtttcacctgatggctgcgtagtttccctacaatgaatggtaggcgaccgtggctggccttggcttcaagagaggcggtgtcacatttcctctgcatttcctgtctcattcttaagggacatctgcttcctctgctcctgggtggactgcctcccagaactgaatcttttggcagccaataatgtcagggagccaaagggactgggctggggctgggtgcatgggaggttgcgttagggctacctaggcggtggagggatggaggtggagtgatctttacagaaacctctccgctcctccagcaggctccccaaaatgtggcttggacttacgcacagggcctcttctggttcccagctgtgctttgcttttccttggcattgttggggaggtcacctgtgccccccttccaccgggcacatgcctggacaccagtgttcgtctcgccatcgccccatatggcctcggtgacacacactcaccccatctgctctgggggacgccagtgccacgtttggtcacattggctccacctcggactcacccctgttcttgtttgcatgtctcctggaaagcggtggcggcacacagcagccccaggactttggcaagcggggcaggccactgcacctcccagggaggagggaggcagagggctcatgtttcagtgaattttcagctgacaccatgccttcaggcccatgggatctttctgtgccccagcgaggccctgcctgcctcaccagatgaggtgagcccatccctggtcacctggtgggatccaaaatcggatctgaagaggagtactgagaccccagcaggcgccctgaacctcctcttccactggtagaagttggctcaaggaggccctgaggacaggactcctgcgagtccggccctagggcgcccgcagcccccactccctcgccgccccctacttgatcccggattcagccaccaccgcgctgcagcaggagcccctactgccgccgccattgttcgagggggcctcagcctgagttccaggagcagagcacgagtcggcctaggcaatgcgcatgcccgaggcgcgagaggattatcccgtcacagtgattcccacagttgcctgagaaaccagtccctgaggcttggcaaagcaggagccctccgtggcagtgcttgggtgtccgggctccgagactccggcctgacctctccatggggtcgaaaggacggtctctggatgccaggagtcgcggagggcggaccagcatgaggaaaccattggcggaaaatggcagaagcagtgcggcatcccagcctcaactgccgggacggtgttcaagtgagtctccccaaaagtcatgccccccgtgatctcgacgacatgtctgcttgtgtgcccgtgggctgctctctcacttgagaatcgttctcgcaaagagcagaaccccgcagcctcaggggttgcctggggctatgtgtttctgtgccactgctctatgtctgtgtgtgtgtgtctcccattctctcttctctctctgtcactctgtttctctctctctgtctgtgagtgtgtgtgccggtgtgcgtgtgtgtgttgaatgaatgtgccctgtgcatcaaaaagcgatttcttgcatatcggcctgtctttggtgcgcctcttgctgcgtctctgcctgggacatgttgccggttgtcaatcggtttcgcggcagttccactttgggtttctaaaggcctcgacgacgtgaggagaggcgtcggtcctggaggaactgaaatttcatctccatcctgagcggcctcttttctaggatcaagacgaccacactccagccaaggacaaaagcctcacaggagctcactgtcctgcaggaggggagcagacaaacgtcaaagaagatggttctatctcctcacggctcttctctgaaaaatgaagccacaccacgacacaatcttcaagaagctgggaatgggacatggcaaaaacccctggcctctctggacaagtcacctgtttggcactcctcccctcagcctgtggcggtggcactgtgctgtatcctgcctgggctctcgcctctgctctatcctccctcttgctctgtctgccctgtttctgaggggcctagatgcttcttgttctggttcaatgtcttcaacaaagatcacttcccagtccaacagggagaaagtggtgatccgtgtcatgattgtttctctctccaaacccgtttctggtggattgggcaggtttgatgatcctggagctctgggcatccatacctgtctcagacagggaagctcccttggtctccatgtttcatgggatggctgcgtggctggccttggcttctaggaaaggcggtgtcgcgtttcctcttcacttcatgtttcattcttgagggacatcctcttctgagctcctgggtggactgcctcccagaactgaatcttttggctgccatgaatgtcagggagccaaagggattgggctggggctgggtgcatgggaggttgtgtcggggctacctaggcattggagaggtgggggtgaagtgaactttgcagaaacctctccgctcctccagcaggtgtagcaaaatgtggcttggattcacgcacaggccctctcctggttcccaggtgtgctttgcttttccttgacgttgttggggaggtcacctgtgccccccttccaccaggcacatacctggacaccattgttcgtctcgccatcgccccatatggccttggtgacacacactcaccccatctgttctgggggacgccagtgccacgtgtggtcgcattggctccaccttggactcgcccctgttcctgtttgcacgtgtactagaaagcggtgtcttcttgcaggagccccagggctttggaagcggaacaggccactgctcctcccaggggcgagggaggcagagggctcatgtgtcagtgaattttcagccgacaccacgccttgaggctcatggatctttctgtgccccagcgaggccctgcccgcctcacagatgaggtgagctcatccctgcttacttggtgagatccaaaatctgaagaggagtcctgagaccctagcaggcgccctgaagctcctcctccaccggtagaagtcggcacaaggaggtcttgaggacaggactcctggtggtccagccctggggcgcccgcagtcgcctctctcaacgaagcccgctcctcgaccttggatccaggtgccctcctaccgccgcgccgccgccattatttaaaggggccgcagcctgacttccaggagcggagcgcgagtcggcctagctaatgcgcatgcgtgaggcgcgaacagattctcgtcacagtgattcccatggttgcctaagaaaccagtccctgaggcttggcaaagcaggagccctacattgcagtgcttgggtgtcggggccctgaggctccggcctgacctctccagggtgtcaacaggatggtctgcggatgccaagagtggtggaggtccgaccaggatgatgaagccacaggcggagtctgggggaagcagctcggcatcccagcttcaggcctgccgggacggcgttcgagtgagtctcccagaaagtcgtgcacccccgtgacctcgaggacaggtctgcctgtgtgcccgtgggctgctctctcacccgagagtcgttcttctggagagcagagccccgcagcctcaggggttgcctgggggggtgtgcttctgtgccactgctatatgtctctgtgtgtgtgtgtgtgtgtgtgtgtgtgtgtgtgtgtgtgtgtgtgtctcccattctctcttccatctctgtctctgtttctgtctctttcttactttctttgtctgtgcgcccgtttgcgtgtgtgtgtgttgggacgaaaatgtcttgtgcaccggagtgctgtttctttcttgtaagcctgtctttgttgagcctctttttgcgtcttttactgggtcttgcggcccattgtcagttttccctgccgttccactttgcattttgtgaaagcctcggcaacatggggagcatcgtgggtcccgcaggagttgaattctcctccccatcctgataggcctcttgtccaagatcaagacgaccaccccacacttaagcacattttttaaaggggtcgcagcctgatgtttaggagccgggcccatgtagacctggctaatgcaccttactcgcctctcactgcctgtcacttcgtccacagcagcccccgctcactattttttaaaggggccactgacgggattacaggagccaggcgcctgtcggccttgccaatgtgcatgctcgtggcgtgtgcaggttctcacgtcttaatgatcccctccatcgtctggggaatgggtccctgaggcttgccgatcacaatcactccgtggcagtgcatccgtgtcaaagcttttgcctgacctctcaacgtggttgacatgattgtctctggatgcccggatttgaggaggtcaccgaccaggatgaaaaaacctcatgcagagtcacggagaagcagcgcgggatcccagcttcaggggacagatggaatctccggactcccatttggatctgattttggatcccacccattgagcaggaatggggttacaatctggtgaggcggggagggcctctctggggcacagaacggtcccacggacctcaagccatggtgtcagcttaaagttcattgactcatcagcccactgcctcccttctccttggacggagcaatggccttctctggtttccaaaatccagggactcctgtatcctgacactgctttctgggaccagtgccaacagggccaggggtgagtttgaggtggagcaaatgcgaccacacgtggcactggcgtcccctatgagcagatgtagtgagcgtgtatctccaaggtcgtttggggtgatgtggagactgacagtgatgtcctggcatgcgctcagggggctatggggaccttcggaagaaagccaaggaaaagcaaatcacacctgggaaccaggagagggcctgtgccggagaacaagcccattcagggaggcctactggaggaggcgagaggtttctgcaaagtacccttcacccccacccctccattgagtaggtacttctcaagctgtctttccttcacccagccaaaacggaaaatcgttcctgcctttttaggacagcagtgctgagcagcaggattccctgagctttgagaccaggacggtgccctgggaggcccaggtcgaagggaggcagtgagctcatgaaacagggaattttcagctgactccctcccctgggatctcagctgttactgtgccccagcgacccccttcacacctcaccagactgaataaccagccccatgggacccgatttctgcccataccttccaatccggaatcggagcagaagagcagtcccgagtgcccacctcacggtctgaagcgcctcctcctccaccgggatccgaacacgaagtcggcttaaggaggccctgaggtcaggactcttagggtcctgcgctgcttgtcgcaagcagcctcctcccccaagccgccgccggtccatctctagcattttcctggggctgccgcctgacagccctgacattgcagcgcgcgcgagccgaccacgacaatgcgcatgcaccaaacgcgaggcaccagggcaagctctgagccagggctggcctcccagggaccaccaccattgcctgggcacgggtcccagaggcttggcagatcaggagccctctgtggcagtgtgtagagttgggctgatgtctctcctctctgagggatcagcacggtgatcccacaatccttggagactggcagggccgaactaggctgaagaaacgtcaagcagggccccaagaatgcaccacaggatccctaaggatccctatgatgtatcaggcctgcctagatagtttaggggtgaatctccttgaaagtcgtccccccgggatttggacatacggcctgcctatgtgcccgagggctgctctctccccggaggggcttcctggcagagagcagaaccacgcagcctcaggagctgcctggctgtgtgtttctgtgcgagtgctggatgtctctgtgtgtgtttctttctgtgtgtgtgtggtttcttgtgaaacaaatgtgactcgtgcgctggagcgcggtttctctcaagtccacctaccttctgatgctcctcactctgtggctccgcttgggctgcggggccccacgtcctttgttttgcttgtagttcctgaagcctcggagaagtggggggctggctccaacccacaggggtccaaatcatctccccaccccggggagccactcttctagaaagaagatgagcacaacacacccaagaacagacgcctcctaggggcccatagtcctgtggcacatccagggctggaccctagctgtcctgtcctcaggatccccttgagcccacttcaaattccgttgctggcagggcaggagcttaaggatgtcagatgggcactcaatcttctttcagttccattccgggtcaaaaagaaatgatgtgtgtagaaataaggtgagacaggggtgaggatacagtctgatgaggtggggaggaggtcccacaactacaccagcaggacaggtgcagatagatgtcaaagaagctggttccaactcattctccccttcctcttcactgcataacctgtccacaccatggcctggtgctggtggaagaagacatgaatgtgaggagaatatttggactgcaaactgtggcctttctggccagcttccaggttgggccctcattcccggagccacatgcgagtgggatggattgatcctgcgcgggctctggcctcttctctgtcctctcttttcctgccttccatgtttctcatgggcctagggtttccttggtctggctctacattctctacaacaaacttttcccagttagttgaggatgacctttctgaagatccatgtcatgagtgtttcctcctcaacacccacatttcctaatgactgggtagctgtgataattcttgaaccgtgggtgctcgtagctcccaccaacagggaaacttttggtcctcctattccgtcagatgactgcatgattcccataggatgagaggtagtcagccatggctggcctttgccttctaatctaggctgtgtttcatttcctctgcacatcctttcttattgttgagtgatctcccatttctctattcctgactggaactgcctctcagcacggaaccattggctgttaggaatttcacagagcaaaagggactggcagttgactgggtgcaggccaggtggtgagtagtgatccggtgtggggtttggggtgttttgcactttgcacctcttggctcctctggctggaatccctgaacggggcttggactctagcacaggcccctcctgtggtcccagttgtgctttgcttgtccttccctttcttggggatcctcattgcccattgggagcatgcccggacatccttctgaggcttggattcaccccatatggcctttgagacacactctcaaccttatctgtccccatggattgccagttccaggtgtggccaccttggctccactttcagcttgcctttgtcctcgttcccgttgctactggacagcagtgctgaggagaagcaggagcttctggcagccagacaggcatgtttgctgaggcactagtttgcatgacgctactgggacccctcggaggatgattttggtagtagggccaaggccaaacaggttagtagccaggctctatgggacttgggttgtttccaagtctgaagcaagatgactgctgggtctacaacctagatatgggtcactgctttcaaaacaaccctcttaggtcttgggatccacaagggtttcataacctcctacatgaatcccaaggctcccagagagagacttttgccaatggataagtgcagaattcttactattgtggggggatatgagcaggtgaccacatatttcaccatcttgctaacatcatcaccatctgtttcctttattgtataataaactagtaaacctaagtgttttccacagatctgtagccattctagcaaatgatgcaactaatggagaggatcatgggaacttctgattcagtcattcagtaagacgtacaggtgacatctggacttgtgattggtgtctgaagtgagagtagtcttgtgggactgagcccctggcctgtgggatctgactctaaatctgattagtgtcagaattgaagtgcaggatgcccaattggtgtgcacaaggaaaagccccacacaagtggtatgagaagtactgagagtggcatgagtatagaaggaaaacctgcttttgcagatacagtggcatacatacaatccttttgtataaccagggttatacaccatgaccaagtagaatttattcttggaatgaaacaatggttaaatatttgaaatcctaacgtgtaatatatcacattaagagtgaaggaaaaaccccacttgattatctcaattcacgcaaaaagtttcaaccaatttcaaaaaccattcatgattttttaaaaagtcatgcaacaaattaggaattgaaggaaa

SEQ ID NO: 1377 - DNA, 20001 bp, Homo sapiens
gtgcttaaaagaatcagtgtggagtcctttggtgcacataaaattaaagaatcatcaggccattttaaattatatttaaaggcattgttgaaaagtatgttagttccaagagcctgtttgttctctggttattctttaggaacaagtgagtagtcagggaagccttcctgaaggaggcaacaccaaggagtgggcattaaggacaagtgtcctcttacatcctccccatgtgaaggaaatgcaggcactgagttatcagatttgcttcagtgctccaaggggaagatgattggaatgagctcaagagtcaatggcagggaacggtctggacccaccagtgccatcggccaagccagaagccagtgctgattatgggccaatgtcatctgctgtggagtgcgctgagattattttacttcagactgccctgattttgtgaccataaaaatcaatttaatgaattgcaaccctcttttttttttaaggtaattatactatctggtaactcagtgcctgtattttcttcacatggagaggatgtaagaggaagcttgtccttaatgcccaccccttggtgttgcctccttcaggaaggcttccctgactactcattctaaacagtgccccctcacacacagtacacacacacacacacacatacacacatataccacttataattaactgaaatcttattttctctcctgccacccatcccactagaatatcagctccatgaggtcagggcctgggtgccttgttcattattatatcatcagtgccccaaacagtgtctgcctactaataggtgctcaattaacacttatgacattgaattaaaattgcctcggctgggaggttccagctgttgctcatcccaaaggctggtattctgcctcctgttctgctctgagaatctggcaccactttacctctcctgcaaggacttcagcacaggccatgatccttgttcacatctctaggcctgaccttctttgttcagtgttgccatctcgtttccttgtctgccagcagctgccatgctacctgccaatgtcagttcagcttcacttaagttcatttgcaccaattcccctttaacattttttccaatcacttttcatcactttttggtgtagttgtgtgaattttaacacatgtatacatccatgtaaccactgtcacaatcagaaaaccttccaaaactccaccaggctatccttttgtagtactctccctcccctttaaccctcgacaaccactgatctactcttcatcatgacacttttgtctctcagaggctgtcgtagcaatggaattgtgcagtgtgtaaccttttgaagctgacttattttactcaacataattcccttgagattcattcaagttgttgtgtgtatcaatggttcattcttttttattaccgagtagtattccattgggtggatgtaacagattttgtataactaattgccctttgaaggaaatttaggttgttttcagtatgaagtcatgatgaatgcagctgctgtaaacattcatgtatagcttttgtgtgaatgtgttttcatttctctaggataaatacccaggagtggggtcatactgtagcatttttttttaattttattattattatactttaagttttagggtacatgtgcacaatgtgcaggtttgttacatatgtatacatgtaccatgttggtgtgctgcacccattaacttgtcatttagcattaggtatatctccaaatgctatccctccccccttccccccccccacaacagtccccagtgtgtgatgttccccttcctgtgtgcatgtgttctcattgttcaattcccacctatgagtgagaacatgcggtgtttggttttttgtccctgccatagtttgctgagaatgatggtttacagtttcatccatgtccctacaaaggacatgaactcatcattttttatggttgcatagtattccatggtgtatatgtgccatattttcttaatccagtctatcgttgttggacatttgggttggttccaagtctttgctattgtgaatagtgccactataaacatacatgtgcatgtgtctttatagcagcatgatttataatcctttgggtatatacccagtaatgggattgctgggtcaaatggtatttctagttctagatccctcaggaatcgccacactgacttctacaacggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgtttttaattcaagatggattgaagacttaaatgttagacctaaaaccataaaaaccctagaagaaaacttaggcaataccattcaggacataggcatgggcaaggacttcatgtctaaaacaccaaaagtaatggcaacaaaagccaaaattgacaaatgggatctaattaaactaaagagcttctgcacagcaaaagaaactaccatcagagtgaacaggcaacctacagaatgggagaaaatttttgcaacctactcatctgacaaagggctaatatccagaatctacaatgaactcaaacaaatttacaagaaaaaaacaaacaaccccatcaaaaagtgggcgaaggatatgaacagacacttctcatactgtagcgttttgcactttcccaagcaatgtatgaaagttccagtagtttcacatcctccccaatacttggtatatgttatcagttttgtcatttttttaaaaatttagccactatgataggtttgtagtagtatttcactgtgctgcatttcttatgaaaaaaatttaaaaatatattccatcacagaaaacaatagtgaatcctgtttgtgtgtgtgtatgtgtgtgtgtgtatatatacatacataaatatatatctatgaagtacacacaatcacatgtagagatatgtactaaatcatgtaaaatatattgcatactgtgaggctatggtttaaaaaattggaagccattgagttggcatttctgctttcttcatagtgactaagcagaaacctaaaaaccttgaataagctcaatttgtaagcaaagagaagaaactgagattaggggccgggtgcattggttcacacctgtaatcccagtactttgggagtccgaggcgggtagatcaggagtttgagactagcctaaccaacatggtgaaacctcgtgtctactaaaaatacaaaaattagccagacatggtggtgtatgcctgtagtcccagctactcggggggctgagacaggagaatcacttgaacctgggaggcggaggttgcagtgagctgagatcataccatggcactccagcctgggtgacagagcgagactccatctcaaaaaaaaaaagaaagaaagaaacaggttagacttcaagagtaccaattgaaaactgagtcatggagaaggtgaagagatcatcagtgctgagaagcaggtgcgacaaaactcactccccttttttcacccttgcttctgtatatacaatatgattccataacaaaattgttgggacttagtccctgcttttcaatgaatataccatcgaatagtggagatatgatgtaaacacaaatatgactatgggaagtattgaaaaatgagggtagatgtctttttcctcgttaaaaaaaaaaaatctatgtaatgcatctctctcccaagaggatatatttcatttaaaaataaagaggtcatgccatgtgttggtggggaagtgggtacagcttcccctcatgcacagctgatgggagtgtggacagatttggcattctggagaacatgcaatatttaaattacataacgcactcacttgctgacccaacacttctaatcatgcgtatggcatgcattacaaagtttacataggagggcaagtaaacacataccaagctgttcctcgctgcatcatttaggggctcacaaagttggaagttatccaggtatctattcccaagagagtggatagaaaaaatgtggtggataagtaccatggaatactaggcagcagctataagctatggaattacacagggatggagctgagaaaagattaagcaacaggatgagatatgtacagcacttacataaagtaaaacatatatattcaaaacaataatacaaattttgctggaacacgcaaacaaaaagtgcatattaagcatattgtaatacttatccattgagagagagagaaacaaatgtaaggaaataggaataaattttaaaaaaaaaaagaaaaagaaagaggctggctgatttttcgggcttgctcaatgactcttagctctgacccaaagggatctcagtgctgttaggcttctactgtataacattgtctcacctaaaggggcctcaaatgattcaaaactagttctggtaggtccagtcattctgtttgcaaaggcaagcttcccatcaaaaagcttgtttcgtgccttggttcttctctctccctctggccagtgctcacgggctctgagagacggaagggttctgatgagccacatacaccaacacttaggtgatgcatggctatcagatggacaggccatgtcccaggaaactggaccagcctaaggatggccctggctccaacaaggaaccttggtccagacaggttctaggacagaagttttaggattataagacaaagcatgactgcttgtttgtttggcttttggttttgcctaaagaacagtttaaaggggcttttctcagaagagagcagtgtggtgaggattcccgcacaatgtcagttactgcctgtctgtagtgtggaatgtgccttagacaaaggaagtaaattgcttgcgaaactcccaggatcttatggcctaaaaaaatagacggactaccctataaatccaaacacaggcacactgggaagggacaaactagggtacaaagataatgggctttgaattagttcatctccagggaaaatctggatgagaatacttctaaatatataattttggcccattactttatcgcatccctctgaagactgttaggcaataatgcattagagtttagcatagtgatgcaaaaattgtaagtgctcaacatattttagttccatttcttccctccatatctgacacatgttgaaaagtgtgcatgaagagcacagcatttgtcctcaaagcctgtatgtcgcttagcagaggtgctacaagcatgagctgttacccatagcgtgtccatacctatgtaaactagattattttcctccataattccaagttaaaaaaattgcttttaaatgtatttgaatatatttaatttttttcttctttccttttcactttctgagatttataactaatagactgaaactggagagcagagagcatgtgagagtcactgagccaaaaaacggagagttaacagccagtgaacttctgttgcactggtgcagaaaaacagactggcgttgaggttgaagaaacaacctctgtgagtttctaacaaccacgcctgtcttacttatgtccaaagctgcattcatttcccaccctgtactccggtcttatactctgttggattgattgggtagaatccaactctgctagacagttgtgcaaaaactggccccaattataattatttaaaggaatatttttcccatgaaaatatttccttcacttattcttaactgtcctgacatttccaagatcctactgtcatacatctggaaaactagtgagtattctcttaaaccactccatagccataccttctggctgctaaagtgaggttcccacgccaaagtttcaatgccattttgtgcaatttttacttcttttcctgttttcacattaataggagctgtagtctggaagataaagagcctttggtaccgcaagccctgtcatctgtgagtgtggcacagtgaaggcctggagagtcatgacctaggccctgtgaagtcaagtatttttaccaagtaaaaagattggcaataaaacatttccacatagtacatgacagaatacttgtacccatcttattttattggacattaattgcactaattgaggcacatgtacctttaaaaaaatgaaagaagaaaatactcagagaaaggactggtatgaggctgaggaagaaaaatgtgtactgcattctttagatgaagcagaaatcgatcagcaacttaaagtcgcaatctattcaatctttcaacattgcaaattaattctcatttggcttgattgtttgattgaaatgtaacctccgtgttggttcttagaaattcaaaaatatagagattagaaatttggttgatgaaaacctacgggaaaaaaaagcatgtggcctcggcctgaaatgtagaatggacaaataaaatgtttacagtgcaatattttaattgaataatccatagtaatagttgaaataaagtgatacattagactatatttgctacaacataaaacttcataacaagattatgaaagtgatttttattattttggtaatggtgtcccagtataagtaatgagatacaatttttttttaatttggtatatcaaacagtaaaggctacatataaatgttgtttccccagaatgtactttgtctacaactatgcactgtagctattatgcacacactaaaagcattcatgataaagtacaaaaataagaaaagattaaataagaaggtatccttgagttataaatgtctactaaagtataccttttaatcacacagttgtgtcacagctaaaaacacacaaattaacatatactgctatgcaactatttgatctaatatagatctactaggaaaatattaaggctgtagtaacacttcacaggtaaaggctaagttctgggacatgaaagcttttagaaaattcacaaaacaaacctgagacatctttttgttttggaaaaaagcaatttgcttatagagtcaaagctttgacatacaaatgaagcatttaataaacattatactttattgcaataacctggagtaaaacttctgactttaatggttgtcagcaaatacattctctctccggtagaaacacaatgagggtttctgattaaagcagtaatctgattactccagcctccaaattcagttattttcattcgttttttgttttcttttcctttctttaactaggttataagcatattaaataagccaggtaaactccaagcaccttactttcttccatataaacacagctttccttttgccgcaagcatctgatgacgactgggcctacatacgtaaaaacagattatagcacatctggacctggttgacataatgaggcatccagattggttcatgattatttttgcagctacacatttctcaatctaaaaaaataggctacagcagcccaaattcactgtctcagccttggtggggcataatattttggaatggcaagtgccaaaaaatttaaatgtactgggcaagcctgctttgtgtagttgactctaatgcctttaaaaatactggcatgattttttatattcaagaagtacagctatgaaattttaaaataaaattacatgaagttttttaatattccaaaccacaaaacagatctgctatgttgtagacttttttaatagcctatttgagatttaactctgctacgccaaacatctttcttctaaatgtccatgctttgaattttgtgctccaaattaattaattcagaatgagtgggaaaatgtttaaccatctttccttcttttcagtgtttctctcttttctcttaccatccccccaccccacacacacatacacacaactatcaaaaactcccttttttaaaattttggtacaaagattccaaaaagcttaataaaatgtaataagcacttagcacttaggacactgtagaactttctttggaagtttaattgcaatgaactttaaaacttgaaacttcaattcacttttctaaatgtgaatgcatacatttcatttgagctttatgctttcccagctaccaaagtaattgccatcttaaaaaacacaactgacctcatctccactgtcttttccaaacagcttccaagactatcttctgattctgactttccaaaaagcaggcattaatgttaactttcaaaaaatcatctagaagagaaacttggtcagttgtaatgggagttctgtccccaactcttgtcacctcgtaaaaagaacatccaggtaattcatggcattttccattattcattgggcagacacagcttagatttctctgccttccacaggagaatgttcagatttccactaacttcaactggaactcaataatcagaatggctttaaaatttagttaaaatttaagcatgccatgaatttggaattttaatatattaattaggttattttcaaaacaagattctgtattataaatagaatttcaataaagatgttataaaaataagaacacatcttaggatctaattttgagattcgccaaaatttgagtgaagaaaagaaaccctgcttcatttccatgtcaaaaataggtggttgatttaatcaagctcatttttagcacacttggttgcgttagttgtacttttcaattttcaatattatacaaggcatatattattcaaccttttcctgaacaagataatactaatatactgcttacggacagttaagtaatatatttcacactatttggtgacttttttttttaacctatgagacttactgaaatcagtacattatggtcacataatttaaagcttggctggcttttttttttttctttgctgataattcaaattctgtactttggcaagcaaaagaggtacaacatcaccttggagttttacaatttaataatgcatactttaaaattcatgataactcatggaaccccactatactcactaattcaactattgatttctttttgagcaactgactttatgatttatccttaaaagtaaggaagtataccagaaggcaaaaggataaatccacccataaatactagagtctaagttattttcctgaaaaggtgaaaagggaatttctggtctttatcttttcccttatcaccttcaatcacacactttacactgaaattacttgtctctgtctcttcaacaatatactctgaaactttgtttaatatactttttgtctatttctgcatatgggagaccaatcttggattcccaccaaaaatggcctggttaccaaaatactgcttcattcagtagtttggtgtaagtgtttgggtgtatgtgtctatatgtgcattttaactccaaagaatgctaccttcagaaataaccaagatgcagtatgtatataataattcattgggccctttaagtctttgactcaaaaaaatctcccagaagctcctgcatagcccactactcatgaagaaccgctgggtatggagcacacctcacctgatggacagttgatttatgctcaccttaaacgctaattgagaagcagcacaaaagaggaactggaaaaaaactgaattttactcctcatctccgaagatgtgaatatttctaaaatttcagcttgcctcttgcttcttattggcaagtttccttggcttgtaaattttggacagcactatcaaggagctccatggactctctgagagtgacattgactttaaatgacttgggtttaatggttagaccataactgaaattcattttcgcaggctcatttgggttggccctgaaatcgcactggtgagccaggatggagatgaagagaaaaagctgcatcttagaaagttcttcgccaatgcaccgccttttgcccactgaaaaaatcatcactctgctggtcaggtccttgttgatgaggccatccttgtccaagaatcgagctggatcaaagttctccgggttaggccacttcactgggtcatgattcacagaccactggttgacaaaaaccacagtgtccttgggaatgtggtagcccaagacagaggtgttggcagtggtggcatgaggaatagtgacaggcacaaagctggagaagcgcatggcttcataaaggaaggccaggacatagggcaggttgggctggtcacccatacaaggcagacggtccctccccacgacctgatccaattctgcctgcactcgagtctgcacatcaggatacctgtttggtgtttaatgtggagagagaaaagcaagtgagcaaaattcttatttcatctagaaagcacattataatttattttaattccactttttcttaaataggctatctagctcagtgactaaattaatatttctgggaaaaaaatctaaaacagcttcctaatttctcactaaattacaagatggactttaagaattatatttcctgtaataggccttgcatgactaatgctgtctttcccattataagtcaaaaaactcttaagttttcccagcctcaaaaagcacaatagtagataaggctgacttttccattgggtaccgcagggacagtgcctagggctcacaacactttttaggggcccatgaaaatatttttacgtcttttacaatcttcagacctaaaaaaactcacttttagttagaagaaaatattttcatacatcattttaatgcattcatctttatatcagggtagtcatgaaatttaatttttaatttttttatagtataaggaatctacaaaggcaaaagcacccagggcccacgaaagttacaatgtgaaagtaaattttttttctccctcatttccctggacaattccaacagacatgctgttctcattttatacaaagataattggtgtcctgatggataaagctacatactgtattttttaaatttgaaagcaaatacccaatgttcataaaattatggtacaaactgtagtacttattcactgttgatgatacaaactgatacaatctttttaaaaaacaaaatcttaatacgaggcaagagacatgaaggtaacctcttcccgcctcattttaaacccagtaatccatgcctagaaatgtattttcagaaaataatttaagagatacaaaaatatgtaaccacaacaggacctaaaattctaaaaattagccaggcatggtggtacacgcctgtagccccagctacctgccagacagcggcgggagaactgcttgagcccaggagtttgggaccagcctgggtaaggtagtgagaccctgtctctaaggtaagtaaatacataaaattaaaataaaaattttaaaaatgcaatcaaggccaatgaccaacattaaagttcaataaatgattatatataactatacattatcatagcaaaatactatatagccatcaaaaattaccaaaataaatattaaaagattagaaatgtccactaccttgagtcaaagtgttagaagtcaaaaaacaagtaactgattgtttgcaactccgaaaaaaaatgtatacacgtatgtgatgaagtggagttatttttagaatcgcttcttcaacattatattgcaggagtctgccaacttttttcatagaaacatgtatggtggggagagccagagagtatctattttagactttgtggaccaaaccctctttgttgcactactctgctctgccttgtgttgtagagtgaacgcagccatcgacaatgtataaatgaatgggcatgactgcgtcaataaaacgtatatacaaaaacagatcgtgtaatttgccaagccctgtcatacgtcttttcactaaaaaggaaaaaaaaagtatcagcatattgaattgaaagtgacctccaaattgttttatttctttttgccgcctaattggagtactcggagaactattgtggttctaatgaaaaacaaaggccgtttcaaaagttaaaatgcctatctgcggatgcacaaaaacctatggaacctattccgggatttccttttccctgatctctggttgacttttctttattcgatttctgcctctccctcacccaccatgggtgtttctatgattttaatactaaaaagccattttaagtatacagaaacttttaatttgtgaaggtagctgtacagtatctaaggaaatatagattgcagtggattttaataaggaaagagtcattctctgccttccaaacacctttctgtggcgcctgcagattcagcatctccaactgctcacttgtgctccaagaaatgacacaaaaccaggatttctggtctcttcggcaatcaaaatttgccttgcgaaacatttgcccctagggatagtgtttccacagtaaatactacaggccgcccagttaaatatggatttcagatcaacaagggctaatcttttagtgtgagtattcccgtgtaaaacttacttttcttttgccaaatctggcaacccgacaccagggacctgttgaatccgtgcttagtagagaccaacgtgggcatcagggggtccgctaactgagccaagcgcaggggccagaaacgtctgcaggcgcctcctggatatcccatctgcctttctgaatgctactctgctttcgtaaaagtgactgcttcttgtcttctaccccggcatttctcaaactcctagcgcggaggttttataaacctagcgctgcccgctagttgtggccgccttctgaaagtttctgtgcgggttacctgtcggctggcccggcctccatgggcttccttggcctggaacaaagccctgacgggcggcccgcttttagcgccagggctgggcggcctcggatgcacgccgaggactagcctaggagaggctgctgtgtttaacatatttatgacattaccttttctttcggaactattccagttctgattgtaatgcgccagggagagagatatcagggctcatctccaagcatttaaaaactcttgtttttccggggggtggaggggtctttgcaaatgtgttctcactcgcaagcaggggaggggacgatagagacaagataggagaccggaggggtcggggcaccgctgggtggggcgcgtgcgcgtgtcgcagccctcactgtgagtccctttaccgacgcgatcttggttttgaggggtggggacctggagcgaaaccccaaacccggggccctgcttgcaaactcagcatattctgtctctactccgcctttttcagaggagaaaagacctggcccacgcctcccagaggctttacctggtgaagaggaggagcagccactgcagcgcggtggacagggtgtcctggctggcgccgaagatgtcagtgatagtggccggtacgttctccaaatccagccgcgcgccaccaccgtgcgagtccccggccgccttcttttccgcagagaggataaaggcgtccatcatgtcgcggggggcggccccgggccgaaggctttcgcagtgcctcaagaacttgtccaggatgaagttgctgaagttgcggttgagctgctcgaattcgcggaaaacggtgcgcaccgggttggggaagtactgcagccagggcatcacgtccaccaggctgcccgcgcccaccgtgcgcccgaactcttcgttgtggctgagcagctcacggaactcggggtcgtcgtggctgtagcggcagccgaaacacacggcactcatgacgttggccacggccacgacggtcagcggcctcgggtcgaggaaggcgccgtccgcgctgccgcgcaccagcagcgccaccagctcgcgcgcctcgctcagcacgtggccctcgaggacttggcggctgcgcggctggcgcgtgaagaagttgcgcatcatgctgtgggctgcgcgccgctgcaccttccagtgctccgagtagtggccgaaagccatgctgcggccgccggacaccacacggaaggaggcgaaggccggccggtcggcgaaggccgagccctgctgcaccagggcctggtggatggcgcgctcgccattcagcaccactatggggcagctgcccaggcggatctggaaaacgtcgccgtagcgccgcgccaggcgagcgaacgagaggtgagccgcctggcccaccgccgccgcgtttccgatcagtggccacgcaaacgggcccgggggcgcggaccggagctgccgcctccgttgcctcagcagccgctggcccacatgcacagtggccagcaccgacaggagtagcaggagcgtggtctgctggatggacagcgggtttagcggccaagggtcgttcgggctgaggctggtgcccatgctggggacagagaggagaaggcgtgacactcaggggtgcagagacaggagcgggcgccccacgcccctaccccagcctctggggactgagtgccgttgggtggagaggtcggagctgactctctggagaaatggccgaagacgccccttcccatccccaacccactctcccttggagaagagaaggggcgtgtttccacctcgctgtaacccagcgccaaacccttcccctccccgcaaggcgcgtaacggttcctgcaatctggggacaacgctgcgggcatcgaggcggtggcgcttgatttcctttaaagtacctaccacgccacccgctacctgtaataatccatctgaagaggtcgccgggcagcgcctcggcagacagactgacctgcggggaggtgcggtttccagtggcgcgggacagccggctccgagaaggaactgggacctttgcctagggcaagacgtcaacaggaacccgcagcccggcctggacacctgctgccctcactggaagctttaactcccactcgagtctcttggcgtcgtcagtgccaggagcgcttggattgggatggggacggagaagggtgcctcgctcgccgagccccgctgcccttggggacctggcaaagtcgaggtttcctcacagcgttgagattgagactgggggtcggtgagtggcgtcaattcccatgcccttgcggctctcacaactggagtcgcagaagcgctcgctcccactcccactccagagtcaaagcgcgccatcccgctcctccgggttttaaggactgggtagaaggagggcagcgcgacctggcagggcggggcctgcggggggcggggcgcgccgcacaccaggccgctttgacccggactcccgtccaggcgcaccggccggcctcggagctctaccagcaggctttcatgggagcggaggtgcccacgtttccattgtgcggtaaccgcgcttcatcacagccacctccaatcgaggccgcacggtgtccccagaaccacgctcggtacaacctgccccggccgctgcgctcgacttgggagcgcgccccgccccgagcgcacgacctcccttccctctccgcgacttgagcttgcttcccggaaagccagtgtagtggcagcggtttgcctcacagcgcccctggttggttgtttaaattttatcttaggttctcgcaaacaaattgccacctcagtggaggctctttggcatgctaaattttttccagttcttgcggcgagatcaggaatccctaaaagtagccgctcccccgccccggggccccgacagtgcttgggcacacaaaggctcctggggcgcagctggccctgagatttcccgcgtagaggccactccaggtggcgccgcccgctggtgggcgcggggccgcccaggctgcgatggaagccgttggcgcagggcggggagccaagctggggcgactgggggggcctgggggagctagcggggcgggacccgagcggggcggagagtggcaggaggaggcgaatctccgcgctccggcgaactttatcgggttgaagtttctgctgtcgcctcccctttgcgtgcggagctgggctttgcgtgcgccgcttctggaaagtcggctccagtcatatccctgggcgctgcctgcggccgctcctcccgcgcttctcacggcacctgacacgcggaggcggcggccgagggtggggtgccggccaccaccacccttggcgtggggtgccggccgccaccaccctcggctgcgcacgcacagtcgcgcctgccaggccagcgaggcggacgcttgggccaccacccgcaggccgagcccgggcgcgtatcgccacctcgctgcgcaccggcggctctgtggtcttcctgggcgcgcttgcggtcgcgaagggggccctccctttataagggaagccggaggcgcttgggcgggggtggcttcccccgcctggcgcgccctttcctacatgctgatgcataggattttcaagacagctaagagaacaaggacttcacgaggcggggggaagggcgaactcgagggaagaggtgggatgtatctggttaaccaggtaggaattgtactggcttcatcaaaggataaatataaaagtgataggttcaccagggacaaccctgcactttgagctccactcgcgctgcgaatctcgtgctattattgacctgtttacagatgaataaactagggttcagagaggttgcgtgacttaacccaggtcgcgcagccatcaagaagtggagccagggcttgaagccaccaagtcccactccagatccttcacataagtttacacggaagaaaattgcagataagaggcccaaatgccttctttcctgcctcccttaaaaaaaaaaatgcacgtggggctaggcgcagtggctcacgcctgtaatcccagcactttgggaggcttaagcgggcggatcacttgaggtcaggagttcgagaccagcctggccaacatggcgaaaccccatctactaaaaatacaaaagttagccggacgtggtggtgcacacctgtaatcccagctactcggggatcaggggggaaggcagcagaattggttgaacgtgggaggcagaggttgcagtgagcagagattgcaccactgcactacagcctgggcagcagagtttaagtgagactctgtctcaaaaaaaaaaaaaaaaaaaaaatcagctggaagaactttttaattattgtttttgttttcataattgagaattctgagaatagcagagaagaaatagtatgctaaccctttgcaattaaattgcttatgagggaggccaggggagtgtgcctcatagctgaccctggaatgactgattacattgtaaagaaacacaaaggagtgtctgaaaagaatctgacttcttgagagattgaaaccagcaatcaatttgctgacctgataaagaaatgtcttttcgtgatggctttttttatttttatttttatttatttattttttttgagatggagtctcactctgtcacctgggctgcagtgcaatggcgtgatctcggctcactgcaacctccgcctgccaggttctcctggctcagcctcccaagtagctgggattacaggtgcgcaccaccacacccggctaatttttgtatttttctagtagagatggggtttcaccatgctggccaggctggtctcaaactcctgacctcaggtgatccaccagcctgggcctcccaaagtgctgggattacaggcatgagccaccgtgcccggcctgtgatgccttttattcggtatcttttgaagagttttctggaaatgatttcacacaccatgatggggaacttagatagtgatggagttttagtttttgagcagttgcattggtttaataataagcgttggtttcccagaggtgagttggcctacacagcctttgaaatgagtttcatagcaaccttcccatgtccagctttagcaagatccttgcctaataattcaagactctggtgcatgcatcaatctctcatagactttaatttagtagacgggaattatctatgagctaatgccaatcctgagctgttgacattcctgaaagcctttatcacaatacctctgccagaatgagagcagatggaagttgcctttaagtaaattcctatttttaaaaagtataaaacgaggttgttcctaagaccgcctgtccaactcctcaataatgccatctagtttttagatcaactagatgcatgctttcctgccatcgcagatagatcagatatatcctccaagctgtagttccttgggctcagctctttttctaggacatgactcaaaaatcagaggaactaggttggtaagtgctgtcagaaagataagcccttatcggttatggcaaaccaaaatgactggctatggtaacactttttgcagagaatcttcaagcctggagttcttagggctttatggtgcaaacttcattgaatgccccatccggtaccctgataaggacttcggataaatccagagcagcctgttggcaccccgacccaactcaaggcagagccctgcctctagtgagaatctacgcaggctctttaattatcatcacaacttctcaaccaaagcagggacctaaggcccaggaatctcctttcaatcaacacagaatatgggcattctgccctcccaaatctcaaacttgaattgtttgttgcaaataactttcaaaaagaacagctaagctagagggatagtttaaagtagagagaggtttaaaatatcttatcttgtattgactcgaaggaacaacttaagcttgtttaagcagaacaggaatgcactggcccatgtgcagagaaggataaccgtgatgcttcacaggatacaaggacccaggccgctctaccggctctctgcctatgctggtctttgcttgggctttctctctttgcatggcaaggaagcagcttaaaattaacaaaacaaagagaaagagaacagctctcttccagggtcctagaaggactccagggggccaggctggcatcaggtttttaccctgtgggcaagggcttgttctgtcatcagaaaaaaagagatggcagaacatgctaggaagccaaagagctgacccagtccactccatgtatacatgtctgcccactggtttctttgggttggaggataacctaaggaaacccaaagccattattgttattattattttaaatcagcagatatatgcattgcccttagagccagtagcccagaaagctctgcccttctgctgtcaggctggaactcagttttcttcatggtcttcctctctagtgtgacccctaagtcagtttaatgggtagccactgtgcttttccagtcatctccaaacacacatacccacatgcactgaggagagtggaggagaataagccatctctggtaggctcttgacatttgggtgggcaggattcagtcatcaggcacatgctggtaggcaagaggagcagaaataaggagacacaccaagtggctgagggtgcgatagagggaggaactgtaggataatgcacaccaggggctggaccatgaaaggaatcttaggaattgataccaaaaccctgtgcctcacctgaaatgctccacttccttcctcctggcaatacacaggcagagaaccacagagctaatagaaaggtattttatctaatctcagaagccatcatttgtaggatgcacccttatttttatgtactaacataaagaaaggaagctaccaattataattgcatcatcgactctaagatacatccagatttcggagatgtaaaatggaaagttgagggtatgatttggagctgacaaagcattatacatttcatgcgcgtccgtgtgaagagaccaccaaacaggctttgtgtgagcaataaagcttttaatcacctgggtgcaggtgggctgagtctgaaaagaaagtcagccaagggagacaggggtggggcggttttataggatttgggaaggtaaaggaaaaaggggggttgttctctggcgggcaggagtgggggtcacaa

SEQ ID NO: 1378 - DNA, 20001 bp, Homo sapiens
aaaatttgaagcataccaaaatttttcaagaaaaaaagtaaaaaacaaaaataaaataaatttgatctaaattcctccactcagaataattcactgttgacatttagtgactatcattccagatgtttctatgtaaatatacagataaaaatgagaatgaaagattgtgtgtgtgtccatgtgtaggcgacaaagagaaacagtttacagagaatggaaatacccatgatagcagtacaaaaaaatgagatcacattttcttttttttttttttttttgagacggagtctctctctgttgtccaggcgggagtgcagtggcacgatcttggctcgatgcaacctccacctcctgggttcaagcgatttccctgcctcaccctcccaagtagctggaattacaggtgctcgctatcatgcccaactaatttttgtatttttagtagagacagggttttgccaaattggccaggctaatctcgaactcctgacctcaggcgatccgcccgcctcagccttccaaagtattgggattacaggcgtgagccactgcgcccggcccacatattttttttttttttagacagagtctcgctctgtcgcccaggctggagtgcagtggcttgatctcagctcactgcaacccctgcctcccgagttcaagcaattctctgcctcagcctcccgaatagctgggattacaggtgcctgccaccacgcccggctaattttttgtacttttagtagagatggggtttcaccatcttggccaggctggaattgaacttcttatctcgtgatccgcccgccttggcctcccaaagtgctgggattacaggcgtgagccaccacacctggccctttttaatttttaaaaatgttttgactcttttgtaataacacttagcttaaaatacgaacacatcgtacagctttacagaaatattttctttctttttatcctcattttataagctcttttcttttctttttttttttttttttgagacagagtctccctctgtagcccaggctggagtacaatggcacgatctcggctcactgcatcctccaccttccggttcaagcgattctactgcctcagcctcctgagtagctgggattacaggtgtgcgccaccatgcccggctaatttgggtatttttagtagagatggggtttcaccatgttggtcaggctggtcttgaactcctgaccttgtgatccgcccgcctcggcctcccaaagtgctgggattacaggcatgagccacagcgcctggccttcttttttcttttttgagacagggtctcactctgtcatccaggcttcagtgcagtcgcattatcagggctcgctgcagcctcaacctcccgggctcaggtgatccacccacctcagccctctaccttccacccagtggctaggagtacagatgagtaccgccatgctggcctaatttttaaagttttctttgtagagataaggtcttgctatgttgcctaggctagtctcgaactcccaggctcaagcgatcctctcgcctcagactcccaaagtgctgagattacaggtatgagccaccacgcctagccaaaagttttttgtttttttggttttgttttgttttttaagacaggctctccctctgttgttcaggctggagtgcagtggctcaatattggctcactacaacctcgacctcctgggctcaagcaatcctctcactttagccacccaagtagtttgggactataggcacacaccaccacacctagctaagcttgcttattttttgtagagatgaggtctcactgtgttgcccaggctagtctcaaactcctgagctcaagagtaatcccaaagtgttgggattacaggctcacaccactgtgcctagcccaaaagtttttaaaaataaattttttaaaaatagaaaaaagtgaccaggcatggtggctcacacctgtaatcccagcactttgggaggctgaggtgggagcatcgtttgagcccaggaatttgaggttgcagtgagcactctagcctgggcggtgacacagtgagaacttgcataaaacaaacaaacaaacaaaaacaactaagacacaaacacccacattagcctaggcctacacagggtcaggatcgttgatatccctgtcttccacctccacatcctgtgccaggcaataggaatttttcaggtctattataatcttacgggatcatcatcacatatgcagtccattttttatcaaaaacattgttatgcagcacatgactgtatgtattagtctgttctcacattgctgtaaagaaatacctgagactgggtaatttataaagaaaagaggtttaactggctcctggttctgcaggctgtacaagaagcatggcagcttctgcttgccttctggggaggtctcagggagctttcagtcatggtggaaggcgaaggggaagcaggcattttacattttacatggtgggagcaagaggaagagagagaaggggaaaggtgccacaaacttttaaacaaccagatctcatgataactcactcactgactatcacaagaagagctctgagggaatggttccaaaccattcatgagaattttgcccctataatccaatcacctccctccaggccctacctccaacactgggaattacaatttgacatgggatttgttggagacacagatccaaatcatatcactgtacttctatcattttcatctttcatcatctatacattctttgaaatcataaagtatttactggattctcttttccacaaagtaatccttattctgatgtatgtttttcatttgctttttgcttatgtgtcttagtccattttgtgctgctataaaagaatacctaagactgggtaatttatacaaagcaagaagttattggctcctggttctagtccaagagcatggtgctggcatctgctaagaatttgatgagagtcttcttatggcatcatcccatggcagaaggtggaagggcaagagagagcaagagagagtcgtcaggaagggaacctaacttgtccttttataagtagcatattcctgagataatagcattaatttattcatgagaacagagccctcatgacctactcacttcttaaaaatcccacctctcaacactgttgcattgggaatcaagatcccagtacatgaactttgggggacacatttaaactatagcaggtggggaccacttatgatctaggagcaaagtgaaggaaggggcaaagtgaatggaagtttcaccattcagggaacaaatttacttttttccctgccatggttaacatttggtatttagccttccagacagatacatacatattttttcctcacaaaatgagattaccatatacatgctattttttttttttttttgagacagagtctcactctgttgcccagcctggagtgcagtggcaccatctcggctcactgcaatctgcgcctcccaggttcaagcaattctcatgtctcagtcttctgagcagctgggattgcaggcacacaccaccacacccagctaattcttgtatttttagtagagatggggttttgccatgttggccaggctggtctctacctcctgacctcaagcgattcacctgcctcagcttcccaaagtgctgggattacaggcgtgagtcagagtgcctggtctgacatgctattttgtaatctgctttcttcatgtcatacatgccatgcatgtttttatgtcatcaaatatactactctcacattatttaagtagcattccattggcacaatatatcacattttgtttaatccgatcccctattcatggacatttctgttgtttacagtaatttatcattggagtcaaactgctgcacaattttcattttcattttaatttttttgagacagagtctcactctgttgcccagactggagtgcagtggtgcgaccttggttcaccgcaacctctgcctcccaggctcaagccattctcctgcctcagcctcccaagtagctgggaccaccggcatgtggcaccacgcccagctaatttttgtatttttagtagagatggggttgtactgttggtcaggctggtctcgaactcctgacctcaagtgatctgcacacctaggcctcccaaagtgctggaattacaggcttgagccaccgtgcccagccagacctcctcttaatccctgtgtttctaattccacataatttactggcccccttaaggtctgtgtccccaagtcaagagcctttcggatttagttccttcgaggcccgaatccccagtttcctgctcaggctggtggtcaccctggctttaaggaggggaggaaggggcctatgatctagcaattcaatattcagctgtttccacccccaccttacacacagtctctggtgccttcatggagtctgcagacgtgtcaaaccatatcttcctgcgctttgctaccttagttgcttctctcagctactgatgtttcctgactcacgtgggtgacggtgaggataggccctttctattccttcactggcctttcagtagggttttgggtgggggaggataaaaataccacctcgtttaactggaagttgcattaattatacaaaggtctttctgatcattgctcatctttgaaagagaccagttattggttaaaaattaatctagagaaagatgaggcaagtgacctggaacagaccacagttttcagctgactttttttttcaaacaacctatcaccaaatgtgttttctcctctgtcttgggccatatcccttcttttcaggatgtaggagggcagtgtagcaacagactctaagatagactttctaatgattgctgttccctcaggccctctcctctggctccctctccagcagcagttttctcagctgggaggctgagacatagatggttaacatggatctacacataacttctctgttagttccacctctcccactccctgcagcctgcagggtggagctgacttctctggagtcattccagctgcttgccttttgtggttctaaacaatggatcgttaagttgggccttccagagcagtgcccttatctatacgtggcagtttggaattgtgccgccacctagcctttgaagctaaagacaggtacaggaatgttcagcactgtctgtaatagcaaaaagctgaaaacatgcaaatgactgtcaccaggaggatgagtaaatacgtcacatactcatatcatcgaacacaattcttcagtgaaaatgagtgaaactatcactgcacatggtagtagttgggtgtgtgtgtatgtgtgtgtgtggggggggcagagtctcactctgtcctccaggctggagtgcagtgacgcaatctcggctcactgtaacaatcgattctcctgcatcagcctcccgagtagctgcgataacaagtgcacgccaccatgcccggctaatttttgtatttttggtagagatggaatttcaccacattggccaggctggtcttgaactcctgatgtcaagtgatctgcctgcctcggcctctcaaagtgctgggattacaggcagcgtgccatcacacccggccgcagttgagtcttaaaaacacagttaagtgaaaaaagttagtcacagaagactatatacttgactgaatgatttcatttatataaaatgcaaaagttccctggaactgaaacatattgtgtgggaaaatatacacgaagaataacactcaggaaaagaagggaattattattaagtcaaattcaggatggtggttatcacaggagggagaggaagaggtgactgaggaggggcacaaagcagtcttcaaagtcaccagttaaattccattttcttttattttgagacagggtgttgctatgttgctcaagctggccttgaactcccagacttaagggatcctcccacctcagcctcccaagtagctggaactacaggagcacaccaccaagcccggcttctattttcttaaagctggttaataggtacatgttttcatttttgttattagtgaaactacatacatgttaagtatattcttttgttggaacaatatttcaaactaataactggagtgattactctcttttttcctcatcttttaaaagatggagttgtttctctttttcatttttggagagttttaaggtgaggagaagagtaaaaaataaactactttttttttttttgagacagtgttttgttctgtcgcccaagctagagtgcagtggtgtcatctcagctcactgcaacctctgcttctcgggttcaagtgattctcgtgcctcagcctcccaggtagctgggattataggctcctgccaccacgcccagctgatttttgtatttttagtagagacggggtttcaccatgttggccaggctggtcttgaactcctgacttcaagtgatctgcccacctcagactcccaaagggcagggattacagttgtgagccactgtgcccggcattttttggtttgcttgtttgtttttgaaatggagttttgctcttgtcacccaggctggagtgcggtggccatgatcttggctcactgcaacctccacgtcccgggttcaagcgattctcctatctcagactcccaaggagctgggattacaggtgcctgccaccatgcccggctaatttttgtatcgttagtagagacagggttttgccatgttggccaggctggtctcgaactcctgatctcaggtgatccgcccatcttggcctcccaaagtgctggaatcacaggtgtgagccaccgtgcccggccaaaaaatacttttatcactccctcgctgcagctgtctatgactttctccagggggtaaataattcacatacacagcctgtgaaggcactggcattatggaccttgggtttccaaataacactgaagaaagcgagtccatggaaaactgataatcaagaagctttattacttccaggattgcttatttttaaaacccctgaaaggaaaatggctttaattcagaaactggcttgtggagtggtggtggggcagcggcgaggcagggttgatacaacggcaactggaggaagaagttactgtgaggggaggcccacccgcatccggtgccccagtggactggtgccacctcagctggcatgacacctgctagagctgtgggtatttctcctattcaggagctctgggtctgttgatgcccgcatatgtgaattgggccccagggctctatgccacggcctggaagaggcttcatgtcagaacttgatggatgggggtgggatgggggtgggagggaggtggggcaggcactatgccaggaaaggtcaacagagtcttgttgtgcctgggagggaatttggactttatcctgagacaaatgaggaactgttaaagggtttcagccaggaaaaggcaggataatttttttttttttctgatagagtcttgctcggtcacccaggctgaagtgcagtggtgcaatcgtagctcactgcagcctctgcctcctgggctcaagtgatcctccagcctcagcttctcgaatagctgggaccacaggtgcatgcccccacgtctggtttattttttattaatattgttttgtaaagatagggtctcactgagtgcccagtctagtctcaaactcctggtctcaagcaatcctcctgcttctacctcccacagtactgggattacaggtatgagccactgcagcctgcccaggataagatttgactgagaaaatacataatgaaaaaatgctgggcacagtaaaacttcagtgactcatttaaaggaagctatactgtattcatcccatcagcagctacatagattatgacaatgtccatatgtaggcaaaagatattttcattctacagacaatacttaggacatgtaaggatttaggaacatttggcaaagactctgtgccctaaccccccactcccctaggactcaagacttacgggttaggcattgctgatccagttaatggcaatgctaaattgttctttttttttttttttttttttgagatggagtttcgctcttgtcatccacccaggctggagtgcagtggcgcgatcttggctcactgcaacctccacctcccgggttcaagcaattctcctgcctcagtctccggagtagctgggattacagatgcctgccaccacgcctagctaattttttgtattttcaccatgttggccaggctggtctcgaacttgtgacctcatgtgatccactctcctcagcctcccagagtgctggaattacaggtgtgagccagtacccccagcctgaactgctctttttgacagcaataaacaagttcagcttcatccttccttaggttggtaagaccgtgtctccaacatcaagggaaagcatgccttcctatttgttataagggacccacaaccaagttgccatttaaatatatgtgaaaaacaaaagaggatctaatacccaacatgcatttatactatttaggactgttagcaagactctattgcccatgtgattttataaatagtattatgacaacagttttgaatgtgtctgactgcacattgactcatttaatcctcacaacgtctgctggggtaggtgctgttattgcagttggcataaactacaattaattatgtaatttcttgttgaatattcatgttctgtgatcagttccatgagagcgggaagctcgtcttgtttatccttgtatccctggtgcctacaacagggcctggtatgtggcaagcattcaaaacgtatttactgaataaatttcgtattcccctttacaagtgaggacagaaaggcttagagatgttaaatagcttaccaacctttaggtcaccagctaatccaaactcacatctgttgaactttatcttcttaccagctctcaagtagtctaaggttttataaagatcacatagcttggtcgagttcctagctattaagtagaaagttattgagagattaacaaacacttttttaaagattcttcctttgtttttaaccattctgaaaacataaaacagaattcagaggagagcagtagtggaatggttatgtttaaacttgccatgtttcataaagacattacattgagaaattcacacctggcatttgagaacaaaagctggcgtagaacttggaggaagtattattaggaattcacccaactaaatcttcctaagcttattatctataaagctcatgttttattaaaatatagctcatatggctttatagctctttctcctcaactgaaatctttggtggggtggggggcggcctccagttttcataggccacctggtattgatcattcttaccttacttggttaaaacagttggccaaggaagcctaggtcctgatcccagccccttcaccatacccagccctgcctcggtacaaatttccttacaaaatgcccaatactccaaggcctctggaagaagcatgggaaactaagattactgttttccataggaaaggtattgaagtaactttcacaagctacctatggtaaaagagggaatataaagatttggagaaagggctctagtgggagtaagtgacaagtcctggcctattcccattccatcccatttctaggcaggagtctagccaagctgccaatcgggcccccgccagacaagacaagagcaactgatgtgtgaacatgcaggtgttaccctgcccaagagatgagcccagaccttgtcttgtctctgggttccatcaccccgagtgtgaagagaatggggaactccaagaaaccagcctgagacttcataccttctctctcactgcaatgtgggcagaggcccatgtgcaaaggtctcaggaacttgaattccctgtagttttagtaactaatgttggtatagattttgatggtacaacattttttcacatgcatctttccactgaggttgatatacaaatattaccgtccccaaattagagatgaacaaagagatttcattacttgtctaaagctgtatcactccctgcatatccagcctcctggtggactactgttcagtcatgagtttgggttttctccctcttcaaatcaatcatctgtgacttttacatcactagtgctcaatctttggtggacgctacgtagagaatctaagcaacactttgggttgtctttccagaaaaaaagcacatctatacacacacacacacacacacacacacacacacacacacatctgttagctctcaggacttttggtgatcccctggcgaccatggacacagggctgagaattcttcttttataaataatgtatgtgagaccaaagggacataataaccaagcacaatgtgtaaaccatgattgaatcctagttcaaaaattcagctatggaacacatttcagggaccaccatagaaatgtgaatatggtatatatattaggtttcactatggaattttctcaggtgacttaagggtaattttctttgatgtgataatagtgtttattatcagaatatcctgatttttaggagatgcctaagtattttggggtgaagtaatatgaagttctcaacatattttcaaatggttcagaaaaaatatagaaagaaacaagattgaaccacatgaaagttgcctacatatattatgtatatatttatatttatatatatatatatatttatatttatatatatatatatatatatatattttttttttttttttttttttttttgcgggggatggagtttcgctcttattgtccaggctggagtacaatggcaggatctcagctcactgcaacctccgcctcctgggttcaagcgattctcttgcctcagcctctcgagtagctgggattacaggcatgcaccaccatgcccggggaattctgtgtttttagtagagacagggtttctctatgttggtcaggctgctctttagctcccaacctcaggtgatccacccacctcggcctcccaaagtgctgggattataggcatgagccactgtgcccggccgatttaacctaatttataaaggaaatattgtaaactattaaaagtagtttaatctgggtggtggtatatggatgttaattaaaaagttattttaacttttctgtgcattagaaaatgttgcatgatacataaattttcataataaaatgtggggggaatagtttctgtttctttgtgatagctctcaaatctgccactatattagttacctattgtggtggaacataaaaaattaccccaaaatttagtggtttaaaactacaaacatttctgggtataatcaaaagaattgagagcagggactcaaagagacatcacacactcatatattcatagcatcattattcacaatgtgcaagagagggaaggaacccaagtgtacctccacagatgagtggataaagaaaatgtggtatatacatacaatcaaatactattcagccataaaaaggaacaaaattctgacatgtgctacaatctgaatgaaccctgtagataagccaagtcacaaaaagactaatgctatatgattctatttatatgagacagctagagtagacacattcatagggacagagagtagaatggtcgttgtcaacagatggggaaggggaaacgggcagctattttttaatgggtagagtttcagttggtaaagatgaaaaagttctggaggtagatgatggtgatagttgcacagcaatgtgaatgtatttaaaccactgaactgtgcacttaacagttgttcaaatgggccaggcacagctaggtgtggtagctcgtgcctgtaattccagcacttttggagacctaagcgggaagatcactgaggccaggagttcaagaccagcttgggaaacatagtgagaccccatgtttacaaaaattaaaattaaaaaattagctgggcttgctggcatgcacctgtagtcctggctactcaggagactgagatgagaagatcacttgagcccaggagttagtgagctatgatcatgctactgtattccagcctgggagcctaggcaacagagcaagtgcattccagcctggatgacagagcaagaccccagctcaaacaaacacacaccaccaccaacaacaaaaaaccaagaagcctcaaaattcccatctagttactacatataggtcaaagttcagtatctttgggtggcacaaaggtcttctgagctggtgacttataaactaaaagacaatccatccaaaatagggactgagaagaataggttaacatgattacagctctcattcggcaaacggaggagtgggaagcatgcagttatcactgcaccaagtccagctggggaggagtggaggcttctagccactggtgtcactggcaccttgggttcttgtaatcctcccaggatagaaataaagagagatcaccagacacagcagcaaagaaaaagtttattttagcttgtgcacaagggagccagcaacaagaaaggagaaggcacaggctcctccccaagggtagtctgtgggttagtctttctataaggaagggtcacgtcagggcatgtagaggagggatttttctagtgcttgtgcagtgctaaacatgcttcttcatacattgtatgtagcattagcattttaaatctctacccctgggcattatttttagcattaaaataagaaacaggtaactataggttgtagtttaagtctaacggcacatacagggccccagagaaatccctagccccctgaaataggagcttgtgattaagggttaatggcttcttgaatcttttgttactgattggctgagagttagataagctagagcttgagtgagaagctgttgtttgtttgtttgtgtttgtttgtgtgtttgttttgtagggacagggtctcactaggttgcccagtctggctttgaactccagcaatcctctggctgaggcctcccaaagtgctgggattacagggaccagtcgccacacctggcccatgagacaagggcttttaccctcttcctccagaccatcttaaaagagagaaccaaccagcttgcctgtccactggcagtggggtaagctgcctggtagcccatctggcagccccaggttctcccatctgggagaaacaacctagtctatcatcctttgtggccatgcctctgccttctctgaggttcctccctgtcccttgtgccccatggccacatctgagtgggcatggaaagtatgcttcttggagctgcacagcgtttacactctgtttactgctggtgccgatttagggcctggggtatgctttagggagctgaactgccacagattgtggcggaccagtcttgaaatttctttggcagtcttgagatttatcaagctgtactctatggcttgtgggctttcatgtaaagatgttataattcaataaataatttaagcagagtgtgtcttggaagcaatggaatacagtatgtcaagggaatggccgagcgtggtggctcacacttataatcccagcactttgggaggccaaggcaggtagatcacttggggtcaggagttcgagatcagcctggccaacatggtgaaaccccgtttctactaaaaaaaaatacaaaaattagccaggcatggtcgtgggcacctgtagtcccagctacttgggaggctgaggtgggagaatcacttgaacctgggaggcagagattgcagtgagccaaaattgtgccatggcattccagccaggtgacagagtgagaccttgtctcaaaacaaacaagcaaacaaacaaacaaacaaacaaacagcatatgaagaggagacagatgggcagagcagagacagcaactgccagatgagggtctctagggttaaaacaaataatcttggttccaagcggaagcaaaaagtttgggagcccagtcagttttcaaggaaactcttgttgtgtgtggttgttgtgtgtgctaaaaactacattattttaaaaccatcaaaactaatctataatgttagaagtcaggaaagtgattacccgtgaaggaagtagtgactagaaggcttatgttatggctgatgttatgtttcttgatcacatggtgtgatcacttcatgaaattttatcaagctgtactctatgatttatgtgttttcatgtacatatatcatccatatttttgtgtgtgactgtgatttatttattcttattgctgtctagtattgcatcatgttaatattaccacaaattatggatccattccactgtttgatgggtgtttggggtagtcaccagtttaataaatagcgctgctatgaatattttcaggtttgtctgttgatgaatttatgtacatgtttctgttgggtattgttccagctacctattgctgcatgacaaagtgttccaaaatgtaatggcgccaaacaacactcattttattatacccatgggctctgtgggtgaggaacttgaacggggcatggaaggtatggtttgctctgctccaccttgcctggggcctcagttgggaaacccaggtggctgggggtgacttaaatggccagggctggagtcatgtggagacttcttgctcacaaatctggtgtctgggctggaataactcgaagcctgcactcacctgagactaaacctcagggtctctctccccagcctgcccctgtgacttaggcatcctcacagcagggtggccttgatgtggtcagacttcctacctggagggtcaggaatgtaacagcaagtattctagaaagaaaacaggccgggtgcggtggctcacgcctgtaatcccagcactttgggaggccgaggcaggtggatcacctgaggtcaggagttcgagaccagcctggccaacatggtgaaaacccttctctaccaaaaatataaaaaaattagctgggcatggcagtgggcgcctgtaaacaaaactgcacatacccagcactgtaatttctgggccacaaaatttcacatgctcagctttagtgctgccaatcaattttacaaagcaattatatcggcgttaccgccgtgagcagtgtgtgagcattttggttggactacattccttcgtttttcattttagctattctggtggctgtgcagtagcagcacactgtgaccttaatttgcatttcctttggattttcctgatgcctaatgatacaagctatagtgggctgaatggtggctctaaaagatatcaggtgctcaaacttcaggaagttgtgaatgttgccttacatggtaaagtttttgcagatgtgattaaattaaagattttgagatgagattattctggattatctgatgagccctaaatgccatcacaggtgttcttataagagagagtcagagggagattagacattcacatagaaggtgagggcaaggctgggtgtggtggctcacacttgtaagcccagctctttgggaggctgaggcaggtggatcacttcaggccaggagttcaaaaccagcctgatcaacatggcaaaaccccatctcttctaaaaatacaaaaattagccaggcatggtagtgtgcacctgtagtcccagctacttgggaggctaaagcatgagaatcgcttgaacccgggaggtggaggttgcagtgagccgagatcacaccactgcactccaggctgggtgacagcgagactcccgagactccatctcaaaagaaaaaaagaagttgagggcaagatggaggagtagtgcagccacaaaccaaaggaagccaggaactaccagcagcccccagaagttaaaaatgccaaggaatggatcttcctccgagcctccagagggagcacggccttgccaataccttgattttggactccttgtctccagaactttgagaataaatttctgttgtttttaagccaccatgattgtgggaatttgttacagcagccccaggaaactaacacaagcatatttttatttgttttttcaccgttattttatcttcctttatgaagataaaatatacttactcatgtgtattgcctattttttactgggttgtctgccatttgtttattgatttttagggttttaaaaatatatattctggatataaattgaactcgtttaagctctctgggaagcagagattgaggtggagttagatgtgtcaaaggagccaggtgtggtggcatggccctgtagtcccagctactcgggaggctaaggcaggaggatcgcttgggcccaggaggtgaaggctacagtgacctatgattgtgcactgcgctccatgctgggcaacagagcaagactctgtctcttttaaaaaaatgtttttcaggccaggcgcagtagctcacgcctgtatttccagcactttgggaggccgaggcaagcagatcacctgaggtcaggagttcgagactggcctggccaatatggtgaaaccccatctctactataaatacaaaaattagccgggtatggtggtgagcgcctgtaatcccagctacttgggaggctgaggcaggagaatcacttgaacccaggaggcagaggttgcagtgagccgagatcatgccgctgccctccagcctggacaatagagtgggaatcagtctcaaaataaaaaaaaattaaacctggaagccaggagcggtggtacatgcctatagtcccagctactcaggaggctgaggcaggaggatcacttgagcccaggattttgagttcaatctgagcaacatagcaagaccccaccactaaaaaataaaaaattaataaagaagaaattaaagcagagaaatgttaaagaatattcattaattcattaaaaaaccaaactcattacatgttaacatcagagtgatgaggcaaggtatggtggcccacgcctgtaatccctgcactctgggaggctgaggcaggtggatcacttgaggtcaggagttcaagaccagcttggccaacatggtgaaaccccatctctactaaaaatacaaaaaattatccggcaatggtggcaggcacctgtaatcccagctacttgggaggttaaggcagaagaatcacttgaatccaggaggcggaggttgcattgagccaagatcgcaccactgcactccagcctgggcaacagagcaagactccatctcaaaaaaaaaaaaaaacatcaaagtgatgatgccatctgaaatcatgtagcctctggaaaattccactgcacaatcttaacagcatgggcagagtaaagaatgccaataatatctatcttagtgttattaagaaaatggctttgaactcatgaacctcctagaagggtcttgggttcccaaagtacattttgggcactgccatctagttcattctcctcaaagcactggcttcttatcccttcaggattaagtttcagtctcttggccttttacacccgtgtcctcttcatctgtgctctagcccactaggactcaccagtctgagccctccagcccagaaattgtctgccataccctgcctgccatccttccccagcctcacccccactcctcttgcctccttttccacctgccccatggctcacgaccattcctaccaccagactcctgagacattgcgattaacacacatatttacatatgtcatatataattttctttttattctttttattgtacagaaaaagataaaatgcatatattctggaattttttgctaaaactatcatggatattttttatatagatcctgcatccttttcaattttttttttttttttttgagatggaatttcgctcttgttgcccaggctggagtgcaatggcatgatctcagctcactgcaacctctgcctcccgggttcaagtgattctcctgcctcagcctcctgagtaggtgggattacaggtgcccaccaccatacccagttaatgttttgatttcaggtagagacagggtttcaccatgttggcccttggcctcccaaagtgctgggattacaggcataagccaccacgcccagcccttttacaatttcatccaacaaaaataatcatagttatttaagcagtttcattaaataaatccacaaaggtgacaaacatcaagacaaagcacatgtagacaaaaaatccagtgtcaagtcagcattaaatgtctaattaacaattggacaaaaacttctaatatttgaattcattttactgtttactgtaaatagtaaaaataacataaagaaaaataatataaataaaaactatgattcagaaaaaaatggctagttgcagttgctcatacctgtaatcccagcactttgagaggccaaagtggtaggattccttgaacccaggagtttgagaccagcttaggcaacacatatgaagagttcatctcatttggccgggcacggtggctcacgcttgtaatcccagcactttgggaggctgaggcgggtggatcacgaggtcaggagattgagaccatcctggttaacacggtgaaaccccgtctctactaagaatacaaagcattagccaggcgtggtggcaggtgcctgtagtcccagctactcgggagactgaggcaggagaatagcttgaacccaggaggtagaggttgtgctgagccgagatcgtgccactgtactccagcaacagagtgagactctgcctcaacaacaacaacaaaaaaggttgcaacagaaactggaatgggtccggaatcaaattggatctgacaattaactggcttggatccagttagaggccttggatgtttaacttggatcagatagaaactggcaataaatggcaatactgcaagtgtacaatctttggctttcagaaattcataggaatttttgtgttctgtcccatttgtttctttttcttgtgtgcttaggtagagaaaaatcgctggctaagttgttcaagaggatctgagagccaaagccaagattcaatgtaaaaatgagatccttaatttctgaataactgagtgctccattttccagctatgcctacctatacgtgaataagtattacgacctggaagcagcaaacgcttatagaaatggtaaaatcttactaaaggtaatttaaagttatagtgggacattccaaatgaacaacattgcactttaagaagtgcatttaaaaatgagggcttccacattccctttgaaaactggcacaagacagggatgccctctctcaccactcctgttcaacatagtgttggaagttctggccagggcaattaggcaggagaaggaaataaagggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaacgtacaaaaatcacaagcattcttatacactaacaatagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaccaatgcctttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaa

SEQ ID NO: 1379 - DNA, 20001 bp, Homo sapiens
gattctcctgcctcagccttcctagtagctgggattacagacatccgccaccatgactggctaattttttatatttttagtagagacagcatgttggccaggttggtctcgaactcttgacctcaagtgatcagcctgcctcgcctcccaaagtgctgggattacaggcgtgggccaccacacctggcccattttcattttatatgtaagaatcaccacatgtatgtgacgtatttattataaattatattgactttattgagcctcccagactcgttggtatttctcactggtcacccccaactcttaacttatagtgcccctttttattattttttgagacagggtctagctttatcacctagtctgggtgatcatggtggcgtgatcatggctcactgcagcctcaaactcctgggctcaagtgatcctctcacctcagcatcctaagtagctgggactagacacactccaccacatccaactaagtatttttgtagagagagtgctcactttgttgcccaggccattctttaactcctggcctcaagggatcctcccacctcgacctcccaaagtgttgggattacagatgtgaaccactgcccaaccacagtgccccctcttgtacttctcatatatcctgttttcagctttctgcctgcctctggggtagtatagagaaaggaaggtcatttaggagaggagaaactccaaaaagtggggagacatactttttttttttttttgagatggagtctcactctgttgcctaggctggagtgcagtggtgtgatctcagctcactgcaacctccacctcccgggttcaagcgattcttctgcctcagcctcccgagtagctgggactacaggtacatgccaccatgcccagctaatgtttgtatttttagtagagatgcggtttcaccctgttggccaggctggtctcgatctcctggcctcaagtgatctgcctgcctcagcctctcaaagtgttgggattacaggcatgagccaccgtgcctggttagttttctttctttacatatatatatatatattttttttttctttttttttctttttcctttttagtagagatggggtttcaccatgttgtcaaggctggtctcgaactcctgtgctgaaatgatccccctgcctcggcctcctacagtgataggattataggtgtgagccaccaggcccggcctttttttttttttttttttttaaatcagccttagccaaactgcacatcctaagcctcatacataatttctcggaccaggagtcttgtgaacttaagtgtgaggcaaaattatattttaaaaaatcgaaatgaaaaactcatgcccctgctctaatactactgaacttcagcactaatttgagaattttcttttctttctctaggaatataagacttacaaggagaactttctgaagcgcttccagcttaccaagttgcctccatatctaatcttttgtatcaagagattcactaagaacaacttctttgttgagaagaatccaactattgtcaatttccctattacgtaagtaacatcctgcctcacttctctcacggggagtgaacctggatttcttctcttgtatttttaccagtattaattttggactgtcttagttggggattacaaggaacagagcctacctacagtagataagagtttttattggaaggatacacttatttcagggaccacaaaagattgatgtttattgggatgcaatccctattttatcttctctcctgttgctagctggaaattatagtcttcctgcgtagagaagaagaaatgatgcaagtaggataagacaggtaggattctgcctggtttggaagatgtcctgagtagtgagggtctgcccatctatttgctggccatcacacctttttgcacactagagttgtactagatgcttttagtttgcttccttccaactcagaaaacttctgcaagatcctttttgggggtagactgttggttttcagttctcaagagacaaggtttttcatacttaagaagatgtttggctgggcgtggtggctcacgcctgtaatcccagcactttgggaggccaaggcagctggatcgcttgagctcaggagttcaagaccagcctaggcaacatggcaaaaccccatctctacaaaaaaatacaaaaaattagccagatgtggtggtgcacacctgcagtcctaggtacttgaggggctgaggcaggaggatggctagaaccttggagattgaggctgcagtgagctgagatggtgtcactgccctccagcctgggtctgggtgacagagtgtgactgtgctaaaaaaaaaaaaaaaaaaaaaagaaagaaagaaagaaaatagtgtcagttttaaattccatgtagtgtttaagaaagtagtatctaaaattaagaggcctgagttttaggctgtcttagtggtgggacctcagacccatagtttgcgtgttttctggatatgttctctcatagataaaatgagaggcttggagtagatgggcctgagccctaggggtttgtccaggtgtaacatcttattatagtattgccaggactcttagaatcatggagggtgaggagagagaacatttgcagttgagaattacaggggaatttctttttctctttttctacacttttctccactagcatcttgtttgtgactagaattaaatggggggacatggaggtttgttctctgcctccttgagtaggatgacagaggtgctttcttcgaaagtctgtgtgtcaaagttttatttcagcactagcctcttgtgaattgccagtcacctgtctgttcctggtaggtaggggcagtctggattccaagggcaactccagagggaggaagattgtgtatcaatggtacttcctgctcagttgccacagaaatttccttgccccattggtttcttttatgggcctagagtaggcccaatataaaagtttgtccttcagaaagcttacttcggagaagttgagaaaaagattgtttcttaactacgcagtcttttagagaacatcaaattgtgactaattctggaaacttgcactttaattattttatgtgctgtaattacttcgagtaatacaattctggatcatttcattgtccatacttcttgaaaaggatctttttcatacctgtcttctcctatgttttattcataacacatcctgtttttgtcggagagttatcagacttatggtgattaggcaccctctgcttatttggagatagagatttttgagggcaggtttaaagtttcactttcaggtaattagccattctcttaactggtctgttgctgtggttgggagatgagtatagtttgctcttttaggctgggcgcagtggctcacatctgtaatgtcatcactttgggaggccgaggtgggagaattgcttgagctcaggagtttgagacctgcctggacaacatagcaagaccttgtctctactaaaaaaaaaaaaaaaatgaatagtttgctccttttcctatttactaacacaaaatgattaaacgtagtatttctcttttgccgcatggacagttttggttcagtcatgaaatcttgagtataaagacttctccaaaccaggcacggtggctcacacctgtaatcccagccctttgggaggccaaggcgggcggatcacgaggtcaggagatcgagaccatcctggctaacacggtgaaaccccgtctctactaaaaattcaaaaaattagccaggcatggtggtgggcgcctgtagtcccagctactcgggaggctgagacaggagaatggcgtgaacccaggaagcagagcttgcagtgaattgagatagctagcgccattgcactccagtctgggcgacagagcgagactctgtctcaaaaaaaaaaaagacttcttcactgatactcattcagacaagtctagtcagcttttgttcaggctgaagagaaaataaaatgagaagtcagcctttagtagcaggaaggcaggttggctgactagagctcacatggactcaggactcatatctccttttttttttttttttggagatggagtctcgctctgttgcccaggctggagtgcggtggcgttatctcggctcactgcaaccttcgcctcctgggttcaagcaattctcctgcctcagcctccggaataggtgggactacaggtgcacgccgccacgcccagctaatttttttttttgtactttagtaaaggcagggtttcacgatgttacccaggctggtttcgaactcctgagctcaggcagtctgcccgcctcggcctcccaaagtgttgggattacaggcatgagccaccgcacctggcttccattttcttaacagtgaatatttattgcagtctgactgcatcatatatgggacactgtcagtctgtagaaacaaatagctgtcaccaatacatagaaagctacatataataattacaacaaagttgtatgtttgtttattaccacatggtttacattttaaactctgtaattttgaacagttaatatgttcacagtctaacttcaaagggagatatataactggacgtgaccaccattagctgtttcttgtgaactcttccagtgataacatggttttgtttcatgtaatgagtggtagcacatcagacaacttttatgatgcaatgtctttttttttattttaccttgtattgtgtaagtttttataaatatttgtagactccaaaatgatatatttttcctaaaattatgtatttaatcttaatattcttgttaactgtctatatattttcctttttaactatttgaaagttcttcttccttttgggggttttttgagacagggtctcactgtcgcccaggctggagtgcaatagtgtggtcctggctcactttagccgtaatctcctgggctcaagtgatcctctcacctcagcctcctgagtagctaggaccacatgcatgtaccaccatgcctggctaattttttttttgtaggggtctcactacattgcccaggctggccttgaactcctgggctcaagcagtcctcctaccttgacctctcaaagtgttgggattataggtatgagccactgcctgtcattcttttttttttttttaaatcatatgggaagctgtgtaaccctgtcattcattttggcatattttgtgaattccaacgcacctggaccttcttgactctgcaagcctacccagagaaagggtcctaaaatagggctgaacaattttgtggtccgtttgtgtaggacagtttccttaacctcacagcctttgtctgattattccggctttattttaaccattaacagaaatgtggatctgagagaatacttgtctgaagaagtacaagcagtacacaagaataccacctatgacctcattgccaacatcgtgcatgacggcaagccctccgagggctcctaccggatccacgtgcttcatcatgtgagtggctgctgaccgtctcatggcacagagtggcaaaaacaggtgtttctttggcatctcagagggcagctcccttcagtgtgtccttgcttggccttggctttgggactctgcaagtaatagtgctgtcagtagttagtttaaggcagtggttctcaattttggctacacattggactcaccttgggagctttttttttttttttttgagacagggtctcgctctgtagcccaggctggagtgcagtggcgtgatcttggctcactgcaacctccgcctcctgggttcaagcagttctctgcctcagcctcccgaatagctgggattatgggattacaggcgcccatcaccacgcccggctaatttttgtatttttagtagagacggggttttacgatcttggccaggccagtcttgaactcctgaccttgtgatccacccacctcggcctcccaaagtgttgggattacaggcgtgagccaccgcgccaaccgggagctttttaaaatcccaatgcctggcaccacaccaggccggttataatagtagttttcagctggggcagaggccagggatgttggtatatattttacaacacgaaggacagcccgtgttacaaagaattatctgaccctaaacatcagtcagcattaaggttaaaggctctctgttagattgtctggaggtggatgtcttttctgtttgatgtcttttctatttttcaagttaattgagatggggttgtgctatgatgctcatgctggtctcaagcaatcctcccgcctcagcttctgaaactgctgggattacaggtatgagccaccatgcctggctggcatttgatgttttgaagttccctgagagaccctgatatgcagccaaggttgagaacctctgccctagactagagccttaccatccaaagtgggatgcatccttggaccaataacatcagcatcagtcttgttagaaatcagcttgttagaaatgcagactctcagtcccctcaaacctaccacatcagaacctggattttaacgtgaccctctgatttgtaagaaattaaagtttgcgaagcactggtttagaggctccctttcatcttaaaaatgttgtggatttgtctcaagttgaaaacagataaaacatgtacttgagatatatttgatatcacatagattattagcataaattgttctcatttgattagcctcttctggaactgtgggtttaatcttaactagcttctgtttatcaagtgctttattgtggttaggcagtacgccagttacttaatgtacattaatctcatttctttcattaaaacacacctccaagacagatgtcagtatcatcttttttacagaggaggagacctaggctcagagtttcagtaattgacctcaagtcagtagaattaggatttgacccaggtactctgcttcaaagcccatgttcttaactcgtccttgaagcaggaatgggaacttacttatgtgatcctgagctttccttatgtttcctatattctcaactattgtaatatccagaggatctggaatatttatattctacaataatggtctttggtatttcttagaactttggttggataagacaggtgggcggccagaggtgcctctgccttaatctagaaacattttttccttgttcatggaagcatgaagtgagatacgttttgctgtatttgtagcactggtttcttaggccaaaggaatcaggttagtgtgatagacagtgtccaccaaggacaccttttcttgatgacctgttgcttttttttttttttttttttttaagacagagtctcaccctatcacccaggatggaatgcagtggcatgatcttggctcactgcaacctccacctcctgggttcaagtgattctcctgcctcagcctcccaagtagctgggacctacaggcacctgccaccaggcctggctaatttttgtatttttggtagagacggggttttactgtgttggccaggctggtctcaaactccttacctcaagtgatctgcccacctcggcctcccaaaatgctgggattacaggcgtaagcccctgtgcccagccaggaatgtccatatttaggttctctcagtggttgacactgtgtacctcataagtgagaatgtctagtctgtcatttctgagcaggaaggagacatcataggtgatgattagatggcttcctcttttctcatctttagtgtccactaaattccttttaaaaagatgtacagaagtgtttcagactccattgtacttcaaggggccaggcgcagtggctcatacccataatcctagcactttaggaggctgaggcgggaggatcttttgagaccaggagttagcctgggcaacacagtgggaccccattgctattaaaaaaaaaattagccagttttagtggcacacacctgtagttccagctacctgggaggctgaggggaggatcgcttgaatccagagggtcaaggctgcagtgagctgtgattacaccactgtagtccagcctgggtgacagagtgagaccctgtctcaaaaaaaaaaaaaaacaaaaaaacaacaaacaaaaaacagtgctttaaaaaaattcccaacaggaattgagtttgccatgattgacacaccaaaagtcctattaattgaatcatggccagaagaagtcatgtaccctcttctttatgactgttgctggatgatgtctagtggctgttcttctaatttttctagtcttggctatgatcctttccttctacacccttttggttttagagagcagactaacccagctcttcatactttctgcaggggacaggcaaatggtatgaattacaagacctccaggtgactgacatccttccccagatgatcacactgtcagaggcttacattcaggtgggttggccacaggcttagtgagccacaaataggtggcgtatggggccagtgagaggagtgggccaaggcaggaagagggatagagttaggaccttggttggagggccaggtacctattgggaagtacttagtagtgagttgggggcagaatgtatggccctgaaagtcaagcagagattttcagaaaagaagtataaggaagtgtagaaaatgtatgagtgagcaaagaaagttgcgattatggccaggttagttttgcagaagtgtgcggtctggtttcgaggaggaagaacctagactcatcagggaggctggctagaagtcgaccacgaagtgctccccagagccccaggcagctttgtgaccccacagcgctttctacttgacgtttgttttagtgccggccatatcgctttgcctgtctgtcctctccattggattgacccatggagcacagagcatctctgtcttctctttatgtaactgccctagtacctggcaaaagaaggaagattgagacaaaagccatagctttgtaagaagaaagtgatacctctccttctagagataacttttttctcctcagtggctgtagccactgtagcagatttccaaatggggtatagcagatttgtaaatggggtgacaagttgtccatggcctggcacagaataggtatttgataagtgtctgttgactgaatgcctcctagacttcagtttgtgttttcatttcttacagatttggaagaggcgagataatgatgaaaccaaccagcagggggcttgaaggaggcgtctagggctttgctcccaagggctgtggctgatgatggtaaataagaacacagaagctgtagctgaacacaggctggctggtgggcttcctaggccagcccagcttgtatgggttctggctacaccagagcaccaagagcccacttgcctgggatggccccacactgtcactcagctgttctttgatcatttttttctagattgatgctcctttctcccatgcattgagctcccatctagcttcagcagggcagaacccttctccagatgtgtgtaacttatgtcttgagtatctgggagtagttgaagaacagataattccttccaaacatcaagccttgggattcttggagcaagcagaaagccagtaacttcgctctgttagaggtggaggattttcctatggttccccccatttcctgatttgtatttttagatggattaaatagtctcctgtttttaaaccagcctcttgttttatatcttttcctttggtggttggctgaggaaaatattttcctttttaatcttcacaaactctctaccctacagtctgacatctggtgcacatcacgctcgccctttcctgtcagcttgtgggtggtgtgtcagttaggatgcatttgtttctaagtaaaaaaatacctgagtcaaggggatacattattattgtgcttaactagagggccagaggtgggcagtttccagctgcagtgcaggaatgagtaagggaagaggaaaaaaaggaaataggaagcgcttctcactacagtgcaattctgaggtggtctcagccagtccagtgtggagccccagggcaaagattccgtcagacaattcagcagaaatggctcccatcaagctcagtcgtgggctctagcagcctagaagaagggtggccttggcatgagcactgtggcaggtccaaagatatgggaagcagctggaggcagccagtcagccccagcaagttctgttgaatggagacaggagccccgcactcctgtggtgccaccctttacctggtcacaaccttgtcctcactttcctctacctctctggaagctccagtatttccttaggaggcttatctcttctatccagccattaaatttgggttttctcaagattcagtcctagcgtcactcttcttgctgtttactttttccctaggccatttcagctatgcatttttatggaaatgactcataaacacatcttaatcccagatttttctaaactcttgaacttcgctctgttgcccaggctggaatgcagtggcacaatcttggctcactgcaacctccacctcccagggtcaagtgatttccggctaatttttttattttattttattttatttattttattttattttttaattttaatttttattttagagatggagtcttgctctgtcgcccaggctagagtgcagtggcatgatctcagctcactgcaacctctgcctcctgggttcaagtgattctcctgcctcagcctcctgaatagctgggattataggcgaccaccaccgtgcccagctaatttttgtatttttagtagagacggggtttcatcatgttggccaggctggtctcgaactcctgacctcaagtgatccacccgcctcggcctcccaaagtgttgggattacaggcgtgagccatggtgcccagccctatttttgggtgttttaaagtaaactcaaacttaacattgtttagaactgagcttgccaggtgtggtggctcctgcctgtaatcctaacacttcgggaggctgaggtggaagaattgtttgtggccaggagttcaagaccagcctggccaacatagcaagaccctattagccgggcatggtggtgtgtgcctgtagttccacctatctgggaggctgaggcaggaaggtcctttgagcgcaggatttgaggctgcagtgaaccatgattgcaccactgcactccagcctgggcaacagagcaagaccttgtcattacaaaaaagaaaaaaaattgagcttgtgagtttccctttttttttttttgagatggagtctcactcttgtccaggctggagtgcagtggtgtgatctcagctcactgccgacctctgcctctcaggctcgagtgattctcctgccacagccttccgagtaggtgggactacaggtgtgcgccccacacccggctaatttttgtatttttagtagagatggggtttcaccatgttggtcaggctggtcttgaactcctgacctcaggtgatctgctgaccttggcctcccaaagtgttgggattacaggcatgagccactgtgccctgccatgagtttctctttcaaacttggctatttttgaggtgaagattacactatccagttagagaaattcatgtataataatctgttcagggaaagtttaatttcaataattattaactacaacgggtttgtagaaacgggattagttagtaacaagtaaagtaaagaatgtaggaataacagatacaaagagctgccactagttctggggctgacagtgtccaaagctgagatccagaccttgctaaaaatatgccctctgaacctcgttaaaaatctgctttgtagtgtactcaggaaagccattcacaggtgtctccctggaggcctctgctataaaactgtccagggaggagagtgccaggtggagctactgggtgcctgtgctgctcaaatgtatatgtggtctccaaaagccaagaaaaacctatcaaacattgtgcgtgcgtgcgtgcgtgtgtgtgtgtgtggtggtatgaggtacagccacctgtcttggagaggatattttgacataactctatactgttgacttccgagaaatgtctctgaggtggcaggcccctgaattgtttgtttgtttgtttgttttgtttttttctgagaacggagtctcgctctgtcgcccaggctggagtgcagtggtgcgatctcggctcactgcaagctccacctcccgggttcacgccattctcctgcctcagcctcctgagtagctgggactacaggcgcctgctaccacgcctggctatttttttgtatttttagtagagacgggggttcaccgtgttatccaggatggtctcaatctcctgacctcgtgatccgcccgccttggcctcccaaagtgctgggattacaggcgtgagccaccgtgcctggttccctgacttgtttttgggtttaactcccaacttcttatttatgtcttactaaggcatctaaagcgcttggtactttctgctcatcagatccaacagcatagtgtcatcactgtagtggactagtgtgatattttgtggattgtcaagatgatcaagatctctgtgaactgtattatgctagagagcagaactgacatagtcctgaggtaacactgtgaaggtatactgttggccctgccaggtaaaagcaaactacttctggtgatccttataaattggtatggagaaataccaatttgattctaacttggtagctccataccaagtgccaagagctgttgtgtatgagtaaagatgctacatctggccccaggcgtggtagcttacagatgtaatcccagcagtttgggaagccaaggcaggaggattgcttgagcccaggagttcaagaccagcctgggcaacaaagtgagaccccatccctcaaaaaaaaaaaattagccaggagtggtggcatgcacctgtggtcccagctacatgggaggcaggaggatcacttgagtcaaggctgcagtgagctgagtttgagctctgggtgacagagcaagacagtctcaaaaaaaaaaaaaaaaaaagatacatctgggacagcagcttcagctggagtcactctgattaagtttacgatagtccacggtcgttctccaagatccatcagacttctgtactggccctttgccactatcattttagtttaagctattgccagtttctgtttgcagtgctctcaataggtctctccacatttctttgcctcctacccccagtttatccatgctttagtcagagtaatcttttaaaacacaaacctgagtcatttctcccccatactctgatctcatgcttaaagacacttcactggctcttaggatagcaagtgaaatcctcagctgctagcctaatttatcaggaagtttctacttttttttttttttttttttttttttttttgagacagggtctggcactgtcgcccaggctggagtgtagtggcatgatcttggctcactgcaatctccgcctcctgggctcaagccatcctcccacctcagcctcctgagtagctgggcccacaggcttgcaccactacactgggctaattgttttgattttttttgtagtggtggtgtttcaccatgttgcccaggctggcctcaaacttctgagctcaagtgatctgcccgcctcggcctcctaaagtactgggattacaggcatgagccaccacgcctggcccctgcttgttcttgagcctaggctcgctgagcttcattctattgctcagatgtaccacatgacatgaggcctctgtactatctgcttcctctgtgagggatgctcgttctttcccttttaattctttctcctccatgacctctcatacccttaataccctgtgtatctctaattgatagcccttattgcacctgaaaaatttgttttttctgtgattctttgattaaggcctatttttccaactaaactctcaagttccaaaggatagatagaaacttttgtgcccagcccttgggaaatgcttggcacttagaagtcaatcacccatttatttatttatttatttttttgagacggacggagttttgctcttattgcccaggctggagtgcaatggcatgatctcagctcaccgcaacccctgcctcctgggttcaagcaattctgcctcagcttcctgggtagctgggattacaggcatgcgccaccacgtccggctaattttgtatttttagtagagacggggtttctccatgttggtcaggctggtcttgaactctagacctcaggtgttctgcccgcctcggcctcccaaagtgctgggattacaggcatgagccaccgtgcccggccaatcacccatattttttgagtaaatgctttagtacttagcctgtgttctctgtgttgtccttttgcacaaatgattttgtctctttatacccttccaagatggtgaaaataggaattatcacttaaaagtttagggactatttcttggagctgaccgtcatatcctgtgtgatcttgaggtcctttgtgggtgacacatggcttgcttccaccacggctgtctgggttgggggcctggcctgcatgtcttcaaagctgatcccagcatgcccttcctcttttggagacctcaaggtctggccagagtttgaaccacacatggggaagaagtgaaattcaattcatgttttcttagcatgaccccacagccagaaatcacgagaaaaagatagatgtggaaaaaatactccagatatatgatagagaaaaatttgcaatgtataggacagtaaataaatgaatatacctagtttatttttactcgtaaaacaataagaaaaagaaacctaaacagaaaattgggcaaaaaacccaagtaggcatttcacaaaagatgaaatataaatggccaataaacatgtgaaaaggtgtttatttggtaactaaagaaatgcaaattagaacgaccatgagacatcatttaaaaatattttggattagcagaaaaaaaaaaaaggaaccaaaccaaaccaaaacaaaacaaaacaaatattttggataggccagatgcagtggctcacacctgtaatcccagcactttgggaggccaagactggtggatcatctgaggtcaggagtttgaggccagcctggacaacatggtgaaaccccgtctctactaaaaatgcaaaaattagccaggcatggtagcacgttcctgtaatctcagctactccggaggctgaggcaagagaattgcttgaacctgggaggcagaggctgcagtgagccgagattgtgccactgccctccagcctgtatatataaatatatatatatatttttggattagcaaagtttgaaagattgttaataccccagtttggtgagagtggaaagaggcacttgttttcttttgggatagaagttggtacggctggcacagaggcccagattgataatccagcctctgttaaaagtaaaggtgtcccccaaatttcatgtcttggaattgattctaagaagacagacaaacaaagatgtaagtgcgaggatttttattttttgcaaatcgttgataatagttgcttaaaaaagaaagggccggccgtgcgcggtggctcacgcctgtaatcccagcactttgggaggctgaggcgggtggatcacgagttcaggagatcaagaccatcttggctaacacagtgaaaccccgtgtctagtaaaaatacaaaaaaaaaaaaaaaaaaaaattagctgggcgtggtggcgggctcctgtagtcccagctactcaggaggctgaggcaggagaatggcatgaacctgggatgcggagcttgcagtgagctgagatcacgccactgcaatccagcctggatgacagagtgagactcttgtctcaaaaaaaaaaaaaaaaaaaagtaagggccagccatggtatctgacgcctgtagtcccagcacttagggaggcagaggcaggaggattgcttaaaccccagagtgatcgcaccactgcactctagcctgggagacagagctgtcatgtggcaattagcaataatagtagatacttacatttattgacctgaaaaggttattgttaaatgaacagtgcaggttacaaagcagcatgtataggatgtttccattttgtagatctgctgtatctgtttttgtatatgtgcacagaaagctttggaattatagataataacatgttaataatgattatgtcgtggatttaaaatttcagttattcattagggggacataatgtaattatctttatttctctataactgaactcattttggctcatgagccctcaaaacatattatttccatttcggagtaactcattcccttcttaatactcagcctctcttggctgactaaccactgaatcctctttcccctttccctgggaatgatttacagattgccctgcggtgaggagaggcactggggactaagcattccctggccatccaggtctctctggagtgtctctcgtcttgcctgatcatcatcttcttgtgccatcactgctacacatctgatttctgctcatctcaagatccactaaatctgtcacagattcatccccaaccgtgggctcttacgggtgcaccatcttgtccagagccaattctgactgcctctcggtctgtgggttgaggttgctcttctgcaaccacatcacactgggaacactctgtgaggcagacctcaggccagctgcctagctccatccctcaggctagcgtcctcaccctttctgatgtcctgtgagaggcaggcttctcttagaagcccacaccctggaaagtgaagaataagtcccctcctcttgggctataatccctcctgggacttctcttcccccaacttcctaagggcagaggtgcaggatgttggacacttctcagggaccctaggagtctcaagtgtagccacttcctgccaattctgtcctcctaccagctagtcaactcttttttaaaattatttatttatttgtttttgaaataggatctctctgtgtcacccagggtggagtgcagtggcatcatcacggctcactgcagccttgacctggattcaggcgatcctcccacctcagcctcctgaatagctgggaccacagacacacaccaccatggccagctaatgtttgtatcttttttttttttcttttagacagagttttgctcttgttgcccaggctggagtgcagtggcgcaatcctggctcactgcagcctctgcctcctgggttcaagcaattctcctgtctcagccttccaagtagctgggataacaggcatgcactaccacatccagctaattttgtattttttttagtagatatgtggtttcaccatgttaggctggtctggaactcctaacctcaagtgatccacccacctcagcctccaaaagtgctaggattacaggtgtgagccaccatgcccagccaaatttttatattttttatagagatggtgttttgccacgttgcccagtctggtcttgaactcctgggctcaagtgattcactcacctcagcctcccaaagtctgccaattcttgacctccttttgaatgaagccgcctttttcattatcaggcactcattcccactcatatttttgggataaactattaatgcctccagttcttcaaacattggctcttcattgtctcaatcaaacttttttgtttttatttttttaaatttaaaacacccttttctctcagagagttggattttgtaatggaaacaatggctttaaggacagtagttagctatagatttacaaatgtctacttaaaatccaggagccaatgaattgtgtgtctcatccccaggcccaagagcaggctgcatagacagctctttctggcgcttgaacggtggaggtgtggagccagaggctgtggggagaagatggaaaaagccccaagctcagtgtcaaaacacacaccctgccgtagctctctcctgggctaggtgggattgtgggtgtcacatgcttccctgtgaagagactaccaaacaggctttgtgtgaacaataaagctttttaatcacctgggtgcaggtgggctgagtccaaaaagagtcagcaaagggtggtgggattatcattagttcttgtaggtttgggataggcggtggagttaggagcaattttttgtgggcagggggtggatcttacaaagcacattctcaatggcggagagaatattacaaaataccttcttaagggtgcgggggtgcgggcgtggggtgggtggggagaatattacaaagcaccttctcaagggtggggaaggtgtattgtcacaaggtcaattgatcagttagggtggggcaggaacaaatcacaatggtggaatgtcatcagttaaggcaggaactggctattttcacttcttttgtggatcttcagttgcttcaggccatctgggtgtatacgtgcagggcacaggggatatgatggcttagcttgggctcagaggcctgacagtgggtaatttccactctctttgtctgtagtttctgaatttcttacaagaaacatgtataagaaatatgacaaaagttattttataaataaagggacacttccaggcatttcagtctttaagaaaagctaaggcttgtttggctttttgtttatttttaggtttttggtgtcctcatgacctaacctcatcccagtgagtagagactgggaggggagagcagcagctggagggcaggctgggagcgcttgtgagggagaggagctatggacgtctgcttctctgccaagggagagagtgaggtaggcctgggcccgctgacttcagggtgaggccacagctactgcagcgctttttatttatttatttatttactgagatggagtcttgctctgtcacccaggctggagtgcagtggtgcaatctcggctcactgcaacctctgcctcctgggctgcagtgattctcctgcgttcaagtaattctcctgcctcggccttctgagtagttgggattacaggcatatgccaccacacttggctaattttttgtatttttagtagaaatggggtttcaccatgttggcgaggctggtctcgaactcctgacctcaaggatcctcctgcctcggcctcctaaggtgctgggattgcaggtgtgagccaccacgtctggccatactgcagcactttaaaggacggtgtctttttctttctcataaaagagaataggactttattagcattggtgcagacattgtattacacaggaatgggtccctagcttgcacaaccccagctgagctttcagcagataaatcacagcagaaatagaatcaccctaggactttcaatcaaaagctggaagtccaccttacagaaagacaaaaagaaacccctttttatatcttaacaaagcaatagctctcaagcagcagagcatctcgaggaagaaagcttgcccggtcgccatcccatcatgccagagcgtgcagtgtccacccttgactacgctggggaattgctgattttttgaaaaagcttaacttaacaatttctgatgtctatcttttagagttctgtatgttcccattttttattcttctgaattttgaattgcaagtagctgtaaaatccaatctttgagtgcatgggggtgggtgtgaggcggggctcagcttcaaccccctgtcctgtaaagcagtggctggtttttcctgagcccagccctgggaggtcgtggtaggtgtggaggctgcagagctcctccagatgctgccctcgctgtgcctcacaccagagaggatggaagtgggctctggtgtcagactgtggttgagctgagacagacaaggccgacacagggctgggggcccgtggtccaccagtggaagtgactgccgaggaagggcgg

SEQ ID NO: 1380 - DNA, 53550 bp, Homo sapiens
gtctgccatatctatttcctttagcaaaccatgtaaagtagagctatctccaatttatgagttaaaaacttgaacaaccttaccatgattaggcaaacttgctcaaggttaacaagtcattgataaactcagtatgactgaggtaaaagcttttatttcaggttggagcaatagctaacctttctattcttttgttttattttgtttttaagatggagtttcattctgtcacccagtggcatgatcacaactcactgctacctccaccctccaggctcaagtgatcctcccacctcagcctcccaagtagctgggaccgtagatacatgtcaccatgcccagctaaatttttgtatttttgttagagatggggtttcaccatgtagcccgggctggtctcaaactcctgagctcaagtgatccgcctgccttggcctcccaaagtgctgggattgcaagcataagctatcgtgcccagcctacctttctattcttctttctttttcttgaaaaaaaaaaataataatctctaaagtttaaaaggtttagaaaattatcctaagtcagttgaagcaaagttagagaagaacccagtaagatatcataacatttctttaacggactcaaatcttcaagtgaaatccatccaggagtatgagagtgctgcatgtggcatacagaatctctgtcaccagtctttgggaaattttataaataattaaagaggttcctacataccaggaaagataaaaagtctccacattttcaaggagaaaaaaatatgggttagagcaaccagtgaattaaagaaattcctggaacaattttagatttggttattaaacagaaggtttatgaattcttagaaaaacaagtagtagtattttatctatcagttagtttacaggaatcagaaagttagaaggcccatcttgcagaaagaaaacgctggtgtgtgctccataattaaaaagaacagacaaccatatccttgatcctaatgttgactattcaaaattcagtctcaggagagaagctctgattggccaagcctatacccaagctgtgcttttgttctatcagggcagataaagagtggttctggattcttgggccatcatggtctgaggaaggaagctgggtttgcctgtctgccaagcctacagaagtagagggttacagttcattctctaaaaggaaatcagtgtgcattttggaaagaaaacaggattctagaccacaaaaatattggcaattgtcctcaacaattgaaaaataggttggattcatgacatacttgcctctttcatttttaaaaagtgtttttggacaagtagatgccatgtatgtgattcattcatcaaggtccttagaagagtttctcatgatacccttgcaaaaagatagaaaaatggaagctggcaggtggtatatgttcatggctggtagaatattaaaaccattattgaatctcagtgaggattgctctctggaccaagagtgctataatcttttccagttcaacattataataatcacttgagtgagaaaaataaaagagttaagactcttgtagttgcaagtgacagaaattcaaccagaaaatttctgaagtgaggctgcaagcacagcttggattatgaaacttgaccaatgtgataaaaatgttgtccttttctcactgtctcttggctctgcttcctctctgttgcctttatgctataaaaccatctccatatggtgttaaggatggctccatgactctattcttacattccatcaggttggcaacttcagacaaggaaagttttcccagcagaagccctgagatgactcttattgtctgaattggtatatgtgttcaatcttgaatcaattaccagagtccaagttgatgaagtgttccgattagtcaagccaaaatcacatacccacccatggagccagggggctaagtaagctcccctcaaaccacctggataaagagaagagaagacatagtactaaaaaaaattgaggttttcttacaaaaaaaggggattttgaatagacaaaaataatgaacatcttttaaaacatgattattcagtttagaggtggcacaaaactgagagatgtagctattaataatattgacaggaagaaggttcaaaagatttcaataagctactggagtgggcttaaactaacacaattaaatttaatcagaatagaaggaaagtttaacattgacatcaaaatctcagttacataagtaatgttggggctattacttcaatgccaaagcatgaaagttttagttgtctacaaattcaattatttattaaccacctaaaaagctaatgtaattctctgctgttttacaagagctatactgcctcagtgatcattgtcccactgtattatgcactgcttgaatatttctgggtgtctattttcaatgctagtcattgacaataaccatataaccagaggaagatgcccacaagaacagacaatttattgccaagcaagttatataatatatctaaagtcaaatagaaacaatattttttccataattcacatcctgtttattatagataaaagttgactatatcatatccagagtgtatatacagcatccagaggtcaacctagtttcttcttagacacttggtataagcaaaaagtaagtaagccttggctaagcctttattgcccaggggcaaagtaatctttaaatatatgctctaggaaacacacatatcaaatagggaatcctttgtgcttgatgtaaaagaaacaacattaaaatgtctttttaacatagacacacataatatgtatatatatggataagtatggctatggatatatacaaatacatacaaactcaaacacaaatacaaacaaatccatacatcagtgtatttgtttcacatgactgttaggaaagtatttctgcataagaacaactagcacaaagtcctgaaactgttctaaaccatggggaaggactgcgctatcttaaatgttgtctttttgaaactttctttagtgacacattaacctctgtgttgttgaccacagcacagaccagttttcctcacttcctgttatcttgttctcatttgatagtgaggctcagagggtgtctgaggggagggaacattttggtacaaaggcagttggcaaacaggaaaagcagcccccttgctggttacaggttaataacgacagcagggagaggagttccttagaattcccttgagccggtcagcttcccttgaggtcaaaaagtcctagggcagctttaatctgctgtataaaggcaaggaaaagtcacttctggtttaccgtaaaacaaaaagagctccttattggatcagaagctgcagaaatgcttatagtcaagtgggttctgttggttgtggagagctgatgaggttagtttgttagaacacactttgtgaaccataaaatctacagaagtaatttatagttgtttgccaaagggatttttctaggcagcttctatatactacatactcttttaagtacttaagttaaattttaattttaacaacattagttgaaatcacggtggttaagtctaaaacatattgctttctttcttatctttttaaataaaatatatttgaccaaacagtctttcttatacaacctaatgggatcatttatgaacatcaggttttgaaatatggtccaatatatactaattgccatttattgaaaacctgttgtgtgccaggtattgtgctaagccctatgcaaaaaacttagatgatttaatctgcaaaacaacctgccaagtcagtgttatgcccatttacttattttacatataattaaaccatggtctagaaagcttaactcacatgaagttaaacaaccagtaaatagtgcccatagaagtagaatctagttgtgccaaaatgcaaaatccaagcttaaaatcaccagtgtgtaccttacagtagtgctctcagaagagtgttgtgttggcaaatgtttagtaaacagctctccagaaaaagtgtatgtatacacacacactacacacacatatatgtgtgggtgtggtatatatactttgtaataaagtatatatatgttttattataaattttactgatataaaaggaattaacaagttagaataactaaaatacataatttggtattataattattataaattccatatcatcagttgaatatcacagaatacacttgataatttttgcctaattcttttattgcagacagctacaatagaaacttttagaaggaaacataggagaaaatctttttaatttggagcaaaatggacatttccgcaaagcattcttagacgtgagaccaaaagcatgactcataaaagaaaaaataaattggactttattaaaattgaatttttctttttgcttcaagagacaccattaagaaattgaaaagataagccatggattgtgaaaattatgtgcaaatcatatattggacagaggacttgcacccagaatatacatagaactctcaaagctcaatattaagaaaacaaacacacacttaataaaaactgaacagatttgaacttatatctcctttgagccaaaagggataatagagatggtaaatgtgcacatgaaaagttgtttgacaccattaaccattaaaaatacaaattaaagctgtgataaaataccactacacacctattagatggctaaaataaacagtactgacaatatcaagtgtgacaaggatgtagaaaagctggaactctcacacattgctaatggaaatgcgaagtgacacagcagctctggaaaatagtgtggcactttcttatatcattaaacatacacttatcaatgactcagccgtctcactcctaggtatttaccctagagaaatgaagacttttatgttcatgccaaactctgcatgtgaatacttaaagcagctttatttataattgccaaaagctgtaaacagcccagagatacttcagcaggtgataaagaaactgtggtacatccatacaatggaatactactcagggatgaaaagaaatgaactattgtacctgaaacaacttgaatgtatcttaaaggcattctgttgaatgaaaaaaagtcagtctcaaatattacacattatataatactatttatataaaattctcataaagagaagactataattctcatgaagagaagactataaggatagagaacagattagaggctgccagagattaggtgtagttggaaagtatgactacaaagaggtagcatgagaaactttttcgaggtgatggaacttttctgaatcttgattgtggtgttggttatattaatctatatatgtattaaaactcatattactatataccaaaagaaaaaaagtaaaagtcaattttactgcatgataatttttaaaattgaattgaatttaaaaagttaaaatttataaaaatttttaaaaagtcaatacataataattctgtgaggttttttttttttttttttggtctcaattacctctaattaggttactttggtagtctgtgatttctaatgaacttatcaagaataagtatccactttgcttatgtcctttaccatttcgggcaaaatcacaacttaattcgctccactgtacatgaccttctcaagtatgggagagtgtgttttggttcagtaccaagcacttcaacaatttgcagggctccttagtaccctataccattcatgaaattcttaccgtttgcaattctattcttacaacctctgaaactggtcttaccatctgaccatctcttttcctctgctgttgactatatatagctccaaattatctcactaagtcctatatagcccctttggaccatctgagatagcaagagaaggcttaaagcctacagagggcgctccaggctatgtggtctccagaagtagaagcccctctgaaacatctgttagatgtggtgtcagtggccaggtgatgggacttaccggacagaatgtctgtgtctctactgtttcactccgattagtaagaggttcagagatgataattcattacgctgcttcataatgttcttcttaacattagtgaggatatacaggagagattgttatccatacatattttgcaaggtgaattataaatacttaaatacaacagcttactttaaggcaagaaattcccaatagaatatccactagcataaattctggtttcttggctgtcctgcatttctcttcaaatggttttgaggacacctctatttctgaggctactcctagtggtttccctgtagaaaaaagcaacctggagaattctgtattttaaaacacaaattgtaggcagtttagccataagagtgtaatcactgataagatactttataatacttcagtgaacatcagtgtggtgccaccagagttgggggaagaaatttctcctagacccagctacatctggtgtcccacaatcctcgctgggatgaagcacacctgataccttcccaggggtagttttagccatgcttgctgaagggcacactggaaagacctaacattgactcaaaacagtatctttatcttattcagcaagggtcgcctgtaatatccagtacttacagctgatgctgggaacttctgtctcctctgtcaggcattcttatatattttaaacctgaagctggtgtaatcaccaatcatttttagtgtttctgtgttccacacacattctaatcttgaaattctcaacaccaccataattagtaccacattcagactatgagactgggataaactggcgttatttcagatatctcttaaattgctctctaaccaacaagactcttagaacgtttcccaaaaggtagaaaagccctttgtgcttagcccacaacccagatatgggaaggaaactacttactcctagctaatagctctatcctccacctctcatcccattctacgggcagttggggaatctgcaaagtccatgctttgaacactgaattaccagctctatccctcctcctatttccaccctcactgctcccaattggttgggttggatccagcctggaacttcaaaccttttccccaaaagctcatgatccatcttttctcaagccagagaaggatcgtttgcatgggtgaagttctccaatggccttaattcttagtgctcacaatagtgaaaggaacttgggtgctcttgttaagggaagattctgagcttatcttggagtttcccctagtcttcttgcagatgaagctgataggtttctgttacctaccatcttttattgggctcacaccacaagatgcctagtttttttattatttctgcatttgatcatgcagcctggtcatttgagactccctacaacacttgcttgcttttctcccaactttctatcttccatttttctctccatccctccattcccagagctttacacaaaaaagtgtttcatatcattgtagactggaagtttcttcatcttctctctgctaggtggtcaagactttatgatgagtttacatgaggtttttttcatcggctagggatttgttctgctattggaagtcagtcaagcagaaatctgtgctaagcaagacagagtggacatgagagatattctctttttgaacaggtaagatttgaaaccttaaaaatctaacctgctgagcagtatagagccacagctacctaagtgctctaaaccttgaacttctaccatgcacttactaatgaaatagagaagtagtaataaaaattgattttaatccttttaattctcagatataggaagagaaaaccctcatattataaaattttctgataacttcttgttttgatgctttctggcttggaggactgaaggaagaaaattagccatatagtcaacttcagggaaaatgtataaacctagctttttggatctgaggtcaagaactgtagttgcctgttactactttacttggcttaattctctctggcctttgtaacatctaaatagtgttactgtatcagtcaaagtcaaactagggataagaaaccacttgagtatttgaaacagaaaaaatacaatacaagaaattagttactcagatgatggaagctctggaagccacacaaggtacaagaggcaacccgggaattagcaaaggttagaatcctctaccacctcctggctggaaggacagaggaaagaggtggttttactggtgcttaaggacggggatcacatggtgaaagatagaaccactgcgagaaagagctgaaaccaacaagaaaatgcagccatggcaggggtgctgcccaaaatggagaaggggtaaaagtgggggagaaatactattatttttttccttcctctcactctctggtctcttagtagtggctcccatgggccaaacccatccagaagcaagataatgtgagatgctggaaaattcatcctgatgggatcaacctccttcttccacaataaagagcagatgatggaaaggataaatggagaatctgtgggaaagatggcctaggactagcctggctagtggagacacatcacaaatgaagagatggttggacctgattttaggacttctccttcctgtaatggacaatttgtaatcaggttgggaagcgctctgccacctgcaggagctaaagtagcagccatgggaaggacataagcagtttgggagagcttcgtaacagtgacttcaaattctcagccttctctcatgaaccacctcaaggcaatgactctctaagctgatgtagttctgttgtgttcctgtgtttgagacagtctattctcacatttccctagtgtgttctgagtcacagttcattttattccctgcctgcatcacttgcttttacactccttacaaaatcatatacttctggtacccaatggtgtctagcataggttgcctattgtaaggtgtctttccctcttcccagtgtaggagccagaatcttttgttcctctcacaagcccatctgccactttacccagtgatctttgatgcctttcctagtactgtctaactctctttaaaaatacagaaacagttactgtggaattctatgcgatcctccatggcctccttcttccaataactccgaatggaaattcctgtgggggaatagcccaataaacacaattatccagcagaagaagggctttctggttggatcagtcaaagttcactcaggagcacagaggtcattccaggtactcaggtagaaggaatttaatatggggaactagatacagtggtgttgaaggtagtaaaaaaccaaaggccaataaggcaacagcttgaattcactactactgctagtaggacaagagggataaagggaataattggagtaattagaacccaagaatcagagccatccataggagctcattaatagcagaggtttcctgttgggatcaggaaccaagctggagacacagcccctgccagagcccatgcctgaaacacagaggaaaaggaataaaaacctggcttcttccttctgtctgtcctccaatctctccagtggttttcgttgactaaaccaagccagaagccacttggcaagagagtccaggaaatggagcttgcaaaggaagggcaggggaaggatttaagagcaaaccaacaaataacccagcacactggttgcaatatttgttctcaagtcttacacttttcggtagttctgagatttctgctgtctgctgccaaaactttttggctcctgaggggtccactcttgacaccccagcatcttcctgctagtggtttaaaagacatgcagatgcagaatgtcatgggcctgggtctagcctattggtctgggttttttttaattcaacgttaagccacaatttagtaatccactgtgacctctaccctccatcccctactcctaattgccactcctcacccaactatgaagatctattcacagccataatgtgggagggcatattggtggaacgctcatttgctaacagagcatgtgtgcaattgtttatgaagatttgtacattattgatatatctttcacttttagtcactgggtccaccaaggtacttctatagctggtagcttactctttcttctaccactctccttcatcataccaatattttttcctttgtttaccttcatggggtcttttatgcttccttgccagttctaaagcatgtgtgaagagcagatacatctatgtaaatggtttatatttactgtgaaaacttatgaaatatttatgaattattaatgtcgtttctagggccacaataaatctctctttttctctctctctctgtgtgtgtagtgtgtgtgtctttctctctctctgaagtgtaacccttcaatatggtataactttctcagactgattctgctactcactcaggagggaatgttaaattctacttattttgcttcagtttgtaaactttctagtgttctcttttttcaaactggattgttagattatctgagggtacccactccctttgttcagagcacagcatttggtgggctgtaaaacagaagagctccttcagacttgtttgacaaatgagaggaaaggggcaatggtggcaggagcttgtacagataaaaaggctcttcaccttgggccaaaaggtgctacttggcaccacctccacttcctgcttttgctcaggaaagaaatctgacaaagcaggagacagtccttgccttgccttcctcactcacaacccccttttttgagaactgccatcttgttctcaagatgggccatatactagtctctatttctatttctccagctcttgtccatgccacccagacaactatgatggcctctccttagttattaccctgtagattagttttgcattattggataaatggaatcctatagttttcgtttggaataatttagtcttcggaatctcttacttaacatgatgcttgtggaattcaccatgtagttgcatacagcaatattttatttattcttttgctgaatattattccattacttttgccagtttgaatggatttctttcttacagtcaagtaggccatgactaagggagataatgaagcatggaattgtcttttccagagaaaccacaggcatggaataagaattccctgaggaggccttttctgtcctttcttcatcaagctgcgacattattttcatattcagagaacttcagagcaacaccgagtttcgctgagtgggttcagagttccatatggcagctgtctcagttcctggcacgaggccaaaggatgacagttcttatcttctttcatgttcttttgcccaaccttagggaatatttctttaccctgtgattgctcatatctgaaaatcttactcacactctacaatcttccatcagcccaatgccatgtggtgttaaccctttgcatgctgcagtgttgagctgcaaacctgcccttttcttgcagtaatccaaagtgcccgtaaagtcttgaggcagacaatgttattttgtcatgtatgttcatataatatcagcaaatcattcattgtgtctttgtctatcttccagacatggtggttgctttgtagaatcaaaatttctgttatcttttttcataattagttaataaattcaagttgagctaaggagccaggtgaagccactgtgatttgggcaaggttcccatcgatagacatgtgctttcagacacaagatgtgctttcagacatacaattctgtttggccagagtagaatagaatgggtggtgcacactttcattatgtaagtacaccctgtttttcccattggtaataatatcttaaggagcgcaaggaaattcaggaaggaacatttcataatgtcaagaatacctactaagtaaattattctttagaataaatctgagagatggattgtcataccaaagccaatagaaactgaagcatgataatgtcaatgcatattttccctgatatactgtagatccgtagttttaaaagcctgcttttttattttgctagctgaatctcttttatcttgctgccactcttctcatgggatgcctcaaaatcctacagactcttgcctggcaatggggaaaaatgagggtgtttaccactaagaaagccaattaaagaagtaactgatggattatccagcccatagaccaaacaaaatggacgttacttcatgtcttcaaatatctaggcactggaatcagaaaatgaactcccaatcagacttccctgcttttcctgcagggaaaatgagatgcaaagcagagtcagagaaaaatagcaaatggccatttgtctgctgggagataaaaatcttactcagaggtcaagtcacattcaaactggttgatcccatggagactgactctgtcctgtgggacatttcttctctcctcctgtctctacctttcttttctctgtctctcccacccttcctctttttatttgcccccactcagggtgcagatacaggttttgtaaggctgaagtttaaatgacagtcaggggccagaggaagaggaagatattattataagtagcaatgaagtaaacatttatctaaaattaaaaaaaaataaatcaccagaaattgcaaatgtttaaatgttgaaagtccttcaacattattcaataccaaaaaagttacaccatgttttttaatgagctgctttatactttttcctacacgtttggctgtattccctttgattgccttttgatatgacaatggattttatatataatctttaatagaaaacagaaagataatttagtttttgggctagcatggttgatcaaaatctattttttattggctgaaatgcgtaaaatgcaaaaacccacctcatacacaagcgcacccatttttcttttagtttttagtactgcaacaagaacatgccctacaaacacagaaattgtgatatgttttgtttcacttgtttcccataaaaactgtacggtgcatttatgattgtatatgttgggaaattctgtgtattctgatagcagagaacttgcattttgacaagaactgaatgctccacttataacttcacaaactgtagactagcttcagagtcctaccttcgagccttgtttcttgtccaccacttgtacagctgccatgtcaagtaccacaggccttattcatgccctgatacaaggtggacattgcaccttcttgtcaagacactggatgagtttacacagcaggcaacaggagtatttctggaagccattactacactacagtggaaaacgataacattacacattatacatgtgactatgaaccgcttaactgtttccactaaataataagtaaatgcatctctaattcaactttcccttctatatatcatcccccaaacactcacccccattcaacaacacctaacacaaagggaattgtggtggagcagaagttaaagtggaaacagacagctgtcttaattgattatgatgcaattttttttttctgaaaatgtttcaaaatcaaaagatgataggaattatttttgaagtctgtcccagggtgtgggagggtctgtaggaactaggtccctgacatttgaacttcctggcaaagcttccttccttaatgctggcaatggccaacttagtgtctggtcttctgctttcccaacccagaaatgtgaagcttctggttgctgaggaggtcctagccctcaggtggaacggtgccatgtgtcctggagcccagatactgcctgggcagagaggtctgatcacacacagagatgggtgttggcctaggctttccagatgaaaacagtgtgactgatggctactgaggtggggctttggaaactgggtcctttcagcccatggatgaagcctgagatgtcatgcccagtgtttgaagcttacagacccagctcaattgactaataagaagcctgctttgtgcatttaactcttcggtgtttcctccctccctccctcactcccttcctctctccctccctcccttcctctctccctccctcccttcctctctccctccctccattcctctctccctccctcccttccttcctctctccctccctcccttcctctctccctccctcccttccttcctctatccctcccttgccccttctttctttcctttacttccttccttccttccttccttccttccttccttccttctttccttccttctttctttcatttaatcatcctgataggacactgaactaaaagcttgaaccctgggtttctgttctgatctaccactcatagctgtgtgtccttgaacaatcccttcatgcttctgaacctcactttcattatctataaagaaagcaagtgaacttgacagtctcttggtttcctgccctcagtaacatctgatttttctaggtctgattagtatgccaaatcacatgtgatgttgaaatgtgtgaggttatgttctcaccactaagtcattcccactgaatctttataaatgtaagctaaatattaagtaagtagtgtgaacccaggattacacagttgcttcacatggatatctcaggtaattccccaacaactaatgttttcagaaaaaatgtatctgtcacttgagatgtcccgggtactgtgaagagctcttgcaacaaagcccacatcatgtaagtaagtcctcatgaccaccttaatagttgtgtgatattattgtattccttattttagagaagaggaaactgaggcacaggaagtttgagtactagagtgtcaaagtcatacagctagtaagtgtcacggtcatcacctccaattatctctaagccacagatgacagcaattaaatgatttacccaggattattcaccctagatggcagagatagaaatagaatttcattgcctctagataatgggacagtataagaaaactccactcacttgaagttctttccaattgacaaatgtagttggcaatttattaccccagagaaatactttttccccttgcttttagatgtatctgttgttaaaaggggggaacaaaagtatcaattttgtataaagagttcggaaataatttgagttttacagggtgtcacttaatctttgaatctggttttattcggtaatattttgaaaactactcaggccaaaaaatccggataaaactactgtcctggcaccaaaaatggaagaaatggtaactgctgttccctgcatcctaggcatttccctgggcttacatagaatttattccaatgttccaccaggtggtgctctggtgaagacatggttctcaggctctccaaccccttgacgttatgcttggaaatattttgagtagattaagtcatttctcctaagaaagaggctgcccagtaaaaggaatatgattgcccattttgccaataagacacaacgtgcacacagagaaaagtccaacgggaatcctcagataaaggacaatcgtccctgaaaaagtcagtcccaaaacatctaagaaggtattagaacagtggtcttggctgagtcttatgggactagaatcaggaatttggagcttgcgtttctgctactaatctatgagtcatttggagaacctcattcttctctggactgcagtgtcctcacctataaaatgtgtataagtgtactggggtggtggggagggggttagactgtatcagccttcttctacagggggctcataagcccaatcaatggtatttgtagtccaacctcctgaagctgtgaaaaaaactttgtgtgtacacatatttttctgggaagaaggtccattgctttggacagatctaatcagaagccaggagtcctaaaatgttaacatctggatcagatcatttctaaggtcctctccaagcttcagtattctatgatgttataatctttctgggaaggaacttgtggctgtcaaattaattggatatccctagctatgttctagccgcatcctttcttatgtactctctaatgattttgttaaggcagtcacacctaagttaacagagtcctgcaacaccctctctactagattaggtggcacatcatgtgactgatgtggttcattagggagccaagagagaccagaggagctgtgagagcaactggccagatcccacaggagctcagtggtggaagcaggtgctaattaccatcctttggaggaacaggatatgcattttttgggagtgggtaagaatttctggttagacaagctccaaattctttggcctactttgaaggcactgcctgttccattggctaggatgagattttgtttcctgatgagcaccagctcagccaggaaggaaggctcagaaaaggaggtgtggatattctttgtggaggaattgtcatgcaaataaaggctccttcccaacccaaggtgtaactgtgagggagtgtcagggtcccacctttctggctcaggaaaaacatatctcttacttttttacaggagtaggtttggtagctgagtaatgtaattatatagattatagattaccaacaaacactgagatttcaacctgttctggatatatattatttgtgaggggaggggcttggagaaaaagagcaggaatattggttgggatgtagccaatgggagaaccccattattaaacagagagtgcagtccaagcattgcacccacaagaggaattcaatgtagggagatattgggagtagagatcagtgcttgggagagaggagctgggaaagaaagcaattcctccaaaggctctaagtcagcgtgttgtccagaacggaaattgagtataggaagagagattctttcttggactttggaatatctagtctggttccttttcagaatgatcagaccaccttccttacctattgcctgggccaatggttctcagccctggctctgcattaaaaccaccttttaaaaatttggcaatctctgggccaggtgcggtggctcaaacctgtaatcccagcactttggaaggccaaggcaggtggatcacttgaggtcaggagttcgagaccaccctggccaacatggcaaaaccctgtctctactaaaaatacaaaaattagccgggtgtggtggcatgtgcctgtaattccagttattgaggaggctgaggcaggagaattgcttgaacctgggaggcagaggttgcagtgagccgagatcatgccactgcactccggcctgggtaacagagcaagactctgtctcaaaaacaaaaaacaaaaacaaaaaacttaatgatgtcttggtttcatgctaaatcagtaagtcagaatatctgaggttagagcctagcattgctactaaaaaagttatttccttgtgactttaatatgctgccaaggttgagaaccactggcctacaccaatgatggaaaacatggaacatgcatgctgataaccccctcccaagttcatggaatgtgtttgtttagtaattacaacattctttgtgcactacagaacttgtgcacaatgcctggaacatagcagttgctcaataaacatttattaaatctagtgatctttggggcaagatggggtggtgatatctttcacttcagcacccattttaatttattccttttcattaaaaggacagtgaaaaatcatctttttttttttttttttagacagattttcacttttgtcactcaggctagagtgcaatggcacgatcttggctcactgcaacctccgcctcctggttcaagtgattatcctgctcagcctcccgagtagctgggattacaggcacctgccaccatgcctggctaatttttatattttcagtagagacggggtttcaccatattggccaggctggtctcgaactcctgacctcaggtgatacacccactttggcctcccaaagtgctggaattacaggtgtgagccaccacgccccaccatcctttctatttacaattctccttctatttgaagtatgcttcctcttttgttgttgttgttgttcttttctctcattactttcttcctctcctttcttggaaagatacatactaattccaagaagttagggtggaagtaaacaacatggaaggaagaagaagaacagcactatcgtagtttccttgattattggtctcaggtgatgccttggggagcacaaatcccaccccaaccccaaagagaaggagctctgtcatggatctcaagaaaaccaggccaacccaatgaggcccccttggcccaaggaggtggcaacactttcagagggatgaataaaggagatggaaataaaactgggacatgaaaaagcctttttcaaaaagaagctctcttttgttcccgcaccatgttgtcatcagtaagcaggcttgcttatggaatgccacgatggatccagataaagaaaacagcctgtgaagcaggacaggtttaccccagatttcaggggagaggggtattcctcatcccatgaggatggtcagtctagagggttaagaacagtgtgtggaggaaaaagaaagaataaattccttagggtatttttatcataagccttcagttaaaggaaaaggaaatattaaaacttatgcaagggccagttccactctccagggtctcagagctgttcctagaaatagtgtgcatttttccttggctacataggtgcttcaagacattttcttttcatacaattatcacagtttattagcatgtatttgtgtattgcctactttattattccattctcacactgctaatgaagacatacccaagactgggtaatttataaagaaagaggtttaatgggctcacagttccacatggctggggaggccttacaattgtggcaggaggtgaaggaggagcaaaggcacatcttacatggcagcaggcaagagggcatgtgcaggctaactgccctttataaaaccatcagatctcatgagacttattgactatcatgagaacagcatggaaaagacctgcccccatgatgtagttacctcccatcaggtcctccccaccccacaacacatggggattatagggctacaattcaagatgagatttgggtgaggatacagccaaaccatatcacctaccttactcattagtctcttggttcaatactgaatccccagtaccttgaatattagcacgtacaggtcactcaaaactgtgtgttcggtgaatgaataaattgcacaaaaattcccacagcatttattgtccaaagaggcagagaatgattggcagtaatttattattatcctatttatttatatttttatttgttaaatcagtcctttgttaaggcgatttttctaatttgattaaaaaatttatagcctatgtgtgatgtgaggagagacataaaagactgggtgtgtcctatgaagcctctcagagctcatagtctagaaggagagataatcaatgaggcaatattgaaagcatcacttaggtctcagggtactctggggccacacagaaacatgccttcccagacaggcacagcttccaagaggatatttgggaagaaaactatggcaaacaatgaaaaccaagggaagggtcagctgtagggaggagaatgcttccttcctgtttgggaatgggtacagaatggatcagaggggtgagcaaaagttggggggattagttaggcaactggtgcaataaatcaggagaaatggatgaagacctaagatcaggcagtatgtggaaattgtaagaagggatggataaaatgtgaaggaaatagggttgagggcatttgtggggtgatggaaactaggagcagaggagagactaaaaaggagcatttgcagtagtgagaaaaccaggcaaagaggagttgaggagttaggaaactaaaccagcgtactaaacagaaggagtggtccgaagtgtcaaacgctgttgattgtggcagaataaacagcagtggtgaaatgaagacaggaggtaggttataggtgagagaggagtgaagtgctaatgtctctttctgtaatagatgctctacctagaaaaaaaaaaagagagagagagagaggtgggatggtagctagagggagatgtaggaccaagctaaaacttctaaaatggaaggaaattttcagttgtgtaggcgagaggaaggatccagtgaaaagggagaaaaaagaggaattgggatatgtgttttacccttttgctatggattccacctttaaacacttttgttatcatcttcaatgacttccttctgacgcattgttagactctcctgctgaagcaagtgctcaatcatactgcaagcctcagacagcatctaatcaaacctgatcattcccacttagctggcttctgatagttgggttactttatctcttggctcagagattcctaatttgctgttcacagatcctcatggggtccacatataaaattgtaccttaccataattcatttcataatctatgtattgtttcatgcttttgaaaggatatattggcttccccagtctgccaaagaagtccatgacacaaagatacccccaaacccttcatcgatatactctaagttacagctatgacaagctctgtatttagaaactaacaactttctcctgtttcctgtggatcacccacttaccttctctgttccagatcaatgaatcagggaaattaatagactggaaatgtcttctaccaattattcccaaagatacgtaataatcacctcgagaaatagacaaaagaatagattccaaaatcccatattacaaaatcccattctgaaaaaccctgaatttagtacatttaaaaaggaaaccaagaatctgcctttttaaaacaagctccttggctaattttaatgcagatagcctttggacaacacaaagaaacatatcacttatctttccctggctttttttaaaatgtgtcctaaatatgattaattctattgaacatgttcagttactttgagaaatatcaaatcctcaaacttaaatcttttccaagtttccccaaagaaatgccgccatctctaatctttactcacgtgaacaaaccaatctctgttggtatttgtttaaacattttgagaggctcatcacatcacagagaatgacatacaaatcacagcacatagggaaatggctgtgtgtatggaacttttcagaatggagggaaaagggaacaatattcttagagaggtacagttttaaatttttggaaatcgcaaagcttataaatataagaaatgagtttaagggaagataaaatgtaataggtggtgatgcggccaggaaaaacaaaaagcctaaataatacaattaacatttttttttttcctgtgaagcagccacaaagtaaaccaggaatttcctctaataccaaaccatcagatgggttttcctgggagttacttcccacacctgaacaaaatttcagctgatcccaagtgacacagtgtgtaacgatatcccgctatgaggagggcccatgattgcaggactcttggcagtactagtgtgagttgaaacaatgaatgaatttgccagatctgatcaacagtttcaaggaagagtggactcactaatctttgagatctgggaaaaccttgagtggggccttcgtgttcctatctttctgagttgaagaaggaactcatccttcatctccaagtcaatggtaccagtggcttctattcccaggtatgtcaaattcctgccaacaaagctaaacagaacatttcagcaccttgacccttactgaggaatttttaaaccagggttagaagtggagctaatctggacagaggagaaggtaaaagacataaaatctgtctccagtgtctgcacttcaattaaaacccatatttgaatcatgaagtaagttgggtctacgacttctcaataataatgggtttcaataaacttgcagagacattccagaggctctgtcaatatatcaatcaatctataactcttttggcccccaaacaatgtttatctatttaactgtgattaccagatgttttggttgatctactaggtgcttgacagcagcttttttatttatagaaaaaaaatcaacaagagtgtggaatattattctccacattcaacaaaaccattttgctgtaatgacagccactaatggacagcagccatcagttaaataacatcagccaatgatggcaagataatatggggtacagttttcatgtgagtctccaatttaataggggttaaaaataatcttcaaggtcatcatattggtagcacttttttcttatcagacactgggagtaataatttatgaagcatttttgagttcacttgcacatctgctcctttggaccagggaaagctctatgagaaacacattctccccatgttcttatagcacaacagggttcatattttattgatgggtttcttaaaataatggtaataaaaatataattttaggcttttccagaagacacctgattactatccagtagccacttgctcatccttttctcttgcctgcagagtcctccccttattatagatatggaaaatgccagataattttttctcaagtcatccttgcaaataagttcaggtcatgtgaccataacccagccaatgagtactgagggagaagtcttcacagaaaatccctatagaaagattttattttctagtaagaacctgatgtttgagaagtgattccttacctctctgtctgctggctgtacagccagttgtgtgagaatatgtgctcataattgtggcagccaccttgtgactatgagaggcaaaccaagagatggacagtgaagtgtcccaacgtggttgatctgctcaagtaaccaactctgaaaacacctgtgtctgggcagcttattaaatgcagttggatatctgttctttgcagtcaaagtcttcctaacaatgctttactaattcattttaagaatgtttactgagtattcactaaaggctagccactgtgacaggcaccgggctatcatggtgagcacaacagacattatttctgtactctagggattctcacctaggggacagacagaagttgattagaggctatctaatgtcatatttagcttcattgcgttgggagtttgtggttagagaaggcttccctgaggaagtgatgcttgagctgctgtctgaagaatacatggaaactaatcagatgaagagggatgttctcactgtgcctttgtgaattaatcaatcaaactatctcctgaaatcaatcaaattatctcctgaaagccaatgaagtcaacaaatagaatcacaggagaaagaaaagtcacccccagttgtcaactattcagccaactgtctcccaagttagtgatacatcaagtgttgatgaggaaggatttttgcagactgacagcccaatccttcttcccgtgggcccatgtggacaccttattgtgatcgttcttatacatacaaaacgtcgtagtttttatggtagctgaggtcatggagatcagttttcatttgcttattgtacttgttataaatggtctaataaattatctctttttgctaagaatttccataattggtttcagcctgagggcacgttttttgtttttaaacattcagccattttgatttatgtgaatgtgaaaaatctacattttttttctgtgtttaatccaatctacagaatattatttagcgcaaggaaatctccaaaatagctgaagcttttcacttatttagatttcaccaaagagtccccagggtagaacgaaaacatctccaagctagggtaattttacaaaaactgcttagagttcaacagctatttctgtactttcagaattctgtaaacatatgggggaaaatctgtccacagttatgccggagcagtgcccgagccctgaattcccctatcgtttcattgttgggaagggctagagccctgattcaatgtctgtgttgcaaaggccctggagctttttcacctttctatttttgccctgttagacaaggtcttccgtcttttcttccttgaaaaatctgcttatttcctcttccttcctgcgtccttccctcatttctttcctttcttccttcctcccacttccctccctccctctctctctcccttccttccttccttccttccttccttctttcctttatttctttcttccttcctctttttttcctaccttatctcgtttccagatatctgcctaatttctcctagttctggtgctacatcctcctctaacttagaatcacgcttaagtgctataggccaagtatgttgtgtgttagggaggaacagagtactttctatttgcatcaaaagggattttcatgtttaatggcaggaaggattttggtttgtgggtgaggagagggggtgctgagagggaagtctgtcttgattctaaaaacggagaatatttctaaagtaaaatatcccttctcatgtatgccagggtcctgggcaatgacagctccaaaatatcagccactttcccctttttgactggggcatgtcctgggacacttcagtgtgacctcacatttagacactcagtgtccaaaggagttaataaataaggctttgacattttctctaaatgtgattgtgcgtacatgcatactgttatagaggttaatgatgaatccaaagatgtctattttacaacttaaaacttgtgtccttttaactgaaccattcaatttccaataaaccatgaaataatactatttataaatacatgtactaatcttataaatatcacaattttctattgcattgtattattaaaagtgttagcaagtttaagataaatatttaaaacaattagtaattttttaaataaaatgataacctttatttttcaatattataggaacttaaaagaatgatgtattttaggcttttcttgacttctgggacaacgcaatcttgtctgtttcactcagggaagtattctttcggtattgtgatgataggattcctaatctgaaatctaaacaatttctcctagaaggtaatgaggttttacacaaaccttattaagtcagtcctttgctaattgaatgtttaaaatctggggcctactgggtataacatttattgagacaaagtaattaacattttctttcttgatgcatttctttcaatattatgcttaaaacctcaacacatagtagaatgcttagcatataataggagttcataatagctattaaaaacaaagtattaagtaagagaaatgtgttctagaactggcagtcttcttgaaccaagaaaggctcaagggaaacaaaaggaatctcaactatgtacctcagatttctgagtccagaagttcattttcagtggcagtacaaatgtgggacatttttggttaaaatacgtattttactgtataggtccactgtgattttaaatgcccttatgttgcttaacagacattacttatatctactttacaatgtgcactgggcttcacagcattaaaggtggaattgttttaaaaagtagccttttagtaagtcagatacattatcgatatgcttccaaatacttggtctaggaggaaaataaggggaaaacatagtgaggatatattgaaaaatattttttttctcagaagaaaggagatacagtttacataaatttgagaattcggcattgcttaattctccctaatgtctacgagaacttctgctttaaaaccagccccaagaacacattggtcagccagctcttgtgctgaatcccagaatattaagaaccaatttaaatgcttattaaaattattattcttgtcttacttttatatgtctatttttctctattcatagatagtcatctctatctcagttacctatctaaataaacatatacatgaaaccaagcataataatgccatacatagaaatctaaaacaaagagaaattttaaaacgattatttatatgagaaagagttcactcggatattgttgcattctttcgtggttgctaagtgcgtttattccagaagggtctcctatgcagcaggccctgaggtaggagtaataagaataataaatacagttgaggcagagatgtcggggtgatgctcagaggaagccgatgttgaaccaggtacattatagaaataaaatatctaaaaaggaggagagaaaaacatttttagtttcagcaaaattgatgtaattgtgaaagaacacattttccaagaacactgaggactgtgggtgacttgaatagaggatggttttaatggagaatgtgaaagaagatgctttcaaattaaattcacaccagattttgaaggacctgtgacctgtggtaaggaattttgtagtttaacttttattttttattttattttattttttgcttatttttgagatggagtctcccaggctggagtgcagtgatgtgatctcaactcacttccacctccacctccgaggtttaagcaattctcatgcctcagcctcctgagtagctgggattacagatgtgtgccactgcacccagctaattttttttttttctagttttagtagagatggggttctaccatgttggccaggctggtctcgaactcctggcctgaagtgatccgcctgcctcggcctcccaaagtgctaggattacagacatgagccactgtgcccagcctaaatttaacttttagactatttccatcataagcttcattagtggctaccttttcactgttgagtccacagtgattattccagggcattgcatgttatagatgcttaataaatggttgttgattgtattgacagataggtatttttagaaagaggagcaacaggatcatatctgtgtatttagttagtcaagaagagaaaaattcagacagcatatatgtaatgggaaggagcagtcctcaagcaataaaggtgggaggcgggagataaatacctcagcttccccacccttgtcagcaggagtgagccccagatgcccatggtggtaacatacagtagtccccttatccacagttttgctttctgtggtttcacttacccagtcaaccaagagctgaaagtaggtgagtacagtacaataaaattctttgagggattacagtctcatgacttttgtggtatattgttataattgttctattttattattggttattgttgttaatctcttactgtgcctaattcataaaccaaactttatcataggtataacgtgtatagaaggaaacggtgtatatagggttcagtaccatccacggtttcaggcgtccataggggagacttgaaatgtatccatcagggataaggaggaagtactgtatttaccaacatgtcctgtattggtttcctttcttttctgtttaatttccttacttccccaggaatgcttcctgggtttaccttacaaatagacttcccaaacttgcaatattatatctcaagttctgcttctgggagaaccccattcaagacagagtcacatggtccttataacggtctacacagagattattagggcctcatctaaaacagtgaccatgaaaaaagtggaaggcaaaattctaagatattgccccaaatccacatcccctgatgtccacacatcttctccaagctattcaatcaagcattaatctcagtgcttctgtgaagggatattgcagaaataattgaggtcacgaatcaattgactttaagcaagggaattatcacgaatgtgtctgaactaatcccatgaatcctcaaaagtgataggcatcttcctgatgagacagattcaaggcataagagggatttgatgggagggagattctccattgtagctttgaagatggaggtgccatgtggcatggatggtgggtctctaggagttcagtgtagcccacagctgattccagcaaggaaatgggatctcagttacacagcagcactggatccttcaatggcctgaaagagcacacaagcagaaactccttcagagccttcaatgagtatgactctgagcagaggactcagccaaaccatgcccaggcttcttaccaagggaaatggtgagctaacaaattatcttaagctgctatttttttttggttatttgctatgcaaccatggaaacttaatacccccaaaaatggtgttaggtttaggatagaggtagaagtcaagccttacaattgctagaatttggtggctgattgtgtcaaatgattgaaaagaaaagaggaataatcttaaggttctagtctgagttcataattatgccattaatgaaatagaaaatgtgtaaagagatttttttttcaggtaagaagtgttttgttgttgctgttttagtttgttacttttgagatgaagctgtctagtaagcaactaaaaatacaatccaaagctcaggaacaattctgggtctgaagaacaaacatttggaagtcattggcatatgtttaatgttgaaatcatggaggatcgccatacaatgtggcacatatacaccatggaatactatacagccataaaaaaggatgagttcatgtcttttgcagggacatggatgaagctggaaaccattattctcagcaaactaacacaagaacagaagccaaatatcgtgcgttctcactcataagtgggagttgaacaatgagaacacatggacacagggaggggaacatcacacactggggcctgttggggggtggggggctagaggaaggatagcattaggagaaataacgtagatgatgggttgatgggtgcagcaaaccaccatggcacgtgtatacctatgtaacaaacctccatattctgcacatgtaccccagaacttaaagtataataataataataataataataaaccatgggggagggtatctgagtattttgtgtagatgtgttcttcactgcttagtccttctaaattttggtaatagggctttcttgactgaggagaaatacagagtacttataaaaatgggaatttattagataatgtgttatcttaagattgtattccatctaatttacaataaagtaatttttaatgttctggcttgtgaagtagggtatggatagcaaatacatggcactaaagccaccattccccaattctgagcctatggcattactaatcaattcagtaattttcccttcagaaccagtattctttccaaccatgctctgggcagcaacgaattgattatagttcacactcatttgcaatcatgggttagtttcaaaaccatatccatttaataacagatacgttgagttgctacttgagggtggagggtgagaggaggatgaggatcaaaaatgattgcttattgtctgtgtaatggaataaactgtacaccaaacccctgcaacgtgcaatttacctatgtaacacacctgaaactaaaagttaaaaaaaatctaaaatacattttattttgatttttctttaaaaatgatgttttcttatcttttacatattgttgaatgatattagatagcctcctgaggaatttgttaagatggcaagaagtggttcctacaggtggtttggatatgaaacattgcaaagctaagttgaaatagcatgaaaaaagtataaataggaatttcctttgatccttctaataaggctgaatggtgttgtgtccacagttattaagttcaaatattataatttttgattcctatactggaagataggggcagttcttgcagttccaagaatgacgtttttataactcagctttatgctgagagccaacgtaatgcacagggattgatctctttccaaccaaaaatgggtaagatttgcacaaagtcatgcatatcaatcatccaattgttgtctcatcctgccatcatcttgagagacactgaaaactctagaaccactgcctgagacacaatttgtatgacccaacctaagaaaaaaaaagcttaggcagctccatttctggatcacagggtgttaacatattagtcaacccataaaagctcccactgatttatatggagttgtagcgttgcgtcacaggtggaggggcctaaattgtttttggagaaatatagggctctgtcttcaggatcatgacccgtgagtcacacccagggctcccaaagccgaggccagtggggacgtggaagaacttggcttagccacagggatgtgactcactaaaaaagatgaactggttttgaaaagtaacaagaaccaccttctattctctacatacctgctttcattccataacttaaaaaaaaaagcaaactaggagttttataagtttttatcagatatgtaaacatattattatttacttttagaatcttggtcaattttgctgttatagaagtggtggccatagctatcttttgaataacaggttgacaaaatgataattgcattacttgaagataatcacttgccaaatttatacaataagttgacaaagttgtgacaaattcataggatgcgatatccagattcaactttctagtcatttaagggactctaattagtaatttatgaaggctcattagcaggaagttcaaggtaattgttaacttactgctgtccatgcagtgacaggtgatctgaaagcggagtgacatgacaaatgtggacagtgtcacatcatatccttatgtggcagggaaagctttcatttcccgaataggtgaggcatatgtgttttgggctaaaactatgattccaggccaccagaattcttatttcatcattttcaaaaattaagttgggtcaggtgtgatggctcatgcctgtaatcccaacactttgtgaggccaagatgggaggatcacttaagactaggagtttgagaccagcctggacaacatagcaagacctcatctctactaaaaataaaaaatctgagctgggcatggtggtgtgcgcctgtagtcccagcagtttcagaggctgaggcaggagagtcacttgagtccaggagtttgactctgtggtgagctacagtcctgccactgctctccagcccaggcaacagagtgagacactatctcaaaaaaattaagttgaaaacaattttaacattttaatatgtgagcatccctttctatgactgctgaattttattctaagaatagataaaaagttaatttcaagtatcgaaaacttgccactttcttttttcatgtttggattacaggcctagaaacttcaaaatgtggaaaacataagaaaaaaaaaaaactagactactgggaaaatgagaatgaatggagatgtatctgacgttttgggagcaggctagattcagatcttctctccctgtagctaaattgggtgggcagctggcctcaagaacagtccacccacaacctccaactcctggcacgaacctgcttgagcttggaagacattgtcggccctagatcccaccctgactcctgcatgttctggacacctccatcaccactgagcagggaagcatgttcttcctttctcattcatttgcttccaaaagaggagctctgattttcttctctcttgcagtgctttttcctctatatagctcttaacctcctctcattctcttcattcccacctgaaaggtgctagttcatgtgtcaccaccatcttgcctgaatgcctgttccggtgatcttcttgcttctaccatttgccactataagtcgttctactcccagaagccagtagcatagtttcagaaggctaacataatagtgtcttttccttgtgggaaaccatcagtggtttttcactcccttaagcacagccaacaacgccttcaatgacctgctccttcagccacactggccttcagacatgtccccaaaagcactcagttagttctcaccctggggcctttgcacatgccactttctgtccaagcttgcagaccaatatatgctttggcaccagctctcacagagcctgcagcacttatggcaaggtgcatatgttgtttcctgtctgccttcccagttagacttgaggagtgctgtgaggatgggtatagaagaaacatctgttttcccagggcccagtccagagcccaccccatagtggatgctcaataagtacttgccaagtgcttcctagaaatatgttaactgtttctttctgattattagattttcttatttgatcttttctggcaaagtggttgcttctgtattttcttagaattccatttgtgtcataagtgatctcttccctacttcatagcctttatacgtgctggatctctcaggaccaacaatgctgtagctcttcaggctaagcagtgaagatgagtttcagggattgtgagtgttttcccagaccttctacagacatttgcatatgcataggcaagtgccttttgggccctcaataaatatttgttgagggaaggacaggtggattgataaatggatgggtggacggatgaatggttgggtggatgaatggttggatggatggatggatggatggatggatggatggatggaagacaaatatactgatggatggtgtgctgaagatgttgacaacttctttagtctgtttatctctaaactcctttcccctctgtgaataacttgtcagatcccttttttgctagagacactgtcaaggaaagcatttcctaatgcttgtaacactgctaaagcaagaagaatattggcagaaacttctattttcaatgcagtttttaggaaggttaattactttgtgtttctgaagatgtaaatgttcctcaaggaagaaatctctgaataaaactcaatgacaagatctttataatggacttctggttattgctatgtgcaatgccctacctataactcgcattttaattgatgtatcctgagcaagatttgaaacagatctctttccctctcttctaattttaatgagtcttctctagcaagcacctatatcaccagagagatgcagagaacctcagcatactctggatgggcctccctctgcaatttatgatgaagtctgacttcagagtgagttcgcagcctccttcctgcctctcctctggtttccagggtagcagactcttgtctcccttcagacctgggctctcccagctcagtcccacttggcatttctaactgaggttatggatacacattgagcccagaactcattgcttttttggaaaaggcaaaataagagaggggattttccatattcacatttttccacagaaatgtattcataagctttaaacttgcccaagctctgttaatgtatgtggttggctcctgtgccaattttcattgtgaataagatgctaaataaaagggttcttgtctttcccctttctcctcccctcccataatttcaacttcataaacctattttgtaagtgaattaggtcttaggagagaatcagaaacgatgttgttcttttagccgcttacagtgtttgctttaaacccttgataggaacgtgggcttgtgacagcagcggcagaggtaaacagatgactttatatataatgctttttacaaggtggttcagttcgtttctaaccttggtctcggcgtcatggaatgagccagggaaattcctccccttaaccctaccctgcacgtcctcccttcaagggcaagaaaatgtccattttgcctttggtttcacagctctttctccacagtagagcttgcataatgctataccccccaatcccagggaaccccggtagtgtcaccaggtatttttattattatcattattattttcatcaggtgactgtgaatgttcacaataaaagttgcaatttttatgagccatgagctggcgtgtcctggcatgtcctggttgtcaagtttctgtgcattttggttcaaatgttccctgcctgtgtttattcctggtcagaccacacctcctgggactgtctttgtggcttttgctcagctgctgactcaagttgcagaagacatggggaatagtagagcaaggtctgcaagattctggcctgaaggaaaaggctccatagctctgcttttgagccatggaagctgcctgcccctcccttttcctggaaggtcccatgactagtttcctaataccaactagtcaagaatatgtagggctaaagggacattaatattaacataagtgatacagtgaggaccagaagccttggatgtaagggagaacacgtgagctttccgtcagagaagactaggttcaaataccagtcctccaaggaaagccagctccttgctggggaccttgggctagtgcttagtatctgatttcttcatctggaaaatagctataataatggaacccatcttagagggttggttaacattatatgaaaaaatgaaagttcaatgcacagtctgtgatctgatataggtcaggatgcaatattgttaatactattagctactataaatattattggtaagtaataatttcctataattaatataataaacaatattgtatcaaaattatctaaatcattaatactgataagcaataattatttactggtaattatagatattaatattacacattgattgatcttgcagaacctctttttcttcatctagaaagcagagattaacatggacattgaaaaaaacctctgactctctagggattttgtgaagatgaataaatgactttgaacagtgcctggccctttgcacagtgcctagcccttcagcctgtaacaagtgttgctgtttttaacgagaggttagttgtccttctcaggccctctgtaaaagaatgtattactttgcttttcagccagtgtgactgtctcattccagcacttctattgctgtctataaaagatgactgtggccaggcacggtggctcatgcctgtaatcccagcactttgggagtccaaggcaggaggatcactgaggtcagaagttcaaaaccagactggccaacatggtgaaaccccatctgtactaaaaatacagaaaaattagccaggtgtggtggtaggcaccagtaatcccagctactggggaggctgagacaggagaatcactgaaaccccagaggcggaggttgcagcgaactgagattttgccactgtactccagcctgggtggcattgtgagactccatctcaaaagaaagaaagaaagaaagagagagagagggagggagggagggagggagggagggaggaaggaaggaaggaaggaaggaaggaaggaaggaaggaagtaaagaaaaaaagatgactgcaaagtgactttagaggcaggtcatgggcctggtgacacccagccatgaggctggatggggggcccagtctcctggagaagatgatccctcggccttgtatatctcaatccaggcccaaggtcatggattcttcctggcaggctaggctgatggacttggtttatgagctgcagtctgtgcctaaagacacctaggaggaagagcttagctgctgaatgtacctgggggaccttccccacctatgttgtctgcctcagttgcctcttccttgggaagaggtgcagacagaaggtggcagactctgggatagatccagtagagctgtaaaaaacaggctggcttgtgtcacagcttgcctgtccctttaagccagggcttctggcagacggacctttgacagtctggtgaagcctatggattccttcctgaggatagttttaaatccataagataaaatatgtggggtttcaagggaaaccaactacataccaatttttttttttttttggaattatactacagtaatggatgtatttctctaatagtcaattagaatgatatgaggtaggtgctaaaaatataataattttgaagtagtaatgagtgaaaatggtaccatagggcatccctaggatatacaaatatttgatttcttttaggggcaaagtcatgcagcctgctaatgcttctgtgatttgtggtctgtgtacatattgaaaagaagtgaaacatttcagttgaaggttagaacaaataaggtggaattttctctcctgtccaggttcacagaccacataataaggagtccccactttgctcagctggtctcctaagtctctgtgccatgagaggtcgtggccccaacttctctttgtcttgtcatctcatttgcgtcacagcctcttgcgtgctctttgacctttatgcagtacccctgcacccatgatccaggtcgcatcaggcctgtttgtgcactctcagagtttaacggaagaacccatctttcatacttcattatttaaagaaggctagactgattttaaaagcacaatgtacatgaaaatcacctgaagtatttgataaaatccatatttctataccaacaccctcaatttgagttgatgggtctgaggagaggccctggtttctatattttaaagaactccctaaatgcttctgaggaaggtgctgcttgaacaagaaggtgcccttctgctaagagacaagccttttccagcttgaaaactattattttaccattctatattctgagcaggaaatgaatggacagactgtatgtagcgatgtgatatacaaacagggatggcagctacaagaatgtggaagtgtggaaggaagaaagaaaggaaaaaaggaaggagggggagagaagcagaaaggaagagaaaaataagggaggaagaaagaaaaggaaggaaagaaaggaagaaaaaagaagggaggaaggaagaagaagagaagcatggagatagggaagaaagaaggaagaaaggcaaaaagaaagggaaaagatgttctaagggctattaaacctatgggaaaggaaatttttatcagcagaatccagagataatataaatcagcaagaagaaggatagattgattttgaaattcaacaaatatttatcatgtgcttgctacattctagggcaggggttgaaatctcaaacacacagaggagccaggcaagatggtgctgatataaaagattcagggttctctcggtcctctatttttgcaatttgaggtaaacagtttggctgcataagaaaaacaacaggctgaatgtaagagttcatgctgtcaaactttggttcacagcatccggcatggctacctagggccttgctttgtgtacacatgaaatctatcttccatattctccaatttttcaagacaatttgacattttatagaaatctctttatgaatagatattggaagctattttagtactatttctgcaaaacaaatttacttaaaatgtatccactttaaaacaatcattttatttttcccatggattatgttggttggaattcaggcaaagtggagctgtttttttttttttttttttttttttacttcaccacgtctgaagcctcagatggtcagactcaaaggctgggggaagtgagggtagcaactaaacatctaagggctaggatcacctagaggctcacttacatgtctagtgcttaggctgggaagactcaatgatcaggactattaactggagcaacttaatgtggctttcccatgtggcttgacatcatggcgggctcaaggtagtgggactcattccactgtggctcagagcatcaagcacaagtgttcctgcaaagaaggagggagctgcatggccttttatgatccagtcttagaagtcatacaacatcacttcagtcatactatattggtcaaaaccgttccaagcccaaccagattcaaagacaggaaagatagtctctacttcttgatggggaagtgacaagtttacattctagaagagcgtgagagcgagagatattattgcaggcatctttgaaaaatagaatttgctgtcataactaattcaaaactttgttttatcctgtaatcccagaacttcaggaggctgaggcgggtgtatcacttgatgtcaggagttcatgacaagcctggccaacatgatgaaaccctgtctgtactaaaaatacaaaggttagccaggcgtgatggtgcgcgcctgtaatcccagctactaggaaggctgaggcaggagaatcgcttgaacccaggaggtggaggttgcagtgagcccagattgtgccactgcactccagcctgggcgacagagcagcaagacttcatctcaaaaaacaagcaaacagcaacaaaaaaaacccttattttaaaaataagttaaacacagtgtgtacagcataatgcatgtttgtaggctagcataacagagggttgcactagttttttacctctgttacagggtataaaaattcggagatgattaagatttggctcctcttcagagaacgcagtcttatattttggaattttggaatctctatgaattacatatttatactttttgtacccttgctggagttgaggagagttggatgaaagtagggagggtactgagactaggaggcagctatttattagaataacctggaaaatggaccaatcccccccattcccagccccaagaagtttacctctatccagaagaggagcatttgcatttttaatattttgagaaggttcagaaacccgagcttcctactgcttcctattgagaagcactgttctaaacagacttctacattgcaattggtactcacatatttagacatcagtcttaccgcttaaattcttcatttgcttgtaaaagccatgtagctctaaactcagaataatccattgtctactgcccttcatccctcatgatcaagtttttctaaatatgtttggaaattgacatgtgatttaaaaataacttaaagtatgtctgatagcccagataaggacatgtactttgtagtgccattcatggaaatagtgaccttgaaaaaaaattctggagggccttcctctcatcttcctttctccagttcctatggatatggaaggatagggctaagaattgctgtctgccttctgacttaataaggagacttttgctcaaataaacactgagttcttttttttttttttttccaagccattcaccaactcatataatgtatctttgtgaggtctgttccttccataggataattcagaaagttatacctaggctgggcacagaggctcacactgatgatcccagcaccttcagtggctgaggtggttaggattgcttgaggccaggagttcaagaccagcgtgggctacacaacgagcctccatctctatgaaaaaatttgaaaacataattttttaaaaggaaagttatacctgggccagggattctgtaccgttcatgatcttgtattccagggtgtgtaatattaggaaggtttaggtttattgtctaaatgttaattgtgtaaataaggtggtaaccatggcaacccaatcccacccccctcagcattggcaggtggccagggaggtgtgatcacaacttctatctgagctcacctttgcaggtaatggggcaggtatgtggcattaaagagcaggaaggccagcaagggttggtaattgtttaactcttccagtggcactcctctgagtacatggaccacacctgcaaacctggcaggacgtgccgtgcatgactggacggaggcactgatacactcggagccaaggaatgggtttaggcaggagctcagggctgaaatagggagcccagcctgccgggctgcttgaaatctcaggactcataatgcttgtgctttagggagacaactgctcattagctggatgaaattaaccagtcatgtcaccttttgacacctcaatttcctcattactgaatagtgagggatttgaacatattatccctaagctaccttttagctctaacatagactgagtatagtctatgtcaagactctgactagagtgtaggtgttttcagattggaagaattatcagaatcacttggagaactcaacaaaacacaaaccactgagctccacccccacccagattactgattctaaagatctgaggtggggcctgagaatctgcatttctaacaagtacccaaatgttgctaagctgctgatttggggcccatagtttgagaaccactgttctggtctgttattgcttggttatgttctggggattttcctgggccacctcatgtagctgcaacattctataaagagggctcctttgctcaaggagtgaggttttatttcctgaattttcccagccctttgttgttaatttttccaccagactgggcatctttggaacatcagagtttgaaaagagaaaacaaaatgaggcatagctcattcgattaggccaaggggccatatttttaccagctttatgtcttatgacttgcctagtactgtttcttaggaggaggagggagagtaattaaacattttctggacttaatattcaacttgcattgccttagttaatactatttataatctgatttgaaatatattcagcacagacagtgtgatatatacttgggattcatttttatctatactctaggagctcattgtatgctgcttctaaaatagctcttaatgatttccacctcctagtattcacacccttgtgtaatccactccctctccatgtgggttaaccctggtgacttgtttccaaactaatagaatgtgacaaaggtgatgggatgtcacttttgagattagaatataaaacactgtgacttccatctttcactctttctgctgctggccatttcctctctggcttttcctgaatgcttgctgtgatgatgaattcagagaggcctgcatggcaaggaagggtgagtgacttcctgctaacttccaacaggaactgcagtccacacccttaagactgggcttggaagtcgatccctccccagtcaagctttccaatgagaccacagaaaagaccaaccccttgatcacagtcttcaaggagaccctgaggcagaggacctagttaagtcctgtcaagatttctgaagcacaaacactgagtcaatgaatgtgtgttgttacaagctgccaggttaaagataatttttaatgcaacgtgagataattaacacaaatctattgacaaaggatgtttcttagggactaggtagtcaacatttggaaaactcaaatcataagaccacacttaatggtaatgcagagccagattgaactggtttgtgaggggtgcttgtacacaactctttctaactccgtatacagagatggcatgttaatatagtagcttgaagtaagcatgatgggaatacttatgcaatgaaaaccagcaagcaatacaattttgagatgccttttactagcatagcactgtactttaaaaaccctactctaagccctagctctcactgtatctttggtgaataacagaatcctggtatatttgcataatggtgtgcagagagtggtgttgcattcatgaagccagggttgttaaaatcatgtggattgtgggataatattacacagggctgctcccttgtgtgaacagggtgggtgaccccaagagtctgcaaacttctgaatagcatctttagcctaggaatatgaaataatcccaactctgtttatagcaggtcatcaatacctgaattgggtgaaattttggcatggaaatatatatatttttaatctgtctcaagtgtaccttctgggaaaggctctgtggaagcatctagctagacagagaattaagtaaggaattcctggcacttggtacctccttgcaaataaatatttgtatttggggaaatttatctctgacaattacttttattgctacatattacctgatgggaaggttggggagaagagacttagcttacctctatttgttgagagctaccaatatcaatagaaaaggaactagtaattgcaaatgatcaaatccactgaggtcagtttgtgggataaatcattacagtaaccataaaatacagatatgctacaagtcttcattttacacttgaagaatttggagtacaggcatggtggtcatctaactgagtttaagaagcttgtacatgacaaacaaagttaaagggctccaaatcagctctgaccccaaaatcatgtttctaatctctctgctagaggtcactcctcccccttttcactgttatagcctgaaaaccttagaggggaaattccagggaaggaaacttcacaggctcaagtttcacagtcttccctgacaggaaatcctagctaaccttgaacttcagggtcatctgttgtggtttaacaccattttttcatttctagttaaaagggcagctctgctcactgtcccttgcatgtcatgccctgaaaacatctcaactccctcttgttactgcctgaaaaatggattccccgaaataataagtcctccaaattcagacatcagctttcctcagttaatttctgcatcgtcatttataatattggaaggttcttacttttaagaaaatttggaccaatgccccaaatggtcttcccatctcagagcaaccaaaaaatgtgactgtggctgctgccaggacccctacatgcaaatgaccagactgtagagagttaagtcttgggacccacacatttctcccaggggaagtcattatttcagggcttttcactgtgttcatgaatttcttctgtgatctaggccttggggagaaagaacattcacctaatttcctataaaaggcactgtagcatagaagtaaagacaatcagtgttcacatcatagttttgtcttttatggcccgtataatcttgggaaaattacttaacgtctccgtgctaatgttttcttatctgtgaaatggaggtgtgagtactgcccatctcatgagtcatgaaaaggattaaatacattaagctctatgaagcgcctggagcagtgcccagcatgccaaaatactcagttaatgttacttcttacacatggtgggcctgtttatcactgctacttcctggaagtccccgtgcgtaatggaaaggatagctttgtgctgtcctgcttgtagccaaccagtttcttagttcattcagcttgctttttgtactccaggagtgtatcagttagctcttgctatgtaacaaatttctccaaatttagcagcttacaacaacaaacatttattatctccagtttttgcaggtcagaaatttctgagtagcttagctgggaggttctggctatgggtctttcatgaggttgcagtcaagtggttggcttggttcagtcaatttcaggctcaactggaggatgatccatttccaagctcacccacaaggatgctgtcaggcctcagttcctcaccatgtgggcctctacacagactgtctaaatgtcctcatgacataacagatggcttgctccagggactagagagaaagagagagatagagagagaaaaaaaatgtaagcaaaagacaaaatcttttatactctaatctataacttatgccatattctatttgttagaagcatgtcactaagtccaacccatactgaaggggtagggaattaggctccacctcttgtgggaacaaatatcaaaaacaaatgtgacatatttttaaaaccacaagtgtcttttacaacccatatatcttagaaattttaaagtttaagtgcactttggagatcaactagcacagctgcctcagttaagagatgagaagaataactcaagagacttgcacaaggtcacacaactaactggccccagggactggattcagctctcttactgttgttatgtgcagctgtacctcattttcaagtcatgtcgatggagtcacttcactgatatgctgtggcacatcctgaagccctaggctactgagagattgaaacttgtatatgatatctttagacttgcactgtctagtatggtagtcaatagctacatgtgttgtgagttacatgtggtgtcaaatatacatcagatttccaagagttagtattgaaaatgtaaattatcttattatttcatattgattacatgttgaagtagtattattttggatatattgagttaaataaaatatattgttaaaattcattttctctattttttttttttttttgcttatttgtatttctgctgttgctctagattaaccaaactgatctccacattctccatgtctttggtctatcagagtcttgcttttacttccatttctgtttccagccacggtgactgagtcacagcaacacaggctgctccaaggcctctgttctctgctgactctgcagagtgggtgcctgtgattttacaggtctgctccttcagacctttctgaacaacactaataactaagggtgtcctgtacaactgcaacaatggtttccaatggtgtgtgctctggtgagctcaaaacattccctgaggactgaacttccactcaaaagctgggtcccaacactctacttcctctttttaaagaccctaccagactaagtaaccctaactagatccattacatactgtttatttccttccttccttccttccttccttccttccttccttccttccttccttctttcctcctccctccctccgtccctccatctcttcttcccttcctgcctctcttcctcccttcctcccttcattttttcctctctctctctctctgtctgtctctctttctttctaaattctgagtcaacacagaaaaattcaagcccagatttggtcttgaagactattgtaaataaagtgatcaattgaatctccctggactgaacatttggactgaacatttggaagagtgattagtgagaggagttaaaagacaatcaattcagggtcttgccatttattgaacagattttcagccccttcactgtagggtattgttttcagaagatctgcctgcccgggattcttggttataattcctctcatgactggggaagataaatatctttcacagtaatttaaagtggttagtctgcactctctctaaacagcttccttccattgatcaacgggtgggccatgaagcctcttgcaggcctctgcccctaatcacccttcttgttgacattccaaactgctaagctcacaaatgtactgggaggacagtagctagaggacacttattccctaagagagaatccttgactttcacggtatgtgactttgttattttcccatccttgtaagggcttgacattgtttcagaaaatagtgttgaattggggaatgtcgttttcagtttctttctcactgacccatgccattcaatgtcttcatcctcctcaaaaccttttttggaataaggcaggaaataaataaataaataaatgaaactgtctctaatgtaaaatgagttgggtagtttgaagatgtttcctctgaaacacttgaaggaagataaagactgaaaagagagaaactgctatattttagatgtaaacaagaacaagggccattggataaatatggtaaattatacagggctagcattttgataacttgtgatctggagaaagtataagttggcacttccactttttttttttttttggttttgtttttgataattgtatgcagcatagaaatcccatagctcccaaatcttctactccaactgccatttgaaattctaccacagtcctatgtatcatcaatgacctccccaatttggccacaaaggatactgagattctaagtagagctagaatcaaacaggaaaccatgtgagtatgagcaaaagggtaagagaagtaagaaagctggtttagatcagaaaagacatctcctccccccagaattttctggaagatgacattttgtaacaataagtttatatccagtttgtaaatcttttggttacataaaacaggaccatgtctatgtcaagtaatggaggttactgttgagttactatgacgatggcacaggcagaagctagtgcctcccttagactagggcagtagttctcaacagtgggtgggagcaggtagagattttgcctctggaggacatttgacaatgtctggggacatttttgattgtcatagttacagaggagaatgctggcatctaatgggtagagcccagggacactactaaacatcctccaaatgcacaggacagctcttgacaacaaagaattatccagctcaaaatgtcgatagtgctgaggatgaaaaaccctgaacaaggacaagaggtgaccccctactccctgtgtggccctgtgacctggaggactttgtaaactaaacatcaaaaaacaaggacaataaatattgtttttggttttcacattcataataaaattctttacttgattgagtataaagttttaagacaagagaagctgacaagcaatagacaaccacgttgcccatcataaaacctttatttatattcagagaacagacattgagtttcagttaagtttcccttggaaataatcatgcaaaggctgtatcattaagcattgtaacaggtagatgaggataagtcttcctcatccctaaaattcttctgaagtagaatagacacccacctgcctggagtggttaaggtaagaaggaaggacaggtaatcctggagagaggtactgcccctccacttcgctagtatttgcaggtctagattctatctttctaaatattacagaatgactcaatagcacattctactaaaaaatggtaatgtatcatttaaaaactcttcaaaaaatggttatgaaactgcacttactgttgcttattatactatcttgatcataattttgtaatgtttgagagaggtactctctcctcacctccccctcacctctcagatccatcagccatccttctctgccttgttctgtgtccctggggatggacccttactgattacagcatgtgaattctcttgttctttagcttctacctggctgagctaatgcgaggtgctggcaggggaacagagagaaagagtagaaaggactcagaatacttattctcctgcccttacccagccttggcacctcttgcctggtagtggctaccggtgtccatgattacagcttctgcttggtggaaacttctttgcggttccagttttttctggctctgtcaaccctatttttatttttttgtctttcaggtcaattggaaaaggcctctagctgttgctggactcagagttcctcaacatcttttatcagttccattaaaactatggggagggataacattaggagaaatacctaatgtaggtgactggttgatgggtgcagcaaaccaccagggcacgtgtatatcttgtcacaaaactgcacgttctgcacacataacccagaagttaaggtttaataaataaaatacaataaataaaaaaactatcaatatctcataaagcaacaggaaccctcattcattgctggtggagatgcaaaatggtacagccactttggaagtcagtgtggcaatttcttacaaagctaaacttcattttactatacaatctagcaattgtgctccttggtattaactcaaatgagataaaatcttatatctgcacaaaaactccacccagatatttatagcagctttattcataattaccccaaactggaagcaaccaagatgtccttcagtagatgaatggataaacaagctgtggtcattcaacaatgggatattagtcagagataaaaataaatgagctgtcaagccatgagaagacatggaaggaccttaaatgcatagtgataagtgaaagaagccagtccagaaaggctgaatactctatgattccaactatatgacatagttgaaaggcaaaactacagagacaggaaaaagatgagtggttgccagagatgtgaggagagaggaaaggcagaataggtggagcacagaagaaccttatagagcagtaaactattctgtatgatactgcaatggtggatacaaggcactctgcatccttccaaacccatagaatgtacaacacaaaggctgaaccctaatggaaaccctggacattcattaataataatgtattgatactagttcatcaatcgtaagaaaggtaccacaccaaagcaagatattaataataggggcaactgtgaaaggcatgggaggcatatgggaactctatactttcagcttaacatctctatagacctagaactactttaaaaatgaagttcattaattaaatatatcagtgaaccatgtatatatatgaggaaaagtcctaccctcttctctctgcatagcctcattattatttatcttcttttattatttatcttcttcttctattatttatcttctctttccagggaaattctatttcctgcccagggcctgactattatatgttgtatcaaaaagacattgtgaaaataaagaaaaccgcaaaaatgaaaatattatcaaaacctttttattcatgaaatgcatgttagacaccaaaatattggtggcttttcatatcaccaatgctaaaaaattaattaaggggtatatatcttttttattccttggcattacctaagatttagagaataaagaatgtccaaacaccctggttttcctggggcaatcctgatttagggctgttttcctgaatgcagtcgttaacggaaccccgttttcctctcaaacttgtcctagtttggataataagttatattattattgtgcctctaatactttctttgcaaaaggagttacaaagcaccatgggcagagtctagtcatactcaccccagcttgtctgtttgggcactgtctggaacagatagactaggctgggaacgaaggtgtgtctgccaggaccaaacgttccaaaaacaaattttttatcagatgaaactataacctagatcttataatgattaaatgcaatttctgtagtgaaaatcaccttaagtagtataaggatttgctgaagatgaacatcaggccccatgagttcctcaacagctcgaaccatggagagttcgtgcaggcagggtcatttgtctaccacctacactgtggatcaggtacagagtacagagggcttgctctatacatatatagctactaaccagctccagaagccaatattttacctaccaggaccaggaccttgaggtttccctttattattatccattcattcaataaatacccattcaattcaggcaccgcattgaaaatacagtggtgcataacacaagtaaaaaatatccattctagtgggaagaggcaaccaataagcaagtaatcaagtcagtgaaacaattcatataatggtgaatactaggaagggtatagatgcaaaatcattgcacaggagagagggagggcttctttctagagatgatagttgaactaattctgaagaggaaagggagccagccaagggaaatcttggatgttcatcccacagtccctctggaattaatgaaactaatgaataaactgtgtgccaagaagaaatattataaatgttaagtggtttttcttgataagcaaaaagaaaactagtattctaggtattacatgtgggcactgtaaattttaaaaagaattgttctcttgttagcagtcatttgttattgattggtaattgccatcatcaaaatgccaaatcatgttgacccatctcttctgcttcaagactttcccagcctgttccagttactatggctgcataacaaattacccagaaccttagtggcttaaaacaatgacaacacttgttttgtttatgattttataattgggaagactccatggaaatggcttatctatgttccactcagcattaactagcaaagtgcagcgagggggtccttgaaccatctaaagtcttcctcattacctgtctggcagttggtactagccattagcagatcccagctaatgcttttggccagaaaattacacgtaacctttccaggtggcctgggcttcctcacaacatggaggctgtgagcatcctgacagagagagcaagggccaactgagtgctgtgttgcttcctatgacctagcttcagaaaacacgtaacattacttcagtgatagtcaattagtcacagtggcaaaaaaggctgtccagattccaggaagggaacatagatccatctctcattgcaggtcacagtggaagaagaacatgtgggatggcatctattggtgcagccatctttgaaacacatagtgttccatgaagctcaatcctttgagtttcttgtaagacacttctatttttccagtccatatgcctaaaagaacacataaggcaactgcaaagataggagaagtgaaataaactgagtgggaaactcaaaaatcctcatgggcaagcagacagacaaggaaagcctagagactcactcattattcatctctgtcctgtgtatttatgataggtatcaagcttgaacgagtcattaaaaatatgtttagaaaactttggtttgaacaaagtaaaatgtttttctatatttcttatcttcttagaaaatttagtaactatgtgtatgtcctccaagagggacacatagtatgaaatttatctccatcttctttgacgtggaatcctttttgcatacaatcgtgaaatagctcacgggaccacttaggaaattctattaagccaatttgttctaagaggggttataatagacccacagagtgggatgtttcatgggttttgtgaggggatggaaaaattctcttccagcttgaagctgtgaaaggaatgcaatgtctgcttttcaactctggttagcagaatgttgtgccctatggtacctgaatgaaatagctaacctgagtgtgctcaaggaatatgttgtttctggtatgccagaattcaaaaccagagcccattagcatgagtacttcaaggactgccgctgatgtaacctttcaggggaaaggctggtccatctacaaatgactcaagatgtgatgaacagtaggaagccaagccagtgagtaagggacaacatatgctgctgatggagctcaacttcaccctgcctcattggaccaagttcattacctgagagtgatgaaatgaggcgaaagagaatgtacaacacgaagactgcagaaacttacaaaaggagtgtaggctagaaatctagaccagcctcaagatgccaagattccacttagagaaaagggaaatacatctgtggaaattaatgagaaacacagatattccatgggagttcagaacctggaaattagtgaggccaagaaaaagagggatatgacagagggcaaatttcataggagtttgcaacatgatatttgggtggaaaggagcttggtttgcttttagcagcaggaggaaaatctccatttcacatttaacaacaaaaaagggaacctggtgaggactaatttggaataccatcttcgaatttggtgccttgttacagtaggggagtagttgacctggccaaaattccaagagccagttgaatgctgttgggtttgagtacactgattaaataagtcaaatcctcttggccttctgagcatcttaactcccagcaataaccttagaaaacattcaggaagactatgaaagtcctggaaaattccaagggaagtatttctacctaaaagtatatgaagattgaaacagccaaggaaggaaggagattattgctgttggagagcgtggaatttcaaccagagtccagagaagacactccatcctcaagatgcattaaattttatacgaggtcttttgtggactgttcggacacatcctgcctctgggcacttcagattagcttcggtactagagtgtttgatgatttttcaaaaaccatgaatcctctctgacactggcaaagaagcttggaaaagatgagataacatacgttatttactagctcaatgattgctaagtggtatttttcttcttttgattagattaaaaaatgtatttaaagaatgaaatgtattaaacagaagctatttacacttaggcaaaagtcctgtttcagagttgggcaagtgttcgctgcaatcaggatcataaccacacctgtacgatttctagcattcattagaagacctacccagacactgaaataataagattgtcaacttttgccctctctgggatcagtgccaaatgactgattttcaatgtcctggctccatgttgctctcattgtgatctctcttctgattctttacttcttacttgcttgttattttcctccttatcattctctgcccccaacttccttcttcttctgtctggacttctgtcttagttataagaaataccatagataggggcttgcgaacaacagaaacatatttctcagagttctggagctggaagtctgagatcacagtgcttatgtggtcaggttctggtgagggacctctttcaagttgaagactgtcttctctttttatcctcacatggtagaaagggagcaagggatctctttggggtctcttttataaagacactaatcccattcatgagggctctatctttatgacttaatgtcctctgaaaggcctcacctcccaataccatcatattgagttaggatttcaacatatgaatttggagggcacatgtacattccatctattgcagcttgtcactccccttctctcttcactcccttcttccactgtggactccatcctgctttttattcacttcttttgcctctggttataaagacatccccttttctcatacccttagttaaaaaccaccctatatttgtaaaaaatttcttcttcagaggaactttctaggaattgtcttcccattctcaaaagatcttgtgtgcaagaagaaattaccttctgagtacaggtaccatctccatgaatttttgatgttcagctcaaatttggaaggaaaaattgatatctattaatttatctaaaaaatgactggttgtaaggtaggtgctaggaaagaatataaagatttgcctccttttcttgaagacgtgccaactggcagacttcctaaaacccaagtgagaaaatgatgacaggccttctggacaggatttgaagtaagcctcatagcatagagagaatttggatgtccagagttagaaggagacaataatgtggtattgtggacaaaggatgcattatcataagggacctgtttagagattattgggcaggaaggaaaggagtgatgaatggtgttggaaagggtggcaaggccagtggtagagggcttttaagtgtagcaggagatacctagaaatacaaagaaatgacaacacacgctttggaattacatggaactgagtttgaatccaggcttctccacacactcacactgcttggctcacctggttgagcctccgtttctgatctttaaaataatattaataccactcacatttcagtgttgtaaaagcaaatatttccaaattgtaaacattaagttcgatggtgaatgaaaaaattctttgcatggtgtttggtttttggtaaaagctctaacacatgatggctattatcaatat

SEQ ID NO: 1381 - DNA, 40001 bp, Homo sapiens
cagagggtactccctcccggcaaggggcatgcctttagctccacgcttggcagcagcagagggcccaaggccataggaagatctgggtaaaccaggagaaactgtcacagagcagaggtactgcagaaagaatcacgctttagagagaaagggcgtggtaccagagccctgctttcctttctgttaacccagtgaccttgaaccaggcatcctaccactccaagactttacttttgataagaggaactcagtttgataggtgtattagtctattctcatactgctcatgaagacatacccgagactgggtaatttataaaggaaagagatttaatggactcacagttccacatggctggggaggcctcacaatcatggtggaaggcaaaggaagagcaaagggacatcttacatggtgtcaggccagggagagtttgtgcaggggaactcccatttataaaaccatcagatctcgtgagacttattcactgccacgaaaacaacatggggaaactgcccccatgattcagttatctccagctggccccactcttgacacataggaattattacaattcaaggtaagatgtgggtggggagacagagccaaaccatatcaatagggtaccaccctctcccacacctctcacctccaagcccccctatttcctggcctacttttcctttttgcacaccactcatcaatttctaacatgccatctaattcacttgttttttgtgtttattgatgattgtttctcttttctcactaaaatattagttcctccaaggcaaggatctttgaaagttgtacttaatagtgtatctcatgtaccaagaattgtgcctgacatacaaaaagggttcaataggtattcactggatggatgttgaataatgaccttgagggatcatctctagcttcaccattaatgtatcggtaatctattgctacacgtaacaaaatatcccaaagttggtggcttaaaacaacaaccgtttattatttctcatgatcctgtggctcaggagttcaggcagggccactgggtaggtactctgctcctgatggcaacagctgcattcagctgtccactgggaatggctagaaggcttgagaaggctttgctcacatgtctggtgtctgtagtccatgtggctcctctctgtccatgtgatgtcccataattcacaggtctagcatggacatctttcacagtaactggattccccaaagcaaaagtcagaagctgccaggccttaaggtcaaggccagcccagattctagagaaaatagattctcctctctctctctttctctctgtatgtcaatgagaggctataagcacagagagggaaggaactgagggtggttacctttggaaactgcctagcatattaccccatgctgtgcaaatgtatgcattctcagtaagtgttttctgggcaccttctagggatgtacagaccaccacagtgcccaaaacctccttgctgtcacaaagctgatccctaaatgagccctggagctgtaaaccttttagctccagctgaaaagtcctctccagcaatcccctcccacagcgagaaggatagaagtgaataattgacaggctgcttgatggggagattgggagactctttggccaaagttgatgaccatctccctggctgtcttccagattccacagatggcgagggtgactggagtctctggtctgtctgcagcgtcacctgcgggaacggcaaccagaaacggacccggtcttgtggctacgcgtgcactgcaacagaatcgaggacctgtgaccgtccaaactgcccaggtgcgtttacctgagtgtgtagctccaagttcaaggggaaagctttttaatttatcattaaaaacttagtgacattgtctttttaaaagatgcactacttttcttttctttttttttttgagacggagtctctccctgtcgcccaggctggagtgcagtggcacaatctcagctcactgcaatctccacctcctgggttcaagcaattctcctgcctcagcctcctgagtagctgggattacaggcacatgccaccatgcctggctaatttttgtagttttttaagtagagaaggggtttcaccatgttggccaggttggtctcaaattcctgaccttgtgatccgcccgcctcagcctcccaaggtgctgggattacaggcatgaggcaagatgtaactacttttctaataagacttctgaccagagtgagtcaggagataattgatgagctgaatggattttctgagtcttatgcacaattgcagtggccgtgacctaaaagacaatgtcgcattgtacttatttaatttagaggagggactctggttagattgggtttttgatgtgggatttgttgtcccttgaagagaaacagaaggcagacactcatggtctgatgaggaagccaggatgagaggcttgacaaccatctgcaggaaaaagacagccccaccggtaataccagagagttgccaaaggctcccaggagcgcaacctggggcgtcttggtagttaactgtcactttatactgcattgtcagtgcttcaaaaactaaactaattgcacacttggtgagaggtcatgttgagagtcaacaataattgtgattgactatagcagtggttgtcaaactatggccaggtctggctcgagacctgtttttgtgtgtcccatacatttttaaactgttgtgaagagaagaagaaagagaaggaggaggaagaagagaaggggaagggcatggaggaagagaaggaggaggaggagggggaggaggaggaagaggaggaggaagctgcaaccaagaccatatgtgacccacaaaacctaaaatatgtaccctctgaccctttaaaaaaggcttagtaactcctggtgtatagtcttactgtgtatttcccattgccaggtagaataccagcctaaaataatatcttagagcctttcaagaaaccacacattccaaatggctttggctgaaaaaaatttcagagacagaaaatctgatccttacaccccagacttcctttttctaccttagacactcagttctccaaccagagacatttggaacaaaggagaaatgaaagcacaaaggcgtttctgaggagagggaggaagaatcagattggaatgaatgtgtatgttagcaaaaggggacacgtagaaaacagggctgaaatgcaagaagtggcggttctggctccatgtcagccatgcagatggatttcaaaacagtggagcaaccattacggtgcttttcctgactttcccatgctcattaggatgagctgagttggaagcctggtgggtggaatctggatgtgtagaaataagcaataaataataacaatatgaggaggaggaagagggaaacaggaaggaaatgaaaaagagaagaatatgaagtaaacgaaaataatgatgaaggtaaaaagatgaggcaaaagaaaatgaagattgcctggtgcggtggctcatgcctgtaatcccagcactttgggaggccgaggcgggcagatcacaaggtcaggagatcgagaccatcctggctaacacggtgaaatgccgtctctactaaaaatacaaaatattagtcgggcatggtggcgggcgcctgtagtcccagctactcgggaggctgaggcaggagaatggcaggaacccgggaggcggagcttgcagtgagccaagtgagccgagatcgggccactgcactccagcccgggcgacagagcaagactccgtctcaaaacaaaaaaagaaagaaagaaaatgaagataaaggtgaagaagaaaaaataaaatagatgatgatgaagaagattttttgagtacttaagtgtcaagcaaatggctaaagtccttacaggtattattttgtttaatgttcacaataactttatgaaataggtatttatgattgtactcattcgacagctatagtaactgaggcatagaggattaacttgcctagagtcacacagaaagcaagtgatcaacctggaatttgaatccggacagtctgattacagagttcatattcttaatcattaaactctttggtctttaccaagagaagggtattggaatcagccacacagggacacagatagcatttgaagtcaaggtttgggggctttcctgttgttttctcttccagagctcacatccagactcaaggtggtagatttaagtgccttgtcaggggaaggctcccctctgcctccatttacaaatgtttccttcttgttttctgtcaccgcggagagcagtgtggccaggagccctcttcataccttttcttctcgtgtgtcctcaccctccttgcatcctttctgcctctcagttcctggctattgcagcttttctgggctcccttgtaacatgaaggatttcgtttttaaggatctctttacttgtttgattcgttgattcccagctttcctggaaagactcatggggcaaagtctccctggcctggcagttattacactgtaaaagtttgtcctgtaggtcaaccctgcaaataagtttgaggtgcctcacataaaatcagagagagccccttaaaggaaatcaagtcagggaaaccagcagggaaggccaaggctcaccagcaaatgttaccacagtgcctcactccctcctcctcttattgctttagcttgcaccggattcctgattgtaaaggaagcttggttaggggtggtagtttgggtgagccagtaagtttgagtagagctgggttcagttcctcagagcaaattatgagaagcccaactttttctttctgaagcatcaccaacaatgctaagtgtcctagaatatgagataactcttcttggctatgcattgtagcatcctcagtgagctagacaaagaatgagctagacaaatattcaagggaaaactaccacctaacacttcccacttgctgctctaagtactttctttacaccaactcatttcattatttcaactctaggaggtagggcaatttgttcttcccatttacagatgtaaaaactgaggcacacaaaagttcactggctaccccaaggtcacgtggctagtaatgatttcaacgcacacagtcagtcattaagaacaagatattaaacactacgttctactgcctctggtttagtttgtcaccctgacaccatcctgacatgtgtcccccactgcccaaaaccccatccctgggctcagtgagtgagttcctaggacttattcaggcacatttggatctgatttcacgttgccaatgtatctggggttttaatatagtttctgcactacgacctgctttttactgtttcctctgttggcaagtttctgcccgtgagtagtaatgaatacaaaaaaggctttgttcaggtgtatttatttttttattgttggggtgggggagataactttttccatgtaatgatggaaaaatgagctcttgtctgtgtttaggaattgaagacacttttaggacagctgccaccgaagtgagtctgcttgcgggaagcgaggagtttaatgccaccaaactgtttgaagttggtaagatttttttcttttttaatccaaatattgacttagtgcctcggagattccttttgcttttgcaatgccatccttggatccacgtaaatgtttcattttccttttctggggtccagtgctcccagcatgtgtcttgcttgctgaatatacttcaagcaagagaaaacagtcctaagcctcctccaccggaccgagcgcttctgtgttcactctgctctctatgcagccttcacagccagaggcagatggggacctgtctctcagcacagaataagcccatagcaggggctcaagtcacatggaatctgttcttactcagccttcattgagcgtcctcaagaaaatcaagaaatggtgccctcagttctccagcagagggagggagggaaagaggagattttctcaaaatattgcacctccatcccctgcaaaaattttttatacaccgggccaggcgcggtgggtcatgcctataatcctagcactttgggaggctgaggcgggcagatcacgaggtcaggagatcaagaccatcctgactaacatggtgaaacccccccgtctctactaaaaatacaaaaaaattagctgggcatggtggcaggcgcctgtagtcccagctactcgggaggctgaggcaggagaatggtgtgaacccaggaggcggaggttgcagtgagctgagatcgcgccactgcactccagcactccagcctgggtgacagagcgagactccgtctcaaaaaaaaaaaaaaaaaagaattcttcataaacctttggtacagtttgctacttgtccactagaaaatggtagagcaaatgcaataaatgtaaaccaaacaaaatggaaagtgactcttcaggtgcaaggtgcaagcttacttttttgaaatagctttatgtgcttctctatatacttaaggattgtagaagggtaaaattccttctgtcccatatcttttagctacccaaaagttcttacttagcctcttcacctctgccctgcctcctcagtcaaaatttagcagtcctgagtctttttttttttcatagccctgcaatttgggagctaatttggtgaacaaaaatgttcctcaaatgcctattggggtcaggtaatggggtcaggtaagcatctcagtagaacaagtctcgaataaaaggaaagacaaataagaaagtctggaggaaaataatggtccagcactgtgatgaaaagaaaatggtctgggcacagtgactcacatctgtaatcccagcactttgggaggctgaggcgggtggatcacctgaggccaggagtttgagaccagcctggccaacatggggaaaccccatctctactgaaaatacaaaaattagctgggcttggtggcaggcgcctgtaatcccagctactctggaggctgaggcaggagaatcactggaacccaggaggtggaggttgcagtgagtcgagatcacaccattgcactccagcttgggcaacaagagtgaaactccatctcaaaaaaaaaagaaagaaaaagaaaaaaaagaaaagaaacagctacagtgtcgggggcagtagagaatggtagggtctgtgacaaaatgaaaagctttatccaaagggtcggccatgatgtggccgccatggaatgaatacccacccagtattgccagatgttctgggtttctaagagaggcctgaaatcttgattttgccagattatatcttaattttttaaatgcttgatagaaatttattttaaaaacaaatccaatcagaaatgtctatgagccaaattggatgcagtttggaaattcagtgtcgctagggcctctacctcatccctccaatcccttcacacacatatgatcaaattgcatttaacaggaaccgtctgcaaatacaatgcatttgactgaaaaatagaaatgactttaaaggcaagactttgacataaagtggtagaaccttaaaggcattcttctgagacagaaagtttctcaggactcttcatatcacaccccacaggcaggcagcatctagctgctttgcagaacacagcccagatgcacaaagccacattggcatgtggctaaggacaccagagctgagtagacatggtgtctcagtcagggtccaggcaggaaagaacatggcacactcaagttaggtaactgaggagcctttggtgagggactgcttgcaaaggtacaagcagagtggaaggattgaactttcattctctcaatgactactcagagaggaggccacagccacagcctatcccagctggcagcacctcgacactcttgggtgcaccctctaggttccctcccacttaatcctctttgcaactttatgagagaagtgctatttttatgcccaaattacagatgagaaaactgaagcacagcaaggtaaaatacctcactcaagtcacagagctcctgaaagttgcgttgcaattcaatcccaggctgtttagcatgcgatcccacactttgcctttcgccaggcctttctgagttcataagacatgcccaatttttctcttcctcgttctattgatgagtgcccaaagccctcttgccagctgcccctcaccctgaccgtgtgatttccacccacaccaccaccagcctcccaggctcctgggtcagagctggagtcactgctgatgtcttcctctctttactccaaagtccaccagccaccaaggcctggcagctgtaactctctgatctcttctgatcccacctgctgtttcctcccagagtatctcacctggaccctccccatcattatcggctctgaattcattttcttactgcacagctcagttaatagctcactatcactcacaaactttccatggctccctagtacccgctgaaccagcctaaactgaacaagattgccatgatctgacaccaacaatcttatattcctataccttctgctcccatgaaactgaacatgtcatgccccagccccagacatccccagcagattttttcctgcataaccttagtttgcacaatgaatgctacctggagagccttcccttgtccttcccccatcgatgctattgcagtctgtgtccattagacacctccaagacccagacaccaagatgggattaggcatgcaagagattttttgaggaaacacccaggaaagataaagaggaaggcagcaggactaggcagggacagctttcagatcgaggtgcatgcctgactcctacaaaagaagaaaggaaggcaggctcagccatgctgactgggaatcccagcaaaagttgcctgttggaggagtcgcttgtcgggcggttcccctaccacgctcagtcattggctgagagcagccagggggtggatgttaaaatcacgatagatccaaaggtgcaacctggaggctgctggtcagcaaagcatccacagcaggttcccttgtaggagctctgagcaggacacttgtggctgtcacacggccctgacatggctcaggagcaacctggtgtcacgtgctccttgaagcaaccctgacttcccctgctagaaatgaccttgcatttttggacacccctggggctttttgcctttgcctcccttaatgcaccccacattccaccacagttggcttccttagatatgcctcatcttacccaccgcagctcactggggcagatgacccacccactcactgggctgttggtgaccagcccacatttcctccacccatagcatgtccctgcacctccaactggcaacccctctgtgcctttgcctgaggtctttctctggacccgagcccagctgcgcatgaatgcacagggcattcctagctggaaatccaggaccagtcccctgtcagtgatgaatgggagctggtggataaaaactcagatccccatcaataaaaacaaatccggactcagtaaggagaggatttattcaaaggattattgcagggaggcaagggatgttatctccctattattgcaatgggatgaacgctgtgaccataagatctgcaagcatctcaaggttaggcaaggagagtttccttttatagagaagtaaataagggaaagtgagatgaaagagtggcatgatcagatagtagattggagaatgctctaccctgaagccagtctctttccaaaagggacccttaaggaggggctgtgctggtttaggctgagggtgggccaaagtccagggacctgggtgaaggagagaagcttaatcaaagtttggttaagatgcattttgtcagccaggcgtggtggcttacacctgtaatcccagcactttgggagtccgaggtgggtggatcttgaagtcaggagttcaagaccaacctggccaatgtggtgaaaccccgtctctactaaaaatacaaaaattagtcgggcagagtggcaggtgccagtattcccagctactcgggagactgaggcaggagaattgcttgaacccgggcagcagaggttgcagtgagctgagatcatgccactgcattctagcctgggtgacatagtgagactccatccactcactgcctcaccccccgccaaaaaaaaagatgtattttgtcctgatcaatcagtgaggacaagcagtttttgaggcaaagaagggaatttgtgcttctggccttgtcacaggtgaacaaagcagacctctgtgagtcttttctaagtcctatggggaaagggcgttctttgcaataagctgttttccagaatgcagaagggctgggggactcctaaccttcactgttttccaggatcacagggcttgggtaaagtttaacattgtctcagataggaaaatgctgaggcatgttctctatgcggtttcccagatcccagtgggagttaccagttccttacagtggttactcgtttgctccacaccctgtattagctgccctcccttctctaattcccctgctcccctgcctctgtttcctgaaatcacttcccaaaaaatcattttcactggaatctttttgtctcagggtctggggtaacccaaactaagacattcactaaacctgagactcactaaacctgaagtcctggactcagatgactgagggaccaagagatcacccataaatgaaaggatcaagtaggagctgtgctgagctggggaccttcggccctgtccatggaggggtcaccattcacctgttcacaggatcagttgttcccatgggagaatgcaggatcagcataattcgatcttttggtttttcaaataaagccaggaatccacatttataattggaataacctaattcttaaatataggcaactaatcaattatttttaatactgaaagaaccaaacacaacccttctgggggtagattttgacccaggcctacaggtcactggcctgtgacccaaatcttaagctccctaaaagtaagtgccccgggctccttcctctttgaggcgccttgccatgtgaatttgcagacagcgatggttacatgcctaaggttaagaggctgggggaaccagtccatatgtggcaaaatcaaaactgagtcctataaatcttcctttggggccttttccatcatatcatcacttatttctttatatttttattttttatttttattattgatttatttatttgtttattgagacagagtcttgctgtgttgctcaggctggagtgcagtggtgcaatctcagctcactgcaacctctgcctcccaggttcaagcgattctcctgcctcagcctcctgagtagctgggattacaggcgcatgccacaacacctggctaatattgtgtatttttagtagagacggggtttcaccttgttggccaggctggtcttaaactcctgacctcagtgttttaagatgatccgcccgcctcagcctcccaaagtgctgggattacaggcatatgccaccgtgcctggcctcatcacttatttagaggggagattcaaataattctgaattcttaagtttgttaggagtgataatcggatcacggttatctaggaaaatatcctcttttttgtagatgcttactaaaatttaggggtgacattatatatttccacaacattttttaaaagataaaacaaatataataatagttaaatccaggtgatgaaatatgggtagtcattgtataagaatattctctacttttctgtgtgtctgaaaatttcataatataaagtggggcatttggaggaagtcttgtgaataatgaagttcccaagttcaagggacgtgagaacggccatccacttctgatggtgccagggggctgcaggggtgtctggctctaggacaggagttgttgacttcagggagttgttgactttagtgtcctcctgcgggccctcaggagcagcctggtgtcacatgctccttgaagcacctcctgtgggccggttgtacacgcggtgagagggtttctctttggccttttccagacacagacagctgtgagcgctggatgagctgcaaaagcgagttcttaaagaagtacatgcacaaggtgatgaatgacctgcccagctgcccctgctcctaccccactgaggtggcctacagcacggccgacatcttcgaccgcatcaagcgcaaggacttccgctggaaggacgccagcgggcccaaggagaagctggagatctacaagcccactgcccggtactgcatccgctccatgctgtccctggagagcaccacgctggcggcacagcactgctgctacggcgacaacatgcagctcatcaccaggggcaagggggcgggcacgcccaacctcatcagcaccgagttctccgcggagctccactacaaggtggacgtcctgccctggattatctgcaagggtgactggagcaggtataacgaggcccggcctcccaacaacggacagaagtgcacagagagcccctcggacgaggactacatcaagcagttccaagaggccagggaatattaaagagactgggatgaggtggaggacgctgcctctggttctggagcacacacgtgctgcactgacgtgccgactggcgccgagaccttcatagctgcggtcgtgtatatttgtatataccacatgagtatttctcatacattacgctaggggcgtgtgccacgcccaggggactgccttgtgaagccgccctcgccatctgcagagctccttgaaagtgcccctggggagcgatgtgggcagaaggatggggacaacttggaagccagaagaagaacctggaagccacagtgggtgcgactcaattcacacccggatccagagtttcaaagagaggcaaagggggaaagagactgaggttgtaaacgttataagcagtttttatatataacttatttaatacaaatgtgacttaattaagcgtaaccttttctctggagttgtggtgaaactaatcacgtctgtgagagatcagaaagaaagagacttagggaagtggaagagaaagggaattttggaatttatttctttaaaaataatgcaatggaaatatatcaaaacatgtaaacgcccaccttaaaccaaatgttatttggtcatgaggcaccttgctggagtctcagattccaaaagtctcttcttcagactgggtagggaatatgatattttagggacaaagctgaggactggttttaaataggctttaaaataaaagatcaatattatcataatgctatcattctgctaaacggccccaaaacagtagaatttctgctcatgtcctagcaggttcagaagactgcagccaagttcagatgtaaaaacaagaagtagcacttttccaaaggaaaacaacaaaacaaatgggaaaaagataatggaccgcatttcacctattttaatactattttaacaattttttcatctaccaatatatccccaataaataaatataaaagggggggagggtcaatctggggaatcttagttttttatgttttaagaaaacaaaaaaaactgcattatttttgtaaagtatttattgagtcacggattattgtgcatcaagcaattgttaatatgacctggtcctatggggtagaacttaggaaaaataaagttggttcttattcaatattttactttgcaaaattctagtaaaagagagtatataataaaatcataataaaaggtgttacctgcatccttcatttatgatacaaatgccataaatagcccgtgtgaagcaagacttcaaggcaggggaaagaaaatttcaacccaggtgggaataaaaggctcattcattgattgacatgattgtgggtggtgtaagtcatggcatccttggcaccaaaatcgtctacccaacccccaggaggctgaggcccattgacacatgtgtgactttttgcccgcccagacctaaggaagccaaaccagagcaaaggcttaagacagcccagatgagcagggccacttccacagaaaattctgcaattacaattataagtagaactactcatcatgaaaagtattccttttcccgatgagaaaatcaaagctcagaaaacataaagacattggacccatctttcatttcctagcctagtattctctctactgtagcacatttttgaagtccttatattcccggtacctttggcattcctaaccccacccttaagttatcctgacacaattctattcttatggaaaactttttaccagtcatttacacattttttttttgagacagtctcactctgtcccccaagctggagtgcagtgacgtgatcttgactcaccacaacttccgcctcctgagttcaagcgattctcgtgcctcagcctcccgagtagctgggattacaggcatgtgccaccacgcctggctaactcttgtatttttaggagagataaggtttcaccatgttggccaggctggtcttgaactcctggcctcaagtgttctgcctgccttggcctcccaaagcactgggattacaagcatgaaacaccatgcccagacatttacaccttacaatgaattatttacaccttagaaggtattgcccattctcagaatatttatatttaagatctgtgtctaatcacggaatgagaagacttattcacatctgaagcaattttttgctacagatgaactgaactagtaggaagagaatcaatgcgtccgtgtatcaggcatatagatttggtttataataatgaggaaattttttttgcaaagagaattggctggcaatggaatgcattgcctttgaggtggtgagtatcctgtcaggacaggtattcaagcagaggctggagattagtcacatgaacagctcaactgggtgatcaggagagacaaaaatgtataggacaaaaccctctgatgtgtttgttaagtgtaagcacaaagtactatgaagaaatagaggcagaaatcagggaagtatctgttggttctaatgaaggagtgggattttataaagcataaaagagcaaggggaagtgggtgtatttgtaataagaaaatagtatggagaaaagcaaagaaataggtaagtacttggtgttttctgaaaaccgggagtttaaggtgatgagcagaggaacaagagtggcaagttatggagccatgtctaaggtatttttgttaaggatttagagtgaaatctcaaagagaacagagagctttcttactacggtgaaaatgactaatgtgagccatgctgtccatgagctatttgccttttaatatcagaccttgctgacctaatgaactgagagttggaaggtggggtaaattggaggggagggctccaggactctgcctactgagaacaccctggtctcccatgcatcatcagatggttccaaacctctggaaatttgctgaactataatccacctctattaggatgagctaattttcagtcccaatgctttagtgggccaatgagtgatcttcggaaatcaagacctcatgcctaggttgtctaataagactaggagacccttatctcattcaacacagggccccaagctggtgccagggcaaccccaggcagttcactcagtgggcagtagatcatctgctcaagggccagctttgcctgcagcagagtaaggaatgagcaaggccacttccacagaaaattctgtggaattctaaggaatgtctgcagtctcgttgcagtccttgtaaatatgaccccgcagtagctgctcaaatttttctctttgagtgcactgctcttttgccttcccctggaaagagagttctagtaattcagtgggcatcctgggtgccacatctgaacacaacagtggtaaacagagatgcccacggccctctagtggctgcacatgggaagggtaaaggagaggccagggcagcctatagctttctcttcggacccagttcatgtaaccgccatgattatagtctcccaagcacctcagtctttatgtcttagtggccaagagggtagagttctctgtcttaacgccggggattaaagaacagctactatacaagccaccatcttctgagcccacactttgtgtctctgtgttaatcattttaccacaggagaccggcattattacatccagtctatagataaggaaaagaagcccaacaaggttagctaacttgttcaaggtcagaccacttggtaaatgacagagctccttgaagccagcagtgtctgatcaccaaagcccaggctcttaaacctaacgcctgtgctctcctctcctcctaactcatcccaaggtctgctggatccatgcttttctgtgactcactgcctttgcttagattgttcaaagaggatctggctttatctctatgtattttgcccagttatctcatagtccataaaaggattttgtggttctatagctgagcccttgctcaggttgggtaagtcacaaagctcaacatttctaaaagatagcctgatccatgggtgaaaacaaagatgggtctgcttttcccaccacacataagccctgtgctaactgctgcctgttaggtagagctcaggggcaacataacaggcacctaaccttcctacatgcccaggttccagcactgcacctggcatgcatagtcaggcaatgtgcagagggcttaagagtttgagggttcagtgggcctggactccaatcctgactctctcacttgcctgctgggagttgtcagacaagttaatacattggcatttagtcatttgccaaatatttattgagcatatacatacgccagataccagggatacagcggtgtacaaatcaaagtccctcctcttggaggggagatagtggataagtaaataagtgcagaatctgagattatggtaagtgatataaagtcaagtttttgatcacacatgtatgatgttacattatttaaggtgatgctggttgctgtaacaaataatcctcaaaatcacagtggcttaacccaaaaaaactctaaagagtatgtttctagccaagtggcccacctctaagtgacaacccagggacccagactccttccatcttgtggctctgccaccatcaaggtatgactttctaggatgccctggggtcatctcaatcccagtctgttcaaaaggtagaaagcagggagaaaacttgtaaagttttttgtaggttcagcagtgaagtactgtccaatgcttccagtcactctcctcagctctgctacatgacacatccttctgcaagggagactgggaaatgaagtccagatgaggggtccaggaagcagagatggctgcatgagcacccagtcagtctctgccaactacccaatccacaagacaggaaagaaaggcagcagaagaggctctgggtggaatcaaagtgggcggtcatggggagaggtccttctcactcccccactgtcttccacattgtactatagtgctaagctggaccccattttccttgtctataaattggggtaagtccacctgtccaaactacccattgtccagtgcttttgctgtcccaagcatcccctcagcactttccatatctgttcaaaccagcccaactttcaagcagcagctcccacatgtctttgcctgatggctttttccatcatcgtggagcccagtgagcttgcacagaagactggaagtgctgggagtcaacagactgagtgcctgtcagtcaactgtttggtgatcttgggggaatcagtaaacccataagactccactcattggtcaatgaataccccaactccctcacccctcgagtggggccattgtgaagtgtgttttataccagtccacgagctcccagtgggattgagttccagttgcctatagcagtcacctacttgaaaacacacactttattagcttccttgccttccccatctctcttccccacttccctactagtactcgctggaatcttctaccaaataagcagcttgctcagcgccatctctcagagtgtgcttccaggggaccccaaaccaagacatcacttcacgcttaaatacttattaagtgctattcaaatattattgttaatatttgatatttaatatttgataataacatagtattatttgaatagcacttatttcattgtgcacatctgaagatggttttgctatgggtgataaatctaccaaagaagagtcaatctcattctggccagagacaggaactctactagattttaataccgttgagttgttaaaaaaaaaaaaaaaaaaaacccttaatttttattattagattcaacagacagaaaattaatctgccaaatgcctctaacatttttaagtacttttccataattttagaattaatttccttgctgactacagacccgtactactctgaggaccacacttggagtgggactgctcaaatcaagtgagcaatagtgatcaaaacccctgtgagtgtcaattccatcccgacacacaaagagttatgaataagcttcccaggaagtgttgtggggcggggattagggcggagttctctgtttgtcattcatttacaatttccaatggaaaaatgtgtgggtcgtcccattatgcctgcacaatttcggacaaattaaaggcttgcctcagtaattactgggtgggtatatacagaaacatacatccatgtctacaggtcctgcatacagtagtgtaaattaaggcagaaagtttacagccagttgtttttctgaggcttagtattggtttaccatatgagagtagaaggagagggacatattccaggatcagaaggtaagatttttaaggaacgaatttatgagactagcaattcttggttgaatcccaccaaaagaacaaagtttaaatgcataccttttttctttttaatttctgtgtagagatttaaaaaaccaagctaaaaagaccagtgccttgcctgtaatggcaaaaataacatcatcctcaaccattttagtggcaggggaatgagtggggcactggattgagacacagctgcaatagcaaagctgggtaagaattttatgactttgctaattttctatctgttctgggagtaataaatgtgcccttatagatattcacgattgccctcaaaatgaaaaaaaccttttaaatggcacagaaaagcctttcattcttgaggcatgtaattcatggatgattttcaaaatgtcatatttgaattgggaaagtaacatttcttgaattaatcagccaattgcttcaagaatatgactcaaaggatataaaaatttcaagcctgacttttaaaaaagaaaaaggaattttttttctatgttgtttagtttatttttcacaaaggtcatagctaaatcaggtttatttgccatggaagagaacagtctaaatgaagtacacttttagttctttagtaaaagggaatgttagcaaattttaacaagcaccactttaaatttttacaccattagacatgcggttttgctttgtctagttatacccttctttatttccctctctaccagattttggtggtgttttttgtttgtttgtttgtctgttttcacctttggagagctcagcaaatggagaaggagaaaggacaaaaaaaaaaaaaaaaaaaaaagcaaagaaaataaaacaaagacttccaggacaaaattctctaaggggcctctaaagtcactcactctctgtgttatcaacataagtaaagggaggtctttgcaaagggaagacaagagagactcataccactgacttgacttttcccaaagaaccttcaaaaatcctcccttagagctgtcaggacccagcagagaccaggaagggattcctaaaggtttgaagtctcagagccaagggatggggactctggtcaagaaagaacgaggtgtcccatgctggtggctacagaggacagaatctcctgtcaagaacatgtcaggatcctcacctggggatcctagagagtggagcccaaggccacctgctctgtgtttcaggaaaaagaccacatttgaatccctcttgagggctccctcctgctattacaggatattggagggagagagaaagaacaaaagcagctgatccagtgccagaaagataaaggcttgttcacactactcaccagcagcaaatgtataaagctgaagcttaacatcaaactcactttctgttccactcttcactatgtctacacagcaccattccagtcaacctccccacagcattcctcccatcccctcggccacacatttgaccctcttatagccaattggccatcctttgggccagtctttttcaaaatacttttggaacattttatggaagtagtacatacattcagaaaagcacacacgtatcataagttcacggctcaatgaattttcacaaagtgaatacacccatgtcaccaacatccataccaacaccaagaaaaaacagaatataaggctcatgaaggagctctctggggctacagaaatgttctatatattgtgtggtttgattgtcaaaactcactgaagtgtacactttttaaaaactgaatttctttgtatgtaaattttaccacaacacaaaataaataaggcaaaaccagcactcccatgcccccgtccagtaacgggcactcactcctcaccaagaataatcagtatcatgaattttacaccagattagttttgtctgattttgaccttcgggtaaatggaatcgtacagcacccgctctgtgaggtctggcatattttgctcaatattggattgtgaaattcttccatatcgctgcttgcagctaaaggtcattcatgcttatcacatttccaatgtgtgaatatatcacaattttatttaacagttctaccatggaggaacatttggattgtttctagattggggctttcacaaagagtgctactatggacagtccagggtgtgcttttgggtgtgcgtattcacacatttccatggggagtggaattagaaggtcatagggcatgcacagctttagttgatactgcccagtagttttccaaagtggttgtcctggtggacactccgtttaggagtgtttgaaagttcccattctttagccaatctcaatttcacccccttcactgtctttcctgactactccactctgtgatctcttaattatttatgtttaactcaatacgtgcatactgagccccattcactgtgctgcgtgctggggacacaaaaaggaatagacaggaatccatcatcaatgaatgaatggcccagtgggggtgtctgtaacacagtgtgaatctgatgtaactcagatgcttgtaatacaatgtaaatggtaccatgggaccaaatgagggtgtgattaattatggcagtaataactagtgagccagaatttatacattattatttaggaaaataaacccaatgattccaagtcttggcaaggcgatgaggaaacagaaactcttaccatcaccgcttatggtgttatgaattgaacagtactttgcctatatctagtaagttgaatctgccacatagctggatgcatcagtttcactcctgagggcctgtttttgtattgtcaaaaagtggaaacagtttaaattgtccaccaacagaggaacagacaaatcaaccatgttaagttcataatagagaatacaatccagctgttaaatgatctaggctattcgtattgtcaaaaatgtgtctatactgtctgaaaaagaaaattacagatggatgcatgttaggtacagaacatttgtgttcccccaaaatttaaatgttgaaatcctaacccccaaagttatgatattcggaggtgcagcttatgggaggttattaggtcatgagggtggaacccacatgaatgagattagcatccttacaaaagggaccccgagagagctctcttgccctctttccaccatgtaagcacaaaatgagaggtcagcagtctataaaccagaagaggactctcagcaaaatctggccatgctagcaccttgatctcagacttccagcctccagaaatgtgagaaatacatttctgttgtttataggccactcagtctatggtagtttgttgtatcagcctgaactgactaagacagtatatgaaagtagtatacaattttaataatttaaaactcacaatgcaaggctacattatatctggacaccaacatacataataaaaatactaaactatgcatgggaagactaagcaccaacttcaagacaatagttacctctgagatgaatgacagtgagtgggtggaggaggggatactttagaggtaacattttatttctttaaaaaaaaaaagcctaacagaataaaggacaaaacattttatgctcatctcaagagatgaagagagtatttgacaaaattgaatattatttcataataaaaactctcaatgaattaggtgtagaagaaatgcacctcaacacaatcaagaccatatagcacaagcccacagctaacatcatactcatcagtgaaaagttcattaaagcttttaaccatcagtgaaaagcttttcctccaagatcaggaacaagacaagcatgctcactcttactgcttatattcagcacagttctggaaatcttagccagaacaagtaggcaagaaaaagaaataaaaggcatctaaatcagaagacaggaagtgaatttatctctgtttgcagatggtattatcttatattcagaaaatcctaaaggctccaccaaaaagctgatagaattaataaacaaattcagtaaagtcataggatacaaaattaacataaaaaaatcagcaatgtttctataagcaaaaaaactatccaaaaaagaaatcaagaaaacattctcatttacaacagcatcaaaaaaaactaaggatgaatacatttaaccaaatggatgaaagatctgtacactgaaaagtataaaacatcaatgaaagaaactgaataaaaaataaacacttgaaaaaatactctgtgtttacggattggaagaatttatatcacaaaaatgtccatattacccaaagcaatctacaaattcgatgcaatccctaacaaaattctgatgatatttttcatagaaacataaaaaacaattccaaaattcatatggaagcacaaaaaatactaaatagccaaagcaatcttgagcaaaaggaacaaagctggaagtataacactatatgtcaaaatatactacaaaggtgtagtaatcaaaacaacatgatactaacatataaatcaatggagcagaatagagagctccaaagtaaatctacaaatttgtggtcaactgatctttgacacatttgcaagaacacacaatggggaaagggtggtctcttcaataaatggtgctgagaaaactggatatccacctgcagaagaatgaaattggactcttatctcaccccacatataatagtcaactcaaaatggattaaagacttaaatataagacctaaaactgtaaaacaactggaaggaaacaggaaaaaaaatgtattgacattggtcttggcagagatttgtctcctgcccaaatatgtaggcaacaaaagcaaaaataggcaaacgggtttgcatcaaaggaaaaaggttctgcacagctaaggaagcaatcaacagagtaaagagaaaaattatgggctgagagaaaatacttgcaaaccgtacatctgatatggggttaatccgaaatacataaaaaactcaaacaacttaacagcaagaaaacaacttgattaaaaagtgagcaaaggacctgaatagacatttctcaaaagaagacatacagaaggccaatggatatatgtaaagttgctcaatgtcactaaccgcaggaaaatgcaaattaaaactacaataggatattacttcatacctgtaaggaagatgtttatcaaaaaatataaagaggccaggcacggtggctcacgcctgtaatcccagcactttgggaggctgaggcgagtggatcacctgaggtcaggagtttgagaccaacctggccatcatggtgaaaccccatctctactgaaaatacaaaaattagctgggcatggtggcgggtgcctgtaatcccagctactctggaggctgaggtgggagaatcacttgaacccgggaagcggaggttgcagtgagctgagatcatgccattgcactccagcctgggcaacaagagtgaaactccatctcaaaaaaatagatatagatagatgatagatagatagatagatagatagatgatagatagatagatagatagatagatagatagatagataataaaatatttgtaagaatgtggaaaaggagaactcttgtacactgctggtgggaatgtaaattgctacagccattatgggaaacagcatgaaagctcctcaaaaaattaaatatagaactaccatgtaatctagcaatcccactcctgggtatatatccaaagaaaattaaatcagtatgtgaaagagatatctgcatcttcatgttcattgcatgattatactcaatagctgagatatgaaatcaacataagtgttcatatacagataaacaagtaagggaaatgtggtatgttcacattatgagatgctagtcagcttttaaaaaggaagaaattctttcatttatgagaacatggatgaacttggaggacattatgtttagtgatataagtcaggcacagaaagacaaattctgcgtgatctcacttatatgtggaatctaaaaaaatcaaactcataccagcagagagtagaatggtagtaaccaggggcttgggaggcgtaaaggggtgtggaaaggggaaatgttagttaaagtgtacaaagtttcagttaggagaaacaagttctggagatttattgtacagcatgatgactgtagttaataatctattacatacttgaaaattgctgagagtctattttaaatattctcaaaaaaaatgaatgtggtgattgatatgttaactagcttaattttcccacaatgtatacacatatcaaaacatcacattgtacaccataaatatagacaattaatcatttgtcagttaagaattaattaacttttttaaaagaacatatatatatcttaaagtgttgatacgagttaaatctgagtattgggtagggtacaactgctacgttatcttctgtatatgtgatatattttaaaccaagtaccaaaagtaagcaaaactaaaagggaaaatgcaattatgctgtgagtttagatgggatcctacaaagccatgcacatgtgagttcacagccggcatatgtgagttcacagtcggcatgtgtggccagtgtatgtggccgtgatgggttgaatatggaaatgtcgtgggtgagacatccttactcactcactcacaggtaatgaagccactcctaccagccttgctggttcctccaagagatgcagagaggcacatcctgcacaacgccctgcaacttctcccttcctctccctcatgcacagtctgagataaacagagcactagactcggaaccatgttctaaattcagcatttactggacaggaggcctcaaacaagtttcacagccctaatgagtcgcagcctgctgaatcacaccttccactctctcctgctctcctgcctctggggccatgacagtggactgaagggagccaaggagacataataagaaagcaaactatggggcccctggctcccacctccagctgaaacacctactttgtgctactctgggaaatcatcacacttagtcatctttacaatttttacaaatgaggaccctgaagctcagggagtgggcttgccatgatcacaagagtagatccgtatttaaacctgggtatgtctgactctaaatccatttcttcttttccccactttttattcaaatgtggaaatggtatctttgatttcttttgttccctctgcttcaccttacctacaccaaaggagcatctgggtggggtgtggaggaagtaaaatttgagcctcatctgcgcatcttccaaattctagcaggtccccctcgagctaaaaggcattttttcctgatcttcaccagtcagttcttctttgggccccatcccaccaccttaaccaatgactcccgcatccaggtctgcccacagatcccttctacagcctccccctgaaaactaattgcagattattagaactttggcttccattccagtgtggaagaagccagaatttaacactccatcctaacaatttccccccacacgcacctgttaagtttagcctaaggctgcctccttacacattttaagttcaacctaaaggtttctctgcaaatagtgaagtgtaacctaactggatgtgtaaacagactgtagcttactcttgtgtcaatcacagaattttggccaatcacaggcagccaactattcaaaccctgttcaaataaggtaaacacggagccgtagtcaattgggctgtttctgcacctcacttccattttctgtacaacactttcctttttcttccaccacacagcagggctggagtgttgctggagtgtctctgagcctattcgggctcgggagactgcctgattttgcaaatcattctttgctcaattaaactctgctaaatttaatttgtctacatttcttcttttaacacaccttaccacatcactaaagtcctattttaaacagctccttttaccaatatatcatgtccagctatcaagaaaaaattataagacatagtaaaaggcaaaaactacagtttaaagaaacagagcaagccatcagagccagactcagatatggcagggatgctggaattgttaggccaggaatttaaaacaacaaggattagggtgctaagggctctaatgaataaagttggcaacatgcaaaaataaactggcaatgtaagcagagagataaaaaattctaagaaagaaacataaaatgagatgctaaagatcaaaaacataacagaaatgaaggatgcttttgatgggctttttggcagactggacttgactgaagaaagaatctctgaacttgaagacatctcaatagaaaccaccaaaactgaaaagcaaagagaaaaaaagactgaaagaaacaaaacagaacagtcaagacttagagacaactatgaaaattgtaacatacacataatgggaatacaagaaggagaagaaagagcagaagaaatatttgaaataataataacagaatttccctcaaattaatggcaaacataaaactataaatccaggaagttcagagaataatgagtgggataatgccaaaaagaaaaacccctacacctaggcatatgatttttaaactacagaaaaacaaagaaaaaattccaaaagaagccaaagggaaaaaacaccttatctataaaggagcaaagataagaattacatccaccttctcctcagaaaccacataagcaataaaagagtggagtgaaacatttaaagtattgagagagagaaaaaaaaccacctagatcctgtgccctgtgaaattagacttcaaaagtaaaggagaaataaaccttttctcagacaaacaaaaatggatggaatttgttaccagtagaagtgccttgcaagaaatgctaaaagaaattctttaagaaaaaaggaaaatgataaaggtcagaaactcagatcttcataaaaaaggaggagaatcagaaaaggaatagtgaaggtaaaacaaagtctgttatttttctctttcttgattgatctaacagataacagtgtgttcaaaataataacagcaataatttattcaattatgcacatatctatatctatctatatgtttatacatgcatgtatgcttatgtataagtgaaatgaattccagcaataatacaagggatgagatggaagaattagaattattataaggttctcacactatccatgaagtggtacagtgttatttgaaagtggacttggattagttgtaaatgtacattgcaaaatctagagcaactgctaaaaaaaagtttaaaaggaagtataactaatatgctaataaaggagagaaaatagaatcacataaaatgctcagtgaaaaccacgaaaggcagaaaaagaatggaagacaaaaacagcaaaaaacaacaaggacaacaaataaaaaatagtaataaatatgataggtattgatgtaactatatcaacaatcactttgaacatcaatgacctaaatataccaattgaaaaacagaggttctcctagtggatcaggaaacaagactcaactatatgctgtctacaaggaatccactttaaatataaggccacgtagaaaggtaagtgtttgcagaaacatgttatgcttgcaccaatcaaaggaaagtagcagtagctatctcaaacagagtagacttaagaccaaggaaagttatcagggataaaacgagttgttacgtgatgataaaaggatcaagtctccaagaagacataacaatccttaatatgtattcacctaataacagaacatcaaaatacatgagaaagaaactaatagactgcaaaaagacatagatgaatccattatcatagttacagatttcaataccccaacatccctcatagttgaactcaacaacacaattaatcaactggacataatggacatctatagcctacttcatccaacaacagcagaatacactttcttctcaagcttatatgaaatattcaccaggacagaccacatactggaccataaaatacaccttaaaaaatataaaagaatagaaatcatacaatgtccactctcagaccacaatggaattgaactagaaaacaataacagaaagctgaaaaatcccaaaagcttacagattacacaacatacttctaaataacacatgggtcaaagaaaacatctcaagacaaacttttaaacactttgaactaaatgaaaatgaaaacacaacttaccaaaatttgtaggatgaggcaaaagtagtgcttaaagggaaactctgaaaaggtaaataaattcaataagcttctgcgctggccaactgtgaataaaagagaaagggtacaaattactaatatcagaaatgaaagagtggatatcactacagatatcatggacattaaaaggataataaaggaataccatgaataactctatgcccacaaattgataacctaaatgaaatggatcaattcctggaaaaacacaatctgccaaaattcacacaagaaggaacagacaatctgaaaaggtctatatctattaaggaaattgaattgataattaataacctgtcaaaacagaaagcactagcccaggtaggttcaatgttgaattataccaaacattttaaaaagaaattatttcaattctctacaatatctttcagaaaatagaagtagagggaattattattaactcatcctatgagagcagcattatcctattaccaaaaccagacaaagctattacaaaaaaagtactgaccaacatatctcatgaatattcgtgcaaaaatcctcaacacaacattagcaaatcaaatccagtaatggacaaaaataattatgccccatgaccaagtgggatttatcctagatatgcaaaggtggctcaacatgtgaaaattaattaatgtaacatatcaactgctaaaaaagaaagatcacatgatcatagaaacagatgcagaaaaatcatctgacaaaattcaacacccattcattataaaaaaaaaaaactttcaatgaactaggaatagatgggaacttcctcaacttgataaagaaaacctacaaaacacccgatagttaatacttagcggtaagaaactcaaagctttcccactaagattaggtacaaagcaaaaacatcccttctcaccattccttttcaacatcatactacaagtcctatctaatgcaataagacaagaaaaagaaataaaagccatatagattgagaaggaaaaaaaggaagaaataaaactgtctgttcatggatgacatgattttctatgtaaaaaatccaaaacaatcaacaaaaaatctggaattaataagcaattatagcggcattgcaggatacaaagttaatacacaaatgttcattgctgtataccaacaatgaacaagtggaatttgaaattcaaaacacaataccatttacattaacacctcaaaattgaaatccttaggtataaacctaataaaatacatacaagatctacaccaaaaaaacaaaacaaaacaaaaaagctacaaatctctgatgagagaaatcaaagaagtaaataaattgagagatactccatgttagggaggctcaattttgtcaagatgtcagttcttcccaacttgatctatagattcaaggcaatcttattcaaaatcccaacaagttatttcatagatatcaataaattggttctaaagtgtatagggagagataaaagacccagaatagccaacaaaatattgaaggagaagaacaaaggtaaacgactcatactacctgactctaagacataatataaagctacagtaatcaagacagtgtagtactgacaaaagaataggcaaatagatcaatggaacagactagagagccagagaatagacctacaccaatagagtcagttgacctttgacaagggatgaaagacaacacagtggagaaaggagtttctttaataagtgttattggaaaaagtgagcattcacatgcaaaacaaatgaatctagtcacagactttatacccttcacaaaaattaactcaaaatgaatcatagacctaaatgtgaaacataagattatctaaaagtcctagaagataacataggagaaaatctagatgaccttgtgttaggcaatgactttttaggtacaataccaaaggcactatccgtggaaaaaaaagtgttggtaagctggacttcattaaaattaaacttttttgttctgtgaaagacactgtctgcatgaaaaaacaagccaaagactgggagaaaatattttcaaaagacctaacagataaatatccaaatatacagagaaccctaaaactcaacaataagaacacaaacaacccgattctttaaatgtttctgaggacacttgaaaaaataaataaataaataaataaataaaaatgagccaaagactctaacagacacttcaccaaagaagatatacagatggcaaataagcatataaaaagatatttcacatcatatgtcatcagggaaatgcaaattaacacaacaacaagataccattagaatggccaaaatccaaaacattgacaacatcagatgctgacaaggatgtggagcaacaggaattcttattcattgagaatagtgagaattcaaaatggcgtgaccactttggaagacagtttgatgtttgcttatgaaattaaacgtacgcttaccataggatccaacaattgtgctgcttggtatttacccaaaaaacttgaaaaattgtgtccacacaaaaacaaaaaaacctgcacacaggtgtttatagcagctttattcataattgacaaaacttggaatcagccaagatgtccttcagtaggtgaagggataaactatatcttattagcactgaataatattccattgtctggctatccagtgctaataagtgctggctatccagtgctattcagtgctaataagaaatgagccgtcaagccatgagaaaatattttttgaaactcagtgaaaaaagttaaagaagccaatctaaagaggctacctacactatgattccaactacatagccttctagaaaaggcaaaactatgaagacaggaaaaagatcaatggttgccaggggttgagaagaggaagggataaataggcagagcacagaacactttcaggacagtgaaactatgctatgtgttactataatggttaatacaggtcattatacatttgtccaaactcatataactgtacaacagcacgagtgaaccctaatgaactctgggtgataatgatgtgtcaatgtaggttcatcagttgtaacaaatgcatgactctagtggaagatgtcgatagtcagagagagtatgtctctatgggggcaggggatatttgggaaatctctgttccttctgttcaatttcgttatgaaactaaaaatgctctgaaacaatagtctattttttaagtgactattaggtagaagaaaaaaaaaaacactaattgcagaaaaccaaacaaggcaaggccaactagactatgagcaactgctggctcctgctgcatgaactagacacttatctggtcacatgtgcctggcagcccgggtatttctactgctaatcagaaactggaagttattgaaaacagagctcagagacacaggacccactgagtcacattgcatctgagtttcacagaggtcaagggttgaggaatgatcctgacttaatcctaacaggtaacagtcactcggagagtgagagaagggagctagataggatatagatcagagaaaagagagaatgaaaggaaagaaagacaggcaaaatggcagctcgtagaagtatatcccacattctatctcctttatttgtcaaaacaaacaacaaaaaggattggtttccagagttctaaggttgctataatgcctaaagaaacatgggttaagttttggctacaggaaaatgtttgtatctatttgaagattaaccccctcccccctgcacacacacactctagagggtgagagagacgtggggacagccagccaaccttcttgtccctgggcctgcagcagcatcagggcacctggtgtggagctgtggctggaggctgattagaggaaggaggctctctaaccagctcaggtcctgcagagattgtgagggctcttctgggaaacagggacagggcagcaccaccagcatgacacagaaggaagaaagcacaggcagttctgaaaactccaccgaagggttgggggctggagagtctgcactgcctgctttcaggaagtgacccaacaccccaaagtcagaaactggggtacaccaggtgaagttgtagagaaagcaacaccagggtcccctcctgtgagaagcaatctatacctctgctggttataagtaagcaataaccctgctgaggggctcatgggtcctggaagagcacaggatgttgtctttttccctggaactaagacttgtattcatggaataggtggtagagtgtgagttgagcaaaaatacttcctaaattcccaaatgagttcagacctcattagcagagttctgtgtgatacattagctttgtactagaggagggatgttaaccctaaaagcattgacttcacactgtgcttgcaaaccaaaggacagaacttagagacaaatggtaccaaagtgctcaaagctgaaaacaagagaaccgaactctggttaatttaaaaagaaaagaagtataggacagatattaggtggctttagaaagacccaaatatataaaaccacatcaaatattaagggaggatgctatgtcaattaggataaggcttgacagcaggtgagagaaaaacaaagtaaccatggctcaaataaggtagaagcttattgctctctcattaaaaaacagaagttgatagtcccaggtaagtacaagttctgggtttcctcagtctcactgctccatatttctcttgaagcagtttccatttcatggtctaagatgactgtccaagctctagccatcacattcttatttcagctagcaaaaaaagagggagtgggaaagggcttcccagaagttaaagataccatttctttttacatcccattgactagaacgtagtcatatggccacagtgagttgcatgaggtgatggtggaaatcatctttattggcagagcacagtggctcatacctgtaatcccagtactttgggaggccgaggctggtggatcagttggggtcaggatttcgagaccagcctgtccaacatggtggaaccctgtctctactgaaaacacaaaaattagccaggcatggtggtacgtgcctgtaatcccagcaactcaggaggctgaggcatgagaatcgtttgaacccaggaggaggtgaaggtttccgtgagctgagatcatgccactacactgcagcctaggtgacagaatgagaccctgtctccaaaacaataaaaagagatcgtctttatctagaatagtcatgtgccccacataaaaaaaaaaaaaaaaaaaaaaagattttatgacaaataaagaagatgctgaaaagaaaattagcagttttgtccacaggggcctaaaccacatgaatactgatgacaattgtcaaaattcttacagctagtgtggtagaccagaaaccctctgaagcctgctgcctttctaggtaagaggggattgtcgcttggatccaaggggagaaacgctctaggacgttccagaattctggccccagaagcatctaaaaccctcattagcactgcaaggtaaacataatccttcctctgtctgcctaggcctggtgccttgaagcctcagcctgagcacagggacgtggtgtgttttcttcaccacttgatcctcggcttctagcccagggcctggcacacacagtgagctctcaaagacatgcttgtgaagctgatgaatgactgctacattcaactccctcccatataaatacataactatttttcacatgtatgtacatattaaaaagtagcgttgaattcacatcttttcttttcatgtgtattttactagggaatgtcgaagtgtgtgtagagacaggagaggcagcactcagattcttgggctagactgctcaggtttgactccctaattggctgcatgctagctatgtgaccttgagcaaggtacttaacttctccatgccttcgtttcttcattgtaaaatatgatcataacgatactgttgctcacagggttgccatgaagaattaatgagtcaacatttatattatggaaattgtgcatgtgtatcgcttaaaatagtgattggcacagagtgttcaataaaacaaaatattaaaagtacaagtaccgttttgcaaagtcattttttaatgtcgtaaagagattctcctcctgaacagagctgaaaagctgcaacctagcctagatgacttccaatttgacagctttttaggtccaagcatttcttaaaagtgctgtactcccaagagtgaggcagttcgtcatcttcaaaggcagtttgtgctgcatctcctgggtgtccagacctagcttaaagagatacgggttgttctaagagaaaagacacactcccaccctcttttcttggctaaggaacccagtgcagccactgactgtatttctctctccaactcttccacctgccaactcgcttgcttcatagcatctcagcagctgaccatattgcaaacagatcagtttcctttgatgccctggaccagacgaggtccatatgaggttctcaaacaaagcttttgctttgtttctaaacaacttaagaagatttcaaagaggaagacgtgctctattttctcaggatcccttttcctgctcaaacagaaagaaaagcccaagacccagggagggacccagtgatacagacagacagactttgagaaggagacaggataaggaatagctgcaaagcttagattacttcctaaaggatgggggtggaatatgtgatctttatctaatcagacagtctactcaggaagtccccgagatcaaagcaaggggctttttatttagcactgtgtcaacttgaaaacagtcctggcaaagccacagatctggataagctcacacctctccccacccccgctgccctgacctgtctctcagcatctgaactctcttaacattccatttagaataaaatcctgggttaaaaagagtccctgggattactgtaggaagagacaacatttgacaaagcaaggcagaaaacgccacagtccttcctgacttccagaacaattgggtgcatactctgggggaagacaccacccaggcattgtgtcacagcgtctcggaggaaaaataggaactaagagcaatcagaccacaacatggaatagggagggcaagagaacagagctacagtccccaaatattacttgctacaaagaataagagagtcggtagggttggggtatgtccttgtaaagcaggagaaacacattgaagaaatgtgttgaagaaaagacaggggcttgagaagactagggactggtccaaaggaagggaggtcacttactggaaacacaatgactcaggcggagcaaggcaagaaagttggaatcacactgcaaaggtagaaagagctcatcttcctggatgaaagactattgaaccgtggttcccataacccagtgtgttaccaaagagaaagaactcagccctattcctttcccaatgtaacttatatcctaccaaatccagtatctaccaaaaaacagataaatgcttcagtatgatactattcatatgaaactacgttttcttggccatttactttgttaggcaacatatagtatctcatttaatctttataactaccatacgactataattctcatttgataacctgcatttattcctttagacctgatttttcttatacatgtcatggactactcccagagttaattactaaaagaatgttcttaaatgagagtatttagtatttatcttggaaaaaaagccttcttcttcaatcccagaattttgaaatgaaggcttctttatggaagaataaactaaccaacagaaaatcattggtttattctttcataaatagatgggccaaaatatttttggtctcctctgaccaaaaaaattgttaatagcctgaatgataagaaatgcattctttcttgtgagtctttctgagtttctatttagttagctgcttttagggtgtgtgcttctctaagaaatgttatctatctcccttcctataaggacaacaacttgcagtggtgtgaaattattataagtcgagaagtatttgcagtaattgcttggtgccctataaaaacatactgtaactttcaggtactatccctgggacctagctgtgaaatcaactttcataaccctcacgaatgcttgtgtacctgtttacaacaagtggctgtttacaaagcatgtccccatgggttgtctctgactttcacagccccacctcacaggtaagggaacagaagatgacagcaaggaatcaattagcttaaaaattcacagagagttgtagggaacaattgccttgctagctgcaagatataactaaatgtgaggtgtgttttttaaatatgacttctagctccagaacttgtgcagcttaaaagtgataggcagtacccaaagatgcagaaaagaggatcttgtccacattttaggcaggggtgtagaatttaaatttacatccttacttctcactgaaaactaacaggtcttaattgtgattagatgagagacttttggaagaaactaagtttcagttggctttaattatgccttaatcatgctcatctatttcaaatattaaggaagcttgcactggaatgggtagaaagggctagaaaatgaaaaacaaaatgatgcctacaaagtgtcttcacaccgctttcaattttccaggcataatctcttcttgaggttggtgtcaagccaggtgtcaggaacagcacctagcaccactacagaaagcacctactaaacaaattattagatattacatacatttgaagctggaagcacgcttagaaataacctagtttaagtttcttattttctggatgagaaaattaaaccccaggaaggcaaagagacttgctcatgcagctgaagaaaaatacaaggatccctagctttgatgaccacattttaacaccatctgaatagaaaatatttgtttcttttcggcttcttatcctgttagtgcagctatttctctattgctgcctcaaagaaacaaatcagaatgtttctgtttattttataggtagtgttccaaccagggagctcctggatgcaaggaacagagagccactcgacctaagtgaccaccagagggtgcccacaggacagcccgacaaatggggtgaggtggggggatggccctggagtgtctcccttctcacgagaaacgcatgtggtatcacaactgagacttatcttttgttcccatcaagaagttagaggtctcaggtctcttctgaaatgcgaggttgcacatctgtattggggaagaaaatctgcaacacgtgccaacctcgtgcttaagatgtatttgtttcgaactcctgcatgcttgctcttctggtatctgtctccataaataaaatgggaagaaatatgtcactttgatttccacacaggcagaagagagttgtgattagatgtcatgagagggtccacagtttctgctacaggaaaggtgatagggggattataatattcacctttccccaacttgtttcctggaacagttacctagttgtccccagagaatcgataatgggtttagacaaaaaccctgtgttcccttcggaagacgaaattcctttcagaagaaagccagatccagaataatcaattaattccacctgtatcaaaactgtgacatgtgggtaatatccattcattccttccctttgataaactaggttcatccatttgaacctgatttttcttacatgccagtaattactccgagaactgactcttaacagaaaatttttcaagtataatatttgacatacactttaaaagaaaacattgttctttaatcccagcatttcaaaatggaggtttccttatgaatatagaacaccaatacacacgtcgaccatcaaaaaagtggtacctacaaagaggtagtcctatcttaccacctctttatagtcacatcttccacccaaccctcccaactccgggtaaccactgatctgttttccatcactacagtttttgaaatgtcatgtaaccagaaacatgcagtgtgttacctttttgtgagtggtttctttcgctcagcataaggcctttgagattcatccaagttatcatatgtgtcagcagtttattcttttttattgctgagtagcattccatgtatggatgcaccagagcttgtttatccactcgcctactaaaggatatttaagttgtttgtaagttttgggaaattatgaaaataattgctataaacatttatgtacagatttttatgtgcacctaagatttcatttctctagggtaaatacttaggagtgggaccgttgggtcatgtagtatgtatatgtatatattcgatttaagtatatgtatatattcaatttagtaagtatatgtatatattcgatttttcagagtggctgtaccatttccatctccagcatcaatatgtgagtgttccatacatacacatactcagttgctacacatcctcaccaacacttggtatgaattttttttattttagccattctaataggtatatagtggtatctcaacatgttgttagtttgatttccttagcgtttcatgatgttgagcatttttcatgtgtttctttgcctttcataaatcctttttgatggtatgcccagtcaggtcttttgttcattttttaaattgggttgtttacacatgattatctcaatagatgaagaagaggccttcaataaaattcaacaccccttcatgttaaaaactctcaataaactaggtattgctgaaacatacctcaaaataataagagccatatatggcaaacccacagccaatatcata

SEQ ID NO: 1382 - DNA, 20001 bp, Homo sapiens
ccatttatccatcttatgtttttgactcacattaaattgtagccagtatactgctgcctaaatacttcaatcttcatattattaaagtttacaatttctttacgattttacttttgctgtaaaattcagcaaatgagatgcacacattttaaatgtatatttgataagttttgacaaatgagtacatctgggtaacccaagcctctatcaagttacagaacactgccatcatcccagaaaatttttctgcaggtctttcctagtcaatgccacccccacttttccagaggcaaagatgtttctgacttttttttccatcatagatgagttttgtctgctcaagaacttcccataaatgaaataataatgtactcttttacgtaaggcttcatgtcactcttctgcttaaaattcctgcgtggatccatgatcatagatcatgaatctacaaatcccatggtacataaagcaaataccttaactcttcatgatctccaggtttgcctcttctacattgtcattctatggtaccgttcctcaaatgcaccattctaagttgcttttgaactttcaggcatagtttcctccacctggagcactttattgactccatcccatgccttcacctgatatagaggttgaccgttgcttttgtgggcccagcgtctcttctctttttcctctggtaacatcaatccgtcctccacgtgtgcactacctctccattccccacatgattctgtcgggctttcagtggcagttctctgccttcctgccctcagttcctgtcaattcatagtcactcatcccattaaccctggtaattcgttaaggggttgggacatgtgacctaagctggacaaatcatagcctttacaaagattttatgatgaaaaaaagtcaactttacagagaaattagaaaacgttaatttccattatctagattctaccattaacttttgttatacttgcgttatcacataccttttccactacctgtccattcactcctctgttatccatcaatcaatccatcctattttttggtatgcatttccaaggaagctgcagtcattggtaatcttcactcctaagcagttcagcatagatcttatgaactataattcgatatttgtttatggttttgaggagcaaactttacatacagtaaaatgcacaaatcttaagtgtaccactggctgaacttttgacaagttttcaacacaaaccactatggagacatggaggacattgccatcagctccaaatgtctcctcttgcccctccccaatcaattcttgccctcatttctacctagagacaccactcactattctgtttttttttttttttttgagatagtgtctttctctgttgctgagggtggagtgtagtggcatgatcatggctcactgcaaccttgaactcctgggctcaaggaatcctcccatctcagcttcctgggtagctgggactacaggcacatgccaccatgcctggctagtttttgtattttttaaaaatagatacggggttttaccatgttgcccaggctggtctcgaactcctgggctcaagtgatccacctgccttggcctcctaaagtgctgggattacaggcatgagacaccatgcccagccctgaattttttttcaaccatagattagtttagtttcttctagaacgtcacataaatggaatcaatcagcatgcactcatttgtgtaagtccatcataatgttttggacttcgtaatgttttggacatctaaatgttttactttttttttttcaagtcttcccagttttgagccaatacattcccttttaatgcttagacaatttcaagttggcttcttataacttacaatctgaagaaacctggctgatccacatagaacactatcactcatccatcaggcctcgggttaaaggctattacttatgcctattaattcaggttctcctttctatgtactttcataggacaaatcatttctgtaatctatttgtgttttggtttgcctgataaactgtaatctcactgaatacagagactttgtctgcctgatttgccaaatattggcgaactgccatgccaccaacctcccgaacagtttgcttctctcagtggttgtttaataaatatttgtccaaggaataaatgaatgattgactgctcttagctcttctagtgggcatattgtaactctaagtctgcattcaccacaaaaaaatctaaaaaaattactggtcaaacaactcaaaaattaggtttataaaatgatgatttccttcaccttgcatttgccattcctactcatttttcttttgatggcttattgctttcttagaaatatgttttcttgacttctgaactgaaagacaatatactttcttttgccctttatatcttaggacacttactctttttatacaagatttactaatacgttctgacattctgatgtattaatgactgctcatcaataagtgtatttatctttgtattttactacagtaggattcttttgtggcaatgcattagcttaaagatgtgacacccaggttacatcttttttttttttttttttttttttgagatggagtcttgctctgttgcccaggctagagtgtagtggcgcaatctccgcttactgcaacctccacctcctgggttcaagtgattctcctgcctcagcctcctgagtagctgggatgggattacaggcacccactaccacccctggctagcttttttgtatttttagtagagatggggtctcgccatgttggccaggctggttttgaactcctgacctcaagttatccacctgccttggcctcccaaagtgctgggattacaggtgtgagctgccgcgtccggccccaggttacatctttaagatgtaatgatttctcattgataggattgctttttgggatcaggggctctactctgcttcagttttacatatttcattccttaatttcctcatccacaggaaatctcccaaaaataaagctaaaaaaggtagatgaatcagacacatgagttttctttatgttgtggtaaaaaaatagccctaagatctcattggcctaaaacaacatttagttcttgctcatataaagtctgccatggtttgcatgactttcttttttttttttgaaattccaacttttattttagagttgggggtacatgtgcaggtttgttacatgggtgtattcaaggcagcatttcgtgactctgcattacgcctcccaatcagtgggtgcttcctcactcgtacaggctggagaagaggaagctgtaccttgtgtgctgccttttaaatgcatttgctcagatttcattggtcaaagcagtcacatgggcacacttagtttccaggtggcagggaagtattaatcctatcagatgtttggaaggacgcgaaattgaaatattggggaacagaaccaatggctatggttctgaatctcttgcattatggttggttgaaatgggatatgagtattgtgttttaggtactttggactctcaatagttgaactctacatgggacttgaagtgggattcattcagaggaggatttttgaaggcctgctttccttttctttttaagcacttacctacaaagcaactgtgttaaatagaacatcaacttcagttctcagcagaaaaaaattattctctcccccaggtaatttcagttttagtcaagcatttcaatgccagcctgatattgtagaaatttagggattttttttagattttttgagagaatgaatcatggagggaaagcccttgggtaagcccaggttttagctgtttatcttttgagaaatgttgattgctgtgcagtaaaaagttggactcttgtgttcacaaaaaaagaaagaacaagttaaaaggagctgcttttgcttttggtttaagagtctttcttaataaggaacaatgaacatcaacacccagttattcagtaaaccaattaaattaaattagcacagccaggaaacaaaggaacaatccttcaactcttccatttataccatagactcagcagtcacaatacaagaaagaggagtaacaatacagtctgtaaaggcaattaatattaatttttcatttttttctccagctaacatacttaaaatgcttccctgcccccccccaaaagacagctctagtatattatttctcttttcttttcattcacaatacaattgagataaaattagcttttttgcgtctttcccattactggtttacattcaatgttgtgtctttgaaacagttttaagcaatctccttcggggactttcccattgcttaccctggttagtctgtaacaaggatgggctatcccagtacagtaaagaatgctggctttagagaatggtcttaggtcaagaattattattgctcaaggccttcgagatctagttatgggtttctgcaaaccctgtgggctcttatgataatgcttttctccactattattgttataaggcattaaatcagtcagattcatgagcaacaagaggtcaacgtctgattgaaattcataaggtcaaaaaggaaactaaaaattaatttataagatatgaagatttaggttcaaactatatccatgagcaataaaatttcacatccataaatgtaagaaaatcagttattaaacttgaggggggaaagaagacttattaagttttacacacacataaggcagctaacacataattttatcagacattactgaaatcctgtgtgtaatataagggatgatgggataaaatgctaaatggtttagcactaaattattaagtgatgtatccctaaggtattaaacagatagaaaatgcagagcaggtgtctctcctagcaagacttgatcaccagtttaagtgcatattgataacaaatgcacttcagagagaaaatagtattagtaatatttttgctgcgtgaaagcctggtgtcaggatgactaaaagcttctccctgacaaagaaatgttcatttcttcttcttcttctttaaaaaaaaaaaaaattaatcatgttaaatgttaggtccctatggagcaaaaggggaactctagagggatttgagtgtttccttatctctttccttccatcatttctgcatgcaaaaaatagaatgagtggaagagaagatctatctacataatatagtaaaaatggaaaacatgaacacagttagtgtggcaaaataaaaagatagttttgccaggatgagagtaaagaaaagtttatgaaagcaaatattggcattaaaaaaacccaacttagagccacagtgcagttaatagcttaactctgttcttggcttgatgtccattttattccactgataaaaggaaaatagaatctttctggtctacttggtaatcagaggctctggctgaaaattaaatagtgaaaacatgtgtttgtaagtgagttggaaggcatctctcttttttctccgtagatgccatataaatctaagcatagttcctgataggtttatggaaacacgatgttagctagttttctgtggcccttgggagctccgtaagattggctcaaacctcactccacacactgtggaagccctgaatgctctccttaaattgcgaaaattctcatgaggctaaaatgcttttgttacctatcatccttggatctgagtgctatgtttgctgcattagtttcgtttatgaatcttttcactattccactttgttttgacctatgatggcccatgtgttgaattgaaccctttcttgaattatacatattctctctctctctcttacacacacactcacacccttcactcagagaagtcatgtagacatgtaagttcagttggtgtaaaattgtacatgcaatcctcatttcacagctatgggacggaggctttgagaattttagtaacttgcttgaggctctggagccttgcgcatggagttgggcctccaacatagacgactgactctaagtcccttgtcttctctactcttctgtcctaggcttgaaatcccctgttggtatagacagaggccagcaaactatgccacaaggccaaatctagtcctccatctgttcttatcaataaagttttattggaacacagccatgctcatttgtttacatgcactctacagccgccttctcactacaatggcgaagttgattagttgtgacaaagactgcacagcccacaaagcctaaaccttattctctggccctttaccagagaacagtttgcagacccctattgtagacgatagattcgtatgtacttcatgaacaacagggttcataaatattaacaggcgtgacatgattttttaaaagggtgttctgtgatctaataagttaaggaaatgctggttcaaatgaagttaaagagacccctcctcagagcctttactgtactgatgggtgcagtttctcttcgagaagatgaagagattttgcataacttgaacccagaactctgtgtgtgtgtgtgtgtgtgtgtgtgtgtgtgtgtgtgtgtaagtaataatttataagacacatttgggaaagcctggattgggtgataatttggggaatatacttcctaaagggtggcatttgaattcctaggtcttccttgggaaggtagctagagaagagtagaattttccatttgtaatatcagattgattaatttaatgtaatctctaatgttaccttagaaaaaggttctcagtctgtggtccaaaggatcactgggattttctatgacctgggcagaagctaatctcttttgactttataggaaaaaataacccaccagatagaattttgttcattttattttcctccccatacatttttcttgagcctgtctgtgagtaccagctataggtgaccggtggataaacaagaatcaaatgattattaataaaaaattggaaatgacagaccttatttagtttgataatttttttaaaaaggtgcatttatggttgctacatggtacatgtgtcatgtagttattttctgccgaatgggttgctctttgtatgtatggtaaaattatgtatcatgtatttcgtgatattctgcatatagcacacagggtttccaggggctctcgctggctttaggaggttggaacagcagtgttcagtgctggaagattatattactcacaacttatttggttgtggatgacaaaaatccaattcaaattcgataagtaattgacttgtataacaagagcaacagtggatgtagctccagacatggccgttcccaggagttcaaatgacatcaccaaaacttttgtttctctttattgttttattctcacttcctccagttgatttattttcttggagtgtctaaggttattggcattgctagcttacattgtttctgtaggtagagatcccaaattttcttaaacagccttgtattagttcccaagaatgtctttgcttggtcctgcctggctcatttgtccaacactggagcattccctatgtccagggtgaggtattctgattggccagattggatgtcatgatcagatgtgtgaccagcaagggacatttcatgtttgacagtcccccaggagctagaaggggaggttcctaaaagagaaaagaagaatgtattgtctgaagaaaaaggaagggatatcagaggtctgtccacagatttaggaggcagagacattggcttggggcagaaagaatatcaatttgggaaataggggaccacactagaatgcaagcttcatgaggccagagttttcatttattcactacttctaaaatagggcttggcacaaaataaacactcatgaattgagtgaatgaaatattcagatggaccatgggaattcaggatttaatagaaaatatcatgaatatcctgggggtgatatggtagattataaaatgcccacaatcgttcactctttctttaaagaagtggagtctatttccccatccttgcatctgagttgggaacaaccaactttggacaatgagacattagcaaacatcactggagcagaagcttgagacacactcatgcatgtaggacatgccaggcttgtcctcgtgcagctgttggatctctgccaccatttgaatgagccagaactagcctgctggaggatgagggaccgtgtagaagagagctgaggcacccaagccaacagccacccagcttcccagctaatccagaaaccaatcacaaactcactagtgagtctcagccaagatcagacaaccctggccatgatcagcagcatctcccaaccccaattgccagttttcagacacatgaactaaatagaagttaatgttttaaaccactgagttttgagggaggtttgttatgcaacacatgctaactgatataggtacttaggttcttgcctgaagagaaatactgtcagagtccaattctctgatgaccagttttttccttgttatcattcttactttcaagcccagaggttttaaagtcctcaagttcatgcctcggtttttccttcccttggtgtgcaaatatatgcctaacatttgcatttttatcagtctttctatatttccttgccagattttcatgagagtgttttataattattagtattattttattgtcacatatatatctcagttaatgccgacatgattgttcttgctgttgtaacctgaattaggaattttcacagttgggtattgatcattcatgtaattgtatgatgaaggaaatacaattccctctctgcctttgagaaatcaaaacagtgaggagaaaggatgaggcaaataaaaaatcaaaacatgtgtggtattttaagaggcactgtctttatattttttttccttaaaaagagaagctattattgtttagggagtttctattataataaatatcaacaaaatggtttgtttgggagttcaaaaaatacgtgcttacttgaaatgatttccaggtaaagttttataaaattactcttgccttattatattatgtacatttttattgtattaaaatacaaattatattacatagcattataaattgttattaaaatgatctgcagcataactagcagggaacttacatataactgtaaaaactgaaataaaaatctattaatgcaataaacctacttaataaaagttactttcatattcaaaaacaaaatattaaggcatgcttcagatctgaaagtcaaaaatgagggaataaattagtgaaggttaagaaccttgtagcagctgactaacaaagctctaggggattataaaatttcatgctcttgtaataaaaaggataaaggattggccagaagactactaaaagttaaaataaatgaacataaaggagatgaaaaagtctgacatgagtgtgaccactaatgtgtaaagactaaagacatggtattaaagtgttagaggctggaattaaatgcaaaatgaattctggtggtagattaatagaaaattataaaggtaaatgagttcggtttcatggtttcagaaaactttatatatctcattatttttcttagcacttaagaagaagcagggtaagacaaattaaaatttggcataaaccatattgaagtgggtggaagtgccaattatcccccagtgctattccctgcgtattccccgtgattgacctttgcttgttaagtggcacatggcagccccaaacaaagcaatttttcccatctctcctgttcataagtgagaccatggatctaagttctcattcagttagtcttaagaggaagtgacagcttccgggaaatatattcaaaaggaggtggtgggtgcttttatgtctctggctcttccttcctgatggctggaatgtcgttataatgtctggtactccagcagtaattttggaccatgaggtgatcatagggatgggagctgtacatggggaagcaacaaggcagagggagcctggaaccctgcccctctgtccaccatgtcaacttgggcctcccagtgccagacttaggaaacatcacccactgttattttgggttttctatccttgcagtcaaatactaatcttaataaagacagagtggacttctactatctccaggcctgcagtgaaacacaggatataacaataccagctcccttgtcagggttggggttggaggaggggctctgaggatgtgaccactgtgttgattggtgctgatgctggaaatgagtgttccactataaatcagggtctgctccaaaactcagaacaagagataccgagagagagcaacctggtggggtgatggcatttgtttcaaagctgaatttacattggtagaacgaagaatttaggttgcattgcagatcaatgtaaacagctatttggaaaggttgcttttcatcatattttctttagatcgagaaaatgtcaattaatgaaaacagatgctttactactgcttatttgtggtgacttttgaggaagaataatggattttatgtgggggaggcaggctcaagccctccatgaactccacccgccccacatcttgacccctccacagctataagcatttttcctctttgccttgacctttcccaaggcaacctagcagaacagttgaaatggcacttcgttgctcttaaggaaacaccccaacaccccatacctttgctataggtagcatttgcccttgatccggagtagatttgccaaaccattagaacaactgctgacctgtatagaaattcttatggtctgaaattaataatggtggaactttctcaggactgttaggaaaagtatcttttggcttttctttttatgtgttctctaagaagccatcatacattgtgcctcagcctctgcaacccctgaacctgctctgggtattcatagcacactcttgactaatgcttacctctgtctttgcatgcaccgggctgcattctagtccctcccttccacgctccctccctttctttcttctttccttctacaatatttacttagagtctacaatatttatttaggcattttctaagcactagaaagatggcaggcaacaagacacattaaaacagtacattccttcatagtttcactaagctttggcccttgaatgcccttagggaagagtcatttatgactttagctaaggtttaattttaatatattaaaatgaggtcaggatgcagaaggggagcccctttgtcaactcgaatccagattttacatgatccttgaccttattcctctgatacacctggaaattcttgtgaaagtaacaacaacaataacaaaacaactacaaatttgcttgtgttgacaaatatgatatgaacaagaaaaacctacaggtgatgaaagttgaaggacaagtggagatttaaaaaaggtggtttttagttagaaaatagagcttttaaataaattgaggagtggaagaaagtattcaaatgatgtcttgcgtctatgactttgtttctataaatgaatgtagataaaatatttggaaaacccagcccagtcagggaagacattagattttaaaacagagatagataactaaagactcaaagaatggaggatccatggggcatctggaaggtggaaattcacaaaggacatgccctttatcaacataggatgggtatccttcaggatgggctaggaagcagcagtaactaacaaccccaagtatcagtgccttaacacactaaagcttatttcttgcttgtgccataaatgcagcaggctatctaggtggagtgggggaaacactctgctgatagcagtcacccatgtacctaagttgaaagaagcagcacttcaacagtgaccctcatcactgcaacagaggaccagaatatggtaaatcactcagtgcctcttaaagcttccacctggaaggaacacctgtaacttttgtctacatttcattgtctaacgcaaaccacatggccatgccttcccttagggtaggcaggggttaccatcctaccacgtacctgccaagcagagcctctgaattcattgttgagctgcaccaatgtctatagcggtgtgtgcacttaaccccaaggatgccagtctcccactgcacaggcagctccttgaaagcagaaacccctcatacagctcctcaatcaccccgttcagccaagggcttggcacataggaggttttcagtaaatgtttgttgtactgaattgatctccattccacgtacttcccgaaacctctcatgatttattggtaaaattttcacccttaattagtgaaaaaagaaactctttctatgagtttataaattatttaccttacaaagcccttctgagctcttcgagcacactgtaaataatttatgttcatacttgtgtgatttcaaatttgtttattaatgttatcttggagatagaaaacaacctaagtgaaaccatcctaacttattttacagatcacttggaacaagaaaaaaaagtgcttttcttctcatgtggaaatgttattgacccaccattagagggtgtgaaggcccagttctttcccaatgttaagcaaatatttctgctggcctgagccatgacattcacgcccatttagtgaattcctactctatccacgtaatgaactaacacgttgagtctatagtactcaatatatccagccctggatccttctcctgaacctcagcctgtttctccaactgccctctccacatctccacgtggatgcatctcattaacactgcaaacttaatgtgtccaaaacagagcccttaatttccagcctcctacctcacagctcccaaagtcttttcccatttcagaaactgcaaactccatccattttactgcccatgtcacagaccttacatatagctttgactttgtgccttctctcatgccccgtatctaatcttctgaaatattgttggtgccaccttcaaaatatatccagactccagtcgctttttaccatctccactgacaccaccggaagccaccctgccttgattgcttacctggtttgtttgtagtggttgaaacgggcattccgtttctgtcactggcccttgcactcgacttctgtgtagcatccaaaggaagccttttgaaatgaagtcacttctctgctcaaaactccccagtgccttctgtttgtcaagccatggaaaagtcagagtcctccagtggccgataagggcctacgtggtttgcatcccatgcccccaactgctcctaccatcccgtgtcctatccctcttcccctcacacactctgtcccagctatggaaacctcttagggtttatgtgaaccttctgtgaacattccagctctgctgcagctttaagacatttgtgtttgctgtttcctctgacttaaatggtttcccttcagagagccacatctttccttctgcccatggctctaagtctctgctcaaatgtcaccttgacactgaggcctgcccagacctgcctacctatggggcaaacatgtcctgtctccttcacattgctctctctttctccgtaacgcctgtgtatttacttgtttatttatacaatgccccccaggccctttctagaatgtaaaaatagtgcaggctgggctttgatcatttatttcaatgctgtctcccagccatcaaatagagatagcccgtagtagaagctcaataaagacttgctgaaaaaaaaattataatatgtaattttattgttcatgagttatttctcgtcattaagtattagttttccaactaaactacaacatcttttcagcagagactaacatggattccttgtaattctctttgtttccaaatgcaaaatggtcagggaatagattgctgatagttgggtgatgtcttccacttttccaagagggttgactcttcttgcagaacattcgtcaccagagattgtctttaaaccaaagtgtttatggcttagaatcttgttatgcaaagttagaaatgcagattctcaggcctcatcccagaccaatgacatttgaatctgcattttaacatgatggaggccagtgcctgctcccttcacgttcgtattcacaggaatcccctggggatctgatgaaaatggagattctgcatttcttaccgactctctcccaggtgagcccattgcagctgcctctgagtgcactctgagcagtgagggcttgagagtctgggaaaagctttacccacacttagacattcacagggtgtgtccatgtcttgggctctgagaagtcttgcattcgtcgcattagaaaaaaatctagtcggccaggcgcagtggctcacgcctgtaatcccagcactttgggaggcagaggcaggcggatcacctgagatcaggagtttgagaccagcctggctaacatggtgaaacgctgtctctactaaaaatacaaaaattagccaggcatggtggcaggcgtctgtaatctcagctactcgggaggctgaggcgggagaatcgcttgaacctgggaggaggtagaggttgcagtgagccaagattgcacgattgcactccagcttgggcaacaagagcgaaactccgtctcacaaaaaaaaaaaaaaaaaaaaaagaaagaaagaaaaaaagaaaaagaaaaaaaatctagtctagtgtttcccaaacatatttggtgacatcagtgaacatcatgaggaccagtgtttctgagcacaggttttgagaatcctcctcccgttctttattcccgggtctcctctcctggcctctctctaggtgccgtgttgatttttttttttaatttaaatttaaagatacctcttccagtatagctttcaagctgagcctggagacatctccagcctcaccccacttcacttcgcccttgagtcgatcctctggcagcaccagctgctcccttggctgcacggttctttcctgttttatttcactcagacagatctttcctctttagggtgctctctcctcatcttggtttttccagccttccgcaattccttcagtctcagcttgggtgccctgtcctccatgaagcctgcccagatttctcggatggactaagtgcccctttgctttcactccctggtggggagtggggcagttggacctccacggagcactcatcgtgctctctgtggccatctactttggtttctgtccctgctcaagatcctgagggctcctccttgagggcaagctcaaggtctcctcatttatcctcagaactttggaccttccaaagtacgtattaggtaattatctgcatggacctttaaaactgaagctgaaaacatgtaccaaatccacccttaagaaccccccctcccgctgccttagggcttggaggcaacaccagtaaaaacaagtaaaaaacggggcagggtttatttaaaaaaaaaaaaatggtgtgaagagctcaaagaaacatcaaaagtcaatttttcaacgatgtgcaactctccaagtcagaaaaatttaattttaggaagaataaggccaggatggattgaaaatggaatgatttgaacatagaatgttttggctccaggggacgtaataaacagaggacagagactccaaaggatagagtgccgagcattcacagaagcaggggatgcataacattggagcttttatccaataccaggatgtgcattcttggttttagtaatatgtatgtattttaatgagtattagaaaaaaaattggattctcctatttatggtcacactatcataagtttcctgacttaatgcttttatttgattcaggtcaaagaaaaaagtataaagacaaattaggacaggtggtatgtgggtggctgatataccaatgactgatgctgggaaaatattttaagaaactggactggtgattgagaaaccagttttcctgccctttggatacacaaacttgctttgctgttcctgttgagggatgtttgaattaagtgatgctgctccttcatatagctgattggaccaagggtgttctcctggcctaagttgggccaatccgattctccttttcaggagtttagctttgggacccagggagacctaatgagaattccgagtgtggtgtggtgacttggttgtcctgtggttgccatattttgctatgtgaactgagaagcttagatagctatgagatatagaagggagagtgagatacagaagggagagagggatacagggaaagaaaaataaaacagatgcacagagaaaagcagaaatgacaggcagaggccctggtcacagttcttttccagattcgagttcctccctcgtctggctgcaatcttaccattgggttttctgagacacactaccatgctgataacaaatctccacctaccaacccacttcacccccagcacttgtctcttaggcttctttgagttactactgttccttgcagcaaaaaccctctatcaatgactatcaaacaggtaacttaccttctgtggacctcagttacttcatctggaaatggcagaagctagctagttttcccgaaagtcaggtcacacaccactggagtaaattgagaagactctaggtgatatttaggtccaacaccaaatattgttgaattgcatagtgattccatttctaaatgtcttccagtccttctgattatatgtcaaggagaagttcagttttattctagtaggttttcttaaatgcttttctaatgctttttctctttttaacaaagagaaatgagacttcagatagggagatttaaaggctataatagccagttagaaattggaattttttttcattgaattcattttttactgttattatttatcataaaattattttaattctggtttttcatttatggtagtgagatacaacttcctttaaaaataactttaagatggggagagaaaaaccagctattccttacagtggaattccaattataaattctgaatgacagaaatagaaagtcaccatttggccaacaccacagtaattattattgcaggcaagaatcatcagtgaatgctaaaattagtgggtaaaattaaggtgagaaacaggatatttgcatagtctcatagactaaaagaatctccccagaaggcactatttagtacaaaggaagaaataatacctttacagtggagaagaggctgacactgctttcatcaagagaccaaagttaatagtacattaaacacccctgatatgaggcactgagaaggcgcagcaccactgtcaaaaattgttgacttcaggctaatcatgagtaaacatcagacaaatgtaaaccgagagatattttacaaagtagctggtcagtgctctttgatcatgttgaggtcctgagagacaaaggaagactgagaacctgtcacagattggaggagactaaggaggcatgacaactgcacacaatcctggcgtggatgtgctttgaatcctgggttgggtcttggtttaggtcctgggttgggtcttggtttaggtcctgggttgggtcttggtttaggtcctgggttgagtcttggtttgggtcctgggtggggtcttggtgtggatcctgggttgggtgttggttttgatcctgggttgggtcttggtttgggtcctgggttgggtcttggtttgggtcctgggttgggtcttggtttaggtcctgggttgggtcttggtttgggtcctgggtggggtcttggtgtggatcctgggttgggtgttggttttgatcctgggttgggtcttggtttaggtcctgggttgggtcttggtttgggtcctgggtggggtcttggtgtggatcctgggttgggtgttggttttgatcctgggttgggtcttggtttggatcctgggttgggtcttggtgtgggtttgggtcctgggttgggtcttgtcttgggtcctgggttgggtcttgtcctgggtcctgggttgggtcttggtttgggtcctgggttggatcttggtgtggatcctgggttgggtcttagtgtggatccttggttgggtcttggtttggatccctggttgagtcttggtttgggtcctgggttgggtcttggtttggatcctggattgagtcttagaccagaaatgacattgatgggcatttggttatatttgagtaagatctgtaaattactgaacagtattatatttatgttaatttcctgctttttaataattggactatagttatgtgaaatggaagcattttgggaatctggaatctgggtgaagagtgtacaggtatactagttttgcaacttttttccctctaagtctgaaattatttcaacatgaaaacctaaaacaaactgtaaaaatttcatttcttcctagaccaatggttcccatgtggatcaattatgccttttgggggacatctggcaatgtctggagaaatctctggccgttgcaaccagtgggtagaggctagggatgctgctacacatcctacggtgcactgggtgcccccaacaacagagaactatcgggctcaaatatcatcaatgctgagattgacaaactgttctagaacaactgttctagaacaaatatattttttaaaaataatataaacacaagggatgttaagagaataataatataggagttgtgtgactatactgcagctgctatacaagtgtctgaacctcattagaattgattctgcatttctacctgggactaacattttggagtctatgaattcaggggcagtgtcattcaaggttagaggtgccaggtgggaagctttgtgactgctcactgcaagtggccatcattagtaaactattttctttctttcccttggtccaaagcgagtacatcaatctgaccatttctaatgagatataggatgatactgcgtggacaagacttgctgtcagccactgcctggtgggcttagagaaagaaacgatccttcattaattaaccttcactttctatgtagattcactcattgagatgcaggtaattaaaccaaggtcatttcaaggactgacaggaggaaaaaaaccccagccgttggaaggcggtgcagtttttttgggtagaggacttggaattctatttttatcttgtgcagaattgtggaatcgtcttttcttggcttttaaataatctaaccttgttttaatgggagattcttaaattcatctcaaaactgtatctcagaaatttttaaagatttaggttattgtaggttatagataacctcctgtgggtttcaggaatacatgttagggcaaaaatttaatttaggggagctaaaccatgtaaaggaagggaaatagaattatgtttgagagacgaagacccattttattggagggaggagaggagtgcgattgctattctctcagtttgaattctgcagttcttgatttttattgcttgtaatattgggcctgtatgatatattatagtggttaagaacatgatttagagttgggtagatatgatttcacgtcttagctctaccatagactcggaccctgggtaattcatttcacttatttagctttggtttcctcatctgttaaatgggtctaatgctggtccttactctcagggttgttggcaggattcactgtaatagctagaaaaggatccattctcagggtgcacatagggatgatagttacctcttaagaaatgtttgctatgtgccatgcggtattccaaggactttactgccttccatcaaccttctgagttaggttctgttattgtatgttttatacatgaggaaactaagacacagagaggacaaataatttgcccaagacaccacagccattaagtagcagagttgggagttgaacctagttgggtggttgatctttacacccacaccataccatctcaagtgcataaactgttggctcttattattagtatcatccttcattataccttaaaaatacattgctaaagcaaatccac

SEQ ID NO: 1383 - DNA, 120302 bp, Homo sapiens
ctactgctgatcatacgagcaattcacctgtaagtcctaataacccgagcttcaaaggctcatcccattgaaaaggaatttccccgcctctgcaattcaaatgaagtaaatactcactgaactgtagacacctcctgctgcttttgactttcatcttaaaaaaagcaggagacagtattatgcgttgtagatctaaaaattcatttgtgaaaggagaatcttccttttaaaaggtgactgttattaattgcagttttataattgatcctttaaggaacacaaatgagttttaaatgttctctttcaatgcacctcaatgggtggaagggtgggtgtattgtctgggataccacaggtagaaccttaagtcttggccttgtagaaatcaggccaagatgaaactgtcttttgtgacaaaattcaacagtctgccttagacaaaaatcaaacaaatcatgaattattgctgatttggatgtttgttccctccaaatctcatgttgaaatgtgattcccagtgttggaggtgggacctggtgggaagtgattggatcatgggggtgggtccctcatgaatggtttaatgccatccccttggtgataagtgagttctcgctcagttagttcatgtgagacctggtggtttcaatgagtctgaaaagagtctggggcctcccatgtgtctctcttgttccaggtctcaccatgtgatacattggctcccagtcaccttctgccatgattgtaagcttcctgaggccctcaccagaaggtgaacagatgctggcactatgtttcctgtacaacctgtagaaccatgagctgataaaaccacttttatttacaaattacctagcctcaggtatttctttcctttgctttttttttttttttttttttttgagacgggatctcgctctgttgcctaggttggagtgcagtggtgtgatcttggctcactgcagcctccacctcctgagttcaagcaattcttccacatcagcctcccgagtagctgggattacaggtgcctaccaccacacctggctaatttttgcatttttagtagagatggggtttcaccatgttggccaggctggtcttgaactcctgacctcaggtgatccacccgcctcggcctcccaaagtgctgcgattataggcttgagccactgtgcctggccaggtatttcttcatattagtgcaagaatggactaacacaattactaagtcagcttcttagaattcttaacaattgctcttagttttcatggtcatgaaaccgactttcttcctttctttttttttttttttttttttgacggaggctcactctgtcacccaggctggagtgtagtggcaccatctcagctcactgcaagctctgcctcctgggttcatgccattctcctgcctcaggctcccgacttccttaattcttccttcctatgaagaggagactgacagtttgctcagtcctgggctacatggtcattctgtctgtagcatgcatctaggatagagtgagcaccagcaaaaaatgtcttagctgaacatctctttcagtcaaattaaaaagtttcttataaacaaaatgtaaccatggccatgagaatctccttagcagttctttatctttctatgggcacagacaggataatttttacaagaaagatgaaagagatccagatgttccctccccagaatagtgtcttataaaaatgagttttcaggctgtttagattattagcatgtcatagtggaactaaaaatctcttaactcatcacaagggccagaccttcaggatgatactgggaatttctcaatgttattggcaagaaaagcattcaatgaaaataaaggtttacaaagtaagaaagggaactcctagttggtgggcacctgccctgttataggcactcagtaacatgctttcagctatttatccacacaacaacactgtgaaaaaggtaaggtgtcactcttaaataatggcaacatgggccgggcatggtggctcatgcctgtaatcccaacactctgggaggccgaggcaggtggatcatgaggttaggagatcgagaccatcctggctaacatggtgaaaccccgtctctactcaaaaatacaaaaaattagctgggcgtggtggcaggtgcctgtagtcgcagctactcgggaggctgaggcaggagaatggtgtgaacctaggagcttgcagtgagccgagatcgtgccactgcactccagcctgggcaatagaatgagactccatgtcaaaaaaaaaataataataataatggcaacatggaaactcaaggtcacagctagtacacagctgagttcatgtccaagagcaggtggctgtgattgcaaaatcacattcttccatcaagccttcttggcttattctcattgtagacatcgcagcctagttggagataagcatataaacatatgaaatgtcaaatagcaacataaaaacaaggatattatgatgcagcatgtgattaattggcaaatgagtgttaggaattgtgagtttgtcatgaactacagtaacctagaaaggcctggcctctgtgtaggacttagataggttaaaatgaaaaccagacagtcataaaggtgtgaatcctgcatatagtaaggaaaatatgcgatcaatatattgttagtggatcagtttggctttaaaaagtttatgaaggagctcgaaggtagacttcagctttgaatttcaggctctctagaccctcattcagtaggtcagtgttactctgaggtcagtggactgcccttcctaacatcttgggggtcctagcacttattgtcaggattcctaagttctctatgaaactttgctttaaaatttttgatgaaaattagaaaacattatgagcatactatggagatcaaccctgtaactgtgcactatcctgtggtggtcttaccaagtgaaggctgaatgatatcccagcagatgaatgcataaagatctcaccattgtttacacagagaaaacatgtgcaaactgaacctgctcatatcatccattaggctggatatactagacctcctctgtacagtgaatgtccatccatgtgagtggatctcctgacttgaagccctgcagtgtcggaaagggtagctgttagtgcccaataaagaaataatctgcttctgggacagatactgttcgtgtcccctccaccccaccctactggcactaactattcttgtatgtggcgctgcatccacctgcaagcccctctgattcttcacctaggggctttctcttggtaggcatgtgtttggggcaggccagatgtgttaattttgggagcatccatccaccaatgacaaatgggagttggagaaaaaataccccagcttcctcgcctcttgggtgggtgaattctgaggcatgctcacattgtcttccaaagttctcaggagcactcagtcccagtggcctggagctgtcacctgcttattaatgcatgctgcattggcctttctttcttgatattgcttcctcacattgcttagcagtatgaacattatttcccagataaaaccctctatccaagtatttgtctcaggtttgcttttgagggaacctagcctaaaagccttccaaatattcatttggtaaagatttgtataacacaatgccagccttatctttacgtgaacaaaatagttgtgcagtgttatcaatggatgcctcaatacaactggcatgcaaggattattcccagacagacttttggttctgatgatcctgaattagaaaaaaaatgcagtgattaatacaatcttatacagcatgcttgtgagaatggctgttccttacattagcattattaaaactgaaatacagaaccagattgagtattcaaacaaacttgagactatattcttcctctattaagccaaatatcagtgattttgttccagcaaaataacatcatgtcacattaaattaatgttgggaatttaaattttattggttctctagttgtgcttgaatataatttaaaaatttattctagatttgtagttatatcaaagctgtcagaataaagagtttatgactagttttatatttatacatattgaaattaaattataatgaatttttaacattacattgagggtccataaaatatacgtgtgtgtgtgtgtgtgtgtgtgtatatacacatgtatatattcacacatatacacacacacatatacatatatgcacacacacacacatatatatatcttttaacccctttaataagagaaactcctcaggcctaaagaaaaacttctttaggtgactgagagacactaaaaggtttcgatcactgaggtgacctcatgaaaatggtgtttcaggacaaattaatggaaaatgaatttaaatcaagatcttagaatatagtagacagacaatactatttgctgaataaatgaattaaataaaagtaaaccgagttagaattctgttgcagcaaactataaaataaaacatacgtatgtaacctagagtgctggaattagaaaacagagacttagagaaccttgtgattatatacgggacatgcattggttccagctctgtcaaggcagaactctgagacaagggttcatgtacaggtaacttattagggatgtgactccaggagaaaccagtaaaatgtcagccaggtgtggtggttcattcctgtaatcctggcactttgggaggctgaggtggaaggattgcttgagcccaggagttcaagaccagtttgggcaacgtagcgagacactgcctctacaaaaaatttaaaaagttagctggaaacggtggcacacacctgtaggctgaggctgaaggattgcttcagtccaggaattcaaagctgcagtgagcgatgatggtgctattgcactccagcctaggcaacagagtgagactctttctctaaacaataacaacaacaacaacaacaacaacaacacaacaacaagtgagtgaagcagacagggagggggaggaggccaagcaaaggtatgattttaggcaaagttcccagagagtagcttaagcctaatcctgcagagaaactctcaaatggaagtgatacctccaagtcgatcccagcttgagccaagggagctgggctttcctacccctgcaccagccagtcactggccaagggcttccatgtgaggtacgaacttccagggcttccagctttctgtagtcagagagcagtcttacagagagagagtagcaggtgacagcctagcagcagaagcacctataagctgggggaagcgtgcacaggaatgataaaagcagcagtatggagtatggagtggtatggagtatggagtatggagacataccagtgttgaccatcaaaactaagcagtcgaaggtgatttgagggctctgacctgtgatgtggccagtggatgtctccattaacagaagaaaggaatttgatcaaaaccacaacgtaataccatcttatccccccaagaatggccataataaaaaataaaaaaaaaaagatgttggcatggatgtggtaaaaagggaacacttctacactgctggtgggaatgtaaactagtacaaccactatggaaaacagtgtggagattctttaaagaactaaaagtagacctaccatttgatccagcaatcccactcctgggtctctacccagaggaaaagaaatcgttatatgaaaaagatacttgcatgtgcatgtttatagcagcacaatttgcaattgcaaaaatatggaaccagcccaaatgcctatcaaacaacgagtgggtaaaaaaactgtggtatatatacatgatggagtactactcagccataaaagggaattaatggcattcacagcaacctggatgggattggagactattattctaggcgaagtaactcaggaatggaaaaccaaacatcgtgtgttctcactcataagtggaagctaagctatgaggatgcagaggcataagaatgatacaatggactttggggactcggggaaaagggcaggagggggtgagggataaaaggctacaaattaggttcagcgtacactgctcaggtgatgggtgcactataatcccacaaatcaccactaaagaacttactcatgtaaccaaacaccacctgttcccccaaaacctatggaaattaaaaaaaagaagaagaaaggaatttgagaggggatttgggaaggagatggagagtcacagcccttggattttttcggggagtgaaacatcctctggatctatctccatggctacagctcatcttcaagctgccctcctgtgttagccagatcacagtaagagcttcctgtgttttcctcagctttgatgttgttgggccctcctgccttgtctgtgcactacagctagaatcatcttcttaaacttccaatcacatggtattacttccttgctctgaaatccttcagcaacttccagtttcaccttgaagatcccgagtcaccatcagcctcttccactctgttctagcctcactggctttctttctgctcccaaaagaggccaagttcatctctgtgccagggtctttgtacttgcttttccctctgactggaatgcttccctgttagcctcgcaaatgcctggtctctgcacatccttcactcaaaccttctcttattggagaggctttttatgggggttgtcagtgccgctcaccatgcttcttttctgcattgtctgggcatacgatggggtagaccttgctggctcccttgtgtccgggtggggctggatgtctgcttctggccaatgcgtgctgagtgcaagtgacatgtattagtttcaggttagagcatttaactgcttgtgtgagaccctccagagtttttttgcttctgcctcaggacaatactgtgaggtcctgtaatagctactgtgccagcctgggtcgctgtatcagttaagagtttgatctgggaagtagaaccagttgagtcatgtggagtaagggatttattagagggattagagcttacacagttgtggaagttggtcaagacatctctggaagatggttgcctctgtgaacgggtttgggcctgaagtttgttgtaggtgcatgaagaaaagctggatgtaaagtggggaagaacagagataattggatgctctgaggatggcctggaatccatgtctgtctctcaccacctccacgctcagtgatgctggtgacctgcagaaggagctggtctccagtgccgtggcgctgcaggtgcatctggttcaggaccctaaaaatgctgaataagaacactcagtgggttcctcacatctgctgtctagatttcacatgtttccctgtggccagctgtaatctgcaactacacacacaaaaaagctctaagaaatgtagttccagataaaataatttgcagagtacaaaactgcgatagtctggagtgactacaatgagtagagtttccctaacaacttcggatgggcatgtagcgtgaaggaaagaccaacctttgctgttttcagcctctcataccagggggttgtttgttaccacaggataacctggcaattctgactattacatctttcctgagcattgtatgtaaagaagtgtatcatcctctcaagttggtctagactatgccaagcagcttctttctttcttactacttacttattactatccaaaattatcttacttatttgtttgcttttttaaaaaaatgtctgcttctcttcagtaggctccatgaggatagggactgatgagtcttactcactgttgcatccccagtccctaggatagtacctggtttctaacaggtgctcaataaatatttgtggggtgaatgaatgaatctagaatggtctgtgcttttcccttgtacataatgggatgttctgtttgtctgtctccctgttgaaacatgagctctttaaatgctggagcctgtctccagtggatgtctgattccttctacatagaaggatctcatctttgttgaaattaacttgaggaaaaacagaaaggctagaatgtagatgcacaaattatgcaaatggaggtgacagtgaaaaccatggggattgttgtgactttcaagttgcagacatgatcagagggcttaggaactcttctaaggaatgctttagcttctgtatagaagcctgccaccatgagtgtctgtgagcctgatttttctctccagaaaacaagcattgccaaattgatgatggaaaactaaacatttcaagctttaaccttccaaactcaaagagttttacacaactgtttacttttatgataaaactgaagaagttaattttaaaatagtactagaaaatccatgtagcaccaaatatggccatgataaaaaacagaaataatttctaagtctgaaaagcaaggataatattaccccccaggcatattgccaggtttgttatggagtttctcatgttttgacctttccttttgcagctcattctaagctgataaatactttatgggctagtattcaagtacccaagaatacttcttcactatgaattacaaacaggctgggtgtggtggctcacacctgtaatcccagcattttaggaggctgaagcgggcagatcatttgaggtcaggagttcgagaccagcctagccaacatggtgaaacccccatctctactaaaaaatacaaaaattagccaagtgtggtggtgtgcacctgtaatcacagctgcttgggaggctgaggcaggagaatcacttggacccaggaggcggaggttgcagtgagccgaaattgcaccactgcactccagcctgggtgacagagtgagactccatctcaaaaaaaaaaaaattaataataataattaggagcaatgttttagttgctatttgcaatcagcttttaactatatctggtctaacttttccctgtttctcaaagcagtctgcctctattaaacacttatgtgtctttcattgaagtctttcctctaaagctctgtatgctggtttttcctgagcaatcctacttttttagttctcttcagaagcatcataccctatcagcatgtctttctgtaatattttcaaaccaacatccactcattgtctccccttaattattgtaactatactttgatttttctttggggaaccaccttcagttcacattgcttttattttctttttttctttttttggtggaggggacagggtcttgctctgtcacccaggctggagtgcagtggtgtgttcataactcactgcagccttaacctcctgagctcaagcaatcctcctgcctcagcctcttgagtaactgggaccacaggcatgcaccatcattcctggctaattaaaaaaagtttttttttgtagagatggagtttcaacacgttgccacatgcatgcaacttggttcaggtctctcagatcatcacactcctctggccacaattgctgtaaacatgggcatctggtcctgatcagagacaatgaattatggtgtgataaagcctatctggatacttctgggaaagggactttgttattccctcagctatgcacttgtgaggacatgcgcggctgtagtcatcttgtagtcacgagaagagaccttgcctcagagtggagccccacggcagacctttccttttgcagctcattctaagctcattctctctccatctaaaggtagagagagaggtatcggcacttggtaccattatttatgtcttgatcaaatcatgcctgaagttcctacttctggactttgcagtaatatgaagcaataaattcccattatattgaagccagttgggttgagtttctgttatttgcaaccaaagaagtcctaagtgataacactgcttaagcagtcaactttagtttttacagtgtaacccaacgtacgtaggacacaatcagctcatcacaggtgtgagaatgaatggtgagaaaatggaaactgaaagccaagatgtgcagttgaagaaaggaagagaaatttcagatagaaaccaaaggaagaaataggatcagtgaagacagtgattctcaaaccaggttgtacattggaatagcccaagggtttttcataacattccggtctgcatcccattcccacggatcgtgattacattggtctggagtgcagcctgggcatcaggaattttaaaagtgactgcaatgttcaggcaaagttgagaagctctgctctaggagatacttgtgtctgtttttaggaaaaaaataagaagccaggggaaaggtaacagctgaagaggcagtagaagggctaaggaagctcgattatgtaattacccaaatttgtgctgaaaaatactgcagtactgaaatattgagcaccacatcggtcactggtagaaaaagtaacgtgtatgccttgtgttttctgagagctatgccagtgagcttttatctttgagaattctatcattggacccagtcttaaaagaaactcatatcctagttagaatgatttgatcattctaccattttgcacactttttttctccttttatgcaatgaacaatcttgagtgatggattttaaaaataaaatgaggaaaatcatgatcattaggttgaagatttaataatagactctaaaaaagtcttcttgctttatttttaaattcagtgttagctttttttttaatcagtgtttttgtaagtcttaaattagtctcagaatgtgtttgaatttgtaagacaatatccacataagctgatttaaacacaagtgattgattttggggtatagaccataacaactcccttccctaaagctctaaggagacaaagattccttgttagaattaaagaagcaattatttttaaaataataaaataataaaagaatatattttctgtggaaaatatacaaaattttgattagtaaaaagaagaaaaataatcgacctaatctctagctcttgaaaaataccataatgtaatactatttttcacttgccttttctgattaataatagagaacatacttctaggttactttctattttgtaatgattttgctgttttaaaaatgttttaagtctttttgtatatggaagaaaattttattcatggaattgagagaaaagaacaaggacaaaagtaaaaatctcctataattccatcatacaaataaatcatttggaagtatagagagtctttttttaggattatttttattttcttctgtgaaacaggaattgtttgtacatcttttttagcatgctgtatctttaacttagcaatatattgtgaacatgtttccaggttaaaatattcttttttatcaaattttaaaattgaatgtgtattatagatgggccataattttatttacccaatatctgtcattaaacatttggttcttttcagtattttgccatttagtgtaatgttgtaaatgaacgtttatagttaagtaattgtgcccattcagtatgattccttgtatgcatcccaggggtgaaattgctgtatcagaggattcaaagtggaaattctttgactttgatgtgcaattgtagattaggcaaataagatggtgaagagattatcaacggtggagatcatcaaaggagaaatgacgtatttgtaacctctcaaattaagggcatttcctcagtatcatcaacttcttcccatccttggttaccacattgagcttacagaccccaaatcgataggctcctagcctcactaaattgctttcttttgcccaaatataccatgtatgtgtttagacctctgtgctactttattccacctctgagagatagctttttcactctttttcatccttttcatctttcaacactcatttcatgtattatctttcctgtgaagcccaggctaaagttagtcaatagctccattgtcttctcacagttcttggctctcagttagcagagctcttagaattccatactgtatatctattcatgtctgtctcttctagaaaacgtgaactatgtcttattttttcttgtctctgatgtgcccatcagtgattaggactttgctttcaattgtgatcttcagtctttattaactgcaacccacagtaagaaacaattttacatcatgatgtattatatgtgttcaacacacacacacacacacacacacacacacacacacaaaacaaaagtttcatggaataaaatttgccatgacaggatgtcatgcactcatattttctattctatttgtcattaaaaatgttctggtcacagttcaccaaatcagtttacctactaatgagtcatgattctcagtttgcaaaattctacttagcataagctcaagtactgtttgttgatctgaattgcaaaacattggcttattttgcagcaaatctcagacattatgtaattttatctatactcgatagtgttaaatgtattaacattgttatgcaatggatttttagagcttttcattttgcaaaactgaaactctatacacattaaccactacttccccttcccctcccctagcccttggcaactacttttctactttctggttctatgattttgactgctttaaatatttcatatcagtggaatcatgtagcatttgtccttttgtgactgggatttcatttagaataatgtccttgagtttcatccatgttgcagcatgtgactggatttccttcatatttaaggttgcataatattccattgtatgtatatagcacattttctttattcatctattgatggacatttgggttgcttccatttcttggctattgtgaatactgctgcagtgaacatgggtgtacaaatatcttttcaagatcctgttttgaattcttttgagtatatcaccagaagtgggattactggatcatatggtaattctgtttttaattttttgaggaacctctttactgttctccatgatgactacaccattttccatttccactcacaatgcacaagggtttcagtttctctgcaacatcgccaacacttatgttctgttcttttgacagtgaccatcctaatggatgtgaggtgatgtctcaaggtgattttgatttgcgttcctcttatgattaatgatgtggaacatgttttcctatgcttattggccatttctgtatctttggagaattgtctattcatgtcctcgatccatttttaaattgggttatttttgttgttttctccttgtttcttgatatatgctctgaattgaattattaaactgtgattcgagcatcttactttggcctgtgaaccattgtattctgtgacctctgggttagcttgcctggcagttttcttggaggtttctattgcatcacggtaattgcccacacgtcttcttcttcttttttttttttttaacttttagattcaagggtacatgtgcaggtttgtcatataggtacattgcatgtcatggaagtttggtgtacagattatttcatcacccaggtaatagcatagtacccaataggtagttatttgatcctctccctcctcccaccctccaccttcaagtaggccctagtgtctgttgttcccttctgtgtgtacacgtgtactcagtgtttagctctgacttgtaagtgtgaacatgcaggatttggttttctgttcctgcattagttcgcttaggatgatggcctccagcaccatctatgttgttgcaaaggacatgatcttgttctttttatggctatgtagtattccatgatgtatatgtactacgttgtctttatccagtctaccactgatgggcatttaggttgattccatgtctttgctgttgtccacacatctgagatgcaacctaattttaagatcatgcttgtaactttttttttttaaaaatacactaattctggactctgtcagttactggactaatttcctccccacacccacctctacttcccttctaaaacaatgctaattttgttcagatgtccatgccttccacattagctcagttgcctcaagggaagccaaccccactccagtttttcagtacaccctgattggtgtcaagaattcccattcagattccccttgccagtgactggcttgggggaatgaccacttggtaaatcctggctaatgagttgtggagggagatctactgggattggggttttctgggaaagtgttgcgaagagagactgcacagtaagaggaagtctcccttctttccctatatattgggccaggaagtgacacatgcagttgctacagccatcttgccaatagctccaggaagatgtagagggagggcggagtctacctcgctaatatagacatccctaagctactgaatctactaccccagagcccccattacctcttatctttatgatgttaaagttttttccttcttgaaaccagtttgtctaagttttcatttcttgcaaatgaaagcatctttcattgagtcacttgccaaaagttataatttaaatcactttaactggttcttcctttctttcttttttctttttttttttttgagatggaatcttgctctgtctcccaggctggagtgcagtggcacgatctcagcttactgcaacctctgcctcctgggttcaagcaattctcctgcctcagcctcctgagtagctgggactacaggcacatgtcaccatgcctggccaatttttttgtatttttagtagagatggggtttcactgtgttggctaggatggtctcaatctcttgacctcgtcatccaccctcctcggcctcccaaagtgctgggattacaggcatgagccactgcgcctggccttaactggttatttcttaatatgattatagactatcagcaatagaatcacattgggagcttcttaaaatacactttctgaggccccattgcaaatctattgaatcagaattttagtggggcactacattcctatacacacaaagacagcagaaataatagtgaaaacttgatgaaatgatttaaaaaattatccaaaacttgcaaataaagctgagaatgagtccatgtcctttcagtgtgagtgttgaaaaaattcacccaagattgattatatagaagaatgcacctgtgtttagctgcaatttgctatttggttagaaccagatactttaagttgtatgttaactatgttttctgtcttggagaaaaataactcctcttggtgatagtttagtgaccctatacaacattacccagttttgactctgttagcacatttatttctgcatccttttggccaacttacgatataaatcctcattcctcaatttctccttttaaccaaccttaccattatgtttgtttcttcattaattaatgaattaaataaaatttttgacatgtattcattgtatatttgtaggagagtcatgcttttttaaaattgaagattatactttaatgggattcttagttcctttgctcgtttttcccctcccaaggagctgtagcatggttccttcctcattaccaataatagctgcttatcttggtacctgcagataaaaggtaaggaaaggactaagttttcccttttgtaccagtggctatttgtgtgtttgtaaaacaagcatgactgaagttgcttttacctttggccactgttcttggcaattataagcagtgtctcaaatgcatttaggtgctgagctaattttctgttttattgatcaaatgatgtttctgttctctggaacacatttagagcactcaaggtaggtgtgacccagagttttaattagataccagttaaaatctaatttctagctgcttgtatgatcatttggggcaagtttctttgaggacagaatagcctagtgcaagccgtcagccaagcagtcctgggtttgaatcccagcccgtgatcaccgcatgatgttgggcaggttcattaaagtcagttttctttcatgtgaagagggggcaatagcagatacttcacaatgtagttctttaggtgagagggaagaagttgaatggagcacctcagagcttacctctaagactaggtgctcaggctgaattcatattcggccacatagaggcttgtggttctgaatgagttacctaatatctttgagtatcattttccttacctgaaaagtaaataatagttcctgcctcataggcttacaaagaacatcaaaggagcatttgtcccattcgtcaacactaattgtttgagtaccactttcacgtattttgctatgtttctatctcatcttgtgcgctcatcacaaatcctgctacgttggcaccatttctactatcacttacttgatattttcgtttaataaatttcattagataaatatttattgacagtctattttctagaaactgttgaggtttcgagggtctagcagtttacaaatagggcaaaagttcctgccctcatacggttcatgtctcaagtaaatttgttttaaacagacactggatatcacctccattagttggaaaacaatgtcacatggaaaagatggtgacttgaatgaaaattgtgaaagctaaacaatgttggtttttacaaattctagctagacacagtctccctttctttgtttaaaaaatacatttttcacttttagagggtgtttgagacatactagtgccacactgcagccctccttgatgttattgggaaagtcaataaagaaccagaaagggggcaatttttctcactgtgggattcaatgttgttttattctatgggcccagctgactccaagttgactgcacttatcagcaggtatacaggacaggttccacactttggggccccacttggattcacataaagcagcacagtcccaggcacagagctcagagggagataacttttggctccagcaatattcatcataaaagagggcacattcttctttgcatctgcatggataggaaaggtctgggtatcctctgcatggttattaattacaaaatagatttcacatgtgttttcacgaggctgcgatttcacaattgcatcttagaatgtgccttcagagctctgagagctcctgggcgtcttgtctttgtatcatttggctcctcgtactaaaagccacatcctgttatgtttggttgctaggtggagaaatgttatcatgggcttcagcaataatttatccacaagctcaaggagttgtcatgttctcctgacagtgagctgcagcactttatcagctcgcctgtaaatcaggcgtgtgtgggtgcgaatgccagcactgtttgatctctcgcagacactgtaataatctgcttttgtctgattgattccttcacatcaccatgcacattgcaacagagagtgggtgccctctgtttatctcggctggtcatctgcaggaggccaacagggcagaaaatgctcttcgtgcggagatgtaagagtttttggaattggggcctttccatcatatccccgagctggtttcgttcaataaatcaatgatagctgaattgaatgcaccataaatacctcaaaccatatctcttacaagaatgtaagagtaattcatagaaacaggaaaggtaactttgtgagaaagaattacgacccctacaagccacagacattcagggctttttactgcctgtgttcacatctcacccgttgaactttgggggaaaaagaatacactgctggcgggtgtttgcttccagaacgtgcaccgggtaaaatggagtagaacagatcctgtcgagactgatcactgcttttcatctgacaccgagcttttctcaatttctgttggcttctgttacatgtggtccgacttcatccctggtgtcaagggatgcatcgcatcatcattatggagcaatttggactctgtcatttggtggtttatgagtcgcccttttgccacccccacaccaggcccacccttacgtgaggattgtcagcctttctgatgctttaaatgtcttcccatcaggcaagcctagtccctgtttcctgggctcctaattgctgacaggtagtttggggcacattttggcatctccagcccccaggagttgggctgaaatccgtgagctgattactgccttgagcatggcagcagcttgctgtgctgtgacccaggagccatccccagcgtccacgcctgccccagttgaaagcagaggtcaagctgtattgtagatgtgattgactaaaatcccatcggagaggaggattgtgttgtagcatccccctcttggatggcggcaagatgaaattacatgaagaagcctttcagctcagaaatgaatgtagctataaaaaaaaaaaaaataaagacagcttgagttgactgtttagtgcaatcaaaggcatgcaattgttcttattttcataatggtagtcaataatattaatgattatttattccactcctattgtgtgctcagacatatttcagtcacctgatagacattattagaaacagtctacattagtggttagagcacaagtaggcaaaccacagccagtgggccaaatccagccagccacctgtttttgtcagtaaagttttattagaacacatccacactcatttatttagatatcatctatgactgcttttccctacaacagcagaattgaatatttgtaacagagactgtgtggcctgcaaaggtgaaaatactatctggcgaccatttaaaaaaacatttgttgttgacacttgagttagaggattgctttggtgctagactgcctgttcaaaccctggctttaccacttaacagctgtgagacattgggcaagttacataacctctttaaaccttggttttctttcatgtaaaatggagattataataatgttggccaggcacggtggctcacgcctgtaatcctagcactttgggaggctgaggtgggcagattgcctgagctcagcagttcgagaccggcctgggcaacatggtgaaaccccgtctctactaaaatacaaaaaactagccgggcgttatggtatgcgcctgtaatccccgttactcaggaggctgagacaggagaatcacttgaacctgggtggtggaggttgcagtgagccgagattgcaccactgcactccagcctgggcgacagagcgagaccctcgtctccaaaataaataaataaataaataaataaataaataaataaataaaaataatgtttatctcattgagttgttgttggtgtaatgagcactgctatggtttgaatctgtctcccagaagttcatgcgttggaaacctaatccccaaatttatgttgatagtatttggaggcagggcctttggatggtaatcaggattagatgaggttatcagggtggggccccattgagaggactagtagctttataagaagaggaagagagacctgagttgacatactcttgccctcttgctgtgtgatgccctccaccatgttatgacacagtaagaagggcctcactagatgccagtgatgtgctcttacacttcccagcctccagaaacataagccatatagacttctattctttataaatcacccactctgtagtattctgttatagcaacagaaaatggactaagaaaatggacaaatatgttagccataactcaactggtaacaatattctctctgaacatcctgttatttgttctcttgtgcccactctgagcagatacatctgttcttcacctgccatttaggtgctgatgtcttgcatgttttgtgcctgtgcatttgcttgcatgaatttatgggagtggacatgtgcagcccagaacatttgagaaagatcagggcagagttacaggcttcataaaccatgatgcttttacaggtactttaaatatattcccaacgttatttgaagggtttattccaaagtctgcacaaaatcctcttagtctgactgttcaaattagaatgatagtgacctcagtggcgttacaggatgatttacaacatatttgagagtacatatttgctcttcacaattttaagagggcttagacctagttttaaaaaattgaaggttaagtcgcctatgtgaaaccttcaactcctgaaaactggattttgaaatccatgattttatactctatcataggagtcacaacatttttctgtatagggccagagagtatctgttttaggcttgcatctgttcagctctgccactgtagcacaaaacagccgtagataatatgcacacaagtggtttagtgttgctataatagaatatctgaagctgggtaatttataaagaaaagaggtttatttggcacacaattctggtgactggaagcttcaagattgggcaactgcatctgatgaagactcttactgcttccactcatggtggaaagaggaaggggagcaggtgtgtgcaaagagattacacggtaagagaagaaactagagacagagcaaggctctttttttttttttttttttttttgagacggagtcttgctctgtcgcccaggctagagtgcagtggcgcaatcttggctcactgtaagctccgcctcccgggttcacgccattctcctgcctcagcctcccaagtagctgggactacaggcacctgccaccatgcccagctaatttttttgtatttttagtagagaccgggtttcaccatgttagccaggatggtcttgatctcctgaccttgtgatccaccggtctcagcctcccacagtgctgggattacaggcatgagccaccgcactcggccaagccaggctctttttaacaacccgctcttggagaaactagtccattcctgtgagagcgagaactcactcacccctgtgggagggcattagtctattcatgtgagctccatggacataaccccaacacctctcactacttcccacctcccagcactgctgcattgggcatcaaatgtcatcatgagttttggtggagatcacaccacatctaaaccacagcaaatgagtgttcctataaaactttgcttacaaaacaggtgatgggttgttggcccaatcagccaatcttgctctaccacctctatctttaaaagctcatatttagtacttgtcctcagttccttatgggtattaatttattaatcctaacaaggatcttaggtggtagttgatagcttcatcattggcttttataggtgaaaagttgagggataaggaggttaaataatttgcccaagatccacagagcttcaactcagcctatctggtcccagagctagtacactgaggcaccattctatactgtctcctttagtcttagtgtacatagtgctattctttatatgaaaattgtccttgattttttttttttttttgagacaaagtctcgctctgtcacccaggctggagtgcagtggcgcgatcttggcacactgtaagctccgccttccgggttcacgccattctcctgcctcagcctcctgagtagctgggactacaggcgcccgccaccacgcctggctaattttttttgtatttttagtagagatggggttttactgtgttagccaggatggtctcgatctcctgatctcgcgatccacccacgtcggcctcccaaagtgttgggattgcaggcgtgagccactgtgccaggccaaaaattgtccttgcttttaaatttcgtttgtgtgtctgtaaggactcctttatggaagacagttttaaaacaatttctcccatccctagttgtgtttgtaaccaaaagagagaacactctatctttatggatactaatgggttggggtcactatttttcaatgaatgggtacttgagtccgccaaatccttgccactcaaaatgtggtcagcttttgtgggcttgcaaccagcgcagagtcctgcacttggaagtggctgcatgcttgaggtttaatgctctgtggttgccaccttgagatttgtaattctatgtttatttgtgttttgtaagtgacatccaaagggacattacttgtgcccggaacttggagcctcagctcacgttagttcctgccttctgctccctgtccactccctggatggcttcttggctccccacttcctgacactgtccagtgacggctgctgccctctgtcttgatggggcctcactccagtgaacttatctcatgagcatccctgtgtccaagaaagaacaacattacaaagcaaattagaaaacaccaaggcagatggagagagagaccacaaagaaacatttctaaaaattgctttttgaataaaggggccagcattttttagtctacactgagcctcacaaattatgtagtcggtcctggctgactctcaacagcagtattacctgggagcttgttaaaaatgcagaatctcaggctgcaccccagacctgctgaatcagaatctgcatttttttccaggatccccaggtgattcctgtgcacatacaattttgagaaacatagcccaaaagacggcttccaaatggaccagatgatcggatgcttaaaaggcatcccaggcaattctggggctcagccacttctgggatccatagtcccatatggatgtttcccagacttacctgatgatcagaaacctgaggcaagtttataacagcaggagctcccaggctgtctgctccaatctctgcatcagactctctgaaggagggtcctgggaatacatatttttaacaagcactccagatgacccttcttaggcagtaagtttggaaaactcaactctttataaatgacacacgaggacctagaggcatccccaaacatctaacttgtatccatatctgtcacttacctgtagaacccggcttaacctcacttgtaatttataagcattttaactagagctgcttcatctcaatcatctgtgtgtttgcaggtcacagtaaagagctatttcagtgcaatgaaaatggaacccagggtatttgggagttttgacatccaggcctagtatcgtaaagacaccaaggtaaagcaagacaaccaggcccctggaggttatgtctttgggcaactgctatcaatgttagagagactggggggaagagaaggagcaatgcttctatccgtcagtagttactctgtgtgcataggttgctctcaaagaccttggaccactgcgtggtggtggcccggaaggtcaacagtgtattaggtgacatcagggatgaaccgagaaatggtagggtctcaaccttgtacaaaacaacagagtatttggatctgggatgctgagtgctgtgtctgactgtactcccaggtagacataaaggggtggaaataagtccacaagaaatgggtcctttttgtgggaggtacaaagtatagtcatcaaccaaagtcagactaaagtagctggaacttttctgtcccatgcatagactgtgaaagagcaatatagccaagaaaccttatagaagcatggtttccaaatggaccatgctggttgcgaactcctgagggagggaggccagaggaaggcaagacgagctatgacctataccctctaaaggggatcagtgccagctcaagctagttatgcatatgtttatgtgtatacttatacatatatgcatgtaatatacacatatatgtaaatgtgttatacttttagtgtacaccattatggccataccattcacagcttttacctgctttgcttgaccaaggaccatgcagtgccagttgttaaaatttgtgtatacacatatagagaataattagctatgttactatatacttacatatgagtatatacattgtattacactatattatacaacattatattatttcatattgtacatatgtaaacatgtcctatgtcgttccaaatgtcagactatggccaaagggcttgaccaactctggaccacccaacaaaaaattccagttttttgttgagtaagcaataaatgtccttatggtttatacttgtgctattcaaagtgtggttcttggatcagctgcattgatattccctgggagcctgttagaaatgcacactcttaggctccacaccagacctgttgaatcagaatcaccgtcttaacaatcatcccaggtcatgcatgtgcacattaaaatatgagaagtggtctgggcgtggtggctcacacctttaatcccagcactttgggaggccgaggtgggcagatcatgaggtcaagagactgggaccgtcctggccaacatggtgaaaccctgtctctactaaaaatacaaaaaaattagctgggcatggtggcatgcacctgtagtcccagctccttgggaggctgaggcaggagaattgcttgaacccggaaggtggaggttgcagtgagccaagatcgcgccactgtactccagcctggcaacagagcaagactcagtctcaaaaaaaaaaaaaaaaagtgcttaagtagactaagccttgttcttttatttggggccttttctgatgctgttccttttccctgaaaacacttatctagcatgctttgctttgtgccggaatctagatgctgcaagttcactcccactgttgaagggtttgtctagtgggcctcttgacttgcaagtcagtgctttttcttttattcttaggtaagtattgcagctctttgtgttggttatctattactgtgtaacagattacccccgaaatgtagcagcttaaaataacacatatttattatctcatatttattatgggtcagggatctgggcgcctcttagttgggttgtctgcttcatggtctttcctgagactgcagtcaaggtgttagccagagatggggtctcttctgaaggctcagctgggaaggcccccttccaagctcagtcccatggcttttggcaggagtcagttcctcaagacttgtgacactaaggcctcatttcttcactgtctggctggttgctgtccagaagccaccttcagtttcttgctaggtgaacccctgcaacatggtagcttgttttataaaagtcagcaagggagagagtcagtcagcaaatggaagttacagctttttaaatcaaatcgcaacagtcagtcatgtctctttagtgctgtcatattctattggtagaagcgagttactgtatgagggggaatcacacaatgctgtgaataccaggaagcaggtatcattgaggccatcctagagtctgtctgccacacctctctgtgtctcagttttcttatttacaaaatggagaaataataaaacccactttataaagattgaattaaatgtgtggtttaaatgagatgatttctcctaaagccctttgaattgttcctggcctgtactgtgttcaaaaatgttagttgtgctgctcttgttatatttggcgtttttagtagcaccctgctgattactattattgttgttaatgacaataattacacagataaagagctcagtagatatatatgcaagatattatgccaaatattttacatgtgctttcaaatttaaccttaatgacaaccatgtgaggtgatggctaatttattaatttcacccttcctataattgactaaaccagtgttcataaacaacaaaaccagaagattgcccaagatcatactgcttataaatggctaagttaggattaaaatccgtattattggtctctagatttagactttttttaaccattatgtattagcttatgtttaatatggacattttctcactgtcttgtaagattttttttttgccattacttaggagtccttgacataggcaacaaggaatagaagtgtgatagtcctaccagttaatgactgacatgctaaactttaaggggaaagacattatataggtgctatggtttgaatgggtcccccaaaggtcatatgttagaaacttatttgttaatgcaacaatagtaagaggtggggcatttaaaaggtgattgagtaatgagggcacacctctcaaatatggattaatgccattatcaaaggagtgatttctagagaagttaatctcaagattaaatcttgagattaatgccattatttaacgagtgagttagttttcaaaagtgggttgttgtaaaagtgaggttggctcacttttgcaatatttttcacaagcactcacttgctcttctgcttttccaccacgttatgatgtagtatgaggctctcaccagaagctgctgccatgtccttgaacttcccagcctccagaaccatgagccaagtaaacctcttttctttacaaactacctagtctctggtattatattacagtaacagtatctttcccccatttttggggaaagataagtttctttcttaaataaatgtgaaaattcattatttgtttcttccccttacactgtgggatgctgttatggtctgaatatatgtgtcccccaaaatttatatgttggaacctatttacccaatgtgatagtattgagaggtagggactttagtaggtggttgggttatgagggtggaggcctcatgaatgggattagtgcccttgtaaaagaggcttgaaggagcctcctcagtctacccttctactatgtgaggatatagctagaaggtaccatctttgaaggagagagagccagtccttggcagacactgagtcttctggcaccttgatcttcccagcctccagaaatgtgagcaataaatttctgttgtttataaatcacccagtttaaggtattttgttatagcagccctcatggtttgagttaggcacctacaatgtaagaggcatccctaagcatcagtccttgagtataaagcattatccttgttcttcctcagtgtccagtcttatgactatgctgtccactacccgttgggctgcctgagatagagatatgtagttgtcctcaacatccatcattcccttgatcctttactaataaggcccgtaattgtatttggaaacatggtggcccagctgaagactgcatttttcagcctcttttgagctggagctgggcaacagaatgtgagaagaagtgataatcagatctttaaagggtgaaggcatttcctctagtcttctgtctttgagctgccctttcttcctctttatgtaatgtggctgggactgatttcatccttgctccaggggcctgcagcctggtcaatcagatcatcagcttcttcctggtcattgtgatgtgcccatatcacatccacccaggcctgaccaattgagtatcccatttctccctgtctcagtgactggttcaggggtatgtgtagatgaccccaaatctaggccagtggaacacaactttggaactttcatcacgatattggaaagagaaaagtggctaccttcctgctgagcctacagtggttggactatgtataacccaagaactgctgggtacaccatatggctagaatgtggctgagagggaaggtgatattgatgaaaacagaactacgagagggactgaaagagatctcacactattgtctgaggctcccccttcatccctgccaaagccccgtgtacactgggacttgtcatttttgtgagataataatttccatgcccttaaaagtaacttttaaaagcatttatttatttatttatttattttaagtaaaccagtttaaatggaagtgcagtcccttgaatctgaaaaaaaattgctttctgatatcataatagttcttacactttgtgattggggattgttgggaaaattaaatgagatgattcatgcgaaacccttagcacagtgccaagatagtgtctgattaatgctggctattctcgttcttactagtggaaagagaaaatgtagactcatgttatgttttgggcattgaaacttactttaaaagggtttatgatgactacatagatttgtagacctgccaccaccaattcatagaccagctacatcggtggacccctgtttttcagggcttttgctatgggggacatacagagaggcaagttacagacctaccctgaggctgttataggggaggcagggggaagccgtggctaacagcatggatcctggagccatataagctccagattctccttccgtcactcattagctgtatgacttaagtcagcaaatttcacctctaggcctctgtttcctcttctgtgagataaagatgatacctgtttgaagttaaagaggtgaatgtgtgtgttaatgagcccagtgtctggtactgagaaagttgtcaattaatggaagccatcacttcccataaaagtttttaaaatataatcgatcatattatattacctagtaatataaattcctaacttgcaaactgtcttgtaacaaaaatcttatctgtatgtttttcatttatctctagatcccagctcagtgcttggcatagaataaaatatgattaaagttttctgtatgaatcttttttctttatcaaatcctttttgactcaaggactacagattacgtcctgactgggtgccctgaatccagccctgccccctctttggcccgttcactgtgaattcatctgtgagcacttggtcactgagtgcccactaggggccaggcacatagacaagcggacaagatagtcaccagcagccgacaagacagtcaaggaatccatctttgtggggctcggagtctagtaaaaaagatggatgaacaaatgaatatgtattatagtagcaggaagggatgaggactctggagaaacatagaccaagatacaggatagaaagtggcagtggatgtttctttagatcaattcttcagagaagacttactggaagaggggacatttgagcagaaatctgaatgaaatgactgggtgaatgaaacaatgtggtctgctggaggtggggggtgggaaggcaaagcaaatgcaaagaccctggggttgaagcttgcttgccttgttcaaggaacggcgaggggccagtgtaactgagcttagtgagtgtggttggggagatgacgtcaaaaaggcaattcttaatattttagaaatgtgtttttaaaatcctgcatttaattttcacattagtaatcacatcacatcagtagtcacagctttctgtgacttccaattgctcttcaaataaagtcttgcatggatttaaaaaaattctttattgttaatttttaatttttgtgggcacatagagttgtatatatttatagggtacatgagatgtttggatacaggcatgcaatgtgaaataaacatgtcatggagaatgcggtatctatccatcctcccaagcatttatccattgagttgcaaacaatccgattatactatttattttaaaatgtacagttattattgactgtagtctgttgtgctatcaaatagtacatcttattaattctttctaactattttttgtgcccattaaccatctccacctcccccacagctccctacctcccttcccagcctctggtaaccatccttctactctatatgtccatgagttcaattgtattgacttttggatcccacagataagtgagaacatgtgatgtttgtctttctgtgcctggtttatgtaacttagtgatcttcagttccatccatgttgttgcagatgactggatctcattcttttttatggctgaatagtactccattgtgtatatggacggtattttctttatccacttactcgttgatggatgaacacgtaggttgcatggatttagaacctctgtgtagcctctaccagactcactttcttattggttcagcagtgctggttttgaaagttttgcagaaaagaacccatctccatgctgcttcggggccgtgtacatgctgttctgacattcttttcttttccttgaccatccaacacccactcctctgatatgtcctcagagagcctcccttgacccttgtcctgagatttggtcaggtttggttttgaaacattttcaagaattttgtttttcttccttgaggcacttttaaccactgcaaatagctaataaattgagcacttgatttaatgcctaccccttcggatagtttgtaagctttccaagatcagacttcctgtatagattatttagcagtgtcctggggtcttgggaaagttttaacaaatagcactcaagaagtggtcatttatggaatgaatggataggcattctgaggcaggacccttctctaccacctgcacctacctcactcacctgcacctacttgcacccaccttcactcacctgcacctacctgcacccaccctcactcaccagtacctacctgcacccaccctcactcacctgaacctacctgcaccccccctcactcaccagtatctacctgcacccaccttcactcacctgaacctacctgcacccaccttcactcaccagtatgtacctgcatccacccctgctcaccagtacctacctgcacccaccttcactcacctgtacctacctgcacccaccttcactcaccagtacctacccgtgtccacccttgctcaccagtacctacctgcacccaccttcactcacctgaacctacctgcacccaccctcattcaccagtacctacctgtgtccacccttgctcaccagtacctactgcacccaccttcactcacctgcacctacctgcacccaccttcactcacctgtgcctacctgcacctaccttcactcacctgtacctacctgtgcccaccttcactcacctatacctacctgcacccaccttcactcacctatacctacctgcacccaccttcactcacctgtgcctacctgcacctaccttcactcacctgtacctacccgcacccaccttcactcacctgtgcctacctgcgcccaccttcactcacctgtgcctacctgcgcccaccttcactcacttttacctacctgcacccaccttcactcacctgtgcctacccgcacccaccttcactcacctgtgcctacctgtgcccaccttcactcacctgtacctacctgcaccgaccttcactcacctgtgcctacctgtgcccaccttcactcacctgtgcctacctgcgcccaccttcactcacctgtgcctacctgcacttaccttcactcacctgcgcctacctgtgcctactttcactcacctgaacctacctgcacccaccttcactcacctgtacctacctgcacccaccttcactcacctgtgcctacctgcacccaccttcactcacctgtgcctacctgcgcccaccttcactcacctgtgcctacctgcactcacctgcacctacctgcgcctaccttcactcacctgaacctacctgcacccaccttcactcacctgtacctacctgcacccaccttcagtcacctgtgcctacctgcacccaccttcactcacctgtacctacctgcacccaccttcagtcacctgtgcctacctgcgcccaccttcactcacctgtgcctacctgcgctcaccttcactcacctgtgcctacctgcatccacctttactcgtctgcacatgcatatgcccataatatactgtcatagaaagtgagtgttatagacaagttgggggttaaaacatccagaggcaggagcagtgggccttgatggcctgtagggaggggtcaaaggaacatttgagaaaagtttctggaggtgatgtgcttggagatgatactgggaatcatcatcaacctgtactctgggacgtagatgaggatctcttggattaggggtgagatggagctaacgttttaaaaatattaagcttaggagaatctaaacagtgagaaaaaagagaaacttttttcctcaaaaatgcaactgcattgtatggagcagggagagagaagtcatgggccaactgaagcgacaatcaggaggatgcactgggggtgttgtcaccgtgttttctaacagattacaaagcctccttgctaaagaactgaccttttagtttatacctgagtgacacaggcagcagcatttcccataatgagaagatgaatggaaaaagtatgtctgaagcctttcctatcatgtttaatgagagatgagtttttctctacaatttcttaatgaaatgcttcaaacatgacttttaaattgaaaggaaaaccttatcattttgtgtactcctgcggctctgcatcccctgagctgggatgagtcaacagaaattgtaacacgacaaggaagaagtttccacgaggacgcctcctgcaggtttgtgcttactttccctgatgaaatgatggcgtctcctgtttcctcacgcttgcagtgttcacgttgtttccatcgccttgagagatgctccacactggttacatcactccttggctgtcatcatctgtccgtctttgggggaaatgacagagtgaggtttagaaagaaatatgtctgaaaggatcacatactaaatggtccaagaagaatatcagtatttttaaatgatccaaaatcatgggctattggaccttctggatatgtggtcactcttttcatataaaggggaaccatcagaagagtatccgatgcctaaaatatttgctttttcatgtgaaattatctaaagacaaattgaccaaacaaaacaaaacaaaacaaaaactctccctcttatctggatttcattaaaataaagtaagactaaaggtattttttacttttttgtctgcgtctgttctcaattaaccgcataaacacttcataaatcttgcatcagggtaatataacactgtacagtgcattttaactggaatattttgttttctgagtgctgtggaaggtggaaaccgctgagccctggctggggcagagcctgccaggccacattctggagtttctggagcatcgcaggtgaattctttgtcctgtgttggtgcagagaaggggtttcaaagtcacgtggagttacttccagctctgacttcttgcttttctaaattttcttggtcctgtgaaataaaaatgagctttcttaagattcattttttatttccctccagtgaaaatgtctcttatttcctctcattctcctcctcccttccccacataccaagacacttaattgagggtttaagcttgttggctaatagctaatcaatgttttctttgacttgggaatatggataatgtgtttatactatttgtaacctactttttcctaaagggaaatgaggtagtacacacacacaaaagcagcaagaaatgtaaaacaataaaaatggaaatttggggtcagggaaggtagaaattaaagtacaaaataaaaaatgaataacaaaataatccagtaagtatatcaccaagcttgactactatcaagcttcatagttttctctgagcttcctgctagccaagagaaaaggggatgaatggaacaactggttccataattctcattttctcaaagaaaatccaaagtatttctaatccttttgacgaagaatattttataaacctgaattttgagcagcacctcacacaggggcaaggggaatagctgaattaaacatcaaacagaatggtgattttcatgggatagtacttggtagcattgttcaagaaaatccaagcacgtgacattaaaacaactcagtgaggaggactccatgcagacattgtggtccaagaacaaggcatattggtagagggaataattaggagaatctgatatacagcatggttacatagggaaatgtcatattacttctacagagactgtcccttgtggtgactgacaaaagacataatgaaaaccgtctgtttagatggggaaaatgtaggtggagctactgcattctcacctgggaacactgagctcacatgtgactcatagggacacatctaacctcttgagtagattaatggcttagttgacagggactgcttaatttaagagtgatatcgtgggggttgcccaggcagagtactacatgtctggctgtgattgagactaggcctctcaggcagagcttttaatatgcctttgacagaatgttacaccttgtcatgcctcaatctttttaatcgttgctaatgatgataataaaaataatggcaatattcaaggcagaggcgaacaaagaaaaggcaatgactcgtagagtggattgaggtgttgtggaaagaaagcccaggctggaaatgtgggggctacttctggcattggcttaagcatggtatatacaggtgattcttttacgtctcccatttttctaatttgcaagagaggctattgtagtggttctccaactgtcagcttttggccagcagcattggtatcagcagggaacaaaataaaaaatgcaaattcctgggccccagacctactgagtcataaactctgggaatgtctctccgtgatttgtttcttgattacaggtatgagccaccgcacctggcctgagcagtttgtttcttaacaagcagtctcagtgattctgatgtatgctcaagtttaagaactattgggcctttgagttaagtctccttctatatgtgtgctagattgatataaaaatggccccaattctccatccctctttgtatctataccttttgcaagctactcctgttaggaggtagagatcttggatattcttgaatatttgaaatttgaattcttgaatattctcgaatattgaacattcttgaatatttactgctcttgcatcttgctttggccaatagaatgtggcagaagtgatggggtgctgtttcgaagctactcagttctcttgctctttgtttctgtttctgtctctcttgcgctcaatttttcagaaccttgtacagtcctgagaatgagcctggaccaacttgctagaagatgagaatgggtatgaaagagagctgagtccttcctacacaggacatcgtagaccagccacctccagccagcctgctagttgaccaaggtgcataggtcagctctgcctgatagaagttgggccttagtccagaggacatactaagccaatctacagacttgtaaactaaaacaaatggacattgctttaaaccactgagttctgtggttgtttgtgatatagaattattatggtaatagataactggtacatgatggaaatgctacaattctggaaatctaagtgtcctgaccttagatttgtgttaggaatctcaaaatcacataaagcaatgtaactttatttttctttaaccaaatgtgttttatcttctgagcccctattctattaggaggtgggaaattatttgtttgtttgtttttaagacaaagtcttgctctgtcacccaggctggagtgcagtggcacaatcacagctcactgtagtgtcaacctcctgggctcaagcattcttccaccttagcctcccaagtagctgagactacagatgcatgctaccatgcctggctaatttttaattttttttgtagagatgggtctcactatgatgctcaggctgttctcaaacttctgggctcaagtgatcctccttccttggcatcccaaagagctgggaatacaggcatgagccaccatgacctgccagaagttagttatttaatttccagttaattccagataatctagatcaatatgtttatgttatctttatgtaaattttcatcaataactcctgttcttctcttcctctgggtgcatgagaagatggcacttccttacctccttgaagttaggtatgacaatatgacagtttcccccaatgcaatgtgagcagaaatgagtcacttctgggtggaagcattgaagagtttgtatgcaattgtccgtgttctctcttcctttaccttcggttgtggaaggacatattgacagacaaatacctcaaaattgaagtagcctcagatgctgtgctgccacatgaatcacagattccccagagagttttctgggcctagagttggcttttcatgaacaagaataagccttcatttccagccattaaagtttgggactgtttgttaccacaccatagcctagcttatcctgactgatacaccaacttttctcagttaactaagggtctttcttccctgcttcaaattctttctcctaatgtattagtttgctagggctgccataatcaaatgccagagacagagggtttaaacaacagaaatttattttctcgtagttatggaggctagaagtccaagatcagggtgttaccagcttgatttcctctgaggcctctctccttggctggcagatggctgccttttccctgtgtcctcatatggtcttttgtctgtgcatgtaccacagcctggtttctctctgtatctccatatttctttttcttaactgctcaacatcactaatcataagggaaatgcaattcaaaaccataatgagatgatatctcacactagtctgaatggctattattaaaatgtcaaaaaataacagatactggtgaggttgtggagaaaagagaatgcttatacactgctggtgaaagtggaaattagtttagccactgtggaaagcattttggcagtttttcaaaaaactcaaagtagaattatcattcgacttagcaatctcattactgggtatatacctaaaggaatataacttgttctgccgtaaagacacacacatgtgtatgtttattgcagcactattcaccatagcaaagacatgaactcaacgtaaatacccatcaatggtagactggataaagaaaatgtgattatatatatacatatatatatatatatatatatacacacatatacatacacatacacaccatggaatactatgcagctataaaaaggaatgagatcatgtcctttgcagcaacatgggtagagctggaggctgtcatcctaagcacactaacacaggaacagaaaacaaaacaccacatgttctcacttataagagggagctaaacacggagtacatacgggcacaaagaagggaacaacagacactggggcctacttgagggtggaggatgggaggagggaggggatcaaaaaactgggtgaggaaacaatatgtacaccaaacacccgtgacatgcaaattacctatgtaacacatctacacacgtgtccctgaacctaaaataaaataaaatttaagaaaaaagaagaaatttccaaaaaactcccaaataatttctttttctaataagtctaatagtcaaattggattagggcccactctaagaatttcattttaatgtaatcatttttaaaagaccctatctctaaatatagtcactttctgagatactcggggctagggtttcaacatgtgaattttgggggaacacggttcagctcataacaccatggagaggcatgcatgttctaagggggtataggtaggactgctgtagggacaggaacagcagtgacttgaatgtccatcgtgtatactggcttccagtggagggcggtcctgaatattgccactgggtctctggctgcacagttcacatgtatggttcctgcattctgtatgtctcgacccagttcatctacctgctctcgtgcgtgttgcattatttccggccacacagagaaacagagaaaaaggccactctgggcacactggtctggacaagcctatgtgttgggaacttccccaggcccagttctataactaagaatgtgtccacaaacctcaccacctctttgagttccacccagggagcaagctccagcatcctttccttttgtattctttgaaattctctggggtttctatcactcccctctgtttgggggctattcagcatatgtatgtgtataagtcctgtgaatatgtctgtgtagatggggggcctaacattcagcgacccattcctgacattccagggacctacagttccaccagcatctaaatctatttgctttgcctcttcctctcccagtctcttattggatgggaaaaaatcttgctctaccttatcatatgttcatatatatatatatatatatatatatatatatatatatatatataaaacctcaaaattttgggctcaagcaatcttcctgcctcagcctcccaagtagctcggattacaggcacataccaccatgcccagcttatttgttgtattagtctgttttcacactgctataaagaaatgcctgagactgcgtaatttataaaggaaagaggtttaattgactcacagttcagcgtggctggggaggcctcaggaaacttgcaatcatggcggaaggggaagcaaacacgtccttcttcacatggcggcagcaaggagaagtgctgagcaagagtcggggaaagcaccttataaagccatcagatctcttgagaactcactcactatcatgagaacagcatgggggaaccgccctcatgatccagtcacctccctccctcaacaggtggggattacaatttgagaagagattggggtggggacacatagccaaaccatattatttatcttattttatttttgtagagatggaatcttgctatgttgcctaggctggtcccaaactcctggcctcaagcaatcctcccacctccgcctcccaaaatgctgggattatggcgtgagttactgcatctggccttgttatacattttaaaaatttttcttggatcttggctttgaaactcaaaagctgaaactttgacatttttgtccttcagctcctctgcaatacacctggctggggtaagatacaccaatctctagtctgaatgcagaagattcccaccatgaggtgggaataaattaccaggaattaaacacacctcacttatataaaaatacttccctcctccattagaatgcacacatttgcccattaggatttcttcttctgacaccaacaaagaagactataaattacatcttgacagaatttaattttcatggtgataactgaaaagctttggtttataaaccatattcagggtccagaaagagggggagagttacttggttttagccaaccattgtgaaaattaaagtagttcatctggatgcagagtttgaaataccatgttgaaatagagtattgcaatataagagcagcactgatatcacacaaatattatgaatgctcccaagcaaagtaaaaacattttgaatgcagaaatgaatttgtgattgatataaagaagaatgaatggagaatgatctatagcatttgtctgaaacctcataaaggcagtatctgaatactggttgttcctgatttcattagttgtgaatcactacatgaagaatgtgtgtccaagttaaacatgagggtcttggaattattttaaagaaaaaaatcaatttcactctctaggatggttttctccttctgatcactgggtcttatatgttgagattagtgtgtttaacacctgatttctcattttccccctgaatcttcattttccattgtcatttggcccacttctgtgttttttcacatcttcttaatgtctctcaatgttgcttttttttttttggttgttctttccaatcttttcttattttctttctcttcaaaaagggaatgaaggaaaagccaagcaaaatatattttaaaaataagggatgtgtgtaggcaaatactgagagatgtagaccaagcagagatgaataattatcaaagtttccaacaactctagctgtgtttctcaacaggaggtgactttgcctcctaggggacatttgaaaatatctcgtcacaacttatgggaggatcagcgcctgactccagaacaaagaataatccagcccaaaatgtcagaatttccaagattgagaaatcctgaatcacacatatggttttttttatcctctccaaattaaaaaaaaaaaaaaggaatgtattgccagcattttacatataaagcagaaaatctagattctttttttaattaatcaggcaagtgattaaaagccaccttctgagagagggcctgtactctgcagtgcatcacagcctctccttctagctgtataaggcaaattcaaggtccagaaagaagggggaagctacttggttttagccaaccactgtgaaaattaaagtagttcatttggatgcagtgtttgaaatatagtgctgacaatggagtattgcaatatacaaaactcacttcattaactcatattacttcctggcccttgtagcaaactgagtttgcaaccctctgcattctagggttggtacattatgaaccatgggccaaatctggcctgccacctctgtttataaataaagttttattggaacacagtcacactcacttattgcttttgtgggtgctttagtgctatgttgaatagttgcaaaatggactgtgtggcctgcaaagccaaaaatatttacactctggcactttacagaaacttttgctgattcttgccctaatctgttgactctattgattattagtgttagtctttgaactgaggcttcctgttggcataattgttagtatagacaagaaatgacagtgtgtttaatcacataaaccaatgtggatttcaattaggggagcccaggctcagtcaacatttttcatatattggtcattctaggaaaacataggattctcaattgaaacatgattagctttctgaatggaatacgggcaaggctaaaagttaacacagtcttactcttctcccctgttgtcagtgacacatttactcccattatgattggctcaacatatggccttgtattttgtccacaaaataccacctgctctgggctgtttgttagatcatctgcctcagaagaaatgagaaacgggaaatagatttcttgacctattcagtttattgcttaaccaccacataatacaaatgtttcaactaagctttgttcatttattcattggtttagttcaggggtcagctaacattttcagtaaagggccagatagtaaatatttttggctctgagggttggctaatctccattgcagctactcaaccctgtctgtgtagaaagagagcagttggaggcagtcaatcaaaccatggtagtggctgtgttgcaataaaactttatttacaaaaataggcagtgggctggatttggcccacagcccgtaatttctgactccaaatctggagatgccttagtcataattgggagtggaggtagcagagctaccgaataatggaaaatggcattttctgggtgatttctcattttccatcctcactttttatttgaaaatgcttcctcttctttccttcctccagtggctcaggggcctgctgttgagggaagagctggagtgagatgagcaggtgaattctattgtggattatgaagctagttcagtagaaagggagtgccacctagattggaggggagtgagacgaggaaacaccttccggttcctgaaacaggagaaggtaacatctcttgtaaggagaggaagactggtgcctgcttgcagctgaggagctgagtctgctcgagactccccaggtcccggaatcctcccatccttgcatccttctcttcatccatctccgcagacatctcaaatgtgtccattccccatgggatatgcatcctgggaagtgcccagtgatagctaactctaccaaggggatttgctttttgttagggactttcaaagtcttttctgtggtttattttcttctgactctaatacttatataggtttttcatcaaaatttggcaactaatgaaaatgtatgtttgagcatcacttattgagcatcacttttactcagaaatgtgcaaattattaaatatgagcatgtgtgtgtccatctacataacacacacacacacacacacacacacacacagaggcactcacccagtcacctaattttaaggactcctaacaaatctctgaggtacctagttttaagcaggtagaaattaagcagcttgcccaaagtggataccgtagtaagattttaaacacagccttgcctgattccaaaactcatattcagcttttttaggatactagtctatctttaagaagaaagaaaaaactatcggccgggtgcagtggctcacgcctgtaatcccagcactttgggaggccaaggagggtggatctcgaggtcaagagtttgagaccagcctggtcaacatggtgagacctgcgtctctactaaaattacaaaaatttgccaggcatggtggtgggtgcctgtaatcccagctactcgggaggttgaggaagagaatctcttgaacctgggaggcggaggttgcagtgagccgagaccacgacactgcactccagcctgggtgacaagagcaagactccatctcaaaaaaaaaaaaaaaaaaaaaaaaagagaaaaaacaatcacccatactgtccctcagacgaaaaagctgccaccttttgcggtgttttcctccagtgttttcatttttttcttctatttgttaaagcattttttagatcatgttgcaaatataattttattatcttgcttttttcactttattatttaagtatcattttaaaacctctttgtaagtatcctcttaatggtatactatttcttcatataggtatattgtaattcacttaaccaactcctctctgctgaacattgcggttattgctagtgttctcactgttttgaataaagaggcaatggatacctttgagtatgaaaaaactttccctcatgaaacttccataatctgaaaagctatccagaaacatggaaatgctattctttgagagaggcaggtgacataagtgaatcactcactttggacgaaaaatttaagggggcaccaaaaaaaatcttcgttattagcatataatagtataacattaaaacattaaattaatattaaaatctctaaatccatgaagaagaaaatatcaacgtcttagataaaggcagggtcagtattactgagtttttcctttagccttaggctccgagctggccatgcacagtgctgttactgactccattcaggccgtggggaggacataattggtgtctggaaggagaaactcagaactacctttattataatttattataattattgtgccctatgggaagctttcttctgaaaaggttcagtgtgatgggcccaaaaacagactctggcaaagactgcttggttttaaaccccaactatgccacttacgaactgtgggacctttgtcaaaataattccactctctggacctcactttcctgatgtactgcatggagatgatgataatcatttatccctcccagtggatgagaggacttagtgagtcccttagaacagcgtctggcttgtataaagactcagtaaatgttccctgttctactgctgcactgtgagcctgcccccgagctgaaggcagcctgcagacctgcttgctttactccatctggcattgttagatttttttttaaaaaaattagttgccaacattctaaaatcgctagatttcatgaaaaaatctgattttttttccccttatgaaaatcagaagacctggcaaacctggggctagctatgtcttccgtagtggtaacatttagtcaaatctgcaaaccagaagatggaagttatctccagtttaccctgaactagggttgccagagttagcaagtagaaaagatatgacatctggataaatttgaatgtcagacaatttttttttagcataagtatatcccatgcaatatttgggatatacttatactaaaagactgatttattgtttttctgaaattatgagacatatgctaaaaatcatttgtttatctgaaactcaaatgtcaccaagcatcctttatttctctaactcttccaaccctccctctccgcctatactttacagcttcattggcctgtgacttccacttaacctctgtagacatcagtatggaggaccttgggatcacatataaaaatcccagcagaggtcatcttccataagtagcactgtgtgtcatcactgcagtgcagttttaagctatttaataaacttccctcaagtctggcggcctttccatgataaaactgggggaaggaatccaatcacctaacaccatctcagcaccattgagtgagttccttgagcaaatgctcatgcgtggacgtgaagttagaagaaggcggagctttctacgttctctcgctgctgctttcagatagggaaccaggtctgagaacattcccgttgaagtagcatctcttagggccagggcatgaaggatggtgatgttttcctacctcacgttgagggacccagccaagcagggcaggtgcttttaagagccacccatgtccctgcttgatcaaagtgagaggtagataccattagcatggttgctctgtgtatagactgaagattatctttctggcttctatcagatggaaacacagatcttagcaggcagatcaggatcagctcaagcagcatctctccacttcggcactatggagtacttctttgtagtggggaccgtcctgtgcattgtagggtgttcaacagcatccctgacctccacctaccagatgccagtagcgaatcccctcagccctcatctccttgccatagttgtgtcaaccaaaatcatctccacacattgttagatgtttactgggaggcagactcactcccacttgagaaccactgtactagaaatatcaccaagagaatggagtaggccacacacgccttaatccatttatgccggaggttgcaaatttttttgtgtgtgaaaaatcagaccttggcgatgatcttgagcagtaagatataaataactcccacaagcttagcgttccaataatggaacactaggcatatgtaggttttaagggctgcagtaacttaattgtgtgagtcagttttaagttactggggtggcggtgtgtccccagagctgcagactggaggtctcaccaaaagtcctcaaatcccattcccaaagttgttggccaaataaaacttttctgtaggcagaatttgggctaagagaatccagtttgcaactcttgaaatggagacattcgcttagctgttctttggtttatggtgcaaatgatgatttgtttcactcctgtttgtgtgtaaccgaatgggaaggctcaaggtatctcttgctttgtgaacacctctctctctctctactcatttccactccccagccctgacaagtgctgcttctcacggtggggtgattttgcccctctctctaggggacacgtggcaatgtctggggacagttttggttgtcacaactgggggatgggagtgctattggcatctagtggtagacgccggcatgctgctaaacatcctacagtgcacaagacagttactgcaacaaaggattttccgaccccaaatattcccagggctgaagctgagaaacccagctacagcaggcaggaatgtgtggctcacctcagcacgctaagtgaggagcttttcctcagcactctgagcacctgggggttcaaagaacttgccttgggtctgtagctggggaagaatcagtctgtggactccagggagggacattttcttttcttttcgttttgcatttgtgcccagaaacagcaaggccagcagttttgtaaggatacagtttcttatgtaaactttcctttcttttgttgaaggtttggatattctacagaagttcacctgggcttcagattcgcacctgatcctaatctctgattaacaccatcagataaagagattctcctaacatgttggggccatagactaaggaagtttagcaagtctgggaggtgagaaatctaggggcagtgtggagagaaaaatagacccaactaaatttcaatatacaaccctacatcatctcagcattattttccaaacaccatttcccctctttatgcaattataaatgtggaccagcctttgataaccaataaagtagctgatgcaatattttcttatcccccttttgccttctgttccctttgaaatattatttggttctattttttttttctcctggtaccctctgtctctcttcgttttttttgtgtgtgcatgtgaccacaattgtagtttcagtaaataaaacggccgcttgataacgtggaacggcccagcgcttaactctgcctttagagatcctttacatcaaaccagcaatcaaaaagtggtgcagataaaatttgtcatcagggatttcctacaaaagaattacagtggagaaatggcctgatcaatactatggattttcactgcaggggctggtggtccaattgctgtgagacactcacacagataaaagggcactgctgccgctccgtcacagactgctgactcagcacaaagcttggcaggtatttataggccagagtgatacagaattatcaccttgcagtgcccggctcttgttccttccaagattgccttcctttatgggattgctaaatgcaggtgaatggaaaaatgatggctaacagctgtcaaaatgcaacagaatgaagtacttaaatctttttttatccattaaaagggtaacaaccatacatatatcacggcacagacattgtaatgatatttgggggctggtaaacgagggagtaataaacaatatatgttctgatcagaacgactgaggaaatagtcttggagggaaggtaggtcttccctgagccttataattactttaatggttgaacatccctctcacggaagaaaaacaaaattgtttttgtatcccaatctttggaagacccactttccccttatgctggcatttagaaggcctagaactattccctatggcacttaaccatgcttactgcatcctgaaatttctgaagtttattcatgtcagcttaattaaagcatgtgcaatgatgataactgatttgtaagattctccaggtgtaaggtctgggatgcagtgagaactttctcttgggttgtttttaacctctgcgttccagttgaatttcagatgtgccatagacagagcttcttcggaggtggaggagaaggcacattactgctctcccacgaggtggggtcattctggggaagttctcaaagctcatcatctcagctctggggctccttagccatgacttacatagatgaagttagtacagttgtcctgattcccaattaatgcttcctcaaggaacccccctggaaaaatcttaccaatccttctagacccacccatcaatatttgtcttatttttcatttagtgagaatcagctcccagaaagattcaaaatagcacttatggtggccttgtagaatcttggcttgtttgagagtaggctgtgtgtgtgtgtgtgtgtgtgtgtgtgtgtgtatgtgtatgtatgtgtgtgtgtttgttttgtcttctcctttccctaatgcattttatttaaaattttcaatgaaccatttttttgatgaacttgaacattaaaagaaaaatgttttcctcattttcttcaatatttaaaaagtactgcaaagcacaagggaaatgaaccaaatatatagaatatcatcaataacaaggcatctggacattaattaattcttcattttggaacacctgtggcgagatgggccttgtgtaggatgtcgcagaaacacagggagtataacaggctttcaaggaaaaagagcttatggaaaggaggacaaggaaaatatttattgaatggattctttgtgccagatgcttggcatatgttataatgaaatagcaaacagccataaaatgctaagcagattcccaagtgcttcattgactcatgggatcctcataagaactctatgaagcagtgttattaccgtccccactttacagattaggaaattgaggcaacagaaggttgattaatttgccaagatcacttggcttggaatagaggagaggggacagccaggtgaccttgaaactccttggtgattcaagaatcccagctcctaactgcagagctacatagcttttcattttggaagctctctcatctcacccttaaaatagtgacatgaagtgggcagtcctgttgaaccaataagaaaagcttagaaaagttgcacatcttccccagccaggtaggcaaagagctgggatttgaacccaggtgtggctgtctccaaattttctgctacttttactgtatcatttacagtgaacctaccaagcaaacaagattctgcagcttctaaattcagaaaacaaaatgcaggaagtgcaagccataatgtgcaatctagggaaaagaatttaatttcaggaagcatgccactgcttggaaggaacattaacaagacttttgtatccaaatcgtccctggccagttttgggtaggactcaaaaatgtaacccacaccttctggaactgtccatggggaaatcatctttgtgcttgtttgaactgccttatcctggtagaaatcattgctactatcatcacagcattgttgtatggaagtttactgtcactggcaataaacatagatgaaaggaggggggaataagaaaacaaaagggaaaaatagaagcaaaaaatgcaccagagtgaaaaaaatatccataaactcgttgttttttgtctctcttgttgctctgatgtgcacaaaggaaatagacggaataaaatcacatctcaggaacaccaacataaattcccccttgctttgacaagtacgtaattttcttcagagatgctcttcacgtctggagagttatgaggcaatttcattcccatctgacaaatttacaaagaaacattagagagaagggattaggaaagcgagaaatctttatagactttttcctcaggctgtatttcccttccatctcttggctcttccttgaggaccaggcatgaatgcctcacacagtgtgggcctcataaccaagacacttaggagagaaacaaaacatgaaatgtgctttcaatcaactaattgtatttacattattgggggatgggggtggcacttggggaccagaagattcttattggcaaacatggaagtgaagtctctgaggtatggattcaaaatggtatttgtaaaattggactttgaaagaaatgcagaaagagaaagaggggagggagagagaaagaaagggagggagagagaactgaatgtctaagaaagtttgtggtgcaaataagcatttcaggatgatcacaatacaggattaataatagcaaagcatatgtatttttttccttgtaggattatagatgctaaggcaacttggagtttttctccttttaaaacatctctgttgctaatttcattgtgcagctttcagagtgactaaccataccagtttgaccaagactgtattggctgcagcacttaaaagctcacatcccggaaatcctttggtcctcggtgaattgggatggttggttaccctattactgatgattgtaattctcaggtaagttacttgagttttggcagctgttaactttcctaaatatttgcaaccttgaattattcacgtttggtctctgttaactggcaaagtgaatgtgtacacacacatactacacatatacataaacttgtagtttgatcatttggggattctagtaaagtcttcaattaaggtcactgtgagggcttagaattctgaaggaaaaatcataataagtgctcagaagttcaggaaacgttattttttttcctggagttgagattaaacataatataatgcagatgctgtcggatacggaacccaaatgacaaatgttttataactgggacttagggaatggagaaaagtaagagatacatagcttccaagaccttagttgagagccgcaaagcacccataatactgtatgtataatttggcaggagaaaggtgagatatttgtgcgtgtattactattgtgtattttttagagtacagctgggcagccatgtttgtgatttactggccatatcaaaagactgaaattgaacctaatctgtataatttcagctttctgttctttaagttttttcacttgtagtcacaatttaagtcatttgcattttctaaaaattctatttttggtgatacttgttattttccttctttaaagttacaagaaaatctttattgtttaccttcctgtgaaatggtgatttatattggaatgggatgtccaaaacctttaggacagaagagaaaccaagcatttattttgccaaaaaaatccccagagatcttgcattttggggtttaagtttaacatcctaaaaccaaatgttgaagttgaatttggatgcgatctctcttgaaactctcacagtcaaactctccctttaatccgtctgctgaatatgaaaaacggggcttctttgaactgtaaatgcttctttttgcctaatttagagaaataaacaatgataagtgatgttcatctatagagagacttggtccagaggcatatgaaagttgtgagttgtctgtactggctaccctctgtaaaacctgccctgtactttatagaggacagtctatcccagtatcaccgataggatgtacagatggctttttgcttacaagcaagcataagtacagtgttgccgagaaattagattgagcatgatgagagatataaaagtttaaaatatccccggtggaaaaatttttttctttttattctgcatttgaatcttttaaatactgtaacttttgggggaaagttattgagacataaaaggaatatttgaactgctttggagtttatgataaccactgtataatacattatcttgaaagcctttatagtacacagttacaaacttccaggaaatctattaaaaggcagcattaattaacataaactttttatagtgttactaatattctgcaaacaactaagagtttaaaagccctttttacaggcatttcttgctgcctatacactatgatcagcatgaattacaggaaacactaaaggagtagaaagaaatgaattttcattgcttgttctagatgggaaattcacctcaatatctgtctttaatttgaacaagtgtgaagacaaggtactcaccagtttgattagcatcctctttgtagacttgtacagctgaccgaaagcaaaacactgatgcttcaatattcattctcccaacggatgataaatagcatctttgaaatgactttagaaaacaaaaggatttccttgaatcctgggagatagagtttggctgtatccgctcacaaaacttttacgatctcatcagtgggttagtccatgatacaggctacatttagacacttacagatgtgtcaagtggttccagaaatgaaagtagtattttaatttttttttgatgtctggttcccagttgcactggcaaatctctgaaacctgaatcttgaccttttttagagtgatgtttttcatttctgttttgaattccaaaggggaggaggcctttcagtctctgtgcccaaagggcaaaactgtctccatttaggattgaaatgaagatgacctgggcctgagttatctagtcataattatttcctgactctctgtatttaaatatttctgctctaacgtgaattaagcaaggtttctttgcttcctctttgcagtgcagtctgctgtttgtaaatactagaatggtgattctggccaaagattcctcgctttcttaggtctttggtgtcatctgggtgcgactgatgattttctattttagtaaatactttacactcttactttattttattttatttttttaaataaaatgctttccagatcccttggaggcagagtcctccaacattttgttgccattctgctgttccctcttcccacaacatcacctgattctcaacccatatggtactaggatttcactgtgataatcataaaacagattattatgcatatacattatttgctgcgtacattttctccattaagttttttgtttattcaagagatatttacttgaggagctcagtattggccctcccattttatcccttttctctatttatattgtcatctatacctcttatctttgcttagtgggtattgtgtgccaggtattgcagaagtgttggtgaacatgacatatgagcttgctccttctggagtttgtcttctagttagggtagctatgcagagggcaagcaagcaaatgactaataaggtgataagtctatggaggaaagaaactgatgatgtgttggggtgtgactgatggagagttgaggcagcatggctgggatgtcatctgtaaggaggtctcatcatagcgggaatttgagtgatgagaagaaacccatgatacagagatctggggatgagtattccaggcagatggagcagtgagtgcaaaggccaggtggaagcgagcttggtgtgggcagaccaacgtgggctggtggagcaggatgaacaaggatgtcagagagttgggaaataagcagtgtctctaataacatctaccccgtatcagtgtgagccctgaaaagacattacctctataccttgaagaagccttgaagggaggtgattgttttcacatttagcagatgattaaatagaagttcggagaggtgttgtggtttgtccaaggtcacacagccaataaatgtcagagctagaattcaaatgtagatttgcctgattccaatatttgtccgttaaatatattttgagtacctataatgtgcctggcccttggtaggaggtgaggataaggtagtgggcaaaataaaatttatattctcatgaggcttacttccagtagaaggaaccaggaaagaactaactgtatagtttatcaggtcgtgagaagtactatggagagagacaaatgagggaaaagaaggcaggaggggagatagtggggatggggctgctcttttgcacaagaatttcagaaaagatatcattgataaggagatatttgagccaagaaatgaaggaaatgaaaacaagccaacaggtttcccttgcagagcagtccagatataacaagtagcaaatgaaaactttcaaagtgggcataagtatggcgtgatggagaaacagcaaggatatcagttagctggattcaggtgaacaagggagagaatatgagactgggtgggctgtggcgaggtcttcggcttttactctgagtgagatgagagtcaatggaagaaaagagggccatattgtaagtttggttttattaccattattctggatgctggttaaaaggtagactgttggggaagagtggaagcaggaagttgggaggccagtggtgattcggtgattcaggcagacatcatggtggctggtgtcagagtcctggcagtgaagttggtgagaaggggccagatatatgatatatttcaacagtcgagtcaacagaattcgcttgtcgatttgggtgtgaggtgtgagagaaagaaaagtcaaggatgacgtagtgtttatggcctgaaccacaagcaggacggagttaccatttaccgaatggcaaaatcagtggaggtgcgctattttcaggggaaaaataaggagctcagtattggctttcccaatgtgtccctttttcaatttatattggcaactatacctcttatttttgctaagtgggtcgctgatgtgcagatgttatttgaacagaaaattgtcaacatttttcttccttaacaaaacaatggttgtcagtacactgtgctagtgcattaattagctttgctgcataacaaacgaccctcgaatttcagtggcttacaataacaaacattcattttcacgaaaccaaaaatacaggatggttatgactcagctcaactctgccccagtgcttccccctctgccgacttctgcctgtacatatcagcttacattccgttggccaaagcacatggctgagtccaaccatgataagggaggaactacacacccccctcaaatggcatgacatttccttcattcaagcctggttgtcatctcaatcagttaaaaacaaataagtagatccagaatgaccatgcaacagcctccaaagaagatgagaggcctcagccccccaaatccagtgagaactagttcttcccatgtctcccagcactcaagcatctctatactggagcagcttctacttggcagtaagcctatctctttggtaatttatttctcccatgatgaccttgagcccactcatagctggcctgtgtctttattcactattacatcatcagtgcctactgcagtcctacacacagtagttctagtttcgtgtgattggttcagatgcattgtacctagcttgtagaattcatttagaggctggtttcttttaaaaggaataaatagaggaatggagaaaagacaagaaagtggagagttagcaaattcagttgccttagcaaattcagaagccaggcagataacacacatagtgcctccacagggtttgagacaaatgggggtggtggcccatttagccaagccagagtacatacccccacatggtagaattaaagatattttaggcctgggcacggtggctcatgcttgtaatcccagcactttgggaagctgaggatagtggatcacgtgaggccaggagttcgagaccagcctggccaacaaggtgaaaccctgtctctactaaaaataaaaaaattagccaggtatggtggcacatgcttataattccagctacttgggaggctgaggcaggaggatcactggaactcgggaggcagaggttacagtggtcaaagatcatgccactgcactgcagcctgggtaacagagtgagaccccatctcaaaaaagaaaaaacaagttagaagccaaataaaacaaaactacctgtgctagtcaaataaaactgtttgaagggcagattctccctgaaacctgtcagtttgagaatctagtaatagagttgggaagatttgggcttatcaaaggaaaacttttgtttttgttttgttttgcttcctcctctcaacctccataactattgggtactaggcttagtgcctgggtgaagaaataatctgtacatcaaacctcagtgacacgagttaagctatataacaaacctgcaaatgtaaccctgaacctaaaataaaagttaaaaaaaaaaagagaacctatttgtagggtggcaaatatctttccctcaccctccatcattaggtagttctttggtaaaaaaaaaaaaaaaaaaaaaaagaatctttttatctgaaactgggacaagaactagctagagggaatacctttatttcttttgccaaagataactctggagattttgtttttagttctcttccatcttcctgaaccttgcatactgtttgggtggtggaggggtgttagggggtggaggagaaggagaagaaggaggaatgcttaggtgaagccctgagagtttctgcctctcatgcctgaggtgtggaggtagagctctctggaatatttccaagccaagttgcggaagcccacacttctcccgcctggagggttgttctttgacttcatcgagggcatccaaggccagggttatgaaatctgatgctcagcagaggattcctgaatcttctcccaccacaatgtttaggaactggggtcaactaggacataggtcaacattagtggtgcccaggaaattcgacctgcagatatattttgtttggcttacacagcaattataaagttatatgtattaaaaaaattaattctctatgggccagtatttacaaaccatgagattttacatgaaaatcaatatttctgccttcctctgaaatgtggaagctctgtcaatatggggccgcatctggttgagtaacatctgcccacttcattaagagcatgccggctagctcacacccgtccctacccagctcactccactcaattatttcacctggatggccctgttagacaattgggagtagactcttgacctatatatttatgtataatacctgtggctataaatacattgctgtaaatgcctcagatatcatctttaatttaaagagcagcctgccctttaggtaatcaacttcggctttttaaaaccagaattgttaattatcctggcagtattgtctttgccctcaacctgataaagtcactggtgaaaggatgcgattatttggtaggtgaatctaaaggatatcatttctcttttttccttcttctgctattttctctttactcacatcttccttgccaaccaatccgacatgcaagaaacccttcaggtgcttaaaggagttggaaaatattcccggaaatgctgaaagtttgccacattgtcagaggataaaagcacagtgttcaatccaaaggctttgtgtaggtttttttttttttttcaatgcaagttccaggttaaatttgaggatgcttgtgttctctacattttaatgagaagctttagctaagaatttttttttaaacaaaggcacaaaagtttaaatcctttgcgcaatagcagtgagattgaagtgacatactgttttaactttttgaaaaacagcaatgctcaaataatcagcaggagagggaatattagacaagtaaatatggaatattatgctcacaagcaataactgtgtctattaaatatgcaaaccatgcagcctcatatggatttttttcattacatcattttataggtatatgtgtgtataagactgggtatatagtaaacttttatgagttaaatcattttttccattagcttttgttgtaattaccaagatgcttactgtaatttctgattgatcttcaattggcactaccccataacactttatcttgaaaattctctgcctgtaggcctcttagttaggtagtgaacgatttatctatacaccttcaacataatcaagaggtcaatatgtaaagggacccatttgtaaatgaaataaagcaaataatatggtggttatttttgtatttagatagattagcaacattgattctaatgagagggaccttcctttctttatagcaattgtaccatgcagtgttagttatgtgctgatttctcagtttatttcatgactaccttcccactagaatgtaatttctctgaggacaggaatcatgcctttgttttctgtctttaaaaaaattgttttaaagtgcggcaaaatatccagaacataaaatgtaccactttaatactttttgagtgtatgcttcagtggcattaagtatattcacgtttttatgctgttatcatcactatatcttcagacttttcatcttcccaaatgaaaactccataatcactaaacagtaattttgccttcccctccccccccactggctgacaaccatcattcaattctctgtctctccaaatttgactatgctagatgtcttgtataggtggaatcatacactatttgtctttcagtgtctggcttatttcacttagcataatctcctcaagattcatccatgctgtagcatgtgtcaaaaacctgcctttatttttatttttttaatatttatttatttatttttgaaatagaatctcatgctgtcgcccaggccagagtgcaatggcacaatcttggctcactgcaacctctgcctcccagagttaagcgattcttttgccttagccacccgaatagctgggattacaggcatgcaccaccatgcccagctaatttttgtatttttagtacagacgaggtttcaacatgttggccaggctggtctcgaacttctgacctcagatgatccacccgcctcggcctcccaaagtgctgggattgcaggcatgaaccactgtgcctggccacatgactttattttttataaccatgtgcctggtgtctagcttagcacttggatgtagtaggaattaggagaccacaatatatctttgttgaaggaatacatgaaagaatgactcagtcagccacattgtattccccttcgtagccttgggatcaggatgcagtaggtcctctgtaattctttggggaagaaaagaattatttggcttcctgatttctgaagcagagcccagggggcagttgagatacttttggaacatgaaaaactcgccatttccccttgcccgtgatgtttgaatccagtgtatgaaaaggaaatctgtggcatcttttctcgagcttgtaatttgggttgctttgtgttcactgctaattaaccagttggtgatgtgctgtttgtcttttcgtctgcctctgagcttgtaaggagtcagtgacaagcccagtgaaactgaggggcactcagataattaaggtttggagggcttcttaccaacccattgatgaaccaattgcttcctctgcctcaattgatgggtagctgacacatgacgttaacagtggctttctctcatatacacagcagcaggagactttcccaccttttaatggctgagcaaacttcatcccaggcaaccctggcaaaatgaaagtgtattgtcaaagttacttgtgaagatgactgtgtttagactagaagaaaagtcttgatacatcagaattgccacacacgcgtgctcacacagtctttattattaacatctaaatgcaaaaagtaatacaaagctttatttaaacatttaaatgtataaggagaaatgactttgtgttctatattgttcttttgtgtgtgtgtatgcctgtttttatcctttaagaaacaacagtgatagagtattgagtagtttcttttctttttttcttttttgagacaaggccttgctaaccctggctggtttgcattggcgtgatcactactcattgcagtctcaacctctcaggctcaagtgatcctcttgccttagcctctcaagtagctaggactacaggtgtgcaccaccacacccagctaagtttttattttttgtagcaatggggtctggctatgtttcccaggctggtctcaaactcctggactcaagcaatccaccagtcaagcctcttggagcgttggagttataggcttgagccaccttgcccagttgagaagtttctctaaatctgataacctcctcctgtatagagtctgtgtctgttatgcaaaaacatcaaataattgaatgtcatgtgtgggcggctctacacctccttacctgtgcttatcttctgcttctttgcctctttttaatccagcgtagtttggaaccagcagcagcagcagctccccagacctactgaatcagaatctacattttgataagagcccagggtgactccatgtacgtgaaaaagtttgagaagtccttagacctacagttcacagcttctccttctttcttattcaactgaattgcagtgggacctgagtatggttaaaataaatgaataaaaacacaaatcaattcttgggtgagtctcatgaacaatcaagattaagaaccactgaccttactccagtaaatgccttgagaaccctgagggcagggacgctgtctactgtgttctttcctaggaaggtgcttggaatatagtaaaaaaaaaaattatttattgaatgtattattatacaaaacccaaggctcagatgaccttggggcagtgtctttttccatgttcagaccctgaaggagatcaacctgcctgtctgctgaccctgctcccgtagctgggcaacaagttctttgaaggtagatctaggtggcccatcttggtgtccaccacaagtggttaacagtcaaatagaatcatgttttaggaggcaggctctagaatttgactgcctacctttcatttctggacctgccactccctggctgagtgactttggccagttatttatcttcttcctgggtgatatggtttggctctgtgtccccacccaaatttcatctccaattgtaatccccatgtgtggagtggggggacctgtaatccccacgtgttgagggagggaggtgattagatcacggggaggttcccccatgctgttcttgtgatagtgagtgagttctcatgagatctgatgggtttatgaggcagttttccctgctcttgctcactctctctcttgcctgctgccatgtaagatgcgcctgcttctctttctgccttgattgtaagttccctgaggcctccccagccctgtggaactgtgagtcaattaaacctctttcctttatacattactcagtcttgggtatatctttacagcagtgtgaaaacggactaatacactgggtcagtctccttatccataacatactatcaattatacccacctgataaagtgatttgagactatagtgagaaaaatagatttaaggcacatattgggcacttaattaaggttagttgttatcgttcctattataatgatattttacataatatataattaaaagtttataatattaaatcatgttataaaaatagattcttcttttgcttgtgtgaagaaacaaactgggatgataaaatgttagagaaagggcagttttatccatactaaagataatagagatattattttcctcttctgtgtgtgagaaccatctttgtctccttacacactagacaggatacatttgtttgtggtctgtgtgcatttttccttcttgtcagagcagcaagaactttgattcttgcctttaaatgggatctttcgggagatgatatgatgataagatttgtaatttgccccgtctctatccttgcgggatcttgggttctgctccagctacgtcagctccgtttaactcaatgatctggtgacatctttcagatctcagaagggctcaacaaatgccaccacggagttcagtagtgaagacacaatgccaagattaagcaaggttgggttacatttgtaaatgtaaaggctcaaagctttgtttgaacaaatcagtgcaatagatcttaggtagaacagagttctagcagaactgtgaagtttctaaaaaaaaaaacaacagaaaacccacaccagtgagtgttaaagtctcataggaataattccattgtggctaagtgcggtggctcacacctgtaatcccaacactttgggaggctgaggtggatgaatcatttgaggtcaggagttcaagaccagcctggccaacatggtgaaaccctgtctcttctaaaaatataaaaattagctgggtgtggtggtgcatgcctgtaatcccagctactcgggaggctgaggcaggagaattgcttgaacctgggagtcggaggttgcagtgagctgagatcgcaccactgcactccagcctggggacagagcgagattctgcctcaaaaaacaaacaaacaaaaaaactaaaacaaacaaacaacaacaaaaaaccccaattccattgtgtggtgatgataatcatcatcattggctcttttttcccatctcccttgtgataataaagctcaaactctgtataagctaggattatggtatgctgtgcacaaacccccaaaacggtgacttaaaaacaatataattttattttagtctcacagaaataaaggtccaactgatttggcagctctgctctgaaactctgttaggaatcctggatgctgctatctcatttctttctatccctatgatgttgcctttgccttcatgacccgggattgctgccattgtggtttgcattccagccagcgggaagggagaaagaggtcagaactctcttccttttaagggcaaaatatacaagttgtacatgatcacttttattcacacatcttttagtcatgcagtcccacccaactgcaagcaagactgggaaatctggattttttgtggccatgtgttctgctagaaactcaattactctatactctctcagaataggtgtttgatacagagctcttcccacctccagctcccaggtgggcacgtgaaccagacttggcacctcaatgcaccacatctccgtggcaactgagataggtttccagttgcccatgcaacccaagctggaacaaagagactgggtcctgggttcttgctatgactagcggtgaagagattgctcttccttctggggttccttcacaggatgaatgtaatcctggagttgctcctggtttttttgcctcctaatggaaaagtgaatgtaacacagaggaaagtagaggagagactgagagaaagggattcctgatgacacagttagagcacttggattctgttgtacctgaaaccaggcttccccagataaataagccaatctacttctttttcttttttctttttagttaggcttgcttggacttatgttcttgccatttattataaaaaagcactctgaataataatgtacctgtgttagttcattttgcattgcaataaaggaatacccaaagctgggtaatttttaaagaaaagatgttgatttggctcacaattctgcagactgtacaagacgcttggatcctgcatctgcttcttgtgaggtctcaggaagcttttactcatggtgaaaggcagatgggagctggcatgtcacatggtgagagagggagcaaaagagagaagagggaggccacaggctctttttaacaaccagatctcatgtgaactcattactatgttatatacttctgtatataataatatcgatatattatacatactatatgtataatatatttgatatatgtatgatatatccacctctggcagaatttacccacatgcctacttctatgtatactaaaactaatattatatagaagtatataatatatagtattatatatagaagtatactttattatctatatcatatatagaagtatatgatatactactatatatactacaacactattatagaaatatagtctatatatggtgtatatgatatatactatatatagaagtatatatatatcatatacttcttatgatgcccagcatatctattcttttctttgttttccttgttttatgtttgttttctttgttttatatcatatacttctacatgtagtatatatcgtatacatcatatatagactatacttctaagtgtatggtctctatacctgtgtcatcagcagcacctggaaacttgttagaaatgtaaattctcagtgattctcaaacttacttgtgtgagattcacctggagggcttgttagactccagattggtggggcccaccccctgagtttctgacccattaggactggagggaagcccaagttggcatttctagaaagttccaacctccctgattttctgatccattaggactggagggaagcccaagttggcatttctagaaagttccagccccctggagtttctgattcattagagctggagggaagcctgagttggcatttctagaaagttccagcccccgagtttcttctgatccattaggactggaaggaagcacgagttggcatttctagaaagttccaggcccctgagtttctgacccgttagagctggagggaagcctgagttggtatttctagaaagttccaaccccggagtttctgatccattaggactggagggaagcccgagttggcatttctagaaagttccaatccctggagtttctgatccattaggactggagggaagcccgagttggcatttctagaaagttccaatccccggagttgctgatccattagaactggagggaagctcgagttgatcctgatctattaggactggagggaagcccgagttggcatttctagaaagttccagctgtattagttaaggtctgtataaaaacagaaccaatcagatatatatatatatatatatatatatatatatatatatatatatatatatatatatatgaatatgaggagttttattttgggagttggctcacttgcttacgaggccaagaagtcctgtgatctgctgtctgcaagctggagacccaggaaagccagtggtgtaattcactgtgagttcaaaggcctgagaaacccgggcttcaatgctgtaactctcagtctgaggctataggactgacaaggtgtgggatgggggtactgatgtaagtctgggagtctgaagacctgagaaacaggagctccagtccctgcgggcatgagaagatggatgtcagagctcaagaagagacaggaagttcacccttcatttatttattgtggtctctccccagtggaatataaggtgctggacagcaaggattttagtctgtttaatttgccgctgtatcctcagcactgaggtcactgactgggacatagtaagcactcattttacatttttggaacaaatttacttcaggcacagataaagtttacctgaaccaaataagtgaacagaattatttataggcccctggtttattaatccacttcctgtccttcatggctgttgtttcatatttgattcatgcatggcataaacatttatgacaatcttgttcatatcataattgttgttagcagctaacatttattgcagacttaatagttgtcactgtgttaaccacttcaatgcattgtctgatttaatccttatatcagtcctacaatgtctttgctattttatccccattttacagatgagaaaaatgaggctaagagagcttaattcacttgtctagtgaattcacatatcacactgcgaggtgttatgggatgccggaattcaagcccagatctgacaccaaagtcgatgtgttctgaacatacaaactgctaaagttccacttcaagtgccttcttgctatgtggctggccatgactctttatagctgaatccccattgtaacttgctcataaagttgactggcattggttgagtcatatttccaaacatcaggtgacactaatagcactgactggaacagaattcagccagctcattgtttgaccattccactttctccttttctgtcttcttatgtggttgaatagtgtgctatgaactctttccctatggatagacattcacaagtttttgatgttctgcatagtgtgctgaataatactgaacacatctttaacagtaaccttaggataaattaataggtacttttaattataacataggtatactgtcttccagacaagtttttttttttttttttttttttttgccacatagtttactcttttttccccatagtgtggttgatatgatttggctatgtccccacccaaatctcatcttgaattgtaattcccataatccccacgtgtcatgggagggacctggtaggaggtcattgaatcatgggggtgggtttttcctgtgctattctcatgatagtgaataagactcacgagatctgctgcttttatgaagggcagttcccctgcacagctctcttgcctgccaccaggtaagacgtgcctttgctccaccttcgccttccaccatgattgtgaggcctccccagctatgtggaaccatgagtctattaaacctctttttctttattaattacccagtcttgggtatttcttcatagatcatgaaaatggactaatacagtggtagactgaagatctagcagtcttatggtgcattagttgatagcatgtgccgttttcaaagacattaacatttgttactgtgctcagacccaacacccacccatcaccattgactctcagcagatcctgtcaccagaggccatccacctctggtagagaacacaggtttgcacttctatgttatccactctcgaggactttgtctttatttgctctctcatttccatccttttaccttgagaccctttcttcttgtgccaagattttgcatttatcctgcttctctgtcttcatcaaagactgtccatgttatgaagattgagaaactgaggttgatcaaacagttataccaattgtacatgaaataagtcaattcttttgatttttttaagatgacatctctgtaatcacttaactgtcttatcttctatgggttctgtaccacacaggcatgatcatttttctattttaacttgagtttcctcttaagatgtagaaaaagtagtttttatctcctccatgttggtcaaatggccttctgctaatgatgcaattagtgaaactatgcgagacaaagggggagatctttcagttttagaaagtcaatgaagtggcaaaatctgccgcatttgctgtatgtgcaaaatatttcacagagctctactgtagtcttttttgagcagctactgtagttgctgaagctaaattataataatttgatgactgtgtgcaaaatgaattcgctaaagtactgcctcctcaatggctatcagatttggtttagagtggggaaaggctctctctcacctcggtcacacccagaaatctggagatttccttacctagcctctctttgctaccttctctccaggacatatccccttttttttcttcttctttcagaattctgtttcctggtaaacaaactctgctaaattcttacccacatggagctaccgtttgatccagccatcccattactgggtatatacccaaaggaaaataaatcgttctaccaaaaagacacatgcacttgtatgttcgtcgtgatactattcacaatagcaaagacatggaatccacctaggtgcccatcagtggtggattggataaagaaaatgtaatacatatacaccatggaatactatgcagccttaaaaaagaatgaatcatgtcttttgcagcaacatggatggagctggagttcataatcttaaatgaattaatgcagaaaaaccattggtgatatcttcatcactgatgcatgtttcagattatttcttctgtaccttcatgtaaaatttctattcatgaggtccatgccttttgcctatacccatctctacccatccctgtggtttgctggagatggcttgtgctggctttggagagctagttgagcacttcttttttgtgttctgcatccaattacatcatgttggtagcttgaaattggccatggtgggagtatttacaccatgaaaattggccagtgctacaaatcagagcgaattacttaacatttcccagcacaccactaatcctttttctgtggttatctaccttctttctgatcaccttcctcatttgttgaagactttggctcctggatcacaatattctttcttcctccaggtcagacaacactctcagagattttgacatctatgttgaattagtgagtgagggccagggctactcactatcctgccatgggatacagggaatataacgtaacaaaggattgtttcacatcctggcatttcttcctagcatcctgttggaaagtcagctagttaaaaaaaccttattataattatttggacctagaacccaaattctattttatatgtagcacaaagtattctttgtgtaactttaatacactccccataaattgaaggagaattgtattatattttgtctggaaattcaccaagggctttctcatcattgaaaaaaattcatgtccccgatggcaatgctaccgtggtatttgagtcacctgttcaacacaccttatttttctgtattgaggctattgagttcaggggattttacatgagtatgcacagagaatattccattaggtcttctcatatagttgtacccaagacatattaaatacatattaattattacaaattatatatatatattatcctctttgtactagaattggagcttcatggtgagttttttaaaaaaaattatattattcatacaaaaatttgtaatattctacctgtattttagaggtagaaaatttgtattatttcatttcagggtgactaaaagggtgttatattataaaagaggctgttagattgtatagggttgagagacctgttacaattcccttcagctgctttgagttcccagtttctgaggattgcttctcctccatgtaattcctaagaactggctctggacctattcaacatcaagacaaccccatttttggaagctcagaggcatcttttataagcaacctctgatccttccagaaccctccttctcttatgctcatttcacctggtcttctacttcagagaaacttccagaatctagatccttccattttctccttcctgtcttctcattgatgggcacatagtatgctctgactccatcccctgtggatggacattgaggctgtttccaagttttcgatgttctacatagtggggtgaataatattgcatgcatctttagtggtaaccttagggtaaattcccagaagaagaattggatgcttttttaaattttgatgctattaccacattagcctccctgcatttggacagtgctacttcatgaaacaaaaagtatatattttacttagtgaaacaagtgagatggttactgaggcaattgtcattcttctcggtcataaatagtacctattttgatagctttctttttccttttctgtagaccacactcatgcatccttcactgctaccagccttgttcaagacacttgaattattgcagtggcatcttaacagtctcctgctttcagcctttttgctctgacacagtctgtttgcagttcacatcctttcacttctcaaactcttggatggcttccatgtcccccggagcgaatgctcaaacctcccacagtccatgtgctttggctaccaatgaccctgccaacgtcgtctccctccatctccttctccctcctgcttagccacacttgtctccccagggccttcgcacttgctttcttcctcgtttgccgtactcccagctacccacagggcttcttctcccacttccatgagtgctctgcacatgtattgagcaggacttcgcagccactcactatgaaatagtagtccctccctctccccctgagttacttttctccacagtacttataatcatttgatatatttactgctgccctgaatgaggccagagcttgttctgttttgttttccattgttttcttatttcttccatctccagtacctggcatataatagatcaggaccagatggtaaatattgtagtctttatgggccatacggttctgtccaccctactgagctctgacactgttgcgtgaaacagccacggacaatacataaacaaacgcgcacagccgaattccaataaaactttatttatgaacaccataaatttgaatttcatataattttcacatgtcaggggatattgttcttttggtttaaaaaatgtaaaaacccttcttaacttatgagccgtacaaaaaagggctgagagcttgaattcggtctgaaggttgtggttgtgcttaaaagttatttgtttcatgaatgaatgaatatgaaaagactatgtatatattaataactttcaggcatgtatcataatctatgtttaagcctgtgcatttggaaagatatggcacagaactaaatgtgccttttcgctatagatgtcttactcattttgacatttcaaccatccctcaatagacaaagggatcactaggatctggtttagtaaaagtctgaaaactgtagtgtagcctatagacgataatacaaatcatctgctttattatatatgtattttaataaaacagaaaggggtgaaaagactctgtgtattttcgactggactggacatccacagctttttcctttgcctttcatagtttatcttaattgaacttccagcactgccatcgtctttctctgcaaactctgtttggaaaaatagaccttaagaccccagtaagagcactcaaattcctcagagcaaataacttaaacataacaaatcgaagcttacaaaagtcggaattgtaaaactaatagggctgttaaaaccagctttcctgaaaattatgaattggtagccctgtttcttataatggcaaatagtgaatcttgatcgttcatcagtgcacatgtcataaattaggtgctgagagaggctgcaaaattctttatagcatcacagaaagctaccgtgactgccttcatatcacattgttagattccagtggtgccggcacagatctggcaatgaaagttttaaaattgtaacaagttgtcaaatgtttatcaacgggattttatgaaggactaaaaagttacgtacgatactgcacagaccattaggggaataataatagtaataaagagactttattctcatcaagacttatgtggcagctagcttttctccccaaacttggttattggaggatgggagaggcaaataattcaatgctaggagtagaacagcttgaagcattagatggaatatctgtattatgtgttgaatagaatataatgaatatgtggggctatatctctatagatatgtagatctctctctgtatttatggagaaagatattcaggattgaaacgcagccttaacaaatgccttgccaattgtgttttatgggttctgcctgcggtgtaggaagaaggatcaggctgagttgggttcggttcctgactcctctgtttaatatttttgtgtcttctctacactgaaattacttcttgtttaagaggaggaacagtcataaagcctactttattaggcttgttgtaattttttttaaataaaacatttagcacaattctttacacatatggagccaaaacccaaaataaaaatcctaccttcttcccttatcagttgtgtgaccttaggctggtcatattacctctcccagcctcagtttccccatttacttagtggtgataatattttctattcactaatcttgtggcattgtgtgagaattaaatgagatatcttattatctatagaaagcctagtacactaccagtcacttggcatgtgttcattataagatcctttttcttttattcaggggtatattcttaaaagagagacaacataaactatatctttggagatgcaggattataataactatattttataagtcaccattaatgcttcctcagaagattctagaaatttaatgactatcacaagtttatgtgtctataacattttgctgaaggaagcagatatgtttattatcaatctcttctagactgcaagatccactagagtagagagtttgtgccttttgttcacctctgcatccctagcatgtttatttggcacagataggtgctcaaattatagttgttcagttaatagttttaaacaaatatatttccagcagggaaaagccataaataaactcaccaattcacattctgtttgttcctatgcaccaagggtaggtgtacccttcatcaggatcccagccggaaatagatggcgcagcccacctgggtaatttgaggagggtatacaaaaacggtgtgggcagtgtgctgggagaccaccagggaccatgcagtgctctggggctggtgacaagaggacgctggcattcattccttgactagaaggaggaaagggagaggagctgactgactgagggaggtcctgcaagcctgtgagctgactgggaggagaggaagtgctctggcagggctgggagctaggagctgggagctgggagctttccttgagggaggtgctggctttgcaggtgtccatgtggtcaggctgaaccatacttcctggaatcctcttctcagtggtgtggctggggaagggtacagagaaactcttgtgtgggatttggaggaatgggcgtgaagctgcagcccttttgtggctcacacatggtccctatctgctgattcccctcctcggcctgctctgttgctgtttcctcttcccctggcgtctcctttcagctttcctgactcttagactgggtgtatgttcatgtcagtgatgaagggtccggtcactgcaggccaccctcatggacatggtcagaggcaacaagagttgacacgggtttccatccatcccgtgggctgcagctcctccttgtaggcaccagcttgtctctgctttccctgactttacatccagcttccctccctgaccgtctgccccatgagcctggagcatgggacactgcctaatgtcacctccgcccatgagtgcttttggtcaaatccctgcacaaagccatacctataggtatgcgttcacacacactcacccacattagtggtcctgcttccctgaatgaaagttgtcttgggctgctataacaaagcgccatggcctgggtttcttctgaacaacagaaattcattcttcccagttctgggggctggaagtctaagaacaaagttccagcattgccagattctggtgagggccctcttccaggttgcagactactgacctcctgtgtctgcatcctctggcctcttctcacgagggcactaatctcattgatgagggctccaccctcatgacctaatcccctctccaaggccccaccctcctaacattatcacattgggggtaagaatttcaacaaataaatttgagaagacacaaacattcagtccatcacaaacactccttgaaacaaggaacacagtcagtagttggtgacaccattacaactgaccaagagtggagagaattcataccttgatgttcctctcctccctccctgagatactctgctagtgtatcccaggcagcaaaccccaccagaaggcagaagtcatcctcatggagccctgcaacagtgaagaagggtggagagaggacctagaagtgcaaaccatctctagggagatgtccactttaaagaccatttggtaaatttgttttaggtaaattcaatttatttgcatgaattgtgaataaattcacctaaaacaaatttactaaatggtctctaatgtgtccattgtttcatggacacgagtgtcacgaattctatcaacatttattcacacctacggaccaggcgctgtgtggaatgctgagacacacacacacacaaagactaattctaaagtggcaggtaatttattgggtatcactgtgtattttgttctccctgatgtatttcccctgccatgcaaagaaggaaaccgagactttgaatttgcctggttgaatttcaacaagtctgtttaaatgcctcatttagcattttacagcagcttgtgtgttgtagggccaaaggcaagattttccaagcttaaaatttggaaaatctaaagtcgtttgaagggtattgtgctggagggatggagaggagcatttttgggaggtggaggtgggagcagacagaatagagggaggatggagagcgaccttatagctggcaaagaaaattggcttttgcatttttttttgctgataaaatgggtctgatccctctttgctagtgccccaggaagtggctgaactttagaggggatgtctgtgtgggactccactgacagtattctgtagcagtggtgtgtatgttttgggggacacagcatttatcagcagtgatggttatcgtctgaaaaccaaagatcctttttctgaatattctaagctgcattcacctcctggggtttatgcatgatgctagagagggttagagagtcccctccaagactgagattgagtttcctactggtccagcagaaggggcccagagctgattaaacttaatctcaagaaataaagaaatgtggcattttatggactggatgttgctggctaaaatttatatatttaccatggttacattcatggcagctacttttgcaaggcacagggctaggtgcttttattctttaatttatttgccaattcaatacatatttattgagcgcccattttgtgttaggcactgttcttagaatggtgcttagcattgaggatacaagagtgaacaaaacagatgaagccccttgtggagtttaaattatggtgggaagctgtaagacactggaaagaaccaaagtgttttcttagtgtcacataccacttaacacagccccttcaacgtcagatgtgtgggttttttcctctatacaacaggcaattcttcagttgggaatcctataatttagttcaattctgacactatctacctggaaatagcatcagaccccacgggttgagggctcagttccacaagactgaccctcccccttcagatgccaatcacaagtagtaagttgtcacctatacttctgaccaatcagctataaatcaggggttaccatgactctcttttcaggtttgattaatttgctaaagcaactcacaaactctgggaaacactttacttacgtacttacatgtggccatttagtataaaggatattacaacgagtgcagatgggcaatgaagagatgcacagggcaaaccatgtgggaaggaatgctgagcttccgtgccctctctaggtgctccaggtaaaggttcagctgtctggcagcaatctgaaccccgtcctgttctttttttgtttgtttgtttgttttaattttactttaagttccaggatacatgtgcagaatgtgtaggtttgttacataggtatacgtgtgccatggtggtttgctgcacttaccagcctgtcatctaggttttaagccctgcatgcattaggtatttgtcctaatgctctgcctccccttgcccccatcccccgagaggccccagtgtgtcccctccctgtggccatgtgttctcattgttcaactcccacttaacgagtgagaacagtttaattttctgttcctgtgttagtttgctgagaatgatggcatccagcttcatccatgtctctgcaaaggacatgatctcattcttttgtttggctgcatagtactccatggtgtatatgtcccacattttgtttatccagtcaatcactgatgggcatttgggttggttccaagtctttgctttgtaaatagtgctgcgataaacatacctgtgcatgtgtcttcagtgtttgtaaggaggcttccttacataggcatgactgattacatcattggccattggtgatcaactcaaccttcagctcctctcctctccttggaggctgagaggtggggctgaaagtgccaaccctgtaagcctgccttggtctttctgttgaccagcccccaccctgaggctgtctaggggccaccagcccccagtcttctcattagcatacaaaagacactcttttcattctggagattccaagagttttaggagctctgtgtcataaaactggacaaagactaaatacatatatatatatatacacacacacgtacatatgtattattatagatcacaatatcacagaagcagagactcagatgaaacacaggaaggagtcatgggaaaattggatggaagagcattcgtcgtactgagggaacaggaagggcaaagccctgaggctgggaggccagtgtggctgcagagtagagcaacagagacaaggtgagccggagagggatgggaggagaggatgtgcagattgggcactaagggctttgtttttactagcatcggatctattaataaatatcacttagtccctttttttttttgagacagagtctcactctgtcacccaggctggattgcagtggcacagtctcggctcactgcaacctccgcttcccgggttcaagtgattctcctgcctcagcctcccaagtagctgggattacaggtgtgccatgatgcccgattaatttttgtatttttagtagaaatggggttttaccatgttgcccaggctggtctcaaactcctgacctcagttgaacccccctgccttggcctcccaaagtgctgggattacaggcatgagccactgtgcctggccggtccctattcttgagtaacttttagtatcttgaggaagaacaacctgtgaactggcagcttcaaccagtgtgcttagtgataaggctctattccacaaaaataaggaaaggcatggggattcagtttggggagtggtataggagcttgccaagaactgggaaggatctaatatttttaccctacttgcaggctatcaagttacctgtcatggttctttaaacgctggcagaagatgtgagacttctgggttagagacaaaggacttcattccacacatcacggcttgcagcgggagcctcctcgtgtttgcattggccccttggggccaagaggaatggctgaggtagatgccgcacaccgttggtttgtgtcatagcagaggaatcctgaaattaagtaacccaatctttaatacagggcttcaagcgagcctgtcccacctttgccctagagggagacattatctttcttttgttgaccaggaaacaaatctgccctctgctctagagagaaacactctctctatcttccaaccccgcaacaaaagctgtcagggcctctgctcacaggacataaagaaacgtgagagatccatggagaactgtctcctgggggttaagttagagaaccctagactctattaatggttttataagttgacactgttttggaccaggttagataatggagttgcagttttcctgactgtttggatgttctagagtgagacaaggaaaccattgacgataacgagcaagtgaagtggtagcgaggggataggaaatagactaaatgagtcacttgagcatgtttcagcattcacttatcatctttttcaataatatttctgcaatgcctactatatgccaggcaccaacctagaggcctgttcgtgatgaaaaaaggaacaggctgaaggtctgcagggcaggctacgaagaggtcagggctgcctgtggtctgatgtttctcaggctgggtgcatgtcagaatcacctgggcagctttgaatctttcctattctcagaaggccccagaatcatgaaatccaaatctctggggctgaggctcagggatttcgtttaaagataccttcccagatgattgttacaggcagcacaggcggagaacgcagccatgggtgagtgcatgtgtcaactgcttctacagcccagcccgttgctacgaggctcgcggttgcttcccttctgatggggcttccgacagctgctgctctcctcgattttcttctctgagggcccagtgtcctttgaggtgggggcctcaggtctgtactctcaggataagatctgattccaacacgtaattgataattcttgttttaagaaaagtggagtgatttttctccagctccaaggtctagggcaggacattttaacctgcctttcttctgggcactagtgtattttgggtttttggcaactatgtccagggatgtgtattgatcaccagtaatttataattgcatagatatctggataggagtaaaacatggacttagaagaatgtggcttcaaagtctattctacccttaccagctgtgtgaacgtctccagacttcctaacttccctggggagcctggcaccatggcttatgctcataatcccagcactttgggaggctgaaacagaaatattgcttgaggttaggagttcaagaccagcttgggcaacatagcaagaccctgtctataaaaataaaaaattagccactgggtgtggtggtgagtgcctgcagtcccagccactcaggaggctaaagcaggccagaggatcactagagccaaggagttcaagggagatcagcctcttctttagcaagaaggagatgatctcactttttccactgagttgttttgaagattaagtgaaaaatgtgtctaagccttggaactgtgtcttggtacatagttagggttaaatatattttaattgtctcattgcctcattaaaacaaccccttaagcaggaactatacatctgcattttgctgatgaggaaactacagcctagagaggagaaataagaacatgaaagtagcaaataaggtccttcctttccaggagctcataatttagtcgagatgatatgaccttcttggaaagaatgatttaaaaataaacccaggtaatgattcaaaactccattataatgataaaattgtgagacattggaacaatgtctcccaactgtaatgtgcagaaggttccctggagcatatcaattatcagttgaagattcccttgctcgggctctgatcctgaagtcagaagactactattcaacagacagatggctccagaaggctctgcacagttgatgtgtcaaccacacataaagaaacagtttgagaattcccagtcagaagcagcttcttggaagacgcaggctttgaattaggccttaagtaaaatctaggtaaagtatggatgggcagagaggacaagagaggatattttgtgagaggggtcaagtcatgagcaaagctgagaagacaggaatggatcatatttgcagaaataaccatgttaatatacatagtaattcaagtttattggctttgctggactttaataaggtaagtattttctcattttcatgacctttttcttgcaaaaaaactgaattaacaaacctcctcgattcttgaaggtcttctctccaacagccccacatctctctcgctgagcgccacaccttggtgcatttggatattgatacgcaaacctaaattatgcagaaagtgaagctttgaaaggcaggcagggagaagtgtcctcttgattaatggtgaggcaacatgtttcaagtgaggtttcaagttccaggaacttaaaacctgtctgagatatacaatttgggatagattccactgcaaactgggagttaaggtgacaagctggaccatgagttaaaaaaaaaaaagttccctctgcccccaccccactgaagtgtgtttgtttgtttgtttgagacagagttttgctcttgtcacccagactggagtgcagtggcatgatcttggctcactgcatcctccacctacctggttcaagcgattctcctgcctcagcctcctgagtagctgggattacaggcatgcaccaccacacccagctaattttgtatttttagtagagatggggttttaccatgttggccaggctggtctcgaactcctgatctgccacccttggcctcccaaagtgctgggattacaggtgcaagccaccgtgcctggccgtttgtttgttttagtaagtccaccttttctgtagaggggacttttctctataatattaaaaattagtgaccacaattttaaaaatggaattcccacttcacttggcaagttaggaggttggtatattgcttggggtacttttgttggcaagtaacaagtaaaaccttattcagaccatcttaaatgataagaaaaatgatgttcttctgtaacacgaaggccagaggttggttccaggtgtggtgtcacagggatctgctgccccttcttcaggtgccctggactctgtcctcatccgtgtttgtctcttagcaagatggtggcagcagttttcagtatctcaagaagacacagtgttgtccagggaagaaaaatgatgttttcctgttttttcctttggaagtcctgacatccaggtggacttccttcatgtctcaatggcaaaatgggttacacgcccattcttatactgaacactgacgagcggagtagatttcttctaattggcaatgtagagaatagaataaaagtaggaccaactttccaacttatgtaggagaagggggttacattgacaaaagaagggggttacactgactggattttgggaggcaaccaacaacatccattagaatctgacattgctggttccagattccttcttggcaaatattgggtgtagcttgatgtgtgttgccccttttaaagggcagcatggggtcttcaatttgccacatcattccctatctgtattattttgtactctatttgcctccctatatattttatctgtttagttcctataggcacttgtgtttgggaccccatatctacagacacaggcatgccatacttttgttaagaggtgcttctaatcaatatcatccagcatgcttgggtaatcaatcagagtgattgtttaattgctcttctcctctgcttgtcagcctttcaacctttcaaaggattgatctcttctttcctgttgtggccaacttcccctctcatgtcttactttcggtggtatcctgatcccgtgggccaccaggaaaagcctaacaaaagtctctggttccatccgagcagctgcagaaaagtcttcaagaatctgagtcttctaaaagctgcctccataatgaactagtcttagtgaagagagaaaacatagacagtgtcaatcatggccagtgacagggtgcaattaacccaggatcaaattgcagcaagatggatggggccagatggtcctgttattctaacaaagggattttatagtaagtgcccttcagaagggagacatttttctacatagaactctggaatgaaaagagacaagggtgagctcttcacaattttcaaacagatattatggagtaggaaaactagtaaatgatgttttaaatcatcattccaattcttaattggtgactggtaaggcgtacatacactgtccgtgttgatagtgcttgaagctataactactagaaaattctaggctgaaaatatcttaaccatgaaagacctccattaggaaattcagaatcttaaatagagtggggcaaataatatagggaaagcgaattgaattaattccttcttacagtaagaatgtttaaagttcttatacacatgcttctgagtgttaggaatatagcaatgaacagtttggatgtctttgctatctgtaaattacatcccaacaggaagacagagttaataaaaaagtaaacaacatatagaaaagatgatttcagaatgataggtgctaaaaaagtgaaaaaagccgaatgttaagacagtgaaaggtggggagtagaagtgggtggtggtgtgttggtaaatgttcaatacctggttctctgggggaaaaaagccttggttttttttgtgtttaccaatttctttggcgtaaatactcccaccatggctgatttcaagcgaccagcgtgactacgagttgggaagagatgcacacagtataagccagctcctgcacacctctgggaggtgttacattactttcagaaaggactgtcaggttaaggactctgacaaaatcgacctatgagctgagatatgaataagaagttagtcatgagatgaccgggcgtggtggctcacacctgtaatcccagcactttgggaggccgaggcgggcagatcacgaggtcaggagattgagaccatcctggctaacacggtgaagccctgtctctactaaaaatacaaaaaaaattagctgggcctggtggcaggcacctgtagtcccagctacttgggaggctgaggcaggagaacggcgtgaacccaggaggtggagcttatagtgagccgagatcgcgccactgcattccagcctgggcaacagattgagactctatctcaaaaaaaaaaaaaagttagtatgagatggaagattcaggggaagagctttccaggcagaagggatatgttacaaatacaaaggtcctgaagtaaaacaagttttgttctccaggggaaaagaaggtgttgatgtataagaaaataaagagataagttggggtaactcatataggtcctggaaggccattttaaaaaatttagattccattgtaaatggaatgggaaattgtaagaggtttaagcaggtgagcagtatactatacctatttagcaggaggctgtttctacattttcatggaaggaagtcagcatagggttgttctgtagcagaagacagagaagcagaaatagctgactttgctgatgttatggtctaggttttgagtttgaatttcattctctcaaagctgtatatgaactgattagcatgatgcctggaacaccataagccaggatgttcgttgttgtttctgcactggactaacttggagatcagtcttgggaaggtgggtgatgtatcaatatcatcgggaatcacagagcgaagacatcacagtgtagggcttgcagtggactcttaacatgttgctgaagatgtgggtaaaagaaatcactatctccagcttttgaaacatagttcaggttacagagagatcaggtggatgcttatcccccagggatgagagttggccagattataagctgtgtttcagtcttcagttgtagtgcatttgttcatttattcattttgtctgatcagggacttccattcagccaccaaagcagaccaccacgtgacaccttcatatagggcatttcaagtgcaagggtatgaaagaaagattcgttatggggttttccttgttgctattgttgatttctttctctcccctcctaccatcatcaactagtaagtagggatcctttaaaatagtaatgtaggaatattattattatttgtattgacagaaacaaaagtttgatggtattaggaggtagcatttgttgcattttactacatatttgtgcagtatgctcagtgctttatatacttaaacattgcaacagactgtgaagtgagaatattgtaccttttattttacagatacagaaactgatgttcagtgaggttgagcagttgccccactaaagcccatggcttaattattagtggagcccacatccacgccagtttctgcaaacgctccatagcttctacccccaatcctaaaagcgttcgcaggaaatgcgcagctttggaaactttcatcctatgtcttctcaacttggtttttggttttgactcttttcctgctgccactatttatgttcagtatctctaaggttttcatgctaccttcctaaggggcctctgcactttcagtatctcctattctatgctgtctcatgaacagctttaaattgaactctttaaaggacagcttggtccctgttatgccttgacccagaaacctcagtggctccttactggctgaagagcagacctttcacgctggggagagctagaggaggcctcgacttcagcccaacgagggactgggcattgcattttgttccgctgtggaatgctggctgctgtcggggcccacctctcatggcactctgtgttttcccatctctcagcatccacattagaatttctgttcctggaaggcagggactgtcccaggcatctgagtgtaaacagcatgggtttgcaacatgacttcactcactatctctcattcctttttccttcgaaatcaaatctaatctctcccaaggccatttcttggatttggtgggaaatctcactcttattttttttaaaaatagattcctcgctctctctaggagagcaaaaaaggtgtaggcttttctgagtgtctgccagtcttttgggctatagtcactctctttgcagcctgttgccctggcccacgtggtcctttgaagagctcagtcctgttctttcaactctaagcttgggcaaagggcttagttcaggctcagtttgttcataaacagccagaacataatagtggctattacgtaaaaacaccagaaaaggaggcttaaatcaaacatagcactttgccagaacatgagctctgagtttcaacttcccaggtcaagcccagcccccaccatttataggcatatgctcatggacaaataactctcatgcctctgtttcccccatctgtaaagcatggggatcaatgctgtctccttatgcatttatgatgaggactagaaaggataataagaataaaagatttagcataatgcctatcagagagtaaatgcttaataaatgtattttatattttttcgcctttcaagaatcttaacttctctagtgatgttgtggggttataagagctgtacctgtgacagagacttcagtattccttaggagtagagcccgcccaatttctgccagtcttgcgagcacctctccctagggaccgtccagttaggtgactcctggttgctcaacctcatagcattagtttcttcatctgtgaaatgagagtgtaaggtaacttgcaaaatgttgggaagccactttacacatttaacacagattagcacataatgaatgttaagaggaagtcaagcaaggaatataatggtcttagtacagtgtctagcatgtagatagggctcaattagggtcagctaccaccatcatttatttcattgtcgtcaacatcatcattgccatcctcaccgtcatagtctcacctcacataggagactgtttgaacattgcagtgaataatatatattggttaagtagtccacataatttgaaaaacaccagaaaaggaggcttaaatcaaagatggcactttgtcagaagttttatgtatatccacttcttttcttaacaagcacttcttaatagttgattcccatggttttgcacttaatgatatctaaatatattaaaaatttgcctcatctggctgtctaaatgatacaggattttgatcagccttcctcgtgctgggaatgaattgattcagtttaaatattttgtctaaaagttatttagcctggaaaataccagtctaattcccttacaagtaagaaaattataaagagagagatctaatcagtgggtagaatatagcctcagaaaatgtgtaccagcataccttaacgaaagtagaataaatcttgaaactttaacattcccctttcttggacctaaataggtccctttggaaaactattttattgtttctcattaaattagaattgtgctgaggtgccactatctaccgtttcctattattattaatataaaaaaattcactgcatattcagcatttcccccgttaaagccaacagaaaatcttccccgcttttgtacttaactctgggtcatttttaaacaaagtttctttttttgtttttgtttacatctgcatttaaagagagcaatattttctagggacaattaaatagatgtaatgcataggtttactcctgcttggtgaaattagcaggtcttgtagaagaaggctgaaaagaatgacagtggcaagaagtgtcttattaaccctaggcagatacagtaatttctgggaaacagaattttggaagcatcattttaaaaaacacaggttgatcatacattagaaaggatacactcaaacttttaatccatcagtgagatgaaaggtttgatgaagattgatactgaagttcttactgctgcatagaacactcttactgttcacagtatttctaaaaatgagacattgcagtgttttatcttcttgattcattcaagagacagatactgagtggcaacagaggccatatgctgggtgaccagaagccacagctgacccagagctgtgtgatgtttgggtctggggaccatattccatctggcaactgttgctagcgcctcatttagacaagacctccctctccagtccccttccatatttccagaagcttcttggctctttagacacagttttcaatctttgcataaaaagcatagagcagctgggcgcggtggctgacgcctgtaatcccagcactttgggaggctgaggtgggcagatcaagatgtcaggagatcgagaccatcctggctaacacggtgaaatcccgtctctactaaaaatacaaaaaattagctgtgcgtggtggcactcgcctatagtcccagctacttgggaggctgaggtaggagaatcgcttgaacccaggagatggaggttccagtgagccgagattgcgccactgcactccagcctggcaacagagcgagactccgtgaaaaaaaaaaaagaaaaaatgcgtagagcatgtactatagctcagatcctatgtactatggtctgaagtgtcctgcaacattaatatgttgaaacttacttgccaatgtgacaatattaagaagtagggcctttaagaggtgattaagtcgtaagggcagaattacttatagatgggattatggcctttatcaaagggcttgtgggagtgagtttgttgccttgcatcccttctgcctgtgaggacatggtgttcgtctcctctggaggaagcagcatgcaaggtgccatcttggaagcagagactgggccctcagcagacactgaaactgctggagtcttgatctgggactttccagcctccagaactgtgagaaataaatttctgttgtttatttattacccatttttaggtattttgtcatagcagcaaaaatggacagaatcactatgttaggacagagccttcaagttacaaaggcacagaaaatagagacccattttaccacttaaagtaaatgtcaatgtcttcctcgaggctgtcataataattagaagctcctacatcatagcccctcccccaatcctcaccaaattgtctaccactttctccattgcctactctgtgccagccatgtggatctccttgtgatggtatccatgccaccttctcacttctttgtagttattgctgaaaagccaccttgtcagtgtggctttctctggccacggtttttaaacttatgggagcttcctccagtttagcactgactaatccctttcccagctttatttttcaaccaaagcctttatcacaacccaacattctaaatatttcagttcatgatttattcattgtctgtctcttccatattagactggaagtttcatgagggcagccacttagtcttatacgccattgcctttcccatacctacaacagtaggggtgtgtaaatcacattctgtgaaccaaacaatgtggttctcatcagatctcctccagccagccggtctgcctgggagctggaggtacaacagtgtaggttcctgataaaaatgttcaacaatgaatgcataagcatagtatatactaaaagaggccccagatgctaggggactgcaagtcactcagaggctggggtgtggaatttgagtgtgggacagtgaaatatgagggtggaatagtatagattttggactcagatggtggacaagagagagccatggaaaggtgagtgagtgaccagaaggcagaagagggacaggattaccaggaatgttttgctgttttgcaaaccaaagagatgtttaactgttaatctccatgagtctgaaagtagggcctttctaaaaaatgtttaaaaataataaaaatactgaagagtctgcttagatagaatttgaataagctccaaaggttgcaatttactttggttttcccccaaaatactgacttaatttcaaacaacttcaggccttagagaactgatcagagaaggtaaaataatgaggtggctccaggatgaacaacatagagtcatcccaattggattcaaattccagttctgctgcttgcttgccatgtaaccttggaacaattacttaacctctctgaacgttttttctcatctgcaaggtggaattaattagacctacacttccaagctgttttgagcattaaattaaaatttttttttggtcacatgcctcctgtaatagtaggtactgaatatatggaaactggatttattaaagcaattatgtatttttatgaatgatttcacaaatgaatgcatcttatttttaaccaatgtgaaaggtgaactgaattcttacaagcataaatgccttaaaatagaacattatggctttttttctgtctttgatttggcttcttaagcatattgtgaaatggaatataaaatatacaatatataatatatacaacaatatacacatacttgtattttttcttagcacctcataggactattttattttattttattatttatttttcagtcagagcctcactctgttgcccaggctggagtgcagtggcgtggtatcagctcactgcaacctccgcttcctgcctggctaatttttgtatttttagtagagaggggatttcaccatattggccagactggtctcaaactcctggcctcaagtgatctacccgccttggcctcccaaagtgctgggattataggcttgagccaccgcgcccagccagactatattttattatattaggtgtcaacatagcactcagagtgtatacaaccatctctacttgttgcatcttatgtatttccctaatattggcgtaagttgctgcttcagtggaagtatgttcttgagttgtagaccaaggctaaaaatctcttcctcttttgaggagtcagatagactctgctttgagaccatgggaacagtacttcatcatttcttgaatcctgtgagtactatggattacactttatttaatatatacagtatgtaaataagtttcagaggcataaaagcttcaaaactaaacgaaaaggaaaatttaataaccggcagatttttagattgtgcactaaataatctgtttttcattctaagaaaggggaggaggaaggcagagtttaatagacgtatataacaaattaaaattcagtatctggggggtgtaaatcacattccatgaaccaaacaatgtggttctcatcagatcttctccagccagccactctgcctgggagctggagcataattcaaccaactgtaaaacaggaagatactctcgataaagggcagaagacagcacacagtccatggctctttgccaagttctgtgcagcccagctatctatataataacatgtctgtaaaatgatgtgtttagaattatccttctaggcctgggatagaagaagagaaagctataaagggaaaaagaaatttgtgcaactgtggctatcttggggtctaagagagagaactggaactagggtgttagagagtagagattcaactgcgggcaatttggcccccaggggacgtatgacataagacaatgtctgcagacttttggttgttccaatgggtgggtgttactggcatctagtgggtagaggccagggatgctgctaaacatcctatagtgcacatgacagcccccgcggcaaagaattatctagccccaaatgccaagaccaagaagccgtcgagtagagggttcaactctcactgttggcaggtttgactgtgattcccatgacttagtcatctaaagtctttggaattatacacaagtgtttttgttagaaggcccaaagttccaatatcattctagcattgtctttctcaggagatgatgcaatggatgtgaatgcattgtgtcctcatctgttttgtcttctttttttttggtgagaggccactgaattgacatgggtctctgtatttgtccattttaacactgctgataaagacatacctgagactgggcaatttacaaaagaaagacttttaatggactcacagttccacatggctgtgaaggcctcgcaatcatggcagagggtgaaaggcatgtctcacaaggcacagacaagagaagagagcttgtgaagggaaactcacctttttacaacgattggatttcatgagacttactcactgtcacgagaacagcacaggaaagacctgcccccatgatttagttacctcccaccaggtcctgcccacaacacgtgggaattcaagatgagatttgggtggggacacagccaaacaatatcagtttctgagcacttggttttgatctggcatggtgaacaaaagggcatcagtgttagaaagctgtcctgtgtcctgagagagagaaataaatgggctttctttcatgtggataagaatttatgtcttagtgaagatggcctgtgaaatggccctggattaaacacaagcctaaatcacagtgttccattatttcctaaaagtgtctccactgtaagtttgaggagaagtggtaggaaagtggacagggttttcattgcctctgtctgtgccacacccggttagtggttaaatggaagatttcagtctccagaactgtcaatccatgactttataatggcatcaaatttgttttaaaaaattcatgctgtgggctttgaggacataattgtagctcctgaaaagtttgttaaagattgcattagatagattctttttaatggacggtctgtatgcttggccatttatacttcataatagtatatttggaggataaaaaaagtatgtgagttagaggtttttcagcaaatttcactactattgctgtccttgtccaaatgtctttgaaaattttatgggagaaagaattttgtccttattatgcttgactgaataatttgttaaattatgttttaaatcagcatttcctcaaattgagaacaactaatgctaaagtatatcatggattattttacatgcaatttgcataaaagttttaaaaagtcactgcttcagtagtaccagagggctgtctagaaagattgcacaaaaccaatgtctaagatggatattgttggtgttcagaccttctgttatctaattataaaaaagcataacatagccacccaattgagtgcgctcataatcaaacataaccatttgaagtaaagtggaagcttaatgtgaaactgctgatacagcatttttaattaaagctcctttgtattttgagagtaaaattctaaatttcagtattttgatgttttctaaatggttccctcaaaatgcaggaagcagctcagggagcttcagggttcaggatggcaggggctgctgtggggttggatgtccaggacccaggccagctctgctccccagccctccagcccaagcttcatccaaaacagctccagggaatctgttttatttattggactcctgcacaaggttttttgtgaagacaggaatctatggctttaaaaagttggaaatcgattggaatagtggatagagattccaggaggaagagctattttttaaatgtatgtaagataatgcaagagacccatacttaaaagcaaaaaaaaaaaaaaaaaaaaaaaaaagattttaggctgggcctggtggctcatgcctgtaatcccagcactttgggaggcagaggtggctggatcacttgaggccaggagtttgagaccagcctggccaacatggcgaaacccggtctccactaaaaatacaaaaattagctgggcattgtgcacacctgtagtcacagctactctggagaggctgaggcaggagaatcacttgaacccagtaggtagagtttgcagtgagctgagatggtgccactacactccagcctgggtgacagagcgagcctgtgtctcaaaaaaaaaaaaaaaaatctgacctccgagtaagctgtgactccactgttttatgacacctattgtagagataaagaaagtgggacttaaagagctaaatatctcatagacacatacataaatggactaattgtgaagtgatcccaaacctatttgagagcaaagctaccctgacaacaattccagtatactgtcttccaaggacagtaattgcggtgaggctaagggtagaaacagccaaactaaaataggaataatggtttttcatgggtgatgcatctcaaatatgtgctcagaacaaaagacagagtgtaagagtagggataatttaaataatgtgacacattccaccaatacacgaccagatgagcacacacccagaatgtgagatggaagacaggaatctcctgtttatttgaggattaagggagaggctctatttttctcttggtatgagcaatcctgcattacattggttaaagatgcctgtctgtggctcagataatgaaacagtaattgatttcaatgcaggaggtagaactggctgttctgcacttacttgttaaaagctgataaaggacggaaatctttgggatatttgagaaattctcaggaggtgtaactaaaaaaaaaattgaagttttattataagcaactttcatcttacatattaactttactaacatatatctaagaggtgattttgttgtatagtgacttgtttcttgcctcataacattcagaggattaaaattgatgaaaaacacaaaaaaagtaacaaggaaaattgatttataattatttatttatttattttttaaagtgaacatgtagaaacagaataaaatggtggttatcagggtcgggtgtggggaatgggggtgggaatgagatcaaaaagtacaaaattgcatttatatagggtaagctgtagatttaatatataatgtgaggaccatcattagttatgttgtattgcatatcgataattttccaagagagtagattttaggtactcttaccacacacacacacaaacaaaacagaaagataactatataagatgatgggtatgttagtttgcttgactgtagtaatcacttcactttggatatgtatatcaagataagcatatcaaaacttcatgtggtataccttaaatatagacaatgaaatcataaataaatgcataaattgaccatttgatgaagaataaaattgtagacagaataatggctcctgccaaatatgtccatgtccagtccccagaacctgtgaatatgttacgtaaacattgatttctgtcttcctaacacagtagcgcttcctcaccaagcctctgcagtagtttttccctctgaccagaatgtgtttccctcagctcttcgcagagtcagctctttctcactcttcatatttcaggcaaaatattaccctttaaaagatactgtctacaacgaatcacattcattttctctaactacatcaagaatagcagttccgtagccctctgccagtgcagccattcaactttaacctgaaggaaagatgaatctcttgaagtttaactacttagcatgggtaaggagcatgggtatctatctgtatatggttcttagacttcatgccagccatcagtcaatgtcatatgacatgcctgccttataagaagatgtaacaatagataatgcaactaaccaaatacaagattccttttttctcccgaaattactttggtgggggttgagtggaacaggaagggcctcttgcactacagggcacactctcacctccttacaccgctttcctgtttgaagtaaagtcactgtccaaaataatttcaacctttttctgcccaagcatattctatcagatcattctgcctaatttccttcagagcattgatcattgtctggaattatcttgtttatgtatctgtttcctttttttaacttgctattcaaaagctatatggtagaaggagggaaggcaagaaggaagagaggaagaaaggaagagaaggaaagaaggaaaaattgaaggaagcaaagaaggaagaagaaagggagggtcatagggaagaagggagagaaaggggaattataaagtgtgtgtaggttctggttaatacctgcttaaatttaagactatcaggcaaaaagaacatacacagtgcccttctttcaccaagatgtgtaaaatctttttctgtttgtttgttttgagacagggtctcactccgtcacccaggctaaagtgcagtggcgtgatctcagctcattgcaacctccacctctggggttcaagcaattcttgtgcctcagcctcccgagttgctggccacatatcaccatgcctggataaattttttttttcttttttcttttttttttttgtattttagtagagacagggtttcaccattttggccaggctggtctcgaactcctggcctcaagtgatccacccacctcctcctcccagagtgctggaattacaggcgtaagccacctggcccagaggttagattttaaattaactaataaagtgtaaattagagatagttaatattatcattgaagaatgcttatgtcactgtaaaatagtgtactcatggttttatgtatacaattatacagtgcaagtatttgtaaatgtataataatgtatctataatatgcactctataaaatagtacatatgcaaaatataattttatagtatatagtcatgtgcaacataatgacgctttggtgagtgtgggaccacatacgtaatgacagttctataagattataaaattgtagttttactgtacttttcctatgtttagatacacaaatacttaccattgtgttatagtgcctaaggtattgagtatagtgacatgctatataggtctgtagtctagaaagccataggctataccatatagttaaggtgtgtagtaggctatgccatccaggtttgtgtaagtcatcctataatgtccacacaatgccatcacctaacgatgcatttcttagaatatatccccatcattaagtggcacataactgcattagatataccattaagtcactatattcatttcttgctctttttaaatttttttgccctgttcacatggttgaattcacatatgaggcaacttcaatttttctacctcatggagctgttgtgagcaacagatgacattgtgtctaactggaaaattactaaatctatatatgatagaggagatgatgacaatgaaggagaatattgatactgatgacgaaaatgataatgaagataataataataaatgatggtgataaagatgatgaaaatgatgaagatggtgaagctgaccagaatgatgatgatgaaaatgataatgatttgaagacttcaacctcattcagcttcctcagactagtatttattattgtaaggttttccatgctgacaaagaggaggaaaattccaatcataagacaatattctttctattaatcaacaaaattaaaataacattattttataatattattatatacaagtataggttatgatacttaaaacatagaaactgcaactccatctttgatttaattccatttgagcgtgtcaagcctaatatactctaatcagaacctcctgactttgatagggttaagccttaaacatatataccaaagtgcttttgtctgcattgatgtgaaagatcagttagaacaacattattttgtagttataagacttcaaaccacagtgaactttagctccctgaatgactcttcagatgtttaatatcgttctaaaaatgtacaaatgtaagagcagagagcagattagtggctgggaggagaaaatatccctgatcaaggatgaatgatgggctctttgtataaagttgcaccaggtctttcctttcctcagaaaacaaattgcgtggttggtgatttgggccatatcttcagatcataaacgtttttctgcaacaatacaaaatatgcattgttacagtcagatgagatttttaaaaaagagttgacaaaatactttaaaaataacctatttaagtataactttttattatggaaattatcaaacacatactaaagtaaaaagaaaagtataacaattccccttgtacctcatcatctagcctcaacatgttgccacttttatttcatctttgactcactaatccgcccactccccatcttgtttttcctggtatattttaaagaatatcccagacaggctgggtgcagtggctcacgcctgtaatcccaagcactttgggagaccgaggtgggcggattgcctgaggtcaggagttcgagaccagcgtggccaacatggtgaaccccgtctccactaaaagtacaaaaattagctgggcgtggtggcgggtgcctgtaatctcagctacttgggaggctgaggcaggagaatcgcttgaacccgggaggaggcagaggttgccgtgagccaagatcacaccattgtactccagcctgggtgacaagagtgaaactccatctcaaaaaaaaatcccagacagtgtatgatttcactgtaagttattcaatatatatctttatagagtaagactttaaaacaatgtagctctatattaaggataatttcttaatatcttaattcttaagaaattaagaaggatttcttaataatataaaaaacaattataaaactcttttaaataatagcagtgctgaaaactatcagaacaccttgccttaggcacaaatctgttcttactagctctggcattggtggttcagcttgagcatcctattgcaccctgagtttggcaacatgtgttggagttattatattactaatggtatagatcaggcttggcaaacttctctgtaaagggccagataataaatattttcagctttgctgcccataaggtctctgtcatgactactcaactttggtgttgcagtgcaaaagcaggcacagataatatattaaatgggcgtgactgtgtgccaataaaactttaattataatgagaagaagagggctggatttggtccttgggccagaatttgctgacccaggctctgaataaggtaatccaattccttcccaaagggggttggcagaccctggggccatcattaccttggagagttgagtatgttgcgattgaaaagcaaagcattaggattcagaatacccaaattccacatctctctagcatttggaaactcttgaataggccacttgctttttggttcatggtttcacatttattagatgaagatagaggcacctacccttcttgcttaaccaggtttttgcagacccagaagcccatggttatggaagtgtttactgagccatagttggctgctgcaatacgaggcattcattatccaccatacattgtaagtctgggtggttcccaggtaatgattcttaattatatttttatccctcttttgccattttttgggggttccagatgtaacaataaaaagcaaacttaaattcactgaccacttctacatatatgacagggacagtaggaccagggagttttatatgcataatttgattagtcaggtattattaccttgctttttaaaggtgaagacactgagactgaaaacaagtaatggcctaatccctgttttctttttcttcttgagacggagtctcgctctgtcaccgaggctggagtgcagtgacaccgtgttggctcactgcaacctccgtctcctgggttcaagcaattctcctgcctcagcctcctgagtagctgggattacaggctcccaccaccacgcctggctaagttttttttttttttttaatatttttagtagagacggggtttcaccatgttggccaggctggtcttgatctcctgacctcaggtgatccactcgcctcggcctcccaaagtgctaggattacaggcatgagccaccccgcccagctggcctaacctctgttgagagtgagtgtcagggtcaggatttgaacccatctttatctgagtccaaagctcttgaactgtatgtatgtctagtgacattgagggtggacagtcacctttctctattttgccacattaccaactaaccctttagtagttttcatagtgctttccaccaacattagctcatttaatcttcacagcagtgaagctatgcaactcactcaagtcatcaacctgaagaacccccacttattctcaaggaccatgctgagctgtcacttattaaatcacctagactgagtcgggttcctgtgtcagatgcttttactgtcacaccttgtatttgctttgtgatgcacacttcattactgtgacttaagtgtcatcctacagaaaacttcatgagagcagaaactatgttgttcttgcttgccactctattaccacccctggcccaacagtaaatatctgttgaataagtgagtttctaaaagtcacggggtggaagctggatgattctgagtggtttgcaacataatagtatttatcgcactgtaagttgagctggtcatgtgaaccatccagcaggaagcttgttaggaattccaagtcagtgactctatgtctgggagtgctagaagtgatagacatccggtctatcaccagcttctcagataggcaagtcattcttcttgcatagagaaacctggaggcatcagaggtcgggtggtgctcaggttacagtactttggcgcaggtacgggagaggtggtccctcttctgtttggaaatgtgaagcgcgtgtgtgtgtgcacgtgaacgtggtggacaaaggctacttcctcatactatacatgaaagggccataggaagataatcaaaaaggaaaagaaaggtaagagttgttgcaaaatgaattgtcttcagaggctaaatgggtaacatacatttgggggagggctgaatataagaaagagaatattgatgcaaaccacagtgaaacaccatctcatgccagttagaatggaaattaaaaagtcaggaaacaattaaaaagtcaggaaacaacagatgttgggaaggatgtggagaaataggaatgcttttatattgttggtgggagtgtaaattagttcaaccattgtggaagacagtgtggtgattcctcaaggatctagaaccagaaataccatttgacccagcaatcccactactgggcatatacccaaaggattataaatcattctactataaagacacatgcacatgtatgtttattgcagaactgttcacaatagcaaagacttggaaccaacccaaatgcccatcaatgatagactggataaagaaatgtggcacatatacaacatggaatactatgcagccataaaaaggatgagttcatgtcctttgcagggacatggatgaagctggaaaccatcattctcagcaaactaacacagatacagaaaaccaaacaccacatgttctcactcataagtgggggttgaacaatgagaacacatggacacagggaggggaacatcacacactggggcctgtcggcgggtggggggctggggtagggatagcattaggagaaatacttaatgtggatgacacgttgatgggtgcagcaaaccaccatggcatgtgtgtatacctatgtaacaaacctgcatgttctgcacatgtatcccagaacttaaggtataataaataagtaaataaatatataaataaataaaaattagaaaaagaaaaggcagagtataacagttaaaaaaaagaagagacaatgatgaagtctttagtgatctagagaatccatattcaccctaaagacatttaaattcaacatgtgaaagcaggtcactttgtagacaagacacaggcaggcacaaggctgcccgtggaattcaactttgcaattccccagaagatggagatagggaaggagcgatgacagcagagaggagaggatgtgacacaagagaaatgattcctgggcagatcgtgattcctggatgatccctatgggcttcatttcttgaattcacacagatacccttctagtcttaagacagtagtatgcagaattccacccacaatatggtattatttggtagtaattacatcatcaaattttcattctcatgcactatgtatgataggttgggactaattcagtgaaacaaggacattttcttatggcctcctgtgatatttctaaatgaaggtggctgatttttcagcttactaaattctaaacagataattggaataatactgatgtttctgggtgcttttattcacagattttcttcttccttacattaatttctgatttggcttccagagtatgtacaggccatcgtgctcctcttatctttaattaaggtctttgccatttctcttcagcagagtctgagcaggtaatgccagggtgcctgaggactctgtgggcacctcggttaatgttgggccatgctagagtcacaacgtgtgcaagagtcacttattgggccggaccttcatcttgtgtttaattatcttaaacgttgcaggctcagcctttctgtttgccatggtctgtcgggtatagagaatgttgatggagtttcctttaggtttctccaaagagccaaaagttagacccttatgaggctactgaagccaagggcttcgtggcaggactgagattccagaactggataaaaattaccctctaatccagcacttgcttttgcgaatacatccagaggcagacaattaattgaaccaattgttcagcaacatggatatttagtgggcgtgaacgcagaggatgcttacagatgaaagcttggaactgttttcttgctctgtgtgtttggggacgggtaggggaagaaacaaatgagcacagaagcctcctcctccttgagtaggataaatatggcttagactaataaaatacaagctggaatgcaccatttcctattccccaaacaggcgtcctggcagttgaaagcaaggagaggaaggaagtctttcatgagaaaggaattggggagtggaggcattggggcttcacgtggtagttctcctgattactgacacccgcctgctcctaacagcccatagagctacagccaccaactcccaaatttgtcactgtcacttcacaagtgcccggcattgttcaggaaattgtgtgtgtaaagtagagctgcctgcgcccagcttcgacaagggagcagccttgcgaaggtgcttgaaaccgaaacagaggcttatgtatcctattatgtgcctgagcaggagtcataaataattgtgacaagttttttttcccatcccacgtgacagtccttgactctgcctcctgtctcctctcccctctgcctcatagactagacttgccaggctgagtgatgatagatgttaccaggcagcaaatgacagctggatagattttttagttggtgctttagagggaatcagatatgctgtataaagcaataaaaaaagtacactcacaaggtgggttaagaatagccagcacagcagtaacccgctttgttgtgtatcaaaagttaaatctcacatggtcttagtgatgtgttaatttttcagactcctgtcagagtgacggtgaggacagtcactttaaaaaaaaatttaagaaaaggataaaagcaatcaactgttttcttagtatattttggtttttcaaatgagacaaaagcgttctctttttaaaatcatatctaagaagagaaataggattctggtgttttgccgtattgctgtattgctgtattgctgtatccttctcaatctcaaatttaaaacataaaattggagatgtgtaaggtgtggaattattcagcccctgttcaattaaataaattttttttttaacattgctcatcttcttccacacactgtattgatctagattctgtgtaacaaatggtctggtttcccagccaccttggaaatgtcatgtaggagtcaacaaaactacttagtgtattttttataaagaattacagcctcctctgaattactcagactttcatctcgggcaagccggcttggctacctcgtgtctcgatggatatgcagagctaccagaacatgattcagtgaactaccccactccctggttcacggacgtgacaggctgagacgtacttagtcatcgcatttctgtcttctcctgcactatatgggaagtggctgctgtgtaatttaagagtgctcagtatatcagatcacgactcttttcccccttgatttttctgatgaatcacgttaggaaggctgtggcttttacacggcagcgtgcagcatgaggaggcaaggcagcacaaaatgtttattaaaaaaatatgtctttcgggctaggtaccaggcaaggggggtaatttgagttacgcctctataattcaaatttggggataattcaatactggtgtagttacatttccagccacatcaagttgtacatgtattattgggtgttgtttattactttggttgtagcattctctccataggacaatttccataatgaaacctattttctatggctttatcacttaacgggttcagtgtttttctttttttccagcagacatgaattgatgagatatatgaatgcccagaaaatgtcatgaaatagttaaaagggtaggtttggagatctgctgtctaagttcaaatcccagcttgtcttcttactccttgggtgaccttgggcaagtaatttagcctctttatgcctccagtcttttaactggaaaatagggataatgataatccccccatcatagggttgttttcaggactcaatgaaataaatgtgcttagtacaatccctactaataggtattgaatacatattattttagttattataatcattatgattgagttgttataattattactgggctagtttcccccaggccacctacatctcctcacttcaggtctttccagacttgatgaccatatgttggatgggtggatggaaagttattttaggaatggagccctctttgtggttaaatgaacagtaatgttttacattggttcagagtagtctttgataaggatgcatattctgtacatcactgatactactttttggaccattttcatctcttcctcatttgaaaagaaccttcagtgaaatgctttatgtggacatggcaggtagagtacctggattcatcgatcagttctttttctgttctttctctcttgcttgccattctagctacctaggtagaccttgttggcttataaacataagtcataggcaggttctaatatgattttagaaacattaaaaaaattggactgtgattcacagtaaggaatacattttatattgtgacccagggtgcacgtgcatgcataatatatagacattttgctgaagccagtgctccatgaaacatcaattatccttcccacatgtgtgatacactttggcattttctatccttttctatttcatttgttaaaagtgatgctttaggtcaggcaaggtggctcatgcctgtaattccagcattctgggcggctgaggtggatcacttgagcccaggagttcgagaccagcctggacaacaaagtgagacccctgtctctagaaaaaaaaaatagctgggcaaggtggtgcgtgcctgtggtcccagctacatgggaggctgaggcaggaggatcacttgagccctgggcaagagaccaagactctgtcacttagaaaaaaaaaaagtgatgctttaaccagggtgagcaaactttttctataaagagccatagtagatattttcagctttgagggccatggagttcttgttgcagctactctactctgctgttgtagccacagacaaaacacaaaacaatgggcatggctgtgtttcagaaggacttgacttacagacactgaggtttaaatttcatataattttcttgtgtcacaaaatataattcttcttttgttattattaaaccattggaaagtggaaaaaccattctcagcttgcaggccacacaacaccatgcagtagccagatttgctcgatggactgcagcttgctaatccctgctttagcccacgaagctgatttttatgacttgtacttgcaacactcttctgggacatttcccaaagtgactgcgaagggacatctgtttagcagggattcaaatgggtgctaatggagagaaagcatctctcttcaagtaggttagtgacccttcagagtaaataaaaggtgcctacctcttagcagaaattctgtgactctttaacataccaccagacctgataactttctttctttcttttttttttttttgagatggagtctcactctgtcacccaggctggagtgcggtggcgcaatctcgactcactgcaacctccgcctccctggttcatgccattctcctgcctcagcctcccgagtagctgggactacaggcacccgccaccacacccagctgattttttatatttttagtagagacggggtttcaccatgttagccaggatggtctcgatctcctgaccttgtgatccacccacagcctctcaaagtgctgggatgacaggccgggtgtggtggcagacctgataactttctaagaagggtacaataaggcatactctctaactgtgtgaccacaagacgcttatttttggaaaatatctctgggtcttgagttctgaggaatgcactcagtggaactctgtctcgaagcagaagtctggggaaggccgccctgttttagtgacggcaagcattctgtgtagacatcacagtgtttgccactgagaaaggtctttggcgattattagcctcccagtgaaggaacacattttgggatctcctgtgagcacaacactgcacaaaatatatgaaaaaaatgatgagcccaatcttattcccagggagtttataggcaaatttgaacttggttacaggcaacatgtcaacaagcacaaactaacatggtctcgtttagactgaagacccaggtgttggtgatatcacagtaggtgataataatgataatatctagaagcattttctgttctctcatcatctttgcatatgtcatgtcattgattttaacaagagctatgtgatttggtggggccagtgtttaccagcccattttacaggcagagatatgaaacaatggcttcaagtcatactgttactgaggcgccaagttgaggatgcaggtcttccttagaattcctgtagtttcctctaaaaatagtggaaatactttgaaaaggaggaaaatttgcagtgggatctcgaaagagctcacagagattgatccttaagagaatctggaggatgcagaggtgtgtgtgtgtgtgtgtgtgtgtgtgtgtgttcacacgtgtgaggttgattttggaaaagacacgggtagaaataagtcctatgtaagagaagcaaagccttttgacagaaatatcagtagttgctaatttaaaagcaaccaactaaccaataaagtaaccctttaacccctaacactattagagattattccaagttagaaatcttgaattcaactttatagtacctcctagtagcaattctgaatcagcttcctgttttggaactatgggaagccccactctaaaactatttgagaaaaaaaaagtgctatgcaatcctttggcattgaggttgatattagccagcaatgcttgagaagagcaggaatggtgttcccattaaaagacaaattagggtcaggcgcggtggctcatgcctgtaatcccaacactttgggaggccgaggcagaagaatcacttgaacccagaagtttgagaccaacctgggcaacatgcagaaaccccatctctacaaaaaaatagaagaattatccaggcatggtggtacatgtctgtagtcccagctactcgggagactgacttggaaggatcacctgagcccagggaggttgaggctgcagtgagctgtgattgtgccacggcactccagcctgggcaacagagtgagaccctgtctaaaataaaataaaataaaataagataaaataaaaagacaaattaagcagtgagtctctttctgcttctgtgttttccccaagagaactttcatggaaatacttttgttttgcttgaaaaaaatactttggcagctgtgaaaaagttactgcagttcaataggatgtaaataaaagaggccctgtcaattcaaggttgtaatttgacagtgcaccattatttagacggaatattgaaacgagagtaaaaatgacttcaggtcatggtactacttccaatttaaagaaaattaaaaactgctttgaaaaactgtgctgcatatttaaaactcctatctcctagttgctgggggttagatgttccacacggcacctggaaatctgtcaatattaataggtatgatgattcttactggcatatgcttatcatctacaattttgataacagcgttgagtgaatccattgctgttttctggcgtttgcagtgtacattgaggaattaataattagtgaaagtgtagccaacttctagaattagcagtccactcagagatgcccaggtgaacaacacgctgcttccctttgtcattcaggtcccagagagattcctcctgacaactctatctacagcggccgccatcctcagtcattccttagcttgttgcttcattttatttccttcttgtttatgtgttcttttacatccttactgtccatcccctccacagtgtcagacccttgagaggacaacctgtgcatctatacccagggtcagcaaaccatggcccatgggctgtatctgcaagctaagactgctcttcacatttttattttttatttattttatttttaaatttatttctgagacaagttcttgccctattgcccaggctggagtgcagtggtgtgatgacggcttactgcagtctcaacttcccaggctgaagcaatgctcctgcctcagccttcgaagtagctgggacaacaggcatgcaccatcatgcttggctaatttttctttttttttttgtagaagtggggtcttgttatgttgcccaggctggtctcaaatttctggcctcaagcaatccttctgccttgacttcccaaagtgctgggataataagggtgagccactgcacccagtctacatttttaaatggttgaaaacaagcaatatttcatgacacatgaaaattacaaaattcaattttcagtgctcataggcaaactttattggaacaccaccagagttatgtggttatgcattgtctatggctgtttttgcacaacatacatagatagttgagtagtttcccaacatgatatggtcccaaaaagctaaaatatttagtactgtgccccttacagaaagtgttcactgaccccaccctgtgtccggcacaatgcctggtaattcataggggcccattaaatgctatggatgaactaatgaggagcagagcttggcaagagctatttccaagtgtcccttccctgctgccaataaacaagaaggaggaacagatgaacccaaattaaatactaactccaggttctcagacaatcaccaaatctaagagggcaggtggagtctgctcggaaaatttgcttaacatttctttaaaagagatgacaaggtacggtctcaggaattcatggtatctcaggttccaatttctaaaaactgagtacgttcaattttcctttggtctaatatgttttctctaccccagctcttccccacctgcttttgatgtgtaatctgactgaagactgaactctgatttttaccaccctaaactcagctgacctcccttccaaaaaatgtcagcctcttaatcctcttaataaaaaggcccatgtaactgggagaatacatttgaaatagtccacagtacaaaaagacggtctgaaaataacaaggggaaaaaaatgtactaaacgcatctgcacacacacaaagttgccagggaaacatggcaatcccttgcaaactgccagcaccgtcacatttataaagaaatgacaacaactgacctttgtctcctcttttcctgcctgccttttaccaggaacagaagagccttgtggcttgaatgatgcttttgataggcagattttcagattctgtgctgtctgcctggatgaggggtcccggtttacagctctgctgagagctagaaaatcttttatgactgtcacctccattatgacctagtctgtgcaattgaaaggtgcattttcacattggaatttggcttctatagtcctgaggagaaaaatgacatattttgttgcattatttaaatattcctgctgaacaacaaattaaaaatatccattaaaggtttatttgatatcttcctaattattgcccattgcgcatttgacaaattatttacacattttaataattgcgactttctttggaagtgacacaaaaacaattactttttcgaaattccactgtgtatatgcttttgaaactacatagccattaaaaacagtctgtcgaattaaaggttgggcaattaattaagtgcaaattctgtaaaactggaccaaggagaaaattcatcaaacctatgaaatatgacctatcttgtccaaaagacaaatatgtttaaacaaaagatgaaaattgatgacaaaattatgggtagcaaaatgcacacagagcaaatataagacagctgtacttggtttcagagtgttgggtttacccttacagaattcatgattcattaccttcaccgtcttgtaaaacttttcctagttaatctccaaagtactgtatctgggataataaaagttctcaataagagcttggaaggccattacattaatgatttgctggcctttgcgggatcccaattaaatgcaacccaagttgaggctggtagcctaagggtacgtctccctaggacagttgaaagccactttgcccatgtggctattttcttttgtttctctctttgtgccttccttacaccaattttcagtgtcgaaagtttctatttccctttatctagaaagtactctgccattattaagactttggctcttaccatgagcgacaagccctgcgtgggtttcgagtatatagcaggggacaccaaaagccagaacagcggttcacatgtgtgtatccataatgggccctagacatgtgtattacaagttctggatgttacccttaggtgctcaggttcacaaatcaacatcagccctggtgcaaagtgggcggaagagggaggtgggttcgcggactgtggggattgttaaggatacacggctgttatttccatattaaaatgtaatgatctcattaaagttaaaaccactgttaaacttgattgagtaaattacttaattaaccatagcatccagtgcattcctccagggtatacctctattcctcaagatgcagaacaaatgcaggctcagcttatagaatgttatccagggtggtatgataacactcatcttagactgacttatttcagaatctgttaaaaaattcagaatctgttaaaaaaacaatgaaaagcgagaaagtgagggtgttactcggtgttaaaggaagatgggaatagcctaccaatgaaagcagatatattttattgttaggctgacatctccgaagattttcttgattaaaaagaaaaccacctgataagcagtttgtggagcgactgctttagctggttcgacaaagcatttcctttttctcgcatattctacctttctctccttttctttgcttgaatatccaaagatatctccatggggttggcagaagctcttcgaaagctttgtttggggttgtgtttggttaagtgactctgaattggggttgcagtgagtttttgtgggtgagtgggtggatgggggaatatttaggaaacatctccaatttgcctgcccaaagcctgctttttgaaatataagggttttttgtttgtttgttttgaatgactacctgtgacacaagtggccaaccaaactgtacttgaaagaagtaagttgtcccaatttctggtgtttcttggtttttgcaaatatagcataaggataataataactgactacttcctgaggttgtcgtaatggttacgtacgtgaatatacgtaaagtgcttagaatagtgatctgttcccaggaggtattgactattattattattcctaagcataggaaagggagggggcagggatggagaatggtccagaaacaatgcagtcggaactcttggtcagcagatcacctcccagacaagctttttcttggctgctgagtccagttaaagaggccagggatccccagacacttagtagccagaaaacctgggttttgtttgatttttttttttttttaaatatgttttcctctaacccagtgtgttgcttatatcagagcctggagtggagaactgtgctggggtagggtcttgctgttgcttgcataacgtttgccatttagaaagataagtcttgcaaatcccatctgcagagggattagaactaaacttaataaagcagaagctgaacacaactggagtaaccttcttatgcctagtttaatatggtgcctttgtagatagacatcttttaaatatatttttatattttagatttttttggattaatcccaaaagaagaacttgagggatttcaaagaaaactatttatttgggaggttagggcaggaaacatagcgaaagattgagaaagtggcatagagaagggaagaaatccagtatataattttaaaactatataaacatataaaatggtttccaaaaaggaaaccaggtcaggataattattttctaaaactagtggtttagaataaaaaccagatatcaagatatctcctgaattgatactcatcacaactctaaacaaaaatgaacagtacttactgggcatttacactgtggcatagaaaagccaattctaagccactacataaactcattttaataactgtgagatggatgtagatgcttctattatatccgttgtatagatgatgaaacagacacagagaggttaataaaattgcccaagcttaccaagctaataaggggtagtgtttgaatttgaaagagtttgacttaaaagcccatattcttaccattccactagtttcaatttcactctctaaaaggggaaaaatcctcttacattaatatgccttgcttaaagatgtgactcaggagaaggcataagagacaaagaaagatagccaaatagaagcttccggcaatcatctgcccaaaggaacaccaaattaaacaactatccacacaccttcataagaaccaaacattaggtgagcaatcacagtacctggttttaacaccatgttaaggaaagaggcaccaaaaagggtgggaaagacagtcttgaatcacctacaccactcctcctacatcccgcggcagctgccctggggtgtggagagagcatctgtgcacttgggggaagaagagtgtggtgactgtgggactttgcattggaactcagtgctgccttgtcacagtggaaagcaatatggggcagaactcggccagtgtccactgaaggagcatttagaccagccctagtcacagagaaattgcccatcctagtgattagaccaaagttcaggcaatctccatgaccacagcaaaatcctccagcatactaaatgaacttgaaaggcattctaggccacaaggactgaaattcctgggcaggtcctggtgttgtgcttgtcctggagccagtgtacttgaggtgcatgtggcctactgagacaccagtgggggtggccaacagagtgcttaatcacccttcacccaaccccaggcagcacagctcatggctccaggagactccttccctctgatttaggagaggagaggggaaagtaaagaggactatgtcttggcaacttgtataccagctcagtcacagtagagtaggacactaatcagagtcctgagacccctatttcaggcatcacgaccatctaggaaaacatgaccttaccaaaggagctaaataaggtaccagtgaccaatctggggagcagaatatgtgaccttttcagacaattcaaaatagctgttttaaaaaagctcaatgaaacccaagataacacagtgaatgaattcagaatcctatcatataaatttaacaaagaaattgaaataactaagaagaatcaagcagaaattctggagcggggaaatgcaactgacatactgaagaatgcatcgaaatttccagcagcagaactgatcaaacaaaagaaagaattagtgagcttgaagacaagctatttgcaaatacatagaggagacaaaagaaaaagaatagaaaagaataaagcatgcccataagatctagaaaatagcctcaaaagggcaaatataagagttattgacattaaagaggagataaagaaagagatcagagtagaaaatttattcatgggataataacagagaacttctccagtctagagaaagatatcaatattcaagtacaagaaagttatgaaataccaagcaggtttaacccaaagaagactacctcaagacatttaataatcaaactcccaaagggcaaggataaagaaaggatcctaaaagcagcaagggaaaagaaacaaattacatatgaaggagctccaatggttctggcaacagaattttcagcggaaacctatgggctaagagacagtggcatgacatatttaaaatgctgaaggaaaaaaaaaactttagaatagtatatctggtgaaaatatccttcaaacatgaagaagaaataaagactttcccagacaaacaaaaactgagggatttcatgaacaccagacctgtcctacaagaaatgccgaagggagtttttcagccagaaagaaaatgacattcatgatcaataagaaattatctggaggcacaaaactcgttggtaatagtaaatacacagaacaacaacgaatattagaacactgtaattgtggtgtgtaaactactcatattttgagtagaaagactaaaagatgaaactatcacaaataataactacaacaacctttcaagacataggcagtttaataagatgtaaatagaaaccacaaaaagttaaaaagcaggagttgaaattaaagtgtagagtttttattagttttctttttgtttgtttgttttgcagtcagtattaagttgtcatgagttaaaagtaatgggttataagatatttacaagcctcatggtaacctcaaatcaaagaatatacaacagatacacaaaaataaaaagcaataaattaaagcatgtcaccggagaaaattaccttcactaaaatgaagacagaaaagaagaaaagatggaagagaagaccacaaaacatccagaaagcaaataagaaaatggcagagtaagttcttacctataagtaataacattgaatgtaactagactaaattcttcaatcaaaagacatagaatggctgaatggatgaaaaaaattagacccagtgatctgttgcctacaagaaacacagttcacctataaagacacacatagactgaaaataaagggatggaaaaaagttatcccatgcaaatgaaaactagaaaagaggaggagtagctatacttatattggacaagatagagttcaagagaaaaacctataaaaagagacaaaaaaggtcattacataaaagagtaaattcagcaggaggatacaacaattataaatatatatgcacccaacagtaaagctcccagatatacatgaagcaaatattatattattattagagctaaagcgagagctagactccaacacaataatatctagagacttacaccccactttcagcattgaacagatcatccagacagaaaatcaacaaagaaacattggacttaatctgcactagagaccaaatggacttaatagatattcacagtacatttcccttaacacctgcagaacacaattcttctcctcagcacatggatcattctcaaggatcgactatacattaagccccaaaacaagtcttaaaacattcaaaaattgaaatcctatcaagtgtcttgtttgaccacaatggaataaaactagaaatcaacaacaagaggaactttggaaactatacaaaaacatggaaattaaataatatgctcccgaatgaccagtgggacaatgaaaaaattaagaaggaaatttaaaaatttcttgaaataaatgaaaatagaaacacaacacatcaaaatttataggatacagcaaaagcagcactaaggggaaagtttataacaataagtgcctacatctaaaaagcaggaaaacttcaaataaacaacttaatgatacatctcaaagaaatacagaagctagagctaaccaaacttaaaattaatagaagaaaataaataataaacattggagcagaaattaaagaaaccaaaaaatacaaaagatcagtgaaagcagtggttgattttttttgaaaagataaacaaaattgacacactgtttgcctaagaaaaaagagaggagactgaaataaataaaatcagaggtgaaaaaggagaaattacaactgataacacagaaattcgaagtattattagaggctcctatgagcaactatatgccaataaattggaaaacctagaagaaatggatagattcttagacacatacaacctatgaagattaaaacgtaaagaaattcaaaatctgaacagagcaataacaagtaatgagatcgaaggcatgataagaagtctcttagcaaagataagcccaggacctgatggcttcactgttgaattttactaaacttttaaagaactaataccaattctactcaaagatttcaaaaaatagaggaggagagaatacttccaaactcattctacaaggccagtattatcttcctgccaaaaacaaaagacatcagaaaaagaaaactacagtccagtatccctgatgaggattgatgcaaaaacccacaataaaatactagcaaacagaattcaacaccacatcaaaaaaaaaaaaatcatttgttatgaccaagtgggattaatccagggatgcaaggatggctcaatatatacaattcaattaatttgattcactctatcaacaggatgaagggcaaacaccacatgatcatttcaatcgatgctaaaaaagcatttgataaaatccaacatctctttatgataaaaaccctcaaaaaactgggtatacgaggaacgtacctcaacataataatatcatactgaatggggaaaaactgaaagcttttcatctaagatctggaacacaacaaggatgcccaattttattataattattcagcaaagtactggaagtcctagctagggcaatcagataagagaaagaaataaaaggcatcaaatttgaaaataagaagttaaataatccttgcttgcagatgatataatcttatatttggaaaaacctaaagacgccaccaaaaaactattagagtggataaacaaatcagtaaagttgcaggatacaaaatcaacatacaaaatcagtagtatttctatatgccaacagcaagcaatgtgaaaaagaaattgagaaagcaatctcatttacaatagccacaaataaaataaaatacataggaagaaaacaaaaaaagtgaaagatctcaataataaaaagtataaaacattgatgaaagaaagaggataacaaaaaaatggaaatatacttcatgttttcatagattggcagaatcaatattgttaaaatgtccacactacccaaagcaatctacagattaaatgcaatctctatcaaaataccaatgactttcttcacagaaatagaaaaaaaaatcctaaaatttattgagaactacaaaagacccataatagtcaaatatatcctgagaaaaaaagaacaaaactgaagtaatcacattacctgacttccagttatcctatggagctatagtaacaaaagcagcatggtactgacataaagacacatagaccaatagaacagaatagaaaacccagaaataaatccatgcgtcttcagtgaactcatttttgacagaggtgccaagaatatacactggggtgaggacagtctcttcaataagtggtgctgtgaaaactggatatccatatgcagcagaatgaaactatacccctatctcttgccatatacaaaaaccaaataaaatgaattaaagacttaaatctaaaacctcaaactatgaaactacttaaagaaaacattgaggaaactctccaggatgttggactgggcaaagatttcttgagtaataccccacaagcacagacaaccaaagcaaaaatagacaaatgggataacatcaagttaaaaagcttctgcacagcaaaggaaatcatcaacaaagtgaaaaggcaacccacagaatggaagaaaatatttgcaaactacccatctgacgagggattaataaccagaatacataaatagctcaaacaactctgttggaaaaaatccaacgacctgatttaaaaatgagtaaaaggtctgaatagagatttctcaaaagaagtcatacaaaggataaacaggtatatgaaaaggtgctcaatatccttgatcatcagagaaatgaaaattaaaaccacaatgagatatcatctcaccccagtaaaaatggcttttatccaaaagacaggcaataacaaacgctggcaaggatgcagaggagagggaaccctcacacacagttggtgggaatgtaaattagtacaaccactatggagaacagtatggaggttcctcaaaaaactaaaaatagaactaccacatgattctgcaattccactgctgggtttatacccaaaagaaaagaaatcagtatattgaagagatacatatctgcactctcatgtttattgcaacactattcacaatagctaagctttggaagcaacccaagtgtccatcagcagatgaatggataaagaaaattgtggtacacaatggaatactattcatccataaaaaaatgaaatcctgtcaattgcaacaacatagatggaactagatgtcattatgttaagtgaaataagccaggtatagaaagacagacttagcatgttttcacttatttgtgggagataaaaaagttcaaggaattgaactaatgagatagggaatagaaatggttaccacagactgggaagggtgggaggtagttaatgagtcaaaaaatatagttagaatgagtaaaatctagtatttgatagcacagcagggggactacagttaataataatttattgtacactttaaaagagtgtagtgggattatttgtaacatacagaaacaataaatgcttgaggttatgaataccccatttaccctgatgtgattgtcatgcattctatgcctgtatcaaaatatctcatgcactccataagtatatacacctactatgtacccacaaaagttaaaaattaaaaaaaaaaagagaatgcaactcaggagtcaagtgacctgtgttttagttctagctctttaattattacatgtgtgatcactgaaaacattatttactctctctgagctttcatgttcttatccataaaatgggaacaataggagctgctgtctgcaggcaggtagtcgccttgcccgtatctccgtggctcaccttggaagtgccctgctgatcagaggacattccctatacctgctaatagcttcttacttcaagcaccaatgtctccctccttgaaggctttctctgactgtaagaggcagctcaacctgcacgtgggcaagttggcagtgctgggggtgatacccccaggagtgatctgcaaatgataagaggagctggtagataaacgtcccagcctcctcaccacccccacacccccagggaatgattctatgttccactcagtctcccagaaggtcttccgttggagtgagttccagacatccccaggggtaactagcttgttacacaccctctattggctttcctcccatcctgagtcaatttcccaatccttcactatgttcctgccctacattcccaaataaagagcttcttttcaaatccttcaagtttctcctttggggagaacccaaacaaagatgctctcaggattgtggtgagaattcaatgaaacgatgcatgtaaatagttggtgccatatctggtgtgtagcagataccgtaataaccataagttttattacctacgatgattattatgtcaatatatgaattttgactgtaatggggaagctgtaataaagagtctgactctagaagtgagacagggacacatgggtgaggaagatcaggtccagataaaatggaaagattctgtaggaaagcatatgagggtccccaaaaatcctaaggatactgctcaagacatgcctccacttcctggaatcaacaacacaaatgcccatcaatcaacgagtggataaagaaactgtgattacatatatatatatgatgcaatgctactgagccataaaaaggaatgaatgaatagcattcacagcaacctggatagaattggagactattattctaagtgaagtaactcaggaatgggaaaccagacatcttatcttctcactcataagtgggagctaagctatgatgatgcaaagacataagaatgacacagtggactttggggactcaggtggaaagggtgggaagggggtgagggataaaagaatacaaattgagttcagtgtatactgttcaggagatgggtgcaccaaaatctcacaaatcaccactcaagaacttactcatttaaccaaatatcacctgttcccccaaaacctaaggaaataaaacatttaaaaacaaagataaaagagacatttctccatttccagaatattccttgcacatgactttgttgaggggacagcagtctggtgaagttgccaggcctattgattccaaatccatgaaactggtgattatttagtgaacagcctttggccaagaggaaggagacatgtgactggcatccaaatcacagcacttatttcgtgctcctggggatgtcgttttttcttggtttctacagagatgagcattaggattttaaggatgagtaaaggggtctaaagaagtgtcatggaaaagggaaaccaaggaaaggagaagggaagaaaaacagcaaaaaagatctgaatagagatttctcaaaagaactcctacaagtgacaaggtaagtagttgctgccttgcccatatctccatggctcaccttggaagtgccctgctgttcagaggaccttccctatgcctgctaatactttaggctcattaagggagaaaatgttggctgaaggagtggctcatgcctggaatcccagcactttgggaggccaaggtggaaggattgcttgagcccagtagttccagactagtcagggcaacatggcaagacctgtttccatgaaaattaaaaatagttggcatggtggtatgcacctgtagtccaagctacttgggaggctgaggtaggaggatcacttgagcccaggaagttgaggctgcagtaagccatgatggagccactgcagtccagcctgggtgatagagcaagactctgtctgtaaataaataaataaatgaacacaaagaaaaaaaatgcattcctcagtgactgagagaagaaagagtatttattgcctttccacatattggaggaatgtgatcttcctaactgaaggttatttgaaggaacaaaatcatctccattttgaagcctgatctagttaaattgtgactggattcttgaatatattttaattctgcacaattattttggccttggttttgaaggccaaatctgaagttaacctaattatctaataaaatgcatacattaaaaaagagtcagactccgttgtttgatgtttatggacaggttttaggcctcattcatccttcctccctgtctgttccacatctggggaaactgttaagaaatcccggacaatccttcctttggtgccggtgggaagtttaaaccaggcatcacgggaaccctaatgtgggcccaccccttaaccaccatcaaagccccaagtcagtgtcctttccctgctctgtcaagaaattttggatgtgcttgaaagtctgctctgctctctccagaaagccttattatgtgagtcacaaagcttgtacgcaccctctttgtctctgtgtggtgtcatgagtcttgacatctgaaccacattttgggtcaagtctatcctgtttctgtagagtcgtcacaatagaggcaattctacgctttaccacgaaaagcaccataagattccttacagtaacaaaagcttctgggattttaaaaaaatgggtattatttatttaaggaggggtccatatggcggcggtgagagttcagggcaggggtctgaagctcaagggcagagaatgaaggaatgagtcacagagggctgccgaaggtcggggcatagatcagagacagtgagctcaccattcccttcccagcagccgaataaagagatctgggatttacgcatagcctttgcttaaaggaaagtgtacctttttgaaccttgcgacacattggaccctcatcaactcggattttaatgagaggaattagtattccaatgaacaatctacataatatcttgtaggcaaaatatttatttggggcttgggacaatgaacaggctagaaatactcatgggcaaaaatgtaacatagtcataaatgtctacattcattttccattggttgtagaaaaagaatctccgttttggtttttacaatttcagaataggctgcccaaatccagggcattgaatcagagttatataacttctctgctagcttctctatttataacagtgaagtgttggcatgtatgtgaaaatttaaagtaaagcctgcttcctcatgatcttgtgatctttaatttttacctttagtttaacaaatatttcatcatgataactttttagtggataaggagggagcattcttttcaagactgcaaaattttaatttgctttaataaaaaattctggttagtataaacatttaact

SEQ ID NO: 1384 - DNA, 43999 bp, Homo sapiens
tgaatgatgcccatacatggcaatcaatttaataaaaatagtgagtaactaacgaacagagagcaagtggccatgggaaaatgtgaaaatgttttacaaatgagtgtctgggaactctgacctaggtcatctgaaagaagcatggtaggtccatgttgtctcaagttttcacagaaaaataccttcactgctgcactattttaagttatgccttttccttctggacagggtcactgaaaggactgtccagttttatagtgtgtctgtgattttgtggcgaagatgttgttcactctgttcctcagcctttaaacaaatccccagaggacaaatccagcttgaatttagttctagggggataaaaagtattgtctctgcacaaaggtgtatacttcttcctgtcagaaaaagacaagtagacctgtcatgatgcttgccttaccttccagaatccttaggggtgaatttactgcttttatcttcccatctattccaatctggcacctgaaagcacattgtcttcctggttccttcagagtactctgttatttaaaaagctctttaaaaatgtcagatatccctgggtccttcagctttcctacaatatccacagagactagctgaatctatctgtatcagctgagataagctagcttgtgctgtggtaccaaatgaccgccatgttgtcctgacttataaacagcaaaggttgatttcttgctcatgctctatgtctatttcaagttagctggtgggctctttaaatatcctcattgaggaaagctggtgaacagagtctttattccctggatggtggtttgttgctatggcaaggcaacaaaagaacatggcagtttattcattttcctctatagttttcaccatggaagtaacatgtcttacttttgctcacattacattggctgaagcacatcttctgaccatgctgaacttggaggaggtgggaatgcacgatttcaccattttcctgaaaggaggggaactgtaacattggtgtatagccccaaatgtcaccatattgccacacctcatattgtgggaggtcaacgaagatctccttggtatctctgaggctttctgaatcagcctttgctacagtttgcttgtctgagatcatctgttttgagccattactcttccttcctgtgaccgtcatccaatgttgctggtcttgttttaactcatattagacaacatctattgtcctttatttcccaaatgaactattaaaataatgctgctgtttgtagtagaagtttgttgcctgtttgggatggagtgaagagcaatgatagcagtgataactcagggcagaaaataaccttacattgttgagagtatccttggggtaatttgatgttttattaactggctattctgtccttggtgcctagaatagaacatgacacatagtaggagctcaattaatacttagtgaatgaaagcacttcaatatatcatcactgatcctacacattttttttagaatttcggttttcattttagattcagagggtacatgtacaggtttgttacatggctacattacatgatggtgaggtttggagtaccattgattccattacccagttagtgagcatagtttttcaacagttagtttttcaacccattatccctctgccctctagtaattcccagtgtctattgttaccatctttatatccatgagtaccctagtttagctcccacttataggtgagaacatgtggtgtttagttttctattcccaagttaatttgcttaataatgacctccagctgcatccatgttgctgcaaaggacatgatttgtttctttttaatggctgcatagtattccatggtgtatatgtaccacatttgctttagccagtctactattgatgagtatttaggttgagttcatgtctttgctattgttaatagtgctgcaatgaacatacaaatgcatgtgtctttatggtggaacaatttatagtcctttgggactatacaaacccagtaatgggttgaatggcagtactgttttcagttctttcaaaaatctccaaagtactttccacagtggctgaactaatttacattcccatcagcagtgtacaagcatttccttttctgtgcagcctcaccagcatctgttgtttgtggactttttaacgatagccatttagactggactgagatggtatctcattgtggctttaatttgcatttctcagatgagtagtgatgttgagaattttttcgtatgtttgctggttattgtgtgttttctaaaaatcctttcctaccacgtagaagttcctactgtctgtactgtctctgaactcctactctgtaaattcctagtatgttcctgtgcttccttttccatttcccttccctttaaatcatattgtttcttttcttcttcagactcttcatctcatagcctctagagttgccatcaaagagtcatcaaattcctcttttccctttatgtaaaagtatttagcccttccggtgttttactcttgacttccctactgtgacctaaagacctcagttttcacattcaaagaactctatcaggtggtttccaaggttaaaaaaagaggacttgaacatttcttaggatgaattgtgttacagctcttgaaagcaaaagtggctgcagtaagtgcttattttcaataatatttcttatctttctgtcaacatttattttaatttgaattctctgagccaaggtattttttccaaaaaaggtgcataaatcaatgaatagttcattgctttttattactgagtgatattacatttgatagagactaccatcttttttaaatctattcaccagttgatgtgtatttgagtgttttaattttttggctgtaataaataatatagccatatattttcatttccccttagaatggaattacttgattataagtgtatatatttttaactttttaagaaactgccaatatgtttcccaaagtgactgtattattttaaatttatgctagctgtgtatgaggtctccaggtgctctccgtcctcaccaacacttgctatttttggctattttaaaattttacctatttgctggcttcataggagtatctcttgtttttttaatttgcatttcgcttatctccaattatattaaaattgttaatgtgtttgttggccatttgtacacaggcatactttggagatattgttagtttagttccagtccacttcaataaagtggatattgcaataaagcaagtcacacaaattttttggtttcttagtgcatataaaggttatgtttacaccatactatagtcaagtaagtgtgcaatagcattatgtctaaaaaaggaatgtacacaacttaattaaaatactttattgctaaaaatgctagtgatcatatgagccttcagtgagtagtaacctttttgccaatgaagagtcttgccttgatgttgatgactattgactaattggacaacagtgaattttgctgcatcaattgactcttcctttcatgacaggattctctgtagcatgcaatgctgtttgatagcattttatagcattttatccacagtagaacttctttcaaaattggacttgatcctctcaggctatgctgctgctttataaactaagtttatgtaaaattctaaattctttttttgccatttcaacaattcacagcattttcaccaggagcagattccatttcaagaaaccactttttttgttcatccataaggagcaactcttcatccattcaagtttgaccatgggattgcagcaattcagtcccatcttcaggctccagttctaatctaattctcttgctcttgttaccacatctgcaattatttctcccactgaggtcttgaacccctaaaagtcatccatgaaggttgaaataaacttttctaattttcagctattcaatttactttgtccaggttcttcagagaaatcactatagcaaccatagccttccaaaatatatttcttaaataataagacttgaaagtcaaaattaatccatgagctacagaatggatgttgtgttagcagccatgaaaacaacattactttccttgtacatcttcattagggctcttgggtgatcagatacattgtcaatgagcagtaatattttgaaaagaatatttttttccttggcagtaggtctcaatagtgggcttaaaatattcagtaaaccatgttgtaagcagatgggcttgccattcaggctttgtccacttatagatcatagacagagtagatttagcataattcttaaggactccatgattttcacaatggtaaatgagcattggctttaacttcaagtcaccagctggattactgctaacaaaagagccagcctgtgcttttgaagctttgaagtcaggcattgagttctcctctctagctatgagagtcctctatggcatcttctttcactttgaggctgttttgttctcatcgaaaatctgttgttttatatataagtaccttcatcaattaacttagcaatattttctggataaccagttgcagtttctacatcagcatttgctgcttcatcttgcacttgtatgttatagagacaatttctttctttaaacctcatcaaccagcctttactggcttccaacttttcttctgcagcttcacctctctaggccttcctagacttgaagagagttaaagggtcttgatttggattaggctgcagcttaaaggaacgtggtggctaatctgatcttctgttcaaagaactaaaactttcttcatatcatcaataaggctgtgctgcttttttattatttgtggactcattggagtagcacttttaatttccttcaagaacttttcctttgtattcacagtttggctgttttgcacaagaggtctagctttcagcctatcttggctttcgacttgccttcctcactaagcatcatcatttctagcttttgatttaaagtgagagacatgtaactcttactttcacttgaacacttagagaccattgtgggtgattaattggcttaatgtcatgttgtgtctcaagaagtagggaggcccgaagagagggagaaagatgggggaatggcctgttggtgagctagttagaacacacaacatttatttattaagtttgcatccttatatggacatggtttgtggaaacccaaaacaattacaatagtaacatcaagatcactgattgcagatcatcttaatagaaataataatgataaaaagtttgaaatattgcaagcattaccaaaatgtgacacagagacacaaagtgagcacatactgttggaaaaatggtgctaacagatttgctccaaggatgcagggttgccacaaaccttcaatttgtaaaattgcagtatctgcaaagtacaataaaataaagcatgataaaacaaggtatgcatatgtatacatatatattcacttttgcaaagggtctcttaaaatgtttcacctatttttttgttggtttgtttgccttattgtcaaagcattgtttatatattctggatagaagtcctttgtaagctgtataattttcaagtagttttctttcatactttgttatttactttcttagggtttgatttctttcttcttgttctcacttcttatgatgaaattttagataattgatcttagacctttcttctttttgaaggtaagcatgatggctgtaaattcccctctaagttccgttttagcagaatctcacaaattttgacatgttgtactgttactattaatttgtaatttaactctactgtgatcagaggacatactttgcatgatttcagttcttttaaatttattgagactttaacaaaatagactctatcttttttagaatggttttagatttatagaattgagatgataatacagagttctcatataccctgtagctagtttcctctctttattaacattgtacattagtatgatataattgttaccattaataaatgaatattgatatattattattaactaaagtctgcagtttattaagaacattagtttttacctaatgccctttttttctgttccaatattctgtccaggatggtatattacatcatgtgctagcctaggagtcactaggtccaccagactcctcttggctgcaccagtttctcagactttcctattttgatgacctgaaagttttgtgtttttatttatttatttattagacagagtctcattctgttgtccaggctagagtgcactgatgtgttctcagatcactgcaacctccgcctcctaggttcaagtgattctcgtgcctcagcctcctgagtagctgggattataggcacctgccaccatgcccaggtaatttttgtatttttagtagatacagggtttcaccatgttggccaggctggtctagcactcctggcctcaaatgattcacctgccttggcctcccaaagtgctgggattacaggcgtgagccaccatgcctggcctgatgacctaaaagttttgaggagtactggtcaggtattttgtaggatgcccctatattaggagttgtctgatgtttttctcataagactggggttatggttactgggaagaagatgacagtgataaagtattcttttcacattatgtcaaaggtatatgatatcaacataatttatgacttaaatcatgatttatccacatgatgttgaccctgctcacctagctgaggtagtgtttgtcaggtttttccactgtaaatgtcttcttttgtccctgtatcatactctttggaaataagtcactatgcagagcctacatctaaggagtggggagctagtttttctggtataaaattcttggttaacagattcccccccgccaatcccctcaacccttcagtactttcaacatgtcattacaatgtcttctgacctccattgtttctgatgggaaattagtagttgacctcatctttgttcctctatgtaacgtgtttttctcttgctattttcaaaaaaatttattttgtaggttttggagaacttttttaagtacagaaagtgttttcttgcttcaggaagtggatgttcctgtcccactggtggtaaagagtaatgataataacaatcaacatgatgtaatccctcagtcacatttagaagtatcagccagacaagtgttaagtactaacagttgctaagtgatgctgtggttttaattggatcactcaataatttggttgagttctttagaacagaataatagaaaaaaattctattaaagaaaagtaggagaaaggtagaagaatggcagttctgagttctcacacctccaggatccatcccttctcccttcacttcctgagtaattctgttagctttttgtagaagtttgcttgatctttcacttcagtgtctggtttctggtctcttataagctgttgtaaccttgacactacagaaggcttcaccattgtgtagaaagtgtcctatgaagaaagaaaattctgtaattttgagaataattttgttgccaattcaaacccattgttgtgattttcttgttgtataaaatgtctgtatctgtgtcagatcccctaatccctagagacatcaggggcagcatcttgggaacattttggtgggaatgcagttggatagcaagagaattctattagtattcaagctctgatgggaggtaaagaataaaaaaaaactaatactgattgagaacctaccatatgtcaggtggcatactttgctttttgtgtaatccttacaacaattcttcaaggtaggtattaatacacccaacttacccttgatattattctcggagaagtttaaacttcttttctctttttttattcaactgattttggcttcttagctaggttgcgattggcaatgtagaagattatctcatggtttgaaccctaggtgtctattattcctctgaccacagttttgttcagtaatgacccaggacatttgtcccaatttttgaaagaagagttgaaagaagtttattttcctgctgcatttgaacctgtgaggatattaccatgtggctgctgatagttatcttaccgttacatgaaatttgaggaagaaatcatggctgagagcacagagaaagaaagagttaggtctgggtgaaatagtttaactcctgaattaacggatccctgaagcaagattcatctgtactttttagttacatgagtcactaaattctcctttgcttaagtcagtatgagtagggttttctgccttttataactgaaatggtcctgactgatatgaccttttttgttcctccattgagcacatctcagcaaagccttctttggaaagggaattatactaaattaatgtaatattctttgattctttgatcctacagcttgaggactaagtgtccttgggtcagtcctgatctctttctgaggtttggttttcctttttgaggaatgtattcatttccatgtaagtggattgtattatatctctaattacgcttcttagtgtaaaattatctggttttaggaaatccttatttcagactaaaatgtgaatgactctaagatttaatagaatctacgagcttgagttttgaagttacagacacatacatttgaaagctgactctgccacttaccagttatataaccaaaagtaaatttctttatctgtttacatttcaatattcctaattataaaggggacataattcatagggtggttgcaaggattaaatgacatcaggtatatggaatcatatgtggtaagcactcaatacctgatagctatcatcatttattactccttcctagtgacatccttatacgaaaataggatttccaaaggtgtgtttggtggaaaacagtcctgcaaaatgccctcacaaaaggatttcggagtcaaatacatttaggaaatgcttatgtttaatcttcccgtattttcaagatatattaacatattaaaggcgctaaaaattcttcagtaaataaatatgcttaaagttgttgatccagcatccaaaatatatttgactacacaatgcttttttccttcatagatgtatacctattaacatatattgacaaaaatagttaaaacccttaaggggtgattttaggcatccatcagttgggttgaagcagtggaagggagaatttctggggggagttcaagtctcagatatgagctcctgtaagctcctactagaaaattgggctttatccaaaatttagcctagatcagccattggcaaactctggcttgtgggctagccacttgtttttgtaaataaagcttcattaaaacacttatgtgcattcatttatgcattgtctggcttatgggctagccacttgtttttgtaaataaagctttattagaacagttatgtgcattcatttatgcatcgtctatagttgctttaatgctgcaagagcagagttgagtggtagtggcagagactacagcctgcagagcctaaaatatttactatctggcccttttcagacaacgtttgttggcccgtggcctaatgacaaggttgcatctgtaagaactgcatgaactcaaagtagatttcttttttggtccgtcttagtaagttcttgttattccagctcataaagtgagatgctatctccttatattagtaatcctgacttcagaaaaatatcaaaagaacccgataactattttactcaaagggagtagaagaagagagaaactccctgaaaagataggaatttatagctcatggaactgaattgctcttcagtgactttgcccttaaatctgaacacatagcagttgctcacttccttaggaagctttcccacatcgacaccatatagtactgagttgtcctgtggaataaatgacattattataagctactactatatctttcacgatgtctcctaagtttcacggtaattcctgttgagttacttttcgggtagcagtgccactgagggcgacaataaacaaaatttcttcactgaagtgattaaaaacagcctcctttaggctccatgggtttggatccatggctgttatcacatcagtggctctcaggaaaatgaataagacttctgaaaagagacaccaagttttttatttgtatcacatcataaagtggaccatgttaactccctggctaaaatttctctctttcaatttttggaagacaggaataagctgtgccttatcatacaaactaggagtctttggtctcacagcagatttacttgtggtggcagaagttcattttgagctctgagttttaagtctccattcactcattcgttcaacaatgtactgagaacctattcatactttatgccacacactaactgtgcagcagagtaagcaaattagataagatccttgccttcatggagatggaaagtctaattggagagatacatgatcaaaaagtactcagatagctagacaaccataacctgtgatacatgctctgcaagaatgaaaagatgcaggcgtgacaggagacatcatttagatagagaggaggacttgtggtgttgtgtgtaagggtatcacctgaatcctaaaaagtgtgatggagccaggtctacctggaagaagaggaaactttccaggtagagggagcagcatgacaggaaggcttttaatctggtggctacatttggaaaaagacctcagtccctggattcagaccttgatacattcttaaattagtttaatttcaagtaacttcaccattcttggtcctaaactttccatctcttaaatggcaagaacaacttctacatgagtggtttataaaaaaccatggagaatcttgctaatattttgattagaattgatgggagaaaatagctttcatgttaacatcagctcatttgttaaaatcttggttatagatgccagatgaaatcttagcggtcactcaagcatttcgtaaagaagtatttgtaaaggggtaggatgaagcagagtctgaatagaattagaatttgaattccatttcacatttttgtaatgtcagtcaaatatgacaaatctgaaataatatcactttcttctaacctgccaactggaagaaaaattcccagtgatatttatgtgatttattgtgagttaaaaataaaaacagataaaatgaaatgaaattcttttattaagcaatttgccccaaacccaactgtactaattaagtctccatggataaatatattcataaatagtcatgttttatcaaagtcaaatacagggcaaacgcttacgttcatgcactactaagcctgagttattaaataaaatctgtgccatactctttaaattaagattctatccattaataaatgtttaataaaaatgtaaagatggaatattgtttgaagaagaaaaacatccccagtacttccagttgaatccagcttagtgaaatgcaaattttataaattccaatctatcaaatagaaattttactataaaaggttttcatggaaataatagctgtcaactatcaattaatgcacacagtcccattttccttaagtactgtattgaactttaatgaaaggttacttattctatcaaattgctttatacttcgtaccattaaacttaaccaaaaattaacatcagtattccatgaagagaacatgcaaacaaaattcaccaaaatgacaggggagcctaaatgtttttgttgcacactgagaaatatgcttccacacacattttaaaaacgcaaagaattcatttttaaaaccgatgctatcagaaaatttaacccattctcaactgcatgtctctcttatatttctttgcctccttacattgagccatgtatgatatacaaacaatatttttaattatgtcaatagggcaaaagcttaactcggcagaagccagccagcatggcatacagtagcaggaccaaggacttgaagccaacatatccaggttcaaattcaagctgtcattaactagctgtgtaaccctgggctagttgcttagtcctcctgaggcttaaattcttcatctgtaacatgagaacaataaactgatctttgaggactgctttgggtacttaggagaaaggtgtatgggtaagcttggaacataggaggtgtccagtaagtggtagctgtacttaatgatttacaggggttaggtaaggatatcaataaacgaaagcagaaagtcactgcccgtgcaaattagaggtgcatatagatgggaaggtcttaatgcatttttatagttttgtaaaatcactcttatttagttcttatagaagcaataacgtacatgtgctgtaatgaagagtgatcgatcataatactaatgacccaggcatgccctatgccctttgaaaaccccctaaacactggattaaaatttttcctcctaaaaccatatgcatatcaatatgaaatggcattgagtgatgctaaataaataaataaatatggtagagtcaggagatttgggttcttatcccagctctcactctagcggaacacatgtccttgaatagcccttcctcctttccagacatcagtttcctcatctgtcagatgagcagtgggcaggtctaagtgggcacgagtaaatactagggagaggtaggagctatggccaaatggagagcatgtattctttctttccatagggacatcctctcctcagttccagctgactgttgccttgctggaccctggaccccgtattgctagatctgtaagaaaagtcagaaattcagatgttgaaaacaattaaaaacaattattaaaaaactgtgctattcaagaaaatcctgtctcctggaagacttcacatttgtgggctgcctgtttagaactttggactagatattttctgaaagccctgaccggatctgcagttttgtaattttagggaaatctcttttttgtctgattttctacactgtaatcctgaaaaatgatttacaaaacccaaatagattttggcatgaactaagcttaaattaactgctctctatcgtgaattaatattaagcagagcttggcagacactaaatatttgttttaggaatacacacagcttccactttcatctgggttaagcgctaatctttggcctgtcagttgcaggatatagcactggataaatcatgctctcttgaacagatagatgccagggtggttgtatacaaatggaacaatgtgtcaatgaacacccgagtttgggttacatctactataaacatcgacattcctttgcagtgagcccatttgctggttaagcagttacagcttcgcaaggtttgatgcgcctgtgcccaatcacggtgtaatgatttcagatgtttgcaattaatgaaccattagattaattggcagagtatcataagaaaggtgttaagaattgggtcaaaaccacagacaagctatcacccacagggacagcaatcaccagaggcaaaaaggtgagaaaatgaattaatgattttatttaccgcttctcacccctccctccacacactttctttctctgtaaaacattagcattgaccagcgtctaagttcgccaaacacagaaaggaaggagaaagctgaaaggaaaaagaaaatatgttttcatattcctacagttaagacttgatctttggaaagctgggagttccattggtaccaaaaagtgacaccatttctcagtgtatgtccaaatctctctctgtgggcttttttcctaagctcttatgttttattaattatgtaacacatcaaccatcttagaaaaatgattaatagtacttcagaaacatggaaataaataagccaagcttcaatatatgattatgtaggcttgatataaaccccagggtagccatcttttaagatgtgaggagtttaacaccaagctgtcgctacagtacttaaaatctggcagcatagtgagttattgcctggcagtggatggtgcttcagatgaatatgtaatttggaaagttaaattaaccctgaaatattttatttgttgtctattttccactcaggaaagagatcttcatgtaaacagagtccctcttattggctgaagtgaagagtcattctgaggtgagctaagcccagatacttggtaaatttatggtggctgttattttcataacaaagaaagtcaatttttggaaaaggatactaccatgacacacacaaaaaataattttcaaataaaatcctggtgcttcctccatagtgtgtgttgttaccggatattttgtttggcatttatttacttataggttcatttctgtctccccactacgatgtaagctccaggggaccagaaacttggtcatttagtttatggttctacccccactgactaagatcctggcacacagcaggtgctcaataaatacttgttgagtgaatgcagaaatgagttgttgttgtcaaaagaaaatggctttggaattctgtgttgtcctgggggaatactgatgggtccaggcagtgaccttactgctcttggacaggctcatttattggtttattcaaccaatctttattgaagacctactatgtgccaggccctgtcctaggcactgcagattcagcagttaacaacgcatagttccctaacctcacagaacttactttcttatgaggaaagcagaaatcaaacacatgcttacacaaaggatcaatttcattaaaacttggttactctcttgaagaaaaaagtatagagccataagaatatgtgatatgggagcctcatctagcttggggagactaggaagccttcccagggaaagtcacacttaacctgagaccttagagattaataggagagtatctggagcagagggaaagcatgtgcaaaggtcctggggaaggagcagcttcatgtttgaaatacagcaagcaaccagtgtggctgcagaagagagagtggggaggacagtgagaagcaagatgcaaagaaagtttcaggtcacagatcccattactgggtatatacccaaaggattataaatcatgctactataaagacacatgcacatgtatgtttattacggcagtattcacaatagcaaaggcttgaaaccaacccaaatgtccatcaatgacagactggactaagaaaatgtggcacatatacaccatggaatactatgtagccataaaaaagatgagttcatgtcctttgcagggacatggatgaagctggaaaccatcattctaagcaaactatcacaaggacagaaaaccaaacaccacatgttctcactagtaggtgggagttgaacaacggacaaagggcggggaacatcacacaccggggcctgtcagggggtagggggttgggggagggatagcattaggagaaatacctaatgtaaatgacaagttgatgggtacagcaaaccaacatggcacatgcatacctatgtaacaaatctgcacgttgtgcacatgtaccctagaacttaaagtgtaataaaaaaaaaaaaagaaaaaagtttcgagtcaaattactagatctgtgaaggcccgtttctgcccttatcctgaaagaaatgaggtgtcattgaagtgttccaaataagataggaaagtcatcaaattttaatttttaaaattttattgaaattaattagaaataaaattatgtttacacagtgagaggagtacgtctttagctttccttggattctcttaaaagaaggaagttgactcatactcttaaagtggggtaaattagtaatgagctggtggttggaggcaaaagggcttacctccaattatctgtgtgttaatccagtcctattccagggacatttttgtctgcaatcctcagagattttatgagattgactggttttgttttgaattaaataagaaattgctaaagtgccagttgttcaaaatgtgtttttcccctttgctaagtttgcatggatagttactggcaaacataccacgagtacctcctatgcatcacgccttagttgtcagggctagaaatgacgtagatgtattctccgtaagccgtataaatgctgctcaaccaagtgtttcataaatggctgaatgacaaacagggtgttccccatcaggagtggatatgtaaatatcacaacctggcccttgttagaagaggtatataaaaaagaaagtgctgtggaagaaaccaatcctttttgggcataaaaagaatgagagatcagagaagggacatttgatttgggctttgaagaataaattggaatttctgagcaaagagtataacataaacaatggtcaacatgcctaactgctcaaagtttagttattgtgtgatttaagagtatagtaactcatatttaatggtgtatttcagtagacttaaaacttagccttaaccaaagcaacaagagctatgaaaacatgcatgttcatttctttaaatgtgtattagaaaacaaactaaaattagcacacgaacccatgttttcatagctcttgttgcttaaggctaagtttttttaaaaggtttgtttctaatgcacatttaaagaaatgaacatcctatagcttgcctatccaatgtccattttcccccttcctcttctaacagaaccccaatgtatgaggttacccacccatcctccatgcaatcttgtgcttcaaggaaagctgaccccattcccacctcaagtaaatagaacttactaagacaggtatcagaatcttgttttcctttccagtgattggctcaggagaggtcatatgatccagctctggccaatgagaagtaaggaaagatctgcccagggatttctgggaaaagttttctccttaaggagacaccagagaggacttttctgcattctgtagctgcagtagctcatcttcccaccaggaaaagagctagcttgcaggtgatgctagtacattaatgatggcagaatggacacgtggaaagaatcttgatgttgatgaatcacagacctattcccttaaacgactgtagagagttgctctgcctctggacttcttactctatgaaagaaagtaaagggccagagagttaatattttaggctttacagcccaagaggcaaaatcaagggtattatgttggtatttatataacaacagggaaaacaaattttgtccaattttttactgatgaaattcaaaatttaatgagagtgtaatttttgtaataaaggtttattaataaaaaagggattattttctttttagtgctcactatcaccaaactgaaaatactcatatgtaaaaactattcttgattggcagaccatatagaaacaggcaatgggccagaattcacttgtaggctatcgtttgccatgccctgttttaaagtaatttttattttaaactttttattggttgaaaattactgttcccaaataatatctactattcatagccatggtcatcataattgatacacattaaacattaaaaaattctctatgaatcacctctagctgtcttatatccataaaagggatgattaaaagattttgggaaataatagtttacttttgctaaatacttttgtgccaattactggattctaaaattatgtgcatgagctaatttaatctttacaaaaatccatcaggtaggcagtattatcattattttgaagatgaggatattatgtcacagagcacttagatggttctctgttaaagtgagattggttattgtctctctactactgtgctgttcaactctgatctttccctatttatgtgcaaatgaaccatatatataaacttgtttctgattcgaacttcctaaactaactggcacattgcagggaagtcagttatggaaacagatgatgcagctttaaaaaaaattatcattacatttctttatggctaaagagcatctggaacaatttaagaaattagaaggagaataagatgttttacaacataatatgccccaggattgccatacaagtgggaaatgtgttagttgaattatggctccgtgctttccttttgtggtatgctttatccagatctctgacattacggtactgaggttggctctttatttagttagttttgaaaaatgttctttaattctagcattccagggaataaagtagcactccaaataataatgcacgctcaagatggagaaatcagacccttcgtggggagagaacaaaaattaaaatgtgaatcattaaaaagcaaaacaaataaataaataagactgtaaatagacccctataattatatatcgcacaagaaaagccaactccagatggttcggtaatctcatcaccagcctcactaataatcattgtaacattcttggtctctcccttaagataatgagcaatatgcactaaaaaaaaaaaaggtgtaaacatgaactacaatttctcatctaaatacaaaacaaaatagaatgactcaccttaaggtctgctagtgtagagtgttttaatctataatctttcccttcctttaaaaggttaaccaatggggaaatacaaccaaattatgaaagttgcctttctaagtagacaatatgtttccccccgacttcctccaagggtggtcccttctgaaatgaacccagaaaattaatgctccaataattaagcaaatttaaagactatgattagtaaacaactttgtcacccttaaagctgtaccactgctaacattttttaaagtttcctaaggccctttcaccttagaaaatgatcgttactagttgagccaagaaacagtatagcatatagcgcttgttattatttttctccatacctgctgttccttctctagaatttattttgaaggaccaaaaaaaaaaaagaaaaaaatcttcattgatggggaagaaaggaccaaaagaacattatgcaaaacagatgtaaaaccatctctataatattgcatgctactattgagcctttatttctgtcttttttgccttgcaaggcagttctgccccagactcataactttgtttcctctcaattaaggttgttcaatataaaattggatcatctcaaacatacctaccgggatgtagaaagaaagataagtttagattttttttaatatgatgttttatctgttggagtgggttaaattgcaatactctttgagcacattctgttttcctgctccttcaggaaatcatctgtggctctgcttcttgggtaatgtagcctacttcattgaaaaaaagagtaactcagttttgttgcttatacatgggcttctggactgcttatgtgtttgtgtatcacacactcaattcaagggctccctttgactttctgcactgagcagagcaatttcattcaaattttcattcaaaattcaatgtcgtcatcagccacccaaatgcaaggatgtgatttagggatgagtgatgtcagttatgaagatttcaaagtctatttaaaattttcaagaatgctctgcattccaatcacacacactctagtctaagaagttctggccattcctgtcatgtcatctggtggatttttaataataaaatcccttatctttctgcccaaggatctgacctatttaggagcttctggactattttcatctagtcccttggctcatcagttgattcagtaaatacatattgagtacttgcaatatccaaggcactgttctaggatctggggacacaatgtccaagactgacaagacgccgtgaaactggcagtttagtgggagttgccaggagaagaagctctccaaagcccatgcaagtgaaaggtattgtattgaaaagtgataggaagccatcattggaaatggtaattcctcatggtatttggggccagaaactgctattctgttaggtataaacccactctttagtgttctctagggccatgttgtttttggacttctccttttaatatgtgtctgctgcagtatttttcttctttctgaagatcagcatttttttgattcttctatcaagtgtatacttggcagaaaacatcccctccagccttgacttgatgtgaccgtgtagttcttgagctcagtgccatctgactcttaagacgacattcttgagggagaatcagatgggttgctgttgagtcagtggaccccgccctcctgtgctagctgtttgttattggtgccacgtgctgccatctgtgaagtcgagtcacacaccacagacatggctgccagagaccaaggcgggaggatgtttgcagggaaggcggcctgagaaacactcccaagtgcacctgcaaccggaggactgttcatctgcagctccaaatgcattgtacaggcacaggctcactcttcccctttttctcacagttgtttagattgtggtatgttgtggaaaacagatatgctgagcttctggctctgtggtttccaggattgaggagacataagtagggaagttggcctttccttctgtcttgcattttattatatttcattttaaggggggcatttctaaaaaatattaactttctcatattacaaaagtaatatgtattcattgtgggaaacctggaaaacagaaaaagtagtgaagaaaagaatactctctcacattctcacttctcacagataactgctattaatattgtatgcccaggccgggcactgtggctcacgcctgtaatcccagcactttgggaggccgaggcaggtggatcatgggatcacgagttcaagatcagcctggccaatgtggtgaaaccccatttctactaaaaaaaatataaaaaataaaaaatttgctgagcgtggtggcacatgcctctagtctcagctgttcgggaggctgaggcaggagaatcacttgaatccgggaggtggaggttgcagtgagccaagatcatgtcactgcaccccagtctgggcgacagagtgagactctgtcttggaaaataaaataatgtatgcccacacttgtttgtgcaacaaaaatggaaccttactcaatattctcaaaataaaagtatctttaccttaatacccatatgctctgtgcccattatgtgagttcacccaataaagaaatgtaagaagcagaaaatgaaaattttctcagaaatttcacctcttcagagagagtcgttgattacagtttggcataaatccttccagatttttaagataggtgtgtgtgagtatatacttttccatacaaatatcaatactctttcatgtcttttacagcttcagcatagtattgtattgaatgaatgtattgtaatgcaattaaaattctctttcagtggacattcagggagtttccagttttttctttataattataaatcaattttgcatagctgtccaaatatttccttaagatatactgctatctgtgggccaaaagttgccatttctagccaagtaggagggagaccatattgagtaattaagtatccaagatatatataaaaataaaagaaaacaaccaaaaaaatcaagacccttaatatctggaagttctgtgggagaattagaataaaaaatgggcacagtagctcatgcctgtaatcccagcactttgggaggctgaggtgggaggatcaattgcagacagttcaagaccagtctgggcaacacagtgagatcgtgtctctacaaaatctctacagaacgtttaacaaattagctgggtgtggtggtgtgcacctatggcctcagcttcctgggaggctgaggcaggaggatcatttgagcccaggagtttggggctgcagtgagctacaaacatgtcactgtactgcagcctgggtgacacagtgagatcctgtcttggataaaaaaaaatgtaagagtgccagaaaatgataaaaacaaaattaaaaaaatgtaacccaaaactttttttttcgttaaaggaggatctgaaaatgtagaggtgagacgctaatggcagagtggcctcagctttcaccaggttttgaaaacatctgtgagggaggcaccaaattcactgtcctgcagctttgacttcccaatcctcgttgcctcgtgctgccagcctgtatgctggtagaagtgtgttcctgggaacatcctggcatcttgtgttaggactacactggtgcatgggacagatcacgctcaagaaggtcgatgtaatttgaaaaacagatgggctctgctttgtgaaaactccaagcatatgaagtctaacttgaataaaaggtacatgtttggaaggagagtgtttgttataaaaggactgttcaccattggggtgtataaatggaagtgctcttttagccaggcagatccttaacctgtctaaaagagtatttgattttaaagtcccttgaactaggtctattgcatatattttcaaatataccactttggctgggagtaatatttagccacaaatattctctcagcaagaaaaatggaggataaaatgttatatatgttggtgtctttttcccatctagtttctatttcttacttgaatcatcttaaaacaactaagaaagttataatcagaactaggtccaaatttgtcgtcctagtttgtttttgtgactttgtctaaaagctgagcaaaatctgctcaacaagggtcttggaaacattgttacttgtgttttccatccatcactcctgttcatctgcatatacctgaacagaattattcctagcgcattgaatctatataccctctcttagtctctgttcattatagtaagctccagaaaaaataatataaaagaaatattaaagaaagaaaagaagggcaaagaaaaaagttctgctggttaagaaatcccttttagccagcggggcgccagaagaatccagggacatcaatagttcctgaactgctaaagtatttcctactcttgtgaattctaaacatctctgaagtccaatatagatcccaaatatactgataggattagaaatagcatttccaataaaaaatgcataacacagtaggacatgaaataaggtatttctctttgaaaccatgaaattgcaccatatttgtctggaaatgtgtacatgaaatttaaacaacccttgaagacatccatctattttttttttgagtttgctcctcaattgaaattccactctctggaagtttgtgctgcgggctcccaacttcactctctgcctctcctctgtttccctccatttccttccctttatgacccttttcagttgcgcccccttgatttatggtcatttgtgtgattgcactgctttggtttatggcagtttatgtcatcctggtcttgtcataaatgactaccataaagtgaggtaaaatatcataaaacattagtgagtccctgctactcaaggttcttcagaataaaccctgacaggtaccagctatagaaaaatagatctggccatttgaaaggtgcagtatttgtaataataatcataataatgatagttaaaaataagttactaaagtttgctgaactctatgtgccagtcactgggttaagtttatttcatacattatgacatagaatccttgttactgccctctatggcaaaaactaggattatcaccgttgtatagatgaggaaaccgaggcagggagaagttcagcatggccagtactcagtacagtccacagtcttactgtgtcttaagagctcgtgcttttaactgttgttggtctagatgctgcagctcgtgctgtgtgcacataaggggttgagtggattgaaatgtgggtttagcatttggcagacagttttcatgactgaggagctcttgtcaccttcaggccttttttgctctccttcccctcccagttcacagagccttctggcacaccctgctaccctggcagcactgcctgcctttgttacctcaccatgccctctagaccacaagttatctgcaaagttgtctttcttgattcatccagctcacttctgaccttgtcctttggaatctcagctgtgctagcacatctttgagccagaagcctgagagtcacctttgattccttctctttctaactagcaagtcctgcctgtgccacctctaagaggcatcttacacccatctgcatttcactttaccttccagaaggtgggtactgtaagccactgccatctctttcctgcactgctagagatcaggctctgcaaatgctcccagccacctgtcctttgggctctatgcaggagcagaagcacttataagcacgagctgggactgccattgacagccctcatttatccctgtggttcgcttccttttgtgctttctctgactcctgcctccctcatgacattttgtcgtgctgttgtctccgcctcactggcctcccccgaaccaggtgaattattttctaacttagaaacttcacaccataaactttgctctctgcctggaacttgcagcccttaactttcctgtacccattcttgtctttacggagtcaatttgcttatcattgttcctgcctgaagtttctccctctttcttcagttctctactactgcaactctttccttcctagatctgcccatatatactgaggagtgatttgtttatgtattgatgatctgtttccctatctagattgtaagctccatggggacaggaacacaactatcacgtccatagccacattcctagcattcgtcacagggcccagcacaacagcatgggacatatttgtggggtgggtttagatgggattgcaggttatatctccacgtctaaactggatcgtgagggctaaaaggacagccatgcatcatctgtttctgtgaaatatgttgtaccaagagcattcacattgtaggaacaaagtggatgttaatgtgatacatagctgttgactgaattatagtagccctcacaaaaccttggctcctaggattaagacagtgcattgcattggattgggcattggagactggccatggggtgtataaaaaggggaaatggatcataagacaagttaggacaacagtttctatgatccaataaattcattgaaagaaatatgtgagcatcttggttaaaaaagaaaaagagaagaaaaaaggaaccaggaggaaaaatggaatcagtgtatttctctctcttttttttttttgccccctcatctcctgtcttttccaaaaatctttctaggtttcctctgtcacatccgtatgaagtgtaaattatagtttccaatataaatggccattttcagcaaattttagcaaggaacaaaatttcatttgagactgaaatttggcatccctttgcctcttcatgctgggaactattttttgtctttacaaaatgcaatgagacataaatctttttgcttttatttctaaatgatactacaccaagccgaaaatgcactgggaaaataggaatgcctccaagctcgggccagcctttgcaatcctaattcatagtgcgtgctgttataccagggagaaatcagatcagggtcctataaaaatgtgaggctatttttaattgtatgtactcacttccaatcccattcctctccctgcaaatttcgttttaccctggcactcctaactaactacattgccacccacaaagaagcctggtacactcaacagctaacacttgatttgacaccatttaggaggctggcaactccaaaagcatatggaatattccagatggattcccagggacatttggctccaggtttctcatgttggggaacacagttggcacatggagcaggccagttctttattgcatcccatccgaggcaagatgttggttgtccctagacccctgacattacatgccagttgatgcctcccagtcactgtgacaagtaaaagtacacctcccccagttctgaatgtaacctttgggggacccgattcactttggctgagaaccaccaggaggatttaaaactttttgcacaaaaattaacagggcatggttgggcatgcctgtaatcccagctactcgggaggctgaggcaggataattgcttgaacctgggaggcagaggttgcagtgagccaagatcgtgccactgcactccagcctgggtgacagagcaagagtctgtcttcaataaatgagtggggttccaagatggccgaataggaacagctctagtctacagctcccagcatgagcgaggcagaagatgggtgatttctgcatttccaactatggtaccgggttcatctcactgaggcttgccagacagtggctgcaggacagtgtgtgcagcccacggagtgtgagccaaagcagggcaaggcatcgccttacctgggaagcacaaggggttgaggaattccctttcctaggcaagggaagccatgacagacctggaaaatcaggtcactcccacccttatactgcacttttccaacagtcgtagcaaatggcacaccaggagattatatcctgcacctggcttggagggtcctacccccatggagcctcgctcactgctagcatggcagtctgagatctaactgcaaggcggcagcaaggctgggggaggggcacctgccattgctgaggcttgagtaggtaaacaaagcagcagggaagctcgagctgggtggagcctactgcagctcaaagaggcctgcctgcctctgtagactccacccctgggggcagggcatagctgaacaaaaggcagcagaaacttctgcagacttaaacatccctgtgtgacagctttgaagaaagtagtggttctcccagcatggagtttgagatctgagaatggacagactgcctcctcaagtgggtccctgacccccgagtagcctaactgggagacacctcccagtaggggctgactgacccctcatatggccgggtgcccctctgagaccaagcttccagaggaatgatcaggcagcaacatttgctgttctgcaatatttgctgttctgcagcctccgctgatgatacccaggcaaacagtgtctgagtggatctccagcaaactccaacagacctgcagctgaggggcatgactgttagaaggaaaactaacaaaccgaaagaacatccacaccaaaaccccatctgtatgtcaccatcatcaaagaccaaaggtagataaaaccacaaagatggggagaaaccagagcagaaaagctgaaaattctaaaaatcagagcgcctcttctcctccaaaggaatgcagctccttgccagcaacggaacaaagctggacagagaatgactttgacgagttgagagaagaaggcttcagatgatcggtaataacaaacttctccaagctaaaggaggatgttcgaacacattgcaaagaagctaaaaaccttgaaaaaaagattagacgaatggctaactagaataaacagcgtagagaagaccttaaatgacctgatggagctgaaaaccatggcatgagaactatgtgatgcatgcacaagcttcagtaaccaattcgatcaactggaagaaaggatatcagtgattgaagatcaaatgaatgaaatgaagcgagaagagaagtttagagaaaaaagagtaaaaagaaatgaacaaagcctccaagaaatatgagactatgtgaaaagaccaaatctacgtctgattggcgtacctgaaagtgatggggagaatggaaccaagttggaaaacactctgcaggatattatccaggagaacttccccaatctagcaaggcaggccaacattcaaattcaggaaatacagagaatgccacaaagatactcctcaagaagagcaactcaaagacacataattgtcagattcaccaaagttgaaatgaaggaaaaagtgttaagggcagccagagagaaaggtcgggttacccacaaagggaagcccatcagactaacagcggatctcttggcagaaactctacaagccagaagagagtgggggccaatattcaacattctgttttttttttttgttttttttttgagacggagtctcgctctattgcccaggctggagtgcagtggcgtgatcttggctcaccacaagctctgcctcccatgttcacaccattctcctgcctcagcctcctgagtagctgggactacaggtgcctgcccccacgcccggctatttttttgtatttttagtagagacaggatttcaccatgctagccaggatggtctcgatctcctgacctcataatctgtccaccttggactcccaaagtgctgggattacaggcatgagccaccatgactggcctcaacattcttaaagagaagaattttcaacccagaatttcatatccaaccaaactaagcttcataagtgaaggagaaataaaatcctttacagacaagcaaatgctgagagattttgtcaccaccaggcctgccttacaagagctcctgaaggaagcactaaacatggaaaggaagaactggtaccagccactgcaaaaacatgccaaattgtaaagaccattgatgctaggcagaaactgcatcaactaatgagcaaaataaccaactaacatcataatgacaggatcagattcacacatgaaagtattaaccttaaatgtaaatgggttaaatgctccaattaaaagacagactggcaaattggataaagagccaagacctatcagtgtgctgtattcaggagacctatctcacatgcagagacacacataggctcaaaataaagggatggaggaagatctaccaagaaaatggaaaacaaaaaaaaagcaggagttgcaatcctggtctttgacaaaacagactttaaaccaacaaaaatcagaagagacaaagaaggccattacataatggtaaagggatcaattcaacaagaagagctaactatcctaaatatatatgcacccaatacaggagcacccagattcataaagcaagtccttagagacctacaaatagacttagactcccacacaataataatgggagactttaacacgccactgtcaacattagaccaatcaacgagacagaaagttaacaaggatatccaggaactgaactcagctctgcaccaagcggacctaatagacatctacagaactctccaccccaaatcaacagaatgtacattcttctcagtaccacatcacacttattccaaaattgaccacgtagttggaagtaaagcactcctcagcaaatgtaaaagaacagaaattatagcaaactgtccctcagaccacagtgcaatcaaattagaactcaggattaagaaactcactcaaaactgctcaactacatggaaactgaaccacctgctcctgaatgactactgggtacataatgaaatgaaggcagagataaagatgttctttgaaaccaataagaacaaagacacaacataccagaatctctgggacacatttaaagcagtgtgtagggggaaatttatagcactaaatgctcacaagagaaagcaggaaagatctaaaattgacatcctaacaacacaattaaaagaactagagaagcaagagcaagcacactcaaaagctagccgaaggcaagaaataactaagatcagagcagaactgaaggagatagagacacaaaaaacccttcaaaaaatcagtgaatccaggagctggttttttgaaaagatcaacaaaattgatagactgctagcaagactaataaagaagaaaagagagaagaatcaaatagacgcaataaaaatgataaaggggctatcaccaccaatcccacagaaatacaaactaccatcagagaatactatgaacacctctatgcaaataaactagaaaatctagaggaaatggataaattcctggacacatacaccctcccaagactaaaccaggaagaagttgaatccctgaatagaccaataacaggctctgaaattgaggcaataattaatagcctaccaaccaaaaaaagtccaggaccagacagattcacagctgcattttaccagaggtagaaagaggagctggtgctattccttctgaaacgattccaatcaatagaaaaatagggaatcctccctaactcattttatgaggccagcatcatcctgataccacagcctggcagagacacaacaaaaaaagagaattttagaccaatatccctgatgagcatcgatgcaaaaatcctcaataaaattctggcaaaccgaatccagcagcacatcaaaaagcttatccaccatgatcaagtggggttcatccctgggatgcaaggctggttcaacatacgcaaatcaataaatgtaatccagcatataaacagaaccaaagacaaaaaccacatgattatcttgatagatgcagaagaggcctttgacaaaattcaacagcccttcatgctaaaaactctcaataaattaggtattgatgggacgtatctcaaaataataagagctatttatgacaaacccacagccagtatcatactgaatgggcaaaaactggaagcattccctttgaaaactggcacaagacagggatgccctccctcaccattcctattcaacatagtgttggaaattctggccagggcaatcaggcaggagaaagaaataaagggtattcaattaggaaaagaagaagtcaaattgtccctgtttgcagaagacatgattgtatattcagaaaaccccatcgtctcagcccaaaatttccttaagctgataagcaacttcagcaaagtctcaggatacaaaatcaatgtacaaaaatcacaagcattcctatacaccaataacagacaaacagagagccaaatcatgagtgaactcccattcacaatcacttcaaagagaataaaatacctagaaatccaacttacaagggatgtgaaggacctcttcaaggggaactacaaatcactgctcagtgaaataaaagaggacacaaacaaatggaagaacattccatgctcgtggataggaagaatcaatatcgtgaaaatgaccatactgcccaaggtaatttatagattcagtgccatccccatcaagctaccaatgactttcttcacagaattggaaaaaaactactttaaagttcatgtggaaccaaaaaagagcccgcattgccaagacaatcctaagccaaaagaacaaagctggaggcatcacgctacctgacttcaaactatactacaaggctacagtaaccaaaacagcatggtactggtaccaaaacagcatggtactggtaccaaaacagagatgtagaccaatggaacagaacagagccctcagaaataataccacacgtctacaaccatctgatctttgacaaacctgacaaaagcaagaaatggggaaaggattccctatttaataaatggtgctgggaaaactggctagccatatgtagaaagctgaaactggatcccttctttacaccttatacaaaaattaattcaagacggattagagacttaaatgttagacctaaaaccataaaaaccctagaaaaatcctaggcaataccattcaggatgtaggcatgggcaaggacttcatgtctgaaacaccaaaagcaatggcaacaaaagccaaaattgacaaatgggatctaattaaactaaagagcttctgcacagcaaaagaaactaccatcagagtgaacaagcaatctacagaatgggagaacatttttgcaatctacccatctgacaaagggctaatatccagaatctacaaagaacttaaacaaatttacaagaaaaaatcaaacaaccccatcaacaagtgggtgaaggatatgaacagacacttctcaaaagaagacatttatgcagccaaaaaacacatgaaaaaatgctcatcatcactggccatcagagaaatgcagataaaaaccacaatgaattaccatctcataccagttagaatggcgatcactaaaaagtcaggaaacaacaggtgctggagaggatgtggagaaataggaacacttttacactgttagtgggactgtaaactagttcaaccatcgtggaagacagtgtggcaattcctcaaggatctagaactagaaataccatttgacccagccatcccattactgggtatatacccaaaggattataaatcatgctgctataaagacacatgcacacatatgtttattgcggcactattcacaatagcaaagacttggaaccaacccaaatgtccatcaatggtagactggattaagaaaatgtggcacatacacaccatggaatactatgcagctgtaaaaaaggacgagttcatgtcctttgtagggacatggatgaagctggaaaccatcattctgagcaaactatcgcaaggacagaaaaccaaacaccacatgttctcactcataggtgggaaatgaacaatgagaacagttggacacaggaaggggaatatcacacaccagggcctgtcgtagggtggggggagggggaggggggaaggatagccctaggagatatacctaatgtaaatgacgagttaatgggtgcagcacaccaacatggcatatgtatacatatgtaacaaacctgcatgttgtgcacatgtaccctagaacttaaagtataataataataataaaagaaaattatttttattcatgtacaaaatggagtactattcagccatcaaaaagaatgagatcccatcatttgcaaggacatgggtgactggaggtcattatgttaagtgaaataagccaggtacggaaagatacatgtcacttgttctcacttacttgtggaatctaaaaatcaaaacaatttaagtcatggagatagaaagtagaaggatggttaccaggggatgggaagtatagtaggaggccggggtgggggaggtggggatggttagtgggtataaaaaaatagaatgaataaaacctagtatttgatagcacaagagggtaactatagtcagtaataatttaactgtacatttaaaaatagcaaaaagtataattgaattgtttgcaacacaaaggataaatgcttgaggtgatggaaatcccatttaccctgatgtgattacacattgcatgcccatatcaaaacatctcatgtaacccataaatatatacacctactatgtacccacagaaattaaaaatgaaaaataaaaaaaggttcaatccacccaaaaaataataaataaataaatcaaactttttgcaggcatctcaagatgaaggtttcctatttgtgattatgaaaaaaatgtcaagaacaagtcccttggtgttcttagaccaaagtcagaacaacagacctagtaagtattctctcagcattcattacatgttagcaaccttcaaagcagtttgtgttccctcatatggtcctccatgaggtaagtatcagagctatagtaagatctatttaacagtgagacccaaatgtgtcccaagaccactcaggattgccctggtaaccctgaagctcgaaaatccctgagatcaagactgaaggagtctgtgttgttcctcccgcatgcttcttccttgcatgtccctttttcttccctttctgtatcctttcttccccatctttaatttcttcatttccaatggtttcctgcgtctttacaaaatcacttaatctgtggaaataaactgaattttctatttgctggttacagcattaaacaataaaagctagatgggtattcaccaaatttagagggtatagtttggaatatttggtcatctagtttctgtagagttgatgaaattcattttgtggtggtggcagggacctgagagagatggactgtgataactccagtgtggctaaaacaggttcaagaggaagcctgtgtgactgtcaatcagaggagggatggttcatatcagggtgacatggtcagagtaacaaacagtgctttcaaggcaagctctgattcaaaagccacaagggcggatgcggggaggccaggagctgatctgcagttgagctccttcttcgtgggcaactctatgtggcatcctccagtgaaggcatcaggaatctctttatttaataatgtttaatgattctcctgtgcaaatgtgtattagggcctgctctgtaattgtgggatggggtggagggataagtaagaaatgaccccaactctctaaaatttcacatcctggcagagcagactgaagcacaaatagtatcaagccctttataatagagcaggggttctcagtttgggcactattaacatttagggtagaatactttttttttttttttttttttttgagacggagtctcgctctgtcgcccaggctggagtgcagtggggcgatctccgctcactgcaagctccgcctcccggtttcacgccattctcctgcctcagcctcctgagtagctgggactacaggcgcccaccaccacgcccggctaatgttttgtatttttagtagagatggggtttcactttgttagccaggatggtctcgatctcctgacctcgtgatccacccgcctcagcctcccgaagtgctgggattataggcgtgagccaccacgcctggcctagaatacttttttgttgtggggactgtcctgggaattgtacaatatttaacagcatccctggcctctacttactagatgccaatagcattcccctggtcttgaaaatcaaaaatgtcttcagatgttgtcaaatatcctctgggagtaaaattactaggtcatgtgtacgccaagtccactggctccaagcccaggacagcaccaggagttgcccaggaattgcaacctttgtagcttagactgcctttcaagtttatttaggacccagagcactttagctcgtggtggtgaggctagccagaatttaagttctgaccctgggatgaacagtttgcctctggctaggactcatctaaatgccgccttcatctatgttgggtgagtttctgtcaagtgttgctttccgctgtgacagggctacactgagttccaatgcaaaaccccatcatcactgcactctgcctcctccagcacacacattctctctcaatgccatgtggccactgtggggggagacaggtggggtggtgtaggcaattcaaaactgtctctcctaccatcttcagtgcctctttccttgatatgatattaaaattgggcactgcgattactcagatgagtttcagtccttatgaaggtgttttcttatgtggatagttgttcaatttggttttcctctggggagaggcgggatgatcgctggagagttctatttggccttccttcttcctttcttgagagaaggtgctctgagcttaaattatgctaatatatgaatgcagagagaagagaaagagcaggtgcaatgaggcagtgaaagcctgaaattagccgcaagaagggtaaaaagtgcagtaattcagtagaggctgagagtaactgagtcatcacaaagccaggagcacgggagagcacagagcatgccggctttggagacacaggtcccagagccattacagcatccacagggctcctgttggataagttgcatctcctttgatcaggggtgtgaggcaacttctatttccttccttacctttgtattcttacaataaactcgaatacctccggtaacacaagcacatacctgtgcctcctaccaagaaaataaatacctcgatgacgtcgggttgtattatataattgtggggaagaacagaagggaaaaaggagagacattagctcactttttggggaaaatccttgctttgctgaggtgggtaaaacatttaaaagttaatctgttaaaggaactggaattctctgggcacatgccaacccgcagctgagacgtggtctggaattgtgtgactaagtaaaatggttcataggaaaaggtttgcctctgtgtcaacaggcagatgattcgtaattcatcaagatttagccaagacaataagagaaatatatgagcattgcaaaggactcatctcaggcatcaccttctcaggggaagactcttctaacacccttcttccctgcgcaagacctagtgtcatcccattcctccagggcccgtaacactcctgatgcacttctctctttgatcatactgcatcggatggtactcatctatttactcatttctcttcactgggctatgggatccctggaggcagggactatgtttaatacgtcttgatatccccagccactaaccaatggcctccatatagtaggcactcaataaattgttgagtgagtaaatgagcaaattcactcctacagtttacctcacgtactttttaaggaggggaaaagaatccattttaactcgagtataggttttctttcctgaagagcatatggataaaggacagctactgatttcttcagagggagaaaaatgatagaacaggcctccatgctatatttcaaactcatgtcaagttttcttttaaaaaaatgtctgtccaccagcagtcatatcatttttcaaatttcatgtcgtccattttctgaggctgcccatctgtcattttacgcagagagtatccatcatgatagaagctaaataattttcaaagccgtcaaggaatggacacaaaaaaggtccccatttcatctgaacaaagttgtccaaggctggcggtgaggatatgactgggaaaggacagatggcaccctgggagtgcctctcaaattggttccaaatggaacaaagaaaaaattcatttgagaaactagacttcagtccttcatgttttatgttacacatgcacctatcagtaccataattaggtaagagtttatttagagcaagtgtgtctgtaaaaataaaattcattttttctaatgattatgtttttctttaaacatagttatgtatatagttttttctaattttaatcttaagagtgaatcatatttatttgccgaatacagaaaagtgtaaggtggaaagtaaaaatcacatattattgcattacacagaagtaaccattaatactgttatttttgatgcattttttagtcacatacacatgtttgtacacacacacaatgtatatatgcatatttatatattttgagacagtttttatatataatatatataataaaatatataacataattatataatatataaatataatatattataatatataatatataaatataatatattataatatataatatatgttataaatataatatatattataatatatataattatgttatatattataatatatataatataataacataattatatataatatattatataattatatatatatatttttatatatataatatattatataatatattatatatatacaatatatattattatatatattatatatataatatattatataatatattatatatattatatataataatatattattatatatattatatatatatattttgagacagagtttcgctctttttgcccaggctggagtgcaatggcacaatctcggctcactgcaacctccacctccccagttcaagtgattctcctgcctcagcctcctgagtagctgggattacaggtgtgtgccaccacacctggctaattttgtatttttaatagagatggggtttcactatgttgaccaggctggtctcgaactcctgacctcaagggatccacccaccttggcctcccaaagtgttgggattacaggcgtgagccaccacacctggcctatttgagtatatatatgtgtgtgtgtgtgtgtatatgtgcataaactgtagtattatttacaattttggtattatattctttatggaatttcatatcctgcttttctcactacattatatcttaaattattttttatgccattaagtattctgggaaacatgattttttttttacttcaaatgttcacgttctttttgatttttaaaattttattttttaattgacaaggaataattatacatattcatagggcacatagtgattatacatattcatagggcacatagtgatgtttcgttatgtgtaatggatagtgatcagatctgggtaattggcatatccatcatcttaaacatttatcacttctttgcattggggatgttcaatatcctccttccagctatttgaaactataatatattattgttacctatagtcatcctgtagtgctatagaacactagaatgtattcctcccatctagctatacttttgtatcatttaacaattccctccctattccctcatccccctacccttcacagcctcttgtatcttctgttctactttttacttctatgagatcaatttccttttttagcttccatacatgaatgagaacatgtggtgtttaactttccgtttctggcttatttcacttaacataatgtcctccagttctatccatgttgctgcaaatgacaggatttcattcttttttatgaatgaatagtattccattgtgcatatataccacattttctttatccattcatctgttgttagacacaggttgattccctatcttggctattttgagcagtgctgccataaacattggagtgcagctatctctttgatttaatgattttctttcctttggatagattcccagtagtggaatcatatggtagttctatttgtgatttttgaggaagctccatactgttttccataatggctgtactagtttacattcccaccagcagtgtataggagttcttttttactctgaatctttgccagtatttgttattttttttctctttttgataatagctatcctaccaggggtgagataatacctcattgtggttttcgtttgcatttccctgataattaatgatgttgagcattttaaaatacatttgttggtcatctgtgtattttcttttgagaaatgtctgttcggatcatttgctcatttttaaattggattgtttgttttttttttttgctgttgagatgtttggatcccttgtaaattctggacattaattcgctgtgagatgagaagtttgcaaatattttctcctattttagaagttgttttttcactatgttgttttctcttcttttggaagctttttagcttgatataatcccttttgtttatttttgcttttgctctctgtgcttttgaggtcttaattcataaaatattttttctgaccaatgtcttgaagtgtttcccctgttgttttctttcagtagttttattgttttgaactttatatttaggacgttgatccattttgagtccatttttgtatagagtgagagatgggggtctagttttattcttttgcacatggatctctggttttcccagcaccacttattgaagagactgtcctttcccccaaatgagtgtttcggtacttttgtaaaaaatcagttggctgtagatatgtggattaatttctgggttctctgttctgtcccattagcctatggatctatttttatgtcagtaccatgctattttgtaatatatctttaggtctggtagtgtgatacctccagctttgttctttttgctcaggattcctttggatattcaggatattctgtggttacatccaaattttagatttttttttctatttcagtgaagaatatcattggtattttgatagagattacattgaatctatagattgctttgggtcattttaacaatattaactcttttgataaatgagcatggaatattcttccatttgtatcatctataatttctttcatcaatattttacagttttcattgtagaggtcttttacctcattggtatttaatttcctaggtatttaattttttagtagctattttaaatggggttactttcttgatttctttttcagctagttgtttgtgtatagaaatgctactgattttttttattatactttaagttctgggatacatgtgcagaacatgcaggtttgttacataggtatacacatgccatggtggtttgctgcaccgatcaacccatcatctacattttgtacaataattttatatactgcaactttactgaatttgtttatcagttctagtagtttttttggtggagtttttagttttttcaaatataagatcatatcttcaaacaagaataatttggtttcttttttcctaatttggatgtcttttctttttttcacttgccgagttgccctggttataacttccatgctatgttgaaagactggcgagagtgggcatcttgtcttgttgtagttcttaaaaaagaagctttcggcatttccctattcagaaacatattagctataggtttttcatgtatccatttatacctaatttattaaacatttttatcattaagggatgtttgaattttatcaaaagatttttcttcatctattgagaggatcatacggttttagttcttttttctactgatgtgatgtacaatgtttattgacttgtatatgttgaaccatccttgcttcctaggataaatcccacttgatcatggtgtgatacctttttgatgtactgttagattaggtttgctagtatttttttgagggcttgttcatctatgtttatcaggaatattggactgtagtttgcatttttaagtttgtgttcttgtctggttttgatatcaggtttatgctggccttgtaggatgagttaggaagagtttcttctgcttcattttatagaatagtttgagaactggtgttaattcttctttaaagtttcagtagaattcagtggttaagccatctggtcctggacttttttgttggaagacttattattactggttcaatctcgttacttgttattggtgtgttcaggttttctatttcttcttggttcaatcttgctaggttgtatgtgtccaggaatttatctatttcctctaagttttcaaatatgttagtgtatagttgtacatagtagtctctagggatcctttatatttctgttgtatctgttgtgacatctttttttgcttttgattttattttggtattcccttttttcatagtctagcaaattgtttattttatttatctttttaaaaaactgacttcttgttttgttaatcttttgtaagttttttagtttcagttttgtttatttttgttttgatatttattatttttttattctgctaattttaggttaggtttgttcttgcatttttagttccttgagatgcatcaagtggtttatttgaaatagttctaattttttatgtaggcattttttgctataaatttgcctcttaatactgcttttgctgtatctcataggtttggggatactgtgttctatttttatttatttcaaataatttttaaatttcattctttattgcatccttcacccattggtcattcaggagcatgttgtttaatttccatgtattcatataattttgaattttcatcttgttattagttcctagttttattacattgtaatcagataaaatatttgatatgattttaagtttttaatttttctttgagacttgttttgtatcctaacatatggtcaatcctgaagaatggagtgttgtagtcaccaaatattattgtattgggatctatttctccctttagatctaataatatttgctttatatatctgggtgctccagtgttgggtgcatatatatttataattgttatattctcttgctgaattgatccctttattattatttaatagacttctttgtttctttttacagtttttgacatgagtctgttttgtctgatataagtatagctacctctgcttacttttggtttccatttgggtggaatatatttttccattcctttattttcagtctatgtgtgtctttacatgtgaggtgagtttcttctaggcagcatatagttgggtcatgtcttttatccattcagtcagtctttatcttttaaatggggaatgtaatctgtttacattcaagattattattgatagatgagggcatactcttgttattttactgattgttttttagttgttttgtatatccttcattacttacttcctctcttattgttaatttttgtgattgggtggttttttatcgtgataatgtttaatttttttcctctttgtcttttgtgtactggttctcccagtgagttttatagttttgcatgttttcatggtggttagcatcttttcactttttaatgtaagactctgttgagcatttcttgtgtggctggtatggtggtgaagaatccccttagtttttgcttgtctgtgaaagattttatttctctttcatttctgaaggatagctttgctgattataatattcttggctagcaatatttttcccctagtactttgaatatatcatcctgttttctcctggcctgtaaggtttctgtagagaaatgcattattagtctaatagggattcctttatacgtgacctgatgcttttccattgttgtttttagaattctctttttgtctttgacttttgacaatttgactgtaatatggctcagggtagacctttttaggttgattctatttggggatctttgagcttcctgggcctggatatctatctctctcctaatacttggaaaaatgttagctattatttcataaaatatgttttctatactctgtctcttctcttctcctggaacacccataatgtgatatttgttacttaatgatgtcccataaatcctgtaggctgtcttaattttttttcttgtgtctgcctgtgttatttcaaaagacctttcttcaagttcagaaatttactcctctgcttgatctagtcttttactgaaactcttgattatatttttaatttcattcattgaattcttagctctagggtttctgtttggctcttttttcatgatagcaatctccactgaatttctcattcatatcatgagttgtttcctaatgtcactgaattgtctgtattcttataccttactgagttttcttgattattattttgcattctttttctggcatttcacatatttcattatgattggggtctgttactggagaattattgtgttcctttgcaggtgtcatttccttgcattttttatgtttgatatgtcatgttaatttccatgtatccaggggaaaagtcacctctttcaattttatggtgtagagtttgaagagaaagtttgattcataatgatgtgtcttggagggtcagtttggtggggtttgttggctttggttttatgtgaatgcagtagtgcagtctccatgtagtttcttcagctgtaatccatgctagtgatgtttgtgagtgtctcagtgacatatgctgaggaaatatgtagtgtgattgtatggctttgctgggggtgggattgctgggctgtttctcaggtcaggggcgtgtgagtgctcaacctaggacctgccttgctagggttgcagtcatgggactgttactctggctatgggcatggatgcacagttgcttggccaatgtgggagcatgcctgctaggggcagaccatagggctttttctcaggctctggacacagttgcaaggctgcttggcttgcctgtcagtgtgtcttccttcccagggttgtttctcaggtctgggatgcaggtgcaaggctacctgaccagcctggggagtgtctttttggggaagctcacagggatgcttttgcagctcaggatataggcgcacagttgcatggctgacatggggttatgcctgtcaggggcagccaacagggctgtttctcaggcccaagatgggggcacatagcttcttgactggcttaggggcatgttagttgcttggtggctgagggaactctcctgctcaggagagggcacacagcagtttggctggctcaagagtgggttttccctgggtggaatggccaggctgtttct

SEQ ID NO: 1385 - DNA, 20001 bp, Homo sapiens
ggcaaggcagtgaggagctaagagcccccaaccaacaccagcaaggacacaggacctcagtcctacagccacaaggagctggattctgctgacacccccagataagcccaggagcctccaggcgagggcccggccctgctgataccttgaggtcagccttgtgagaccctaagcagataacccactgagcccacgcagacttctggcctccaggactgtgaaacagcaggtgggtggtgatttaagagttcaagtttgtggcagtttgttacattttgcagcaatagaaatacccacgtcctcagcaaccactcatgctactgcctttttaaaggggtgcagagccttacagcccatcctccactgtccctcgaggggacagcccctgacctcgccactcctctgcttacagaccttccatgggtaccttcaggatgaagtctgagctcccgatggttgggcattcaacgtgggaaagaaaagacatcgtctccatcagtttggagaagattggctgcaggggccctgctatgtgctgggggcagctgagtctcacaagggactgagctcccagggaaatgcctggactccagaggctgctgtgcagacctgtctgtccccccgagtcctagggctcagggcccatggagatgcccctgggtcagggaccaccgagcagcccaggcacactgggaggacgtcggctacgaggtgacacggagccaggaggcttgggggactggggagcaccaacttcacttcccaaagctgaaacacaagagaccccggggatgcaggctgttcctggcctcagtttcctcatctgtaggcgatcactgatgataagccccgctcgggtagcaccgggctctgttctcagcgtgtgatgcgcattacatcgtaaggtggggtaggtgctatttgtcagtgctgtcaatagtcaatatcacagtttcccaggcaaggagctgaggagacaggtgtggctggaacagtggctctcaggcagggggaggggctggtgaatgagggccctggttctggctttgtggctgtgtcctgggcttgcctcctggcaccccacgtagcagctggggacctggaccagatggactggctacctcctgccgccccatgtcctcctctgtaaatcggggacagtgatgactggcctcagcccaaggctggctcacaggaggcagaggttctgtccaggggaagtgagaggtccccaccatagctcagatgctcaacccctccccacagctctgtggcatcaggttcatctggggaaatggcggaatccactcctgtttcccggcgctgtgcgtctaacccgggcttggcatctctgcagctggcggctgtcacagctcactgcatcctaccgccaggcatctgaaacccagcccgggacggcgagaatttagatggtgccaattggcaggtggagctgagcacccagcaatgagcctcacttgcacagagccccgcctaccctgcagcgggccccagagtaatgcagtaataataataacaaacacgatgacaggcaggatctttggtgtgtgcgggagtccctgaagttcactgagcgccctccacacctgctcatgccttgcatccatgcagggaatagggtcaggtgctaccctcttctcagagaggttgtgccatgggccagaggtcacacagcccgtgagaggcaaagctgggcagaaatctgaggaccctgatgcagatgctcgtgctactgctggggaagctccttctcagagcttctgtcttggggcactagggtgagggctctgctctgtagaccagtcattttatatccccaaggcggaggcaggcagcccaggccagaacaggagcctcaactttgtagctgtgtgccctgcacgagtcacatggcccctctgagattaagatctaccttttttctctgaccaggtcaccagctccttgagtacagggagtgtgccttctctccccattcttcctgggctaggcacagagtattggcagaacactctgtttaactgaagccgaatgaaggcccccacttaccgggggctctgtgcctcacggtgtcactcaggtggtttacctgaatcttcacaaccatcctaggagtcacttctatgcattccctattaacagattaaaaaatcaaacaggcccagagaggttaggggacttgcccaggggcacacagctggcagtgcacagctgagatttgaacttggatctgtccctccttagcccccgccctaagcctctactcctgacctcagtgcaacaaagaacagagtagagagctctggagtgggagcttatcctgggtctacctctctaggccttggtttccccacctgctccatgctcattgctgttcgggcccctccagctcacagtgggaggctctggtaggctctgtacagcactggcttctggctggtttagcccaggcgccgagaggcaggttatctgggattaaacagctcaggcccccatggcccaggctggaattccaggcctctttgattgtgctgagcagcctctcccaatcttgtaaattgtttggcttggcctcacggagcaacctttgttattgcaaaatctcatgtttccataaagcccagggaaagaagaggctttggcggcaggttccagcgactgtctgaattctgttcttgtgaggctcccagctgtggggacgccagcccggggctgagcggcagggtggaggccgtggccctggccaggtggcccaagcctgtgtgggcaccagccagccgcagcctggtcaccagtcaacatctgagatgaaccagaactgccacagagatgcccaagggccagacggggtgagactgagatgaggaagccgggggaggtgttcccatggtcacaggcctgggacactccacagaccctgtccaagggctctcaggcagatcgggaccagccaagccctggttcctttggaagaggagaaaggaagggaaactccagcttccagagcttggattcataaacctcctgccaggcctgggcctttacaaacatttcctcatgagcaccaccagcccaccatgagcaaggcactattatttttgcactgttacagctgaggataggaaggatcagagaggttaagtaccctgtccagggtcacacagctggtcagtagaagatgttgtctgcgctgggttggatttccaaacccttcagaatcatttatgccaacattgctttctcagttggagaaagccaggtttcaacttggtgtccaggagctgcctctgcctcagtctctccaccctggatccaggccccatgagggaccaggccctctgcggttgggtttgctgacatcctgctctaggtcccccagaatgccacgccgggtactggagcccaggccaagagagaggatgggctgccttctgccccagggcaccatgggaatatctgggagcactgcttgcaaagatggatccccagaaccctggcttgctagagcgaccttctaggaccagcagcatgagcctcagttactgatgagaaaatggaggttctgagggtccggtgagttgctcaaggcccctgcgtagtgagcctccttgccaccttcatgtttcatttcaatgtgacagttacagatttgcagtcagactcttgggtctgcctcctgtctgtgcccccttggacaaaacactttccttttgtaagcctcaatttcctcgtctttgaaacggggcccacagttcctcccttttagggacctgggatggttggtcagtggaggccatataactaactgatttaccacaaagcctggcacacagtagggcctctgctttgcagtcctcaccgcctgcccccactagcggtcagtacctatagtttgatatttcactgagacacagcagtcaccgctgctgtatcttaagcacctgccgtgtgcaaggtgctccgctaggcacttggtatcatcatccgtgacagtaaccacaaccgctgttttgagccgctcgttgggcgcaattctgtgcacttcagaaacatctcaatggctgcaatgtgggtgctgtcatcaccacacccatctcacaaacgaagaaactgaggctggaaagtgacttgcccaaggcaaaaggctagcacctttggtcagtagagcggaggtcctgtccttctgagccagctcggggaccctggggcagagcctggcctgccaggagaggagggagggagcagtgaggaaggttggcgagggggttgggtgcagatgggcaaaaatgggaacctgcaggctgccaggtgcctcccagggtggagtcaatagggctgaggacccacaaactgtcttggccaaggccccgacctggactctggagtatggcggtcagcgcaggatgggtctgtgccacagacatagggaccggtctgcatgggactctgcccttgacaacgggggctcacagtccctaggtgagctggcttcactgggcagagtccctcggtcctctagctctagatactcagccattcctcctagtacccccctctcagtactcactggtgccatcttgtccaagactcactgtctcctgcctggacttaggcagtagccaacaatctctctgactccattctctggcccactgagccatccttcacatggagccaaaggatctgtgtgaaatccacatccaacagcatcgctctcccgctcaagaccctcctgtggctccctatttactttcaggctaaagtctggattccacctgccatcttgccccttctcctgccaaaggccaccctaggcttgcatagcctctcaacttttctgaaggtacccttatactctctgttttcttttcctggacttctctcttgctcctttttatctctgaggacccagaacatttgtctcctcttcctggaagccttctctgagccccagtctgggtccctgcttcctttgtgcttcctgcccatcacagccctggtcccaatgaagtgacactgtctatctgtgcctctgtcactgccaggagctcccagagagtcaggtttggttctgccttggctcagtgtctccagtgtgacccacgacagggtccagcccagagggggtctccacgcctgaagtcgcatatgtggttccaacaggcctggcttggagagccagcccgggaggcaggcagcggctggtgcctcttgagctcccccgggacacctggagcagtctggccacgtctgcaacttggcactgatgtttgattaataagcatatttggtacttgcctcgtacctctcatctccaaccctctgaacgcgtccccaactataattaattctccccacaccccaatgaagctgctcttcccacagcagataatgatgtgcgaagtcctttcagtgaaggtgttgtgattaattccactgtgtaattaggatcgtctcttcccgcctcccaggccccttccagttctccccctccctcccccaggccaacaggtggactcaaggacttcagcatggagcactggtttattattgttaccaagccacacatgagcttgctgcctcaacagcttggcttgtccttggaaaatataatgggataatttttgcagaaatgacagaggcagcagaggagcagtgagtggagcgcagccacactggaacctggtctctgcaagcttggggagtgaactgaggttgggaagggccctgggaaatcacaactttagaaagctctccctccttcaggaagcctcctttgattagtctgctcagattggcctctcacttttctgtttccctctggcctttagagcagaggcccctgttttaatagatgattgcttggtattggcctggccttcccaaagacactgagagtccccgcatcagattcaagtttccatgtctttgcatcctgcggggtgagcggaggactttgcatccagtagatgggtatgtgtggatgggtagatggatgcagcatgagtgaacagatggtagatggggggatggatggatagatgggtagggaataggtgaatggatagatgggtgaatgggtggataaatggatggatggatggatgggtaggtaattggtggatggatggatggatgggtgagtgggtgggtgagtgaatgggtgggatggctagatggatagacaatgggtagatgggcagatgggtagagggttgagtaagtgaatgggtgggccggtggatgggtgagtagatgatgggcggatggatgatgggtgaacaagtttacggcaggatgactatacaaatgagtggttgggtagatggagggctacgtggacaactgaaggacgggctgggttgataggtagatgggtaaggtggtgagtgtgagatggatgggcgaggggtgcatggctcggggggttactgggtgaatgatgggtggtgggtcttcaatagacaataacaataatggcagtaataatttacctccagctaatatttattgaggtaccaggcactgttccaagcattttacatgatgaattagcccatttaatacttgtaactcttccaggggagaatgcatggtagattgagagggggcagcttgggtgtctgtgttgtggacaggcaggcagtcaggcagacggctggatgtgcattttgtgatgggggcagatgcttgatgaaacagatagggagctgggcagcttgggaggggaggcgtgcgggaaacaggatgatgagaggtcctgaggggcaggtgagaggctgacataagagctgagtatgttttatttgcccccacctcagggagggacatttccatccactggacacccacaccaggaagctggtgtcccctttgatggccatctctgcctaggtccctcatcctaccacctcttagggctgcagccgtctaataccatccattccagatcccactgactcctgctgaattttgcctcgtaggcccccttagcagccctggcccactcccctgtcccctacacatggaagccagagggatctggccaaaatgcaatctttttttctttcttccttttttttttgagatggagtctcgctctgtcactcaggctggagtacagagctcactgcaacctccgtctcccgggttcaagcgattctcctgcctcagccttccaagtagctaggactacaggcacacgccaccacgcccggttaatttttgtgtttttagtagagacagggtttcaccatattggccagggtggtctcaatctcctgacctcgtgatccgcccgcctcagcctcccaaagtgctggaattacaggcgtgagccaccgtggccagccccagaatgcaaccttaatcctgccacctccctgcccaagctcttctgtggctcccaacccccatggacagccagccctggtctgccatgtgttacatgaccagcagctgcagacacacctgaggccctggtttccccccaacaacaggttccttcaggcttccaggtcatgactacaaggtgcctcttcccaaatgccagcccccatctcagcccattcaactcgggtcgagggaaacctcacctcctctgcagcccccgccacagccaccatcccagaatctgcgcggaggtctccagcctgaggtctggagccactgccgtgtgcaaaccttggcttctccagcccagcctcctcatctgtaaaatgagggtgagacttgttctcatctcccctggttgtcttgtcgtgaggactcaatgaggtgtgaaaagtgctgaggacacagctgacagagagtgcttcgcgaatgcctggctgtgattgttattaataaagcgcctgcttccccaccaggcagtgcatttctcaaagataagactggggcttcttcatggatgaatcatttctttcaacagatatttatggaggcccttcctccgcgcagggcagtgtcctgggtgccagggacacgctagtgcacagaggtcccccaggctcagcctaggccccaggtgacataggagagtggtgaccgaatggtggcatcacgtatatgcctaaatgacagcaaacgagacaagccaaaggaccttgggggctgaggtcccaccagctgcctgctggcctgttccctggaccacgaagggtccttgcctttcggagcagggcagactggctgcccaggtcctccatctgcatagctgagtctaagccacttctctctcagggacaggagggtgaccttgcatctcccggagcctgggccctgaggagctaagaatagtgaagggaccccaccccccgcagtgtggccagctgctgctggcatctgtggggacatggctgagcctgggcagctgttggggagggcaggggagccagagttggggagagtttccatctccaaatgtgctgagccagcactctaggctgccgtccttgcggtctcacctggagtaggggaaggcgtggaactctggctctgccacttactagcaagtgactttgaacaatctgcttgtccttgcatctctgtttcccagagaagaaagtgtcagggcccttgcttcaggatgcgggctgcctcctggcccccactctaatcctgacccccaccaggggacttgaggatggcagcccttgttgccccaggcccctgtcttcatcttcagctttgccaagcgcatgctctacccctggcaccccgtttccatatgaggaggcagcagtggctgagagctcacagcactgctctggagtctgccagcctgaggacaaatgccactgggcactctcagcctatgacctcagtcaagtcctttgcctcctagcctgcttccccctgtgtaaaatggggacaatggcccatccttggggcatggtgctgtggggtgagctatgcatgtcaatggcatgtagtgagagcttctgaagcacacagtaggcgtttggtgttgctgttatgcttccccacgggttggactgctgtggtgacttatataatagattacctctgcagagccaagctgaggaggagagaaaatggccaagttttctgcatctctgagagtcaaggctgggaccagcagggaaagctttggggtggattggaagggccccaactctcggagctgggagaaacagtctaaattggctgtccattcaggtagggagctccccattactaggggcaatcaaatataatctggtcctctgctttccagtgattcacatatacgtgggtcagtattttccctgagatttcatgatgcagttgtttatctagatcctcgtcagtagaaacactctatataaactttaggtgaaaatcaggtctgaccctgccaggctcctgccacggacccttctatgctcccattgccccagtaggcaagggaggggaggaggggaaacccaacaatgatgtccccacgcatgccacgaccccggccaccagacctggagtgggaggaaggacaaaaggccaacaccagcaggtggatgaacatggacaggtggattcaatctgggctgagggctcatccccaggggcctggagaagatgaggtgagaggcagcgatgggaacaaatcaaagcgattcatgtgccgcccagagctcctgtcacgcagtgaactcggcacaatccttggggtgttctttgatgcctgtttcatagaggaggagtcagaggctcagataagttcagagatcctcccaaggtcaactcccagctgtggagtgggaatctgagcccagctgcaaatgctactgcccatcgctccctggggggcgtctgtgaggcgtcattgcctcgctccctggccagcacaggccggttatgcagctgaatcctgggctgctgctggcctctggcacaggtggcccctgctgcactgggcaggcctgttgggttctgagctctgcggcctggggtgggcctgctgccctggagtggatgcctttcccgggttgctgtccagctcatcactcccctgccccatggctgcacagagtcctgagcggtcggcaaatcacagtgactgttttctccccccatggaccaactggaggggagcgctcaggtgtctgctgtccaggtgtccgttggctggcgcccctgacctgcggactccagagcaggtttccagcggtcggggtggcctctctcaggctccattcgctggacccctatcctataacatcctcctgaaacccagcagcctcggtggaatggaagcacagtcagtgtaatgagggcgagttcctgcatttgggtcttaccttcaaaccctcccacagtgaccaggagtaagggttcttccactcagcaaggacacagagggtgaaggctgcattccaggagttgctctaggtcactcacttggagaggcggaggcagagagagcggctgggaggtatttttctgggttacgtttgtaacttgacccttcctcttcacttgttcatctatgggctgccaagtccccaatctccctcttgagcatgaaacccatgtcaccaactgtccaggccctgaggctgcaggcaggtctgagctggaactctgcaccctatgcccagatctccaccctcaccctccagtcagatgcttccccttggctggcaccaggctctgtggttccaccttgtgaattcgtccacttccgtccactaccacactgttggcaccacagtcgctgtctaggcatcatcctgctgtctgctcccaggcccccgcctgagtaccatcagcctggctctgcccagcagcccagccagctgcccggaacgtcctgcagtgggatgatctgaccaaggtaccaggacaccagcatcagcgagatatcactagtcagggtccccagaaaggcaaaggaaggggatccccctttcccaatcctgactcctcactcacatcagagaccagagagggaggattgtggggacactctttcaggaagagagtgggcgcagtcccaccctgagtctccaaaggggaggagactgctgccagcttctcttctgcctggtgggaccggtgagagaggctcggtgttgactggaaccaggggctgcaggctcaggggaaacccaggagagagggctgggttgggcacggctattattcccagagttggcctggccgaggtgcctaagtcagtctgtggttcagacatggggctcagggctgggggagtcctgccaaaagaccctgacaataagtcttcaaggtgtgaagaccttgaagaagagactcagggactaggcgtgggagggcagcagcctggggccagccatctgctttgggaaactccgcccagtggctgcatcttgccgtctgatcagaggacgagatgggcaggcaggtggggtgggatttgtgttagaggcttggggggctgtggttcaactgatttgcctgtggcctcagggggtgtgagccccatccccatttatgcggggggctgccaggtcctgagaccacccctgccagttcctcccaggtgatggggttgcttctgaggaacaagtggcctctgtccaggagtcacggggggtggggacaccccaagttcacagacacccctcccccacactagaaagtatgaatggagacaaatttcgtcagcctggtgttcacatgcatggcacagctccccccagcccacctgcccaggggccccaaaggtctcagcctcgcacgagatcccccgactttccaaacttgtcagctttccaggtttgtcttcctggacgtgtttctgcccaggggtttctgctgtgcctgagaggtggcccagggtcatgtgacgggggtagaaactagcccagcaggcctgggtttgcctgccactgtgcttctcacttgctgtgtgacctgaggtaagttaccagagctctctgagtatgttttcctagtcaagctttggacagatgccctgtgcgggggtgagtggtcagaaaatgctgtttcccctgtctcccttccacttttgaatgtttcctcttctcagctgacatttaaaacaattcccacaggccggacgtggtggcgcacgcttctaatcccagcactttgggaggccgaggtgggctgatcacttgacgtcgggagttcgagatcagcccggccaacatggtgaaaccccatctctactaaaaatacaaaaattagccaggcatggtggcgggcgcctgtaatcccagctactcaggaggctgagacaggagaatcacctgaacccgggaggcagaggttgcagtgagccgagattataccattgcactccagcctgggtgacaagagcgagactctatctcaaaaacaaagcaaaacaaaacaccagttcccacaaatgcctgaacctccccctgaaacaatgactcatcttggggcggggggtgccataaagtatgtgatcaatttaaccctgtctcagccacagtgtcatcaccccagcccccgtcacctcactgatattaagtaggcaatgaacacggcaggtggaagcagtccctgcctgatgggggaaccagatggcgaaaccgatggcagggctgcagtgggaacctggctttgcctgcatcacgggggaagaatctgaagaattggctgagggccattgagagcctgcggctgacggagactcggggaatttaatgatgggttagttgcctgcatacaggaacctgctgacatggcattttgtgggcaattctgggaattttggtgacaagtgttcctgacccctcaacctcaccctcacccccactgtggttctcagtttctgattgggtaaggacaaacctcagtggaaactcagtcccaggtggaaggggccccagaggctctctggtcagggaggctccctttgtgtgagtgtgtgcattcacatgtgtgcgcctcttggaagagaggattccaggttctttcaaagctcagagaggtttgtgattcccagagaccaagaactgcaggtcttgttcattttacaagcaggaaaagccccggacagcctggcttgacttacaatgtggccaatttgcttgcagttgaaccattcccatagtttccttcaggaagcaggtctggcgggctgggggtggtggtgagggaggtgtcagggacatctgtcactggtgcccctcctcctggggttttcaggagtaggcccagggctggtaccccctcacgatggccccacacccagtcacagccagtggagaccacagtagaggggaggggactcctctgggcttggtcctcattggtcactacctgtggcccaggtgccctgggtacttgggcctcaggagaggaccgctttggccaccacgtccaccgcactgccacagctcccctcactgtcctcacccccctcctcagtttcctcttgatggtcagctggcccgccccctcctttcttgcagaagaggaaacacaacacagccctgtgactcttcagggctcccagttttctctgtctccgccaggctggtggggcttgctgctgggcccattggggtgagatgtgtgggccccacagccttcttcctgcctgccccgggctctgaggctcagggacctggagacccctcttttctatccgcctctaacaggatgagttgagcatggaggtttctagactgggcctcctggcagtgtctcttcccagccccagggtgctattgaagggatgcgaggcaaggagaaggattcgagccaggagccccgaggagggagctgcttgagggacctattgcttgcaggtaaattcctggttttggagaacccaggtggcccccaatcgcccccactttctgcgccttccgacaggtggcaggcggcaggtgctctgtgcatatatgtccctttttgagaattcgctctgagtcaaggtggctcatcccaaggctccttagacctcagggagcacctgcgattttacagcaagtacccatgcactctcccgcttagaccccacgacagcctggccgggtggcgatttcaactgacattttgtataagccttcagggggctgagtgacttggctgagaacacccagtgggacagcaacagagctggtgagagcactcactttccaagccttattccagcactctcttcccagccctggggaagctttcaggtcatctggtaatggcagaagcacacagccaagacgtgtgtggagaagctgcgggtaaaacccctctccccctctctattctcagcaagcagcacaagggacccctctgaaggtggggagaccacgaccctgctcaccgttcagcccctctgcagtccctacctcaccagagcaaagtcactcaccaccctctttctggaacacacttgccctaagatacccgctgggctaatgggcttgcttctgtcacattttttgtttttttgagatggagtctcactctgtcacccaggctggagtgcaatggcacgatctcagctcactgcaacctccacctcctggttcaagtgattctcctgcctcagcctcctgagtagctgggattacaggcgcccaccaccacaccgtgttaatttttgcatttttagcagagacggggtttcaccacgttggccaggctggtctcaaactcctgacttcaggtgatccgcctgcctcggcctcccaaagtgttgggattacaggcgtgagccactgcagccggccatgtcacatgttttctaaagcaccgacttttctgtaaggccttggccatctcactgttcaagatctctacctgccctccccactttctccctatcctgattcccctttccctgttctttgcagttatgtttcctgccacggctccccacctccggaacatctgtgcaatttactatcaaccacgctgtcacccatgcccctttgatctggagcttcagccacacgagggctaggtctgcatctgccttaccctctgctacgtcccagggcctggcacctctaggacctcaatactaatctgctgaatgaatgaatgaatgaatgggctcttggggaagcacctttgggatcagcagctgcccaggaccctgggaacactgggcagaccccgggcggggagttgggttctgttcccaatgagcaagtggctcatatctttgtttcatccatcagaaaccaagcctgtgccaagcacggtgacaggtctacatgggcccattaaagcctaaggaagaaggaagtactttgtggcaattcagccgaagcaaggagaaaattcagaaagattgtgattcccctttgcagtttttgccaatttcgtttcttttggtagtgagcttatggtctttatttcactatttctggggattttcttcatggctgtactcatgggtttgtgtgtgtgtgtgtgtgtgtgtgtgtgtgtgtgtgagagagagagagagagagagagagagagacggagtcttgctttgtcacccaggctggagtgcagtgtcatgatctcggctcactgcaacctccgcctcccgggttcaagtgattctcctgcctcagcctcccgagtagctggattacaggcacgtgccaccacgcctggctaatttttttgtatttttagtagagacagggtttcactatgttggccaggctggtctcgaactcctgacctcataatccacctgccttggcctcccaaagtgctgggattacaggtgtgagccaccgcgcctggcctgtccctgtgggttttatgatagcattacacagagtgatttcaataatgaagatcctgcctgtttgttcttgctagcttgggagccaggctcattacatagggaggaccagcccgggggcctggatgtgatctaggactggaatttggacatgggagcttctcctggcaccagatggggaagtgaagggaaaaaagctgggccagagaccaagttctgtgtcagggggtgcataggatgacccatctgcttctaaactcctttcccgagttctccacccacctcttcctcccccaagggacactggcctccttgctgctctggggccacgtcaaacacactcctgcttcggggtctttgcactggccgctctcactcccagagagttctgctgtccccagagatgcccgtggctgcctcgccttcctccatgcctctgctgacaggtcgttttccaagcatcctcacctcctgatgcttcccactccccttctcagctcttcccctgaggcattcattgccatctgttagattatacacgtgcttgcttatgtgcaaggagtgaacggattctgttctttagaagatggggagggaggctcgaatctgcaggccaaggaatgcagaggggcaaggacatcctaggtttctgatttgaggatctagctgggggtggagccatttgcttcaatggggcactgaggcgacacttccctgagaagcttctggtctccccacttgcattgctgcccacagtggcccccatcggccccctctgtagcagctaacccattgccagtaccaagcagtgcttggccgggccccactgattctgtggctggctcagctcacttgcagccccctggatactgccctgaacttactattaggggctgaactgtgcccccacccttcatatgttgatgttctaaacccccatccctcagaatgtgactttatttggaaataggattgttgcagcaataattagttaagataaggtcgtactggagtgtgctctaattcagtatgactgtgtccttataaaaaagggaaatttgagtccaggcgcaatggatcatgcctgtaatttcagcatttggtgaggccaaggcaggaggataacttgagtccaggagtttgagaccagcctgggtaaaatagtgagaccctcatctctacaaaagtaaaagtaaaaatattagctgggcatggtggtgcatgcctgtagttccagctactggggaggctgaggtgggaggatcatttgagcccaggaagttgaggctgcagtgaaccttgatccagccactgcactccactccagcttgggcaacagagcaagaccctgtctcaaaaaaaaaaaaaaaaaaaaaagagtggggcaggcggaccttgaagacaggaaaaacaccacatgaagaaggggaggcagagattgggatgatgcatctacaagccacagaatgccaaagattgccagccaaaccccagaaaccaggagagaggcctggaacagacctttcccttggagtcctcagaaaaactaacctgctgacaccttaatcttggacttccagcctctagaactgtgaaggaatacatttacattgttttgtttgtttgttttttgtttttgagacggagtctcactccatcacccaggctggagtgcagtggcgtgatctcagctcactgcaacctccacctcccgggttcaagtgattctcctgcctcagcctcccaagtagctgggattacagtcatgcaccaccacacctggctacttttttgtatttttagtagaggcggggtttcaccatgttggccaggctggtctcgaactcctgacctcaggtgatccacctgcctcggcctcccaaagtgctgggattataggcgtgagccaccgcatccagcccatttccatcacttgagccactcagtctgcgaaacttcgttaggacagccctaatgtcattgccaagcacaaactggccagtccccagccctcaccctgtgccctccgctgttctgacctgtctcatttgccagtggaaccttcattcctcaaataaggagtcgcttctctgagtctccagttgatcacttgaaaaattaggataataatacccacctcctacggctgtcacgctccttcaataaaatatgacagaaaatgcacctggtttgtagcgatgctcagtaattgctggcggcagtaatgtgacagttatttttactgttgtttttatgaatcgtgttattttaattagctgtcagtttccaggtctgagctggccatcctggagataaaagagcctcgtggttaggggctctgctcaccactatgtgcaggggaggaggccaccttgaggataagggaaagatctgcatgcattgtgcagacattcactcattcaccacttgttgctgcctctgtgcccacacaataccatgtctgccccaaggacgcagctacattaaaagcaattgcaatgctgcacgatcagggctctgaactcggggacttcgggggtccagagggcacctggcccagcctggaataaggtggcatgtgcaggaaggcttcttggagcacgtggcttttgaaataaacataaaaggaagagaatccaagcttctgggctcccagcttatttgctgtgtgacctcgggccagccccttgccttctctgagcctcctgaaatgaaaaaccaggagcaagagttcacaggccaccaaggcctgcccccaggagagactcagagttgtcacatcagttgagcctcagggtccccagactgtgctgtcaaagccagctgaagtaaagatactggttcccctgcaagggagtcaggcgggtcatgcttacattccagccagctcccaaagctacatgcgtgaggataagaaaagaaactccaacaaacatctgaaacatttcacggctccctgccccgctgttccagttggagagaaaacagaacgctgagccagtctcgctgacgacccacacgctgccgcggccgagcctggaccatccaatggcatcctggttcttttcattcaatttagtctctgcggttggccacctgcctgtccttttgagcactgaactcgagggataaatggggaagctggagctgggcagatgtcaccgtttctgggagttgccgctcgctcaccacctgggattttgttttccccgttggaagacagaatatcccagcaacgtgcaatccttctttgctggcaggtttaaggcctcttgtaaacaagagccaaagaaggagagagaaacacacttttgccgtgtgcctgttctgagccaggctctgtgcggcgcctgatatcctttcaatcctctgtacctattttacgaataagaaacgaagaggcagggagctgagagagcccccttgggaggtgaaattatcacttggaatgtcaagcttgctctaaaccaggacatggactgagatttcagggctgagcagtttcggggggatggttaagctggtggagggctaaggggtatgtgttaaagagaaaaattgcacctgacccgtgtttaaaaatggcaaagaagactttaccaaagatgattgtaacagcgaacagagtttgaactcaaccttgaagacaggaaggacagctggaaatttatggccaaggagcagagtgaggggcagtggatggaaaattactcagaaggactagatttgacatcaagggtagaggacttcctgctacccaggcccggtgggattcttgctaaagggacaaggacttaacgatcaagagtgggagagaggaacttgatctgagatcaagggtgggggattctctccctgaactgacttagcgggattctttgccagccaaggtcaaggcctgtgccagaagagggctcagagacacctggctaaagtttggtcgaggacggcgctctgtcacgtggagggggagacacttaggagcaggaggttgcgcaccacagtgtgaatgtccaagtctccccagggacgtggcagggcttcgaggtatcctaggaggtggtgaggggccgggacaaatgcccagagccagggggaggtggcgggggcacgctgaggatccagcaggtactggacccagaggtctggggaccccagtgtgtgtgacagacccgaggttctcagtcgaagtttggggtcagcaggggaggaaagagatgctgaattaggttggcagggtgagggcggca

SEQ ID NO: 1386 - DNA, 20001 bp, Homo sapiens
actatctcaaagtcgaaggaagtatatacaagtgtctaggacttggattaataatggtatctttggagtttaaatactttaattctaaaacaactcaataacgcataaaatatgcctttaagaatgtagaatagatgttacattcataaaagtaatattttataagtattacttgtaaagtgcttaacaaagtgcctgatacaattgaaaaattcaataaatggtagataataacctctgttttacagatgaagaaatgtaacaagggtcaaataatttacccaaaattgctagttagcaagtggcagaagctagattgaatgaaaagtccatactgaagtttcaataagaaataagcaagtttaaaatgtgtatatttagcttacaaaatctttcattcaatataaatctgttaaacaaatgaagtgaaatatatatcaaatatttgtaatttcccatcaatcaaaactcagagttcatctgaaaatgaggtgaaagtgtgacatattatataaaatgttcattgaatgaatacattaccaatcaatttttgcactaaaaatcaaagttggcgatgcacacttatttctttacctcaccccaccccccacccaacacacacataaatatcatggactaacatgaacaaataaatgatcaggaaattcctaatgatttgtggtatcagcatccgtggaaaccggaaaaggagatgatgcatccacacatcaataagattaatgagtgctatcagattgctcttgcatcctctttttcaaatttctttcagcttgtacatctagagtatcttctgctctgtataaatggcctttgtttcataaaatccatgagatttttacaacttgaaataacttctgaatcctgtgtgaatcctatgcccccttgatgtctatagattggatcaccacaataatggcagtaggtgtcagtagcaccagggctccaagcatctggaggtttccagatgccacacatgtagcaaatcactgttcagttattacaatgagatgatgttttaaatgcatagttgtttaaaagtttccttgagaactaattcccttatttaaatactttagtatttagagttccaaataaacgatcttctaccaaattagttacattttaaataatagaaactcagatagtgccccaagtagccttccagcatgttcacagaagacagtcaccattttcaaactatcatgttggagaaagagaactgtatttaaaacaaaaaggtcctggacttgagttcaagggtcatgaacagtttatttaagctcgctcagtctcagttttttatctgtcaaaataatcatttacagggttagtgaaataattatatgagataacatgatctataagctataatgttctttctagatatttattgttgttattgacaagatacattgatccaggaagtcttccttgagtcttcaagactggattaggtcttcctacatgttcctgtatcaccctgtgcttattttatatagaagatccattgtaacccaacctgcatcccctttgcagcttcagtttccatacacagcccctgcaactctctgtctagagctctctttgtccacaggaaatgttgattagctcaaacacaggaaaggttgagaattgccaggtggttatcccaggagtagccctcacccagtgactgactaaaggtggtagataaatatattagctccctccctactgaaaaaactctgagtgtattcttcagtttccaggaggaaatcaggattcaaccccagttgatttgaatggagatctgcccttaatatgggtgagcactatacaactggctggggccccaagattgaacaaaaaggcaaaggaaaggtgaattttctctctttccaggaacaacttctgctggaagtagttccagcagaacttcttctcctgcccttgaacatcagaacttcagtaatgatctctcccagtggtaataaggtgttcacaggtgttaaatcaggagaggcctcacaaagatgcagtcattagaggacttcagggtatggttgctgataatagatatgtatatcccagatctggatatgcatggttaaaatattctgtaagcctcagaaaattaggaagccagttaaagccacagttcccctttgacagcagtgatggatgagctgccagacgactgtgagagtgccaaagagagatcatagtatcaagcatcaaaagttattagcaagcatcaatgtgcattatctcctttcattttagggctagatgtatcaaaatatgctatgttggcaaacgtggtgtttttaatatatatcatctgtctacctttctataatacttggcagagaaggctatttttcatagtgagtgaaattataggttgggaactagaccaataaatgtaaatgccaattttccttcttactaaagcaagtcattcagtctatttcttttcctatctgtaaaatgaggtttatattccttcagtagatgttgaaataattaaactatacatatgtgtatatatgtatatacatgtatatatatatatatgtctgtagtttacaattaaaatatatatatatataatgtttgcatgtgtacacagtgtttagtagaatacctaatagttctaagtgtactgaaaacatatgtggtggttttggcacagtttcaactcagtggaactagaattttgcctcccagaattccctcctgtgtatggttctaagctaggattggccacaagagaaattctcacgagatttggaagatgggagtgaagcagcagccattgcccttgcaggcgctgtggcagcccacacacatcatcactgacctctgccccatttggctggcgtggagaagtgcgtagatctggagctcctccggctcccactatatctcctcctttagcttctccaggacctgggccagatgcatgtgcagctccacagtgaagggtgtcaacttctcctacagtcacccacattgtcaaaattggtggtgggtgagaaacagtcgtgggttctagttcatctttatgaattcccatttgtccttgctgtcattcacatccagcctttcttcctgatcataggtctagctgaaccatagcaacatacagataaagatcagatgcaaaacaacagcctgcatagcctgtcccaccagctcccacaattacttaaggtctaaccccaagatagatttcttattctatgtcaagagctgactgatacaacatggtagctttgtgacaagatgtgaaaatgaaattatttcagattcagttgtacctaagtggtgccatacacaaaccttaagagaataaataatgtgaggtatcctgagataaatgacagcaaaaatgattgtcattcttctgtttataatctttcagacctttccccctgcacccgagataaagtttaaacttgtttacatagcacagaagaaccttcatggtcaaagtccactctccagccaaaccggagcctccttcaattactcaactctttttctctcttctcctccctccctccccctctttctccctccctcacttcctcctttcaaaccttctcataagctctctcgtctataataccccactctcctactcaccccaaacacatacacactcctttcacctgactagctttgctgattcctcatatctcagcttataccttacttcttttagaatatctaaccatactttaagaatccggtttggaagttgttccctaagcattacctactttctaacctcctagctttccaatctcccctcttcattcacatttgtctctctaattcccagtaatctttcagaatttatctgctgctcctttctcctctctaaactacattaaattcccctgtatgagacactcactcttattgtagtccttatcacacaacattggaattagatttttactcatcatctctactagacacttaattttctggccaccatttgtggtggatgctgtgatatgctccccagatctccctttaagaataaaggacttatcctgggacttggcagaatttgagggaaaaaaagaataagaaacttagtactgtagtttctgggagagctgctggaggagagccctcggctaccagcggctttggggactgcaaaaaactgaaaactgaaaaaagtcattttgccaaggttgtaccccctcctaggagtggccagtattgatgcagatgtataaagggccagcccttcttgccccagtgcagaacatatctgaaaggtcattcttcattcttctaaactcctcatatggttgcctgaggcttccattgaaactgcatcacagtttaacctctccatctaccccatccagcttctttaccttcccttccacaggtgctgatcccatgagcaccctccaatatacctcctacacactaatatctgtctcagagtttgcttgccagggaacctaatctgtgacacccttgtccccaccaccctcagcacagggcctggaatagatagggtagtattcagtaaatactggttgacttaaaaggggaagacctcaacagtccaaggaaggaacacagctgggggactactagtcagctatcttaaatacttcaagtgatctctagaaggcttatacacttacctaccacttacaaaccttctggatgttgctacaacctcagccactggctcctttgagataatttaattatgtagggaattcagccactggctgaaggaaacaaactctggcctaggtaattcatgttactagaaaattactagcaaattaattctctaaattattagtgtgtgtacacagtgtttggtagaatacctaatagtactaagtgcactgaaaacgtgtagtggttttggcacagtttcatctccatggagctagatttagaattcccttcggtatatggttctaggttagcattggccacgagaaattctcacaagatttggaaggtggatggattctgtatgagaatccattcctaaattacaacaaaagaataggacattcaaggaagaaaaagataagaatgtattctttacattatagaagaaataaaaagttcaatctgtctgaagttcacagtgaaaagtgatagagaatgaggtaagagtcatatgggctatagagagagcggttatttgtaaaaaaaaaattgtatcaaaatactttaaatttttactgaagctaacaatggtatttatttactagtcacaatggatacttttaaatttttattccattttccaataaaatcattaaatttatgttttttaattactccctctaaatctaatctactcccaaagattgagttatcttcacagcacttcaggctcagatactttcttacttgtcacttaacagaagaaattagttctgttaataaggggaaggtaggaaatatgatagatgagtgaagacaaaattttgttgtgctgtctaagagaaaccaatatgaaatagtctgattctaaatattgtgaatcctgttgaaagataagtgcttgcaagataacttgacattcttctaagaatgtatagacgcttactttgaaaattttagccatgtagttgcatccagttagataaacagcattcatgttatctacatcgtagcagttaccacaatctgaaattattttattactatgggatagggggtgagattggggagatgttgataaaggacacaaaatttcacttagaaataagttcaagagatctgtagtacaagatgatggctaaagtgtattatattcttgaaaactgctaagaaagtagattttaagtattctcactacaaaaaaagataagtatgtgaggtaatatgtatgttaattacatcaatttggccagtccagaatgtatacatattttaaaacaactttctgtgcacaataaatatgtacaatttttattagtcaatttaaaaatgaaataaaattatcttgtgattatttaattatttatatttgtctcccttcctagaatgttaattccatgggggcagaaatcacgtttttattgttgttgtagctgatgttgttaccccattttatctccagcacttagcatagcacctctctcacagttggcactaaatcattaattggggaataaaaatgaataagtgatgaataattgtgaagtgaaaaaaagccattctggagtatttgaattacattggtagcaaccttagagatactgataaaactgagctagagccattgaagccctggtttaaaccactgagcactccttatctggtagaatggcgaaaagtaacatttgtttacttctcttatgctatttgtgtgcctgtatcaaaatgctatcccatcaacaggatagggttgaggaaagagagaataaactataaattaaacaattttgtgagttagggttctttggtgacaattaacagaaaaacttcttgactaacttaagtaaagggaaattagattaccaaaacaaaattgcaacaaaaccaaaccaacaaaaagcactgttgggattttgactggaacacgttgaatatatagaccaatttgagaaaagcaaacatgttgactatactgaaaccctaatctttgaaaaggtatctcttcattaagaagtcctctataatgtatttcaataaatttttatatatttctccttaaaggtgctgcatgtcttttgttaaatttatttctagatttttctacacacacatacatacatgcacgtgtgtgtcaatatttaatattgttttaaaattacatcttttactggttatttgctggacacatgaaaattaagttgaacaaggtatattgattttatggcatatattatgcaggcttaggtgtgtaaaaagccaccccagattcaatggcttgtgttcttgtgcctctgttatgagaggaagatacatacaatcttccacatccatgagacatgagtttgtttgttcactgtcttgtacagagtataaatctgagtaactggtgggtggatatgactctccaggcaagttgtaacactgattcctaagccctgctctaagtaaacagaaacatagacaattgcatttttgaaactggccacaataatatctcccatttctcatgctcttccacattgtaaccttaccacaaactcattaaaaggtggtgcctatgttccttcctctcaaatttcggtggcctatgactgctttgatgaataacagatggcagcagtgacactctgtgacttctgaggataggtcataaaagatgacacagtttctgccttgttcagcaaaacactcacatttaaagctctgagccagcctataaaaagtccagctaccccaaggcctccatgcttagcaggaaggcaagctctgctccatggaaaatctgcacacagatgctcaagttgagctgcatagccaaggttccagccagaagccagcaccaacatccagacgtgcaagggaagaagccatctttggaagtagattgtccagctcccagccatttgagttttcccagctgaatgtccagacatcatgaagcaaagaaatctgtttccaccatgcccttattagattgccaacccagagaatttgaaggcataatgaaattgttattttatatcactaagtttgtgatagactgctatacaatagtaaacggaacagaggtttaaccaaatcattttgagacctccagtaatttctaaattctgctgcaaagtgaattacatcagagcagggctatacagaacactactatctaaatcccagtcctttagttggaggttgagaggactcacttgttctcagaatgatgaataattcagaaccaaagcttgtccacttggggctgtcttttttcagatctctgtttttccggtcaaggccataacatctttctagctacagtggaatacaggatcaagggagcttgcagaaaagacagccgtgctcactacatctttaaggaattgatacagccagactttaaactgagcctggttcagttactttagcttcactttgggtttcctgaaagtattctttgctcagctgcttttgtaattttcttttttaccagggaaacttgagatagaaacacacacacacacacatactcacatgggtggggtggagagggggagggctgttaaaaacacccattgtgttgaataattaattgctccccaaaatacaattcagctgacagaagctgaactgaattcaaaccttctattgtcttccatttttccatgttgactgctccttttggggccctaaagcagcattcttctctgacagcaacaaggagaaaaacatccacaagcctccatgttacatttctctctttcaaaggaattgcttagaatattaccctagtaaattcagaagattttctttaaagtgttatttcttatttccaacatgagtaattcacacaactataaaagcccagctcactataaaggatgctcatgtattaaaaagacattatttgaagtctgaagttactgagtggggtgtggaagggagccaaaagaatcttttggggggaaatgtgtttcctgtctttgcctgcacttgtttgttttcactttggaaggaagatgcaagtgtcccagcttcactgtaaggactttaccttacaggcaagaattctagctatcagaaccctagcattggagcacttattcaaaaggcctctgattgggaaatataagcatccccatgaaagataagagcatcagttccttgcatagcctctgacaaccatagttccctcttggtggaataagagaccatcccaggtttttcagagatctacttatttctaaaaatcaaacccaggtaacttttttttttccatgggaatgttccagcagcttacagctttgcattgaaagctttcaaatctcacagaaggatgctttgaggtgggagtgaggcaggagaataggatctgaaggcagggagcctaaggccaattcatgctgacttcctagaactaaatctaaaggaaaatctcaactttccatgcccaaggaacaaaaagaccagaggctactcccgttgaatgcccccatcccccgccacctttcctttgtggcagatgaaaaattgaaactacctctgatcagtcccttcccacaaccaatcagtctggtcatgcaggccaagtctttatttgcatgggagtataactttgtaacttcacttcggcctctgattggtcaccttccacaaccagacgtttgcatagggtataactttgtaacttcacttcagcctgtgatcggccactttccacaaccaatcagactgattgcaggacactacttcatttacatagggtgtacaccaagtaaccaatgggaaacctcctagagggtctttaaacctcagaaaattctataaccaggctcttgagctcctatgcttggacctgctcccaccctatggagtgtacgttcgttttcaataaatctctgctttctttgcttcattctttccttgctttgttcacatgttttgtccaactctttgttcaagacaccaagaacctggacaccctccactggtaacaggagaattactacaaaaggaaccatagtaccaggaaactcatgtcctgtagagacagtgactccatatggtagctagtctccaaagatgtcccccagaaatctctccctcctctgttttcccatgctattcctgcatgcaaaggcaaaacttataccaccactccttgaatctgtgctggattgtctattgctttgagcaacagaatgatgagaaagtggcattttgatacatctcagacctcttcttccctcaaagatgtttgagctgccgtggaaaaaatccaggttatcctgctggagaaaaggatgagacaccaagtgtagagaaaggtgcaaaacatccaatttttataagcttatgtgcatcattaaattattaaacttgggccaggcattgtgggtcacaactataattccagcactttgggaggctgaggtgggagaattgcttgaggtcagaagttcaagactagcctgggcaacatagcaagacctcatctctacaaaaaaagtaaaacttaaccgagtgtggaggcacatgcctgtagtcccagctacttgggagcccgaggcaggaggatctcctgagtccaggaattggaggttgcagtgagcttggatcgtgccactacactccagcctgaagaacagagcaagacctcatctctactaagtaaataaataaatgaatattattgaactttcctgaaactcaatttccgaatttgtaaaaatgaagataaatacctattttgcaatgttgtaaaaatcaaataaaattattctccctcccttttttaaggtttattgagaacctaccatgttccaggcattgtggatacaacaataaataaattatgaattttattttacaagagcgcacagtctagaagaagacacatacaaaatccttgagctttgttctggagtaagctttgaaaatgtaacaataatagaatgatccttgagttgagcagggcactaaaaagctataaaactgaaaaatacgattcttgtccacaagaatctcttaatatagttaaaattctagagttaacatataaatcatgaatactgactacatatcattgtatgctaaactttacaattgctgttcaagaaattttaaaactagaaaatgcagtgtggagcagtcttgcagtgcatggtggaggtgagagtgagccaagcatcaggaaggccactaggatttgcagagggggcgatgtgggaagctcatatttctggctggaaaacaacttaggcaaactgatgactgcagtagaactgtccataggactttctgccacagtggaaatgttctacatcagtgctgtccagtgcagtagccgctggccacatgtggctattgcatactcaatatgtggccagtgtgactgaggaattgattttttaattcatttaattttaatcattttttatttaaatatccacaaatgtctagtggctactatgtttgatggcacatgcccgaaagacttagggaaaaccagccatgatatttttccattgctttcagagatgtcacccaagttcagctgacatattgtgactatttatctgccactactctactccaactaaggtataaaacagactgaaaaatagtgcttctttgcaacataattccagggcaacttcatgggctgccaaagtctattcactcatcctcatcttgaaccagtcatttctcctttcaaaggactgtggttccctgtaaaatccagagaagagggaggggaaaaacaacagccagcagtgaaaaagacaatgacagaaagtgcatttaccagaaagttttagtatttttcagtttccttggttacaagtaatagaataaggtgggaggaggaaatatttgaagcacaaatcactggaataagaaaccagacaaggtttcaaagctcagagtaacatctagggcactagcaaagcagagtggagaaataagccaattattctgatggtccaaggcaaaatgaaatctttcacctggaaatcaccagataattccaaatgaaaggattttttttggttgttgttttctgttgagttgagctgatagttactagagtttattttcttaatatactcttcagtatagctatacaaagaaaagttcagatgaacttattaggagctggagcctgactatgatgaatctgatggactcctcatcccttgtggaattaaaccaagggtaaataggaaaaatagaaaagaatagagtacacacaaatccagaagccctgaggaatataagattaggggtttttcccccctaagagacttgcggtgcggcttcacaactagctgtcaatactgggtttaaggcatgagttgcagtggggagaaggaggtcgtaatttcaggagcagcagcagcagcagcagcagctcccatcaacattagtgcttatgtttgcattagtaggcatgggctggatgttctgtcaggatttctcctatttctctcacagtaggcctaagaaaaagtctcattatagtgtgggaaacatgcatatgaatgtcctgattcagggaaatgtctctaaaggaaaagtacattcattaaattagtgagggagagaaataaaccaaactataagaaataaacttcagaatcagtttagatgtattactatgaattctaaatgcttctctgccaaagacccagcagaccttaaaaaaatcagagtagatgctatagtatattacgctagagaaaactctcaagtgatgaattaactttggtgtaaggcagctgagaccagctttgctctccagcaggttaaaaggctgatacagtgttgaagcgctctctgagtgtgcattagacacaaaaggatccccccactgttcaacatattgtgctggagcaatggaatttccagaaatagattcgccctaatcacctttcttatattttctagggctgaacctgaactttcaaggggcttgacttggcttttatttttcactcttcttttcatagatgatttaatttcccagtgttgctttcagatcagatgttattttgggcacaactcaaagaaagccatccatatacattgagaagcagtgggtggcagaatgaagttcagcttcattcctgattaagcaaagaggcacatcagggggtgcaggagaaggtggagggagaaaaaaaccactaaaggctccaaggtcattgaaaagtacaagtatttgactacacaggatgatgctggctgatgctcagagtctactaagtctcaaggggggacttgcagttttttaaataccagagctattgttcacatttactactatcacaaaccatgtatttaattattacaccttgatatttaaaattttaacaatagaaactgtataaaatcacaatggaaaaaacatcatttgatataattaaggaatttttgtcattaaaatctagcttaaccttctcctggtaacataactattctccaatcctagttcacaacctaccctcaaaacctcttcctgacctcctctttctcttcctccctctgacctgccagaaataaagcaggaaatatatgttgaacccaagaacctgtacaaaactatttgcctaactgtttcacttaattttcctcataagactatgagagaaaagtggggctcatgtagataaataacttgcccaaaaatagacagttcacaatcagatctatctgattacaaaatttacactcaaaaaaagttctgtttgaccacaaagagagcagagcatttatcttaaattcaatgtttgaagatttcaatgtaatgatgtgaggagggaaagcctgatatttccagtgacttcacactaaggcatctcaagtcattattttcctctttgttggttccaaagtgtattggggaagcaatctgattttaatatactcgctagggagtacatttttaaaacatgttggtgtcttcaacttgctgaaagagagtgggaattattttttgtcatcccttctttctttgaaattctaattcattagtaaccacctgggacagcacccacacacacttcagcatcacatgtcagcgggcccctcccctacaagcttctaacttggatcctaggcaaagaaaatgtgtttgtgcttagggaaaaaaataacagcaacaacaaaagaaaaaaaaccatagcaccccacccacacatctgtttcatggggctgaaatcaaatgaggcaaataactgaaagcaggattaatatattcagagaactagaggtatttttaattgattttccacctacttcatacattccaatgaaagcatttgaggtctcattgaagatgtcttaaaacaaataaaaaattaaaaagcatttaagcccaaaatgtatacctactttgttgtcctatcttatcctgtcttccagagaaacttatggagataagaaacttatgcccacgcttgactctacttggtagcaggatcacagactgaagattaaagacaattctcttgttttgagccatttttaataagatcaaatatgacaccaaaatgctataatctagggcatgaggggaaattacatggataatttttatcatttttaatgatctctattttgtcatttttaaatgatcactttccttatatttttaaaggttgttttatctagaaagaaaatgaaaagcctgcatgttaaaaaccatagacaaaaaaaaatctgatgtgctcctatttcagacattgctaggaaaaaaatattttttaaaggcttcattggatccatacagttctcaggctcctttgcctttaggaattcaaagcttgattattaataaggtgtagtggaaatcccccagagcagaaggcaggctatatgaattctaaatctcagcaagtccattcagtagtgggatgaccttgggcagatcatttaacctctccagttcttaatgagctttttagaaaaaggaaagatacactggacaccctctaaagacctcttacagtcctaactgtgctcaaaatctaaagcaatatgccatatttaaactgtaatgaatgttgctgctggaggtaattaggtatctttggggattgcaagatggtaaatggatgcctgtttctctcaaaggatattattcccccatctgccaattcccttaggccaggataataatcattagtcccttctgagtttgttcttgtctcttttactgaacatatagtttacaaatgatgtacactcacttatcccttgctgataacaaagcacacattatcctctgttctctcagcatttctatagtcaaatagtcatcacttttaacctgctgaaaaacaccacagaacctcaaaagaactcaaaaacagagtggttagataggatatcataaaggctatagtagcaaatgtctggagaaggtctgttctatacatggttgccaaaaaaagcctctttgaggaagagagatttgagctaagatgtgttagataaaaaataaaacatgaaaaaaggcaagaaaataacttcccaagtgggaggaacagcatgtacaaaggtcctgaggtgggaaagagattgccatattccaggaacttaaagtaggccagtgtgatcagctggggggaaaactacacaaaatgaggttaaagagctaggaaggtctggttcatacatgcggcaggctgtgctaaggtgtactgctaagtgaagtgcgagccattgcacaagggtataacatgatctgatctaagtatttgaaagagaaagtactctggctgctgtatgggaaacaggtgttcaaggtgtgaggcagcaagaactaaagcagaaataaatatgggaagagttttgcaatagttcaaaaaatagttggctggactatgatggtggcaatgaagacagagtgcatgaagttgagatgtattttggaagtagaaacaatgggacttgttaatggattcaatgtggtcagggaggtgtgtggaggagggtagttgaaagatacaatgattactgtttagattctggcagctcaagtaccaaagagatggggaatttaatgagatggaagaaagcaaatagccctgcttttacagcacaagcttggttttcttctagaaaaaaaaaacctattgtaaaagcaagactatctgtgtacagatgatatttaaaccgtgaaactagatgagctcacctagggagagaatgtagacaggagagagtacctgtaaccaatgtcagaggattgtaatgttttcaacagagaatgagaaggaacagagatgtaagaggagaaccaagagagggtgttatcatggagcccaagaacagagaatatttcaagaggtaaaagagtaaactgggtctaatgctactcagaagtttggtagaatgaaacctgaaaagtgaccattggaaatagcaacctggtgaccttaacaaaagcaattttcatggcatgccaggcaagtcagcttcagtgtgttgaggaatgaatgggagctgaaagcaaaggcaacccacacacacaattccttttgtttgttttaatttaatattttaataggaaatacattaatagaactcaaaattcaaacagtgctaaagagtatgcagaaagaggattccctcccacacggatccctcagccccactgttcttcttgaggtattttgtgcataagtaagccatattcttgtctttttatttctttttttaatacaaatgactgtgacctatatagacagttccatgccttgcttttttcacctaaaaacatatcttagatcactttatatcactatatagtttcctttatcattttcaacttttgtagtgctttattgaatgaaactaatagtttagtctctacttgactttctgtcattgcaaaccgtgctgaaacaaatatccttgtgtatatgtccttttgtaaatgtgcaggtgtctctacaaaagaaacttaaaagtggaattgctgtgtcaaagagtgtgttccttagttattttgataataactgtcaaattcatctccacaaaggttgtacatccacgagctgtgtatgagactatgtgttccccacacttttgccaaaacaatatagcaaacttttttttctaactttcaggctcaggatgtacatgtgcagttccgttacatgggtaaaatgtgtgttgctgaggtttggtgtagacccatgtagtgagcataataccagatgggtagtttttcaacctcaccccatctccccaggtcttgggactcctagttcagatgcacactgtagtcttaactccagagcgccatgcggctgagagccacagggaacatctgttttgcgactctcggcgagagtggtttcagagcataagttcatcactcaaactgatacagatagctttaaggtctctctgttctcccatgtggcagtgctgctcttcttgtaaaggagggtagggcccacctttgggcccctgcaagtgggtgttggttgtggtggtggtcagctggttggctccgccagctctcaggccccagggaaactggtcaggtgccagcatagtcggaatggggcaggtagttccccagttcccaggcccccatatatcccactggacagcaagtatgagtcccgaagggactaaaccctagcccagagttcaagtgctggctgtcatggggaagcagacaagctgctccccaggtcacccgccaaactctctggcaggggcaggaagaacgcttaggttgtgggagcccaaggaatatcacaggcctgtgggggtgggttttcagaaaggctccgggcctcgggtgaaatgatgaggcaggggcagggtggctgtgccatggacctttcactgaggagggccggaaccctcacgcaaaaggtgccaagcgttgtctgttccctctgggagttttgccccagaggaaggcagagccacaattacataacggtgctcaggcgcgggcagggttgctgcggggaagtccaaatctggagcctcccgggctagcagcagcaggggtagaggccgcacgtctgccagtcgggcagtaccctggggaattgctgtgcctgcttgcagtgttcaagggggtgggttgctgcgctggaagccccaggggagccttacctggcaaagaggagcggggcagtctgaccactcctccgcatgacagctgcggcctctgtgggggctctggcacctggtcggctgttcagggatccatggcctgtggggctccacgtgggtttgaggggtgcctctgaaaaaactccacgtggctctctgtgtgggtctagatgcccaaggtggtgaggggagttctcccgggcccaggatggcaaaggtccgcgtgggaagtgtggatcccccggggcctctcactcaatcgccccttccccaccgtcaggagcttcccacagctccaccgtcccagttgggtggcttcccggctttgctcctctctgttctctgggtcccctcgctttcttggtgaatcccaacgtggtctcctagaggatccacttgaagagctaatattttgtcgccactttgtttccactccgctgctttctagtcggccatctcgaacctcacgaattttttgatcttggtcaatctgacagatgagtaaggcttctcagtgtatcttaagtgttatattgacattttcattgtattcttaaatgtcttgatattttttgcatgactaggtaatggatttcttcatctctttcagtaactttcagtagatacaaactaatgttggccactctggattttttttcctaggacacggtatgctctcaaagtatttataatagattcaagatctttctcgtttctgtaaaattgtctgggatgaggtgtgatggctcacacctgtaatcccagcacttcgggaggctaaggtgcgaagatcactttgagactagcctaggcgacattagtgagaccctgtccctacaaatgattttttttttaattagctgagcatggtagctgtgcttttattctcagctgttcaggagtctgaggcaggaggattgactgaggctaggagttcaaggctgcagtgagctgtgatttcaccactgcactccagcctgggcagcacagcaagaccctgtctcaaaaaaaaatggaagttcaatctttaaatatttgttttattttataattttggtttcttctttggagactcaagttttgcaaatattgtctctcctaagcctgctcatccattcctcttttttcctgacacttcactgattatttttctttccttcttacttgtcttgttcttctcttttatatcacttaatgttttgatctgactctacttccctgtttgcaacttccaatttcaattaatctctttaatgaagaattactattagttcactttttctagaactatgatacctcatgtttcctcttcttacgcagtctcatcctcttctacttgagttattttttctttagtttatgctcttataacataaatgagaggatttcatgatttttcataattcatgaagaaatgtttacatataattttctcctttttacacaaatattcagagcagttttattcataattgtaacaatatgggggcaacccaaaatttctttgatgggttaatggttaaataaaccctcctgggagaagcagtaacatccataaaggtgtggaagttgaagcaattgatcagagtagactgccttccactgctcccacagcctgtgttactgatgtgactgttatggaacagaagaaaattttgaacgacactcctctcatttctatgattttaatcttttgaaatttattgataaatattcttcatccctagcaatcttcttgccttaagtctattttgtctggtagtagtataaacacactaaaatttctactagtatatatggcttattatttttcattcttttactttcaacttttttgtgcccttatatttaaaatatggcttttttaggcaacatacaggacttttgaaatctgatttaaccattgttttgccttgaattggagtacttattcaattttcattaaatgtaactactgatgtagcatggctgacgtcttccatcttgctgtttgttctctatttgccccatctgttctatattcctttttctcccctttctcgtcttctgctatactcattaggcatttttacttccattttcccctttattaaacaattagttatatgtttttaatggttatagctgttgcaacatgccttacataccataaggttaattcgacttcttcctttccaatttggatacactttattt

SEQ ID NO: 1387 - DNA, 64083 bp, Homo sapiens
tgctgctttgaaaacaaaggaagcctcaggccacgtagcaaagaaatggagaccccaggcctgcaatcataagcgactgaattctgctcacaaccctaatgagcacctccgggaaagagcccagcctgccaacacctcgattttgccttgtaagcccctaagcagaaaatacagttgaggcactctctgcccagacttgcagtgcacagaaactgtgatgctaaatggatgttgcttgaagctgctcagttggtggcactttgttacagcagcaatggaaaatgaatactggaggtaacactgtctctcccagtgacaggtccggctccaggagctggaccccagtgaccgtgttacagtctaggcttaaggcccccctcactcccaacctcacctgtgcagagagggaaggaaaagtgccatgtcaacccccagtaagggaaaggaggatgggagacccctagcctgcagcacatccaaagccctgctagaaaaatactgagaaatgttagacattgagctaccacaggacccaggattacaactcctgggtatctacccaaggcaaatgaaaacatgtgtccccagaaaaatttgcacacaatgttcatagcagcattatttataataattgagaaatgggaatagcccaaatgcccatcagctaatgaatagataaacaaaatatggcatagctatacaatggaatattatatggccctaaaaagtaatgaagaagccagacataaaaggctttgtgtgattccatttccagacagaaagcagattagtagttgctgcaggctggcgggagggaggaatggaaagtggctgctaacaggaacacggtttattctgggggcaatgaaagtgttctaaacttagatgtgatgatggatgtacaactgcgtgaatatactaaaaagcattgaatggcattgaatggttcatcttaaatgggtgaattttatagtgcgtgaattatatagataaagatgtaaaagatttgtttaacatcaataaagatgtaaaaaaaaaaatgttgagtttcttgggcagccagttcaactgcccagccctgccctctaggaggaaaacgagtactccctgcccacccttcaccattcccacatctgaagtgggcattggggatctcagttctctagtggccagttcctaatggtgcagattctagactgcagagattgcttgggcttggaaataacatcacagactttttcaaaaaaatttttgtcttgtttttgtgttttgttttgctttttgtttgcttgtttgtttgtttttaccagacttgaagttttggggcagtacaactccatcaaaaaaattttgacctcaagtgatctgcccatttcagcctcccaaagtgctgggattacaggcatgaaccaccgcacccagcctccatcaaaaatgtattaggcatttccctgtctttatttttaaatatatatatattgtagtctgggcatggtggttcacacctgtaatcctagcactttgggaggctgaagagggaggcttgcttgagcccaggagttcaagaccagcctgggcaacatagcaagagctcttctctactaaaaataaaaattaaaaaaaattagccaggctatgtggtacatgcctgtagtcctagctactcaggaggctgaggcaggaggattgcttgagcccaagagttcaagattgcagtgagctatgagtacaccactgcactccagtctgggcaacagagccaaacactgtctcaaaaaaaaattacatatatatatatatatatatatatatatatagagagagagagagagagagagagagagagatgtgtgtgtatatacatatatatacttcaggcacacaaaaaattagatcgaataatataaaaaacacctatatacccaacacctagcttatatattaagtattaaaatgtcaccaatacagttgaagcaggaatacagttgaaattgaaaatgtagttaaaatacaattatagttgtagttgaaatgtactacatgctagatagaatgtacaactttcttatgactttggggtgggaggtgattttctgagcattgcacagaaagcagaagctgtaaaaagtgaatgcttccttggattccttggactatataaaaatttcaacttctgcctggtgaagatactgtaaacaagtttaaaagataaacaaatagatcgagagaatatttgcaatgtatacagtgaatcaatatctacaatatgcaaagtgttcccaaaaaaaataagaaaaagaaaaaaaaaccagtagcaaaataggcaattcacacaggaagaaatatagtggtcaattaagttatgaaaagtatgcccttattcataatcaaataaatgaaaacttaaaacaatgatgagataccatttttcagttagcagactggcaaaaaaaaaattcatgcaaataacaagagcaataatatccatccaacggcaagcctacaggaaagtaagcattcttctacactattggcaggaatataaattgaagcaacctttttgggagagcaattgcctggaatctatgttaatgtaaattgtacatacccacaatcacacccttagtaatacagtgttcagaaatactagcacttaagaaaataaatgaaaaaacaataaaagcattagaaacatcttttttttttttttttttttttgagatggagtctcactctgtcgcccaggctggagtgcagtggtgcgatctcggctcactgcaacctccgcctcccaggttcatgccattctcctgcctcagccttccgagtagctgggactacaggtacccaccaccacgcctggctaatttgttatatttttagtagagacagggtttcaccgtgttagacaggatggtctctatctcctgaccttgtgatccgcctgcctcggcctcccaaagtgctgggattacagacgtgagccaccacgcctggccagaaacatctttaagtccataaatatggactgattaaatagatgttgattataaccacaacatggcttttcatccacctttttaaataattggttcatttatgtgctgatagggaatgttttccacaatttctttacaagtcactccacagctacttcagtgggggagcagggagtgtatatatgggaactctctgtaccttcttcccaattttgcagagaacctaaaactgctctaaaaaaattgagtatttaaaatcaaattttagaataatagacatattatggccccattcatattttaaaaccgtgtatgatattatgtgtatatatatatatatatatatatgtccattctttagggttacctatttgtctaaaagtggcatcatttgaattgtaataacaaacattatatttcttttgtaatctaaaaaaacaccttaaaaatctaataaagaatgtattataaggctgggcacagtggctaacccctgtaatcccagcagtttgggaggccaaggtgggcagatcacttgaggtcaggagttcaagaccaacatggcaaaacctcgtctctactaaaaatacaaaaattagctagatgtggtggtgcacgcctataatcccagctacttgggaggctaaggcaaaagaattacttcaacccaggaggcagaggttgtagtaagccaagatggtgccattacactccagcctgggcaacagagagagactttgtctaaaaacacaacaaaaaaagaatgtattataagtatgtgattaaaataataaaaatgaagtctattttataattcttcttttatagattgtgccttttgtgtcttatttttaaaatctttgcttaacccaatgtcactaagatttttttcctatgttttctcccagactttgagagttttcgcgcttatgtttagatctataatctcttttggttaattttttagaatgttgcaagataaaggttagattttttttttaccataatgatatttacttgtttgagcaccatatgtctaaatagcaatattttcccccattgaagtaccttggtatttttgtaaaaaatcaattggccatataagtgtgagtatttttggtttcttcttcattgatcaggagtttgagaccagcctgatttatggtttatccttacaccaataccacaacatctcgattactatagctttctagaaaggtttgaaagcagattgtgttatctttctgaacttcatctttttccaagattattttggctcttctaggtcctttgccattctatataaattttttaattaagctgtccatttctcttcttaataaagatgtgggattttgatttggattgcaatgaatgtatagatcaatttgaggataattatcatcttaacaatatgggggcttccagttcatgcatgtgggtatatctctccatttagttagatctccaatttccctttgtgaggtttcatagttttgagtgtacagatcttgcacatcttttgctcaatttattcctaagtgttttatctttagtgatattgtaaactgagttattctttaaattccactttccaattgctcattgatagtatatagaaatatgatggatttctatatgttggtttttatcctaaaaacttgctatattcacttattacttctagctttccctagcccccattccttaagagttttctgtgcatgcaatcatgctgtctaaaaataaagacaattttacatctttcttttctatacttatgccatttatttctttttcttgccttattacattggctaggaccttcagtataaatgttgcctagaagctgtgagagatgtctgcaccttgttcctaatcttagtattgagcctttcatcattgaggatcatgttaactgtaggttcttcatggatgtccttcattaaactgaggacactcccttctgttcctcttttgctgagaattcttattgggaatcagtgttaaatctgattgaatgctttatctgcatctttcaaaataatcatatggtttccacctcttattgtattaatgtaatgaatttctttgatttttggatattgaatcaactttgcctccctagaataagccctacctggtaatgatgttatctttttcatatattgctgtattcaatttgttaatgttttgttgaagacattttcatttatgttcatgagggatttgggttcctagttttcttttcttgtgatgctcttgtctgtttttgctatcaggataatacttacctcataaagttggttgagaggtatttcttcctcttatatttcctgaaatagttcatgtaggatggtgatgatgatgatgatgatgatgactatgagacagggttcatctctgtcacccaggctggagtacagtggcactaacatggctcactgcagcccgggtgcaagcgattcccctgccccagcctcccaagtagctgggactgcaggtgcacaccaccaagcctggctaattttttattttttttagagatgggatttcaacatgttgcccaggctggtctcaagctcctaggctcaagcgatccccccccacttcagcctcccaaagtgctgggattataggcctgagccaccgcacctggccaggatttatattattttttccttaatgttttcttgtggaaaggttttaaatgacaaaatcaatttctttaattgatagagaactattcaaaagttctatttcttctggaccagttttggcaattcatgtctttcaaggcaattgtccattttatctaggtagccaaatttattggcacaaatttgttcacattttcttataatcctttaaatgcctgtaggatctctaatgatgtctcttctttcattcttgatattggtaatttgtatcttttttcttgagcaatcaagttgtaggcttatcaattttattgttcatttagaagaaccagattttggattcactgattttatctatgatttctctattgtctatttcatagatttctgttcattttacttcttttttcaacttattttgttctctttttctgatttcttaatgttggaactcagatcaagcctcaaacttggaaaaaatacttgaaaaaaatagatatctggtaagggcttgtatccagaatttagtttttctaaaaacaaatctcctacagttcaataataggacatgctatctgattttttctttagtggacagatgatttgaacagccacttcataaaagaagatgtatgaatgcccagtaagaacatgacaagatactcaacatcacttgtctttaaggaactgcaaattaaaggcactatatactcacaaaaaatggctaaagttaaaaagactgacaataacaagcgttgaagaccatgtggagcaactgtaactttcatacactgtgggaatgcaaactggtatagctactttggaaaacagtatggcagtgttttataatattaaccataatttatcatgttactcagcaaatccactcctagccatagatacataagggaaatgaaaacatgtccatgcaaagacttctatgcaagtgtttatggcagcattattcataataaccccaaacaggaagtagcccatatggcccccagctgggggaatgggtaagcaaatttgtggtatatccatagtatgaattattactcagcaataaaaaggaataaaatattaaatcacacaatgacaagaatcaatttcaaaaacatgctaaagaaaagaagtcaaacacaaaagatcatatattgtatggttctttttaatgaaattctagaaaatgcaaaataaagcactcaatcatcaaaattcatccaacactacaattttattgtatgtaatttatatctcaataaagttattttaaaaaataagtatttttaaaacccaataaaggagtttttctttttctttttaaaatattttaattttttaatttttttagttcaccttacagtgcagtatgctttcccagtttttgctgggagaaaagttggttgattggagaatctcagtgcatgctcttgtcctcccactgctgcaagctcaaactgagctattagcagtaattgcagcaggcagaataatggctgcctcacagatgctcctgtcatatcaccagaacctgtgactatgtcacctcacatgccaaagggactttgcagatgcgatcaaattaaggatcttgatatggggagatgatcatgagttatccagatgggcaccatgcaatcacaagggttcccataagagggaggcagaagtggggtcagaggagacagccacatgaggctggaagcagagactggagaaaagatagaggaagggggcatgagccaggcaggcaggcagctactagaagctgaaaaaggaaaggagtcaatcttcctctcagagcctgcagaaggaaccagccccgccccccaccccaacaccttgactttaggacttctggcctccagaactgcaggataataaatttgcattgttttaagccaccatggtaatttgttaaagttaagaacaggaaactaacacagcaataaaagggaatgaactactgatacatgcaacaacatggatgcacctcagttgcactgcgtgaaggaagccaggatcgaaggtcacatactgtgtggttctgtttatatgacattctagcaaaactacagagacagggacaagattatctaggcccatcccagatcagtagaaccactcaggtgttcctatggactcattgcaataacagatggttgtcactttaggccaccaagccttggagtggtttcttacgcagcagtgctaactgatagagcagggagaaagtcctgcaacggtgccaggggctcggtgttgagaccaactttggagagaaggttgcaggagcagaggcagtgagagtgactgaggctcaggagtaggttagggtgggagccagtctggtccttcttcccttagcaaaggttgctagaggccactatctctgttgccagagtctctgtcctggagtacttgcccagttgcctccacccacctgggccacactccatccctgatgccccccagggttccgtggccagtcctgcctcctgagagcctgccttcccccacggtagatttccttctccatctcagcctctcctcatgcctggagcacctgctgagcccaaggggggccaggctgggccaggcttctgtgcccgctccttggcagcacacagccctatgcagtgcagtgccaaaaccatatgtctctgggggctgcctcaactggaggagctgcctccacacatccacccttaggagggtagcctcccagggaacatgatcagcagcttcctgatgggccgggggtttgcagggcagagaggcagccagctctggggaagccctggggctgagccaggcagttgagggagggggcagtgggctattggactagaattttaaaactgatattcattgacttcttactattctgagtgtcttatgtctatgatctcatgtaatccccacaaaatgagtcaggtaccattttatgcagattttacatatgaggaaactgaggcacagagaggttgaataacttgcccaataatatcacacaactatcatgagcagagccagaacacgaatccagctgcagaacaggtgctcccagccatgacatccacctgcctgaagcccccacattttaggtctgatgtgcttccggctccagcacatccatcacaccccatatgacaagacagcggaaggcagccagggacaaggttaacttcctgaccagcaagtggctgagacaggcagtgtggaagagggctgaggatccttaggttcaagtcctgatactgccatttactcactgcaagaccttagccagatggtctcactgccttgtgcctcagtttccccagcagtgatggtggttttatgtgtccattgggctaggctacagtctcagttcttcaatcaaatacaagtctgagtgttgccataaaggtatttcacaggtgggattaaagtagttcataatctgttgacttttaagtaaagcagattagcctaatcactggggtgggctggactccatcatttgaaaagccttaagggcagagctgaggctttccagaagttccatctgtggacagcaacttcgtgccatccctccctactcccacccccatctcataagccaattccttgcgataaacatcttgctgtagatttccccctggttctgcttctctggttgaaccctggccgagagactgtctgaaagtggtggacactacagcctgcgccacaggatggtagtgaaggtgaaatgcgctcatatacataaggtgtttaaaatcacgcctggtacaaagtgagctccaaataacctttacagcacaaaatggctacaaaacacattttataatgaccttggtggccaggccctgctctgtgccaccagttccacagcaggctggctccagcagggtgcagaacacagctccctcaggcagccccatcctggagcgaccccgggagtacaaataaagtgtggtgaggggcttccaggtgcaagaagcttcctgtgccccatttctcagagcacagggtctgtccagggccccaggctgccccttacccccagccgagacaaccagggaacagggctctcacgatcctcccacctgtccctgcttcctgcttctcctccctgcgctgcaggggccactcatggagcacccagtgtgcatcgtatcttagcttggatgtcacctcttcagagagacctgcccaaccacccttcctagaatcacagcccccagggcacagcatggtacaaactcacttttaacttattactgtgaaaaatttcaaacctacacaaaagtagagagaatgagatactccctaccatgccctctgagacagtagacagaagaatgccccctcaaaggtgtccacatcctaatcctagaacctgggaatatgtcactttacatggcaaaagggacttagcaggtgtgactaaggttaagaatcttgagatgggaggtgatcctggattatccagtagtaaaatgtgcattgtggggagtctgtctttatgagattgctctttttatttttctgtattttaaaacttttgcaaactgaaacggtggtgggggtggggaggagatgtttgtgccagacccagtgctgcatactgggaggatggggctggataaggtggagattaggacctgcaagggctcatagttttggtgaatggcatgttggacaccttgaccctctcagctgccgcaatttcatgaatttcctggtgccacagagaaatcaattattttgaagtcagacaaatctgggttcagattctgagactgtcatttactggccatgtgatttttccataagacaaataattgctctgaacttcagtgtccacctctgtaaaatgggataatactactaatttacagaaaatctgtgtataatacaaactataatagcaagtccctggcactgagaaagtcctggataaggaatagctactgttgtgaatagagcttttaagtccattgccccttctccagctcctatccccagaggatcttcctgcagatgtggggagctgggtggtgtggagacaaacagtcggacatcagcatcagagagacctgggttcaaatcccatcttcaccccttagtaaccatgtgactttgggtgagtcactcaaacaatatctgctccctgctgagtagcggagatcgaagtgaaaatgtgtgtgttttgcggtgcccgacacatggtaggcctcataaatgatggtcattgtgacactgaggactggctcctgcttcccagcccactgggaagaagctcagtctagcctagattaatcctcctcatgattccatgctggggcagaggctgctcactcttcctcaatatccatttccttcttctttccttagtagcaggacaaagcctacatgcccagcctcctttgcacttcagagtggacacaagattcgttgaaccgaggggaaataagcaaaagttacacctgaacctccaggtcatacctttaagggatagtggtgtgtctccatcccttctccccttcctactggctggaatgaagatgtgatggcagaagctggtgtagccaccttgggttagaaggtaaaaggctcagatgaaaggggcagaggcacaagatagaaagaacctgggtccatgttcattgtggacacacaaatcagtctaggaccaccaagttgggcttttccttgagagagacatagacattgcttttgtttaagccactgtcatttctggatctttgtcatagccactgaacttgagtactatattgagtaggcatggacatgtgccacagttgtggccactggacatgggaggtggtcttctggggagctttgggggaattttttcctcttcctaaaggtgcacaggaagggaccctgccttcacctggcttttggacatggctgtgatatgaatcctggagtcgatgcagccaccttctgaccttgaagagccaatcctagggaggaaaatgaacctgccaaggctggcagaggggaagatggacagtcaaggggttcttgatgatgtcccccgtccactgtttaaaccagcccaagaatgcatgcctccagactccctgtgacatgagagaaccactctttgatgcataagccagaagtcgccaggctttctgttacttgcggcagaaataacaggatattttgggagcctcctcaggggctcatgcgtcctcaacaaaactgccccgggctgaatgctgaagggagcttcaggacttggattcttcctgccttggtgcaaggggctgggactcttctgggaccgccaatcctcatcatgtctctcagcaaccaggcatgccgagagctgggaaagctctactgctcccaacatcaggattcatcaggcatccgttaggctgtatgtggactcaattctctgagcctctgtttccttatctgcagaataagttcatatatataacagtctctcttacaagatctttgtgtgaatcaaatcagataatggattattttctaagcttgttgtatgtcagtttaccctactagaagagtgatttcttgagggcaaatgaatggccatgatatctatataatccacagacctgtgacatggccttacaccagccagatactcaggaaatgtttacaggggaatgttaggcatgacctatcagggcactgcatttctctcaaggcacagcgattggttcagagatggccaaacccaagtcactcaagccaattaaagtgagtcccaggacttttgcttggacagctggaaaagatattaattttcccacttacctctttaacagtggggagtatgaagccagaactgctgcagttagtttgccacaccagaggagaggcttcctgagaatggagtcatgcagagcaagcagaccccagagacagatagaaagcaaacaaggttttcacagcatcatttaagcccccggatcaaaccatacctaaagaccacccttagattttttttctgttacatgcagcaacacctcctttctccccaacctttttttttattttaaagagagtttggatccctactgctgcaatgaataacagaagggcatttggtaaatgattcaaccctagacatgtgtttgaaatcactcctgccggataggtgagcaaaactgctgacggctagtcccggttttgctccgcctagacatggtgtggtaaaggcaaacctttgctatgggagttataaggcaatcagaaggtttcctctttccaaaaatgtcctagacatcttccaaagtagagtaattcacaagtgtttataccaaaggcaaactctccatccaatgttctatctcctgagtggggatgtcctcgccagaaagcctcagttagacgctggtctttcacacttgtctgtaatggccaaccactctctccttcagcccgacagtgcctttcttggtttaagccagtgcaaacaatgctccaacacgggcagccggatgggagaggctggacgggaagaagctggaagagactggcttcaatggggagcagagcatctgccggttggaatcctacgtgtttgcttttgtttagttgggcccctctgtgcccctgtggtccgagtacttgctaggtgggctccctccggagcaggctccaagaggtctattgaagagccctcaaaatcagcatctggttgcaggaacaaggaggcaggattgagcagagggagaagttgggctgtggccaccacagaggctcagccaatctcatgaggctgagcagggaacctgtgagactcaccacagtgctcactacactcccaactcccacagcaacttttgcaggaatgggaatgtccccagtcctctctccgcccttggctccttttccccagagattcctcacttctggttgggaacaccacaaagccatgtggatcaccctcatccctggaacgatggggcccaaatgcctatggacaaatgtgtggacaaatgccccccgggctctgatgctctctggagacagccaagccctaagcactggccattcacagctctctgtggtgagagacgcacaggctggtgcagtttcctgtctcttcctgcatgagggtgaactctccctctctcctctcaggtggctatgggtccacctgtcctccggactagctctggagccccccctcccatgcctcctggaacaatgctgagcttcccccgtgtgtctgcaggtcctttccaggcttgtggcctgtgtgggatccagcctgtggactgagggtggctgtctccctccagtgggacttcggggcctatctccacctgatccccaagaggatggtgtcctctcagaggacagtggggccccaggagcctcctgcgctgcccagctgggggtgcatgcagggcctggggagaggcggtgtcctgtggaaggctcctgggaggcgctgtcagagtctcactctcagacttcctcccgccgctgtgggaggcctggctgtgcccgcgacgtgtgtggcacagcgggctgggttgcaaaatatatctggcatggcagttggtgaagtagttatgcaaccaccaccaacttacggaaaccaccgagcgatgtgccttgctagcagaggtgcctggcttggccacgctggccacagactctggttccgtgttggcagtgtgaaaagtggcccaggctgtggagtgtcgagaaccatgacaggtcttccctgaagtcaccctgggagcacatgacccacgagaccccggcagagctggcatcttctcctccaaggatctccttcccattctacagaatccagaagacagcctcatctggttatcagcagccgatcctccctaggaggcccacctcagaggggacaggcccagcccggggcaagggtctcgaggagataactgcaaaagggaggtggctggaggcccaccctttgaggagctgaggtggctcagcctggagaagggcagtgctgggcaccctctcaccatccctctaaggaagcaagcggcctacagggcacagatggcaacactggggcttgtggggaactcccacagaggaagattccagctccatatccacaagaacttcctcctgcccagagcttccacagatgagatggaatgctgagaaggatgtcctaaagggaacccccagcatgtctgtgcccctggcctgaaagtgctcttcacccatcaggctgctcagcagagtgaggagaggaattctgagaccaagcagggaacccggtgaggaggaggcccctcccctccccactgagtccctccagctcccctgagcctccacgtcacctgccccagggagaagtgggctgagcacgggctttgaagccaaacccacctggagctgatcccagctcggccacctaccctctgtgtggccctgcacaagtcccttcccttctctgagcctctgaggattacatgccataacggacaggaagtccatgctcaggagaaggaaagttcatgttatttcaagctcacacctggctgccttcagccctcaggctgaaaccttgcacattagactcaccacctcctgggctgataaaatggacatcaggttggaatgcatccttctagatgttttcatatgccctatgtacatatgtatgcatagccagaggagggttatgatgctttgcacagtactcggtaccttgctttttgcactcaaagatttgtcttagagacctattcatgctaataaatagagccactcattctccttaactactacattatttagtgaatggctacatcatggtttacttagctcttcctctatgattggacactgacgttattcctattgtttcgctcttacaaacaatggctatcttcactgatgccttctggtgtgtatacacaaaggctactttgagaatacccaaagaaggggaatctctatgtcagacaggatgcacatttgtcagtttaatagatacaggccagtgaaaattcattagtaaataaatacaattttcaattcagccgcgttaacaccaaaggcaagtttcaggtgttgtgggtttttttcttaattgttaagttgcctttaaaattccacaatgaatgcatgctccttgtaaaaaatagatgcccatattttttaagcgcaatttccacccttcctagcccattcccttctcccagttgtgaacagtggacacatatttgctatgcatttgcaaacacacaaatcaatacgaatttttttacataaatgagatatagatagacagatataaaacttgattttctactttactgacatatcttggacatctttccatgttagtagattcatatctggatctttacttttaatggttacatagaattttattataagaaggactataataaatttactcagtctcttattgatagacattttcattcttttccatcttttgctatcataaacgaaattgcagtgaacgttcttgcacatgcatctttgtaagctttgaaaatacattgaactaaagcaaacaaaactaatcctggaaacgttgacagacaggtgttagaagacagaaattcactacactttggggaaaggctggtgactaggaagggatcccagagggtctctgggatcctaggatggtctaattctggttacaagggtgtgttctgtttctgaaaattcaccagttgtgagttgtgcgtttttctatatgtattttacttttctgtatgtatgttacatgtaaaattttactttaacatggtaagtgaaaaatatatatatataagtttttcagaggaaatgtgagagatgactgaaactctataacaagttaaattcttttttattttaattttagtttcagggggtacatgtgcaggtttgtttcaaggtatatttcagccgggtgcaatggctcaaacctgtaatcctggcactttgggagaccaaggcaggaagatcccttgaggccaggagttcaagaccagcttgggcaacatggtaaaaccccatgtctaccaaaaaaaatttttaaaaatagccaggcatggtggtgtgcacctggaggctgaggtgggaggactgcatgagcccaggaggtcaaaacaacagggagccatgactgtgccactgtactccagcctgggcaacagagcaagaccttgtctcaaaaaaaaaaaaaaaaaagaggggagggtatatttcatgatgctggagttagggcttctgttgatcctgtcacccagagagtgaacatagtattcaatagggagatttttagtccttgcccttctccctccctccctccttttggagtccccagtgtctgttctcattttcatgtccatgtgtacccaagatttagcttccacctgtaagtgagaacatgaggtatttggctttctatttctgcattaattcatttatgataatagcttccagctgcagccatgttgctgcaaaggacatgattttgttcttttttatggcttcatagtgttccatggtgtacatgtgccacattttctttatccaatccactgctgatggattgactttcaagttgattttatgactttcctattgtgaataggacaagttaaatcctaatttatgcacaacttatatactgaacatggttatacagtttgcttgcagacgttgaataagtaaccaggggaagcatagggtggaatggaactaaatgtgcttagggacttataattccagggagttcagaaaaactttcctgaggaactaatgtttaagctgaaacctaaaagataatgaagcctgtttcttctgtcctttttcttgtgttttcaatcacaccccatcttctcatttgcctggtgatttttaattgcgtgccagacattgtctatgaaaacctatagagataatataaagttctgaatgatggtatctttctttagaaaggatttacatttgcttctagagaacagccagggtagaaacattaccagtcttcgatcatctcaatccaatcgtggagataattcaaaactaagcatcaatcccaatgagagatggcctatttctgattcactcttgcttggtttttaataacagttctattgagatatgattcacacactatacaattcacccattcaaagtgcaaaattcagtggtgcttaatatattcatggatttatgcaagcatttctaaatcaattttagaatgttttcatagctcaaaaaaaaaattcacatcctttaactatcacccctcttatcacccccatatgccctacctctaagcaaccactaatctactttctgtccctataatttgcctattctagacattcaataaaaatgggattatattctttttgtgactagctctttttgtggtctttctgtgactagctctttcacttagcataatgttttcaagttttatccaagtagtaacaagcgccagtattcctttctctttatgactgaataatattctagtctatggctatatcacattttatttacccatttatcagttgatggacatttgggttgtttctaccttttggatattatgaatagtgcttctgtgaacatttgtgtacaagttttaatgtaaacatgtgtttccacttctcttgggtagatacccaagagtaaaatttctaagtcatagggtaactccacgcttgaccatttgaagaactgccagactgttttctaaagtgactgtaccattttatattcccaccagcactgtatgagggtcccaatttctccatatcctcatcaacacttgttatttgactttttattatagctatcctagtggatgtgaatcaatgtgtcctggttttgatttgcatttccctgataactaatgatgttgatcattttttcacatgtttattggacattggtatatcttctttggagaaatgccattttgaaatggccaaaggacttgaatttgtttatttggtttttgtttttgtttttgttcttgttttgtttttgttcttgttcttgttcttgttttttgagacggagtctcaccctgtcgcccaggctggagtgcagtggtgcgatcttggctcactgcaatctccacttcccgggttcaagaaatttctacctcaggctcccaagttgctgggattacaggtgcccaccaccatgcctggctaatttttgtatttttagtagagatggggtttcaccgtcttggctaggctgatcttgaactcctgacctcgtgatataccctcattggcctcccaaagtgctgggattacaggcatgagccaccacgcccagctgtttatttggttttttaaaaaattattgagttgtaagatttttaaaaatatttttagatacaagtcctttatcagatacataatttgaaaatattttattccattctgtgggttgtcttttcactttcttgatggtatcttttgaagcacaaaagtttttaatttcgacaaatttctaatttttctatttatttcttttgttgcttatgcttttggtgttcagtctaagaatcattgccaaatctgaggtcttgaagatttactcctatatttcttctaatagttttatagttttaggtctatttttttctttgacagctttagggtacaagtggattttggttatatggataaactgtatggaagtgaatatttaggtctttgatccattttgagtcaattttttatatggtgtaaggtaagggtccaacttctttccttcgcatatgtctacccagttgtcccagtaccactggttgaaaaaactattctttccccatcttggcaacattgtgaaaaatcagtttgccaccaatgcatgggtttaattctagatttttattctattccattggtctttctggctatccttatgctagtaccacactgtcttgattactgttgctttgtagtactttttttcttttttttttttagatggagtctcactctctcaccaggctggagtgcagtggcatgatctcggctcactgcaacctccacctcctgggttggagcaattttcctgcctcagcctcccaagtagctggaactacaggtgtgcgccaccatacccagctaatttttgtatttttagtagagacggagtttcaccgggttggccaggatggtctcgatctcttgacctcgtgattcacctgcctcggcctcccaaagtgctgggattacatgtgtaagccaccacacccggcctgtagagagttttaaaatcaggacgtgtaagtcctcctactttgttcttctttttaagaattgtttttggctattcttgatcccccacaattccatatgaatcttagaaccagattttctattttaccattaaaagaattcagctgtgattctgacagagactttgttgaatctgtacatcaatttggggaatattgtcattttaacaatattaagacttctgatccatgcatatgggatgttcttccatttatttctatttcctttttttttttttttttttttttttttttttttttttttgagatgtagcttcgctcttgttgcccaggctggagtgcaatggctcaatctcggctgactgcaacctctgtctcttgggttcaagtaattctcctgcctcagcctcccaagcagctgagattataggcatgcaccaccatgcctggctaattatttctattttctttagattgcttaataaaaatgttttgtagttttcagattatatgttttacacttctttagttaagtttatcactaaggattttaggtttttggtgctatttgctattgaattgttttcttactttcatttttagattgttcattgcaagtgtatagaaatacaattgacttttatatattgatcttgtattttacaaccatgcttaattcatttattagctctaatactttttctagtgagttaggattttctgtttataatattatgtcttctgtgaatagagataattttacttctttcttatcaatatgaatgcattatatttcttttaattgaccaactagcctgctagaacctctagtataatgttaaatagaagtggcaagagtgggtatccttgccttgtgtctgatcctagagaaaaagtatccagtctttcatgattcagtatgatgttagcagtaggtgttttgtagatgtcctttatcaggttgaggaagttcccttctactacaggtttgatgaatgtttttattatgaaatgttgttggattttgtcaaatgcttttttctgcatctattgagatgatcatttggttttgtccttcattctgttgatatggtgtattgcactgattgatttttaaatgttgactaaccttacattcttgaataaataccccttggttatagtgtataatttgttatatatgttgctggattgagtctgccagtattttgtgtaggagttttgcattcataatcatgagatattggtctgtagttttcttctcgtgtaatttttttgtctggttttggtatcagtgtactgctggcatcatagaaagagttgggaattgttctctcatcttctttttttttggagaaaaagttgtgaaattctttaaatttttggtagaattcaccagaagtcatctggccctgagtttctctttgggagtagttctgttgttgttgtttactaactcaatctttttgcttgttacaggtctattcagattgtttgtttcttcttgaattagttttggtagtttgtgcctttctaggaatttgcccacttcatctaggttacctaattttattagcatataattgatcacagttttcatttataatcatttttatttctgtaagttcagtagtaacattccctcattcattcctgattctaaatattgagtcttttctgtcttttacttattcagtccagctaaaagtctattttacatgaattagtatagccaatccagccctcttgtgtttgctgtttgcataatatatccttttccaattctttttttcagtctatttgtatctgtaactccaaattgtggctcctttagacaaggtatagttgggtcttgtttgtttttcccgtgtgacaatctctgacttttgactagattgtttaatccatttacatataatgttattattgatataatcggatctacttctgctattttacttttttttctctgtctactgtcttttttgttcctctattcctactttactccttccctttgcattaaatattttctaatttagcctttaaatttatgtaatgttattttcaatatattcttttgaggtatttccttagtggttgatctagggcttaccatcaacttcagatttttactaacttaactccaatgagatgttactcctaatagctctattcacttttcccccttttttacagtattattgttatttttatatattacatttatgaatgctataaacccaacattacagtgttataattattactttacataacttcaggtctcaaagaagctgtgaggagaaaagagagcaactatgtatttatagtttttattatattagccatgttatttatcattccttgttctcttaaaaaaacaattgaagttctgctttggtacttttcctggactatgccctctttacctctttctcagactaatctcaatctgtatcctttccctgtgataaactgtaactgtgaatttaacagcttttagtgagttctgtgagtctttccagtgaactgtcaaaacttggggaccccccaaacttgcaattaatattaaaagtaagggcagtctcatgtggactgtgtcccctctgacttcgcacttggcctaaactgcacaaataattcccaaggttagtgtttgaaacttgttctaactcccaagacggcccctcccagctgtctcttccccatttctattcagcaaagtagccagcttgcagtttagcctgtttctccactgaatctagcaacatccccctcatggcctttcaccacaacctccactgattttcagagcgctcttaggcttgaatttctccaaactctgttgcatataaagtcagttcctttggggagagatttggagttttctattttatggcttgcttctctctctgggcaaaatctctgagccacggttctggtaattggggcaggaacaatggcatgctctcctctcagtgacaccccagttttaggagctgagcactcagtggagagggggaggcagcagccccaggtctcctcagcttacctttcccagtgtggatccttcatcccacaggacagggggtgagcagtaggggccccaggattctcggtggttctgtgccctgtactgagcctttgtcctacaagtggggggtgctgggcagaaggaagcctccacttctgagatgcacttgcccggaatttagcctcagcaacaggtagctgtgggcagaatgagaaaaatctgaagatctgcccctcccaggaggataacccttcaacagaaagctgcagggtggcgggggaaggagtcctgtgtcctcgactatactagcacgatgcagggtttcactatctcactgagctgggagcaaggggaaagagggtcttggtccaaataccacagactgagttttaggagatttgcttgaataaatatttcttcatttgccatatgttcttaggaccatttccagagtgattgttttagaataactttttaccagttttgattgcagctgggtccatagagctcctcatgctgtcaggccagaagtacaaacttgcttccagggtgtagtgccctttggggtctgaacctggggattttatcaaggcccctgcttctgggcagtttctgacttccgtttcttatcttctcaggaccatgaatctgtcaagagttgtttacggccgggcgcagtggctcacgcctgtaatcccagcactttgggaggcccaggcaggctgatcacttgaggtcaggagttcaagaccagcctggccaacatggtgaaaccccgtctctactgaaaaaataaaaaaattagccaagcatggtggtgcatgcctgtaaccccagctacttgggaagctgaggcaggagaattacttgaactcaggaggcgaaggttgcagtgagccgagatcatgccactgcactccagcctggatgcagagccaaactgtctcaaaaaaaaaaaaaaaaaaaaaagagttcggtttacttcttaacttttcagcctttcagaatcagccttgagagggaaatggtaccaaatgccagactcccatctgccagacacccatctctgggtgtcccttctatccttagtggctgatctagggcttaccatcaacttcagatctcgctctgttgccaggctggagtgcagtggcaccatcttggctcactgcaacctccgcctcccgagttcaagcaattctcctgcctcagtctcccgagaagctgggactacacagatttttactaacttaactccaattatcttagccctgcaatctctcattgctatagtagctcttcaaagagattttaaaaaatatttagtccagattttctagttattctcagaggaagggttggtctggaaaacttaatctgccattgatggaggtaggaactgaagtggctaacagtgaagatggagaggaagatgagcagaagaaacacttaggaggtgaaaccaagagaccctactgattgattggatacaggaaaaagaaagataacaggatgatgtgaagatttttatctgatagcttcatagttggtggaacccttcacagagacagggacccgggaagaggaagcaagcatgatgagaaggagagatcatgagttcaactctgggtattccaaatttgagatgcctgtgtggcattacactgttcaggaaatgatgcagtatcgaggtctgaagtacaggagaggagcctacacttcagaccaagatttgaaaattatcaacaaagaggtaaagactgaagccacaggatggacaagagtgggctgagagagaggaggaaccagggaagatcattggaaaacactgactttgaggtgatagaagagacagttggcctcagagaaggagtgggcatgaaatcaggaggaatttaggagagtacaaccagtagaagaaatcaaaggagaagggtgggatccacacatcgagtgcttcaggtggcccaagcagaggagaggagtaccttccagagaagtttcaatggcagtgggagcagaatccaggtggccaaggctgagggagtgggcaggcagttaaagaagcagaagacaggagtgtagacaactcttttcagaagttcctaagaggagtctgcaggagatctctattctgctaagccatctaccttaagtgtgctgcatttctgcagcctacactggttgtcttggctttcccacctccccctcaagctcttgaaagaattccatggggatggattagttgttgaatctagtcatttctccttttgcctcaatctatttgtccactcagcatcatcaaacaccattaaccacccatctctacctctggtccaagataacactgtggtaatttttaaacatagatgcaaattccttgacactatctccctttgatccctccccttgagtctggacaggtttttgatcatttctgtcatggtggtggaaattatactatgtgacattcaaggctaggtcataaaggtcatgcagcttctgccttgcatgatgcattccaattcatttgtactgttgcatgtaccaatagctctatcccttttattgctgtatagtgttccattgcatggataaaccacagtgtgttcatccattcatcagttgacaggaaattgtgttgctttcagtcttgggcagtatgaataaagcatctctaactgttctcatataggtctttgtgtggacatacgttttcatttggaatttgccctctctgctctctccttttccccatcctgctgcctgacatgcagatatgatggcagaactctagctgccatcttgagccatgggatgaagaccttcatctaggatggcagagtgttgagctgggaagagcctgggtccctagcgctgtgcaaatccacagcagccgtggattgtccacctatggacttctcaaaaataagaaatacattcccatcttatttaaaccaccattattttgagattgtctattacttgcagaaaatctaattttaacttaccattgtgaaaactccttttggggagatggtataagcttaagttacatggagtcagtttgcattgcttgcaaacaagaaccccaattgaaagctttcctgtgatgttagagaagatgcacatcttcttcaccagatgtggtcttgtctgttcttggcaaatagatccaaagcagtcaattcatgaccatgaacatgctgaggattgtaagaggaagatgaatggcacctggccccatctgtgggtccattcctgctggcatttgtgagccactaacctatccaaacttggggctgcccaatcctctgggcttcatgttatgtgagaaaataattatcattgacaaagacttatagttgatcatctattacatgcaatggacagaaaccaatgaacacattccctctcctaacaccttctcatagcactcaaggactttaccatccgagtcccccacctttgcagcttcatgttggcttctatatttgtccactttcctgactacaaagttctttcatgtactttgtcccatgaaattctcccaagatccctctcgcttaggattttttttaatccccattttacaggtggggaaatcaaggcaaggcaaagttaagactcaaccaagatgccccaactagtaagtggcagagcctctgctcgcttcacctaggcctgttaacaccacgtcttgagttctagtcacgactctaagctgcctttctcatgaacctatgcccctaatataggctttatttttgcccgccacactgtgcctatcctcaaacattgccgagaaaagccctttcctcatctccactttcacaaatctcctctatcctgaattcagtgtaggctcaaacatcacttcaaaaataagacagtaccagatgttcttggcctcagtgattggatcgttggtgatcacaagacacacactagaccaattagagtaaattctggaacttttgctggaatcactggaaaatttaaaagtccttttttcccacaaagtagctcaactggagagacaagagcctgagagtactggggacttctgtgccaccttgtaagaagcccacatagaggaaagtagagacggtaatggagagagactggttttattgtctctctctagtgccttataattcccagttacatcagccacaccaacctgtttttgcctgtgtatttgggttgcaatcctgtcatttgaagtcaatagttcagactaacaaaagcccctaatttacaacaccttccctcgttcatttagttttttttttttcaacaaatggtatgaagcatttatcgtgcaccaagtgctagccatggtctattaaacagatacagtctctgatttcctcagattcacagcctcatggggaagacagacatcaaccaagaggaagcaccaattaacgtataataatgaggcaaagtggaaagtgttctgaagtggccattccatgcaagtacctggggaacctgagctaaattgaaagcagaggcaaggccacatcctggccttgatccaggatctggccagatcccaggcacattggaggggcacatttagtattctgagcttcatcctaagagccatgagaagtactgctgtaggaagatgtttttaaaattatcaattttttgcccaaagacttccttcaagccctcttttacctcctcccctattcaggtcatcaggtcatttctgtactcattgcctcagggagggacacgtcaaagcaggaagcagagggaaaaaatgagtctcttcatggctttggcttattccctcctcaagaagcagtctgctgaggagcagcccagggctggcagggcagctcttctccacaagagtatctgtctagcccctggtggcgcaatgatcacctccatgtttgccctccagcccaggggaaggagaatgaggactccagaggaaacagcttattggggctcatcacttctcctggaatcttattagcccaagcttaatcacatgaccacgctgattacaaagaggctgggaaacgtggtcactagctgggtggccatgtacataactaaaatttggagtgtcttattacttgttaatattttttgttgaggtataattcacttaccataaattcaccttaaaaacttctgtgattcaatcatcttgaatatatccagattttgcaaccatcactcctatctaataccactgttctaatttcagaatatttttatcaccccataaagaatctctgtgctccttagcagtcactcctcactcaccctatcccccaacctctggaaagctctcatctacattctgtctctatgggtttgcctttgctggacatttcatgtaaatgcaattatacatgcagccttctgtgtctgacttctttcacgtaacatattttattgtttatctatggcatagcatacatcagtgcttcactcttgactcctttttttttttcagtaacaatgttggcatggctgtttttgtttctgctcagccccagcctggtcctcaccatctccttccacctgcccattaactcctgaaagttcctccatgaggagatccacaaggacctgctagtgatgggtgcgtacgagatctccaacaagtctgggggtgctggcagcctgcacagccacctcaaggtcacagattctgctggccacattctctactccaaagaggatgcaaccaaagggaaatttgcctttatcctggaagattatgacatgtttgaagtgtgatttgagagcaaggaaacagggtggatacctgatcaattcgtaatcctagacatgaagcatggagtagaggcagaaaagaaattacaaggagattacaaaagtcgagaagcttaaaccgttatagatggagctgcaatgcctagaagacctgtcagaatctattgttaatgattttgctacgtgaagaagagagagatgtgtagtactaatgaatcaacaaacacttgagccctgtacttcagtgtctctttaatgttctgcttcattggactagccacctggcaggttttctacctgtgttgcttcttcaaggccaagatgtcgattgagtaatgaacgaagtgcactctcctcccaccttgtatctcaggcagcagaacatcactgggcatcctaccaaaagcaccatcaaaatgcactggagccctcttgccagaactgatctcttggtgggggaggacatgggtaccacctacccaacaagtcaatgagagatttctttttagctggtagtatttggacttgttttgcaacaataggaccagtattagagtcacctatgaccaaaaataagggttaccaaataatgccaaagccaggatttgtgctgggtttccttgtgcgatctgtttgaaccaagttttctttccttctcccgctttctcggcagcttgaatttccactctagttcttttacccagattggtatggccatgttgaacttgtttccttctggttgtcttctttgggtttccttgtgaaaacacccttaactttccttttgcctttagctgaaatgtttacatagcttctggtgatatcttctcataattttatgtctcttaaaaggttgacggatgtgacacttcaaaaagtgagctttgaactgaagataactcttaaagaaaatatcattttagacaattaaaatatttatgctccaaaaagatataatttacatatcactttttcactgtttttatggctaaataaaattacatggcatcaacattccatactttgcccatccattcatcagttggtggacatttggattgtttatatcctttagctattaggaataatgctgctttgaacataatgtaagtttttgtttgaacatttgttttcagttctcttggatatatacctaggagcagaagatgggtcatatggtagcttcatgtttaacttttcaagaaactgcctgcttgtttccaaaatggctgcaccatcttacattccccagaagcaacgcaagagggttccaatgcttcaacatcctcaccattgctatcgtccatctttattacagccaccctagcggatgtaaagtggtgtctcactgtagctttgatgtgcattttctgatgcacatcattttactgatgctgagcattatttcatgtgtttgttgccacttgtctatcttctttggagaaatgcccattcaagtcttttgtccatttaaaaaattggattatttgtctttttattgttgagtttaaggagttctttatatattctagacactagaccttcatcagagatatgacttgcaaatattttctcccattccgcggcttgtcttttcattttattgatagtgtttttgaaacacgaagttttaaatattgatgaagtacaatttatctggctttcctcccctttggttgcttgtgcttttggtgtcatatctacgaatgcttgcctagctcagagatttgtgcctatgcttttttctaagcagcagtgatccaatcaaagccacattgcaaaaaagacccgcagctgactgtggtgtggccagtaaatggagagggcaaaggagcaggtatggggaggtcagtgaggacactgtggcagtggtcagggaaacagacagacagatgatagcagcttggtccagagtggtggcagtaggaatggaaagaattgggcagatttctgaattattaaggaagacaaacctcagaactgagtcttccatctccaccgtccacccacgttactcctcctcagtctcctaacacactttttttaaaaagaaaaaactactgaggtgtattttacatgtcataaaactcatccatttcaagtatagaattcaacaacttgtggtaacaaatacaatatgtggccttttgtgactggcttctttcaattagcttaatgttttcaaggttcatcatgttggagcatgtaaatgggcttcattccttttcatagctgcataatgtttcattatgccacatactgtttatccattcatcagttgatgagcatttgggttgtttctactctttgactattatgaataatgctgctaagaacattaatgtacaagtttctgtgtggacatatgctttcatttctcttattttcattttattccacctaggagtggaattgctgggttgtatggtagtgttatgtttaactgtttgagaaaccaccaaattatttttgttttctttttaagatgaggtctcgctatgttgcccaggctggtcttgaactcctggcctcaagtgatcctcccacctcagcatcccaaagcgctgggattacaggcatgaggcatgccaccattacacacccggccagccaccaaattattttccaaagcagctacaccaccttacattcccaccagcagtgtatgagcattcccatctctctacaccctcgacagtaattttggtctgtctaatttactatagccattctagtgggtaagaactcacacacacttctgcttcttcttggcaatgcatccatgtggagccatgctggggctttccaggactggctgactttcacctccacttgtagaaagaagggacatatctggcaatactgtagccccagagcttggtccagggcctagaactaaggatgcacccctgaatggctcctggatggataatgggctgggtgagggaggtacatggtgagggggatactggtttcagtgcaattggagctcagtgatatctgagaagtctgggggctgggaggggagatgtgcatatctaaggacaccacccaccgtatgatagggtatagaagaggcagggtaacctgtgtagaaaatcagctcccagcctcctgctcggaccttaccctcaaggaatgcagaaccccctgtgtatccctttctcctcctgatatagtttagatatttatccccaccaaatcttcatgttgaattgtaatcccagtgttgcagatggggcctggtgggaggagttttggtcatgggggtggacccctcatggcttggtgctgtcctcactgtagtaagttctcacaagatctaattgtttaggtgtgtgccacctaccccctcccactctctctctcttttgctcctgcttttgctatatgaggtacctgatcctgcttcaccgtccaccatgactgtaagcttcttgaggcctccccagaagccaagcagatgccagcaccatgcttgtacagcctgcagaaccatgaaccaattaaacctcttttctttataaattacccagtctcaggtatttctttataacaatgcaagaaaagctgaatatacctccccactggagcactagccccagacctgtcacaagtcagatgtcacatatgcttatagagacaagaaagaggacatggaagtcccagaggggctgcaggtagtatcctggcaagggttgagctctggaattgggatgtctggtttgcccccctcatcttcttggggctaggtgagctccttggtatccctagttggcattcccaattggaatctgcagactcacattgcctggatttttcctgggctatttcatgtgatccagaccctgggagtgcttcctctctcaagaagctcctttcatgccctgacacaaattcctcaggtctcaacccaacacagaaacccacctcaaagcgacttaagcaaaacaggtaatacattggctcatgagactgaacaaccatgacccacaaggctggtgtgggggctcaaaaggtggcttcaggaaccaggctgtgtccatttctttgttcttgtttcctccatatgtcttgacccaccccacaatggccacagcatctccatccttacctcttcctagctgagcaatcccagcagagaaagagtaacttttctcagcacttctaaaaggaataccatgcctgagtctcttgggcctggcttgggggcaatgtcacaaggtaattcctcagggattccagcctcctctttattcaagggatacctggtctgtgaactggctttggtctgggaactggataagggactgtgactccctattatggcaattcaattcagggctctagtcacctgacctaaagaaccttttttgttggtgtttaggcagatcaaattatatgacttctgcttctggtcatgatggtataacagggagtagacttaccctcccatcttaaacaactaaacaaaacaaaatatgcaaaacaatggttttcagattttaccaacagtgcaggatgatgatctctgagggaatgaaaacaaatgaggtgagccccatcgctgtgctgtctcatctctgaagggagtttcaggctccagtgctgggagggaggcttaaacagattcttgtggtctccctgatttacagagacagtgttcagaagacaaggtagacagaattaacaaggcagagtaccagaaagagagctgaagagagggggtaggtggtactgaaattctgcacagggctctccttggttagtcagtggaatactgatcattgcatgtatgtgaagaaacttgtgaggctaggtaaagaaccacggaaaagtagcagacagaacaatccctagggttgacacagggccaggaagtgttcatgttcccactggccagaatggaactcaacaatggggccaaattagtcctagattaaaggctattctgggtcaatgcttaaaagcaagtcacaaaagaatcaaactctatcccagaacaaagcacaaacagacaaaaatccagcacccaggatcaaaacacttataaatctgctattcaatcaaaaatcatcagacatgcaaagaaacaggaaaatataaggagaaaaattaatcaatagaaacagatcaacaaatgacacaaatgatagaattattagattatggcattaagacaactattataaaaatactcaacatgttcaagaagggagaagaaaacatgaacatgatgaaaagagaaattgaacatataaaaaagtcaaaaattaagcttctacaaataaaaactacaatggatgggattaacagcatattagacattgcagaagaaaaataaagcaggaaaaaaaggaaaaacaaagaacagatggcatagaaagaaactagcaatatgctagaattaaattcagccatatcaatcatcacagtaaatgtaaatgttctaacattctaactaaaaggcacagattatcagatcaaaaaaaaattttttttttgagatggagttttgctcttgttgcccaggctggagtgcaatggtgcgatctcggctctctgcaacctctgcctcccgggttcaagagattctcctgcctcaacctcctgagtagctgaaattacaggcctccaccgtcatgcctggctaatttttttgtatttttagtacagatggggtttcaccatgttggccaggctggtctcaaactcctgacctcaggtgatccacctgcctcggccccccagagtgctgggattacagacgtgagccactgtgcacaaccaaatttttttaaaataagacctaactatatgctgtctacaagaaatccattttaaatataaaagctacagataggttaaaaatttttaagtggagtgtaaatatatatatatttcatttgtatatattattatatattatatattttataatacataaatatataatatatttcactatatattatttcatatatattccatatataatatgcatattcatatataatatgcatattcatatttgccatatataatatgcatattcatatttaccacatataatatgcatagtcatatttaccacatataatatgcatagtcatatgtaatatgcatattcatatataatatgcatgttcatatttaccatatataatatgcatattcatatttaccatatataatatgtatattcatatttaccatatataatatgcatattcatatataccatatataatatgcatattcatatttaccatatataatatgtatattcatatttaccatatataatatgcatattcatatttaccatatataatatgcatattcatatataatatgcatgttcatatataccatatataacatgcatattcatatttaccatatataatatgcatattcatatataccacatataatatgcatattcatatataatatgcatattcatatataccacatataatatgcatgttcatatttaccatacataatatgcatattcatatatgccatatataatatgcatgttccatatattatatattccatattatatatattctatattgtatatgtttcatatatataatatatattccatattgtatatatttcatatatataatatatatattccatatatataatacacacataccatgaagttactctttttgaaaagctgggatgctatactaatatcatataaaatagatttcaggacaagaactattgccaggaataaagagggacattccataatgataaagagttacttagtcaagaaaacataaaaatcctaaatattaatgcacctaataacatgacttcaaaatatatgaagcaaaaactaaaaggaaaaatagacaaatccacagttatggctggagatttcgacacatcttctcaataactgacagaacaagcagacagaaaatcaataaacttatagaacagaggtctgaaaacagattagccttgtttttgtaaataaagttttattggaaaacaaccacaaacacttttttatatactgttggtgactgccttcatgctataatggcagagttcagtagttgagttgcaacagagatggtatggcctccactgacaaaaatatttataatcttataatgtggctctttaaaaaaagtttgccaatcttttttttttttttttttgagacagagtctcgcactgtcacccaggtgtgagtgccgtggcgcaatctcggcccactgcaacctctgcctgccaggttcaagcgattctcctgcctcagcctcctgaatagctgggattacaagtatgcgccaccatttccagctgatttttgtatttttagtagaaacagggttttaccatgttggtcagggtggtctcgaactcctgacctcaggtgattcacctgccttggcctcccaaaatgctgggattacaggcatgagccaccacacccagcctgccaatctctgatatagaagacatgaacaacatcatcaaacaacttaacctaattactgtttatagaacactccatccaacatctgaatacatatctttcaagtacacagaaagcgttagccaaaacagactgtattctgcaccataatggaagtgtcaatatattttaaagggtgaaaatcatactaaatgtctcttctgacaacaatagaattaaattggaagtcaatccccaactaaataacacacttctaaataatccatgagttagccaggcaccatggctcacacctgtaatcccagcactttgggaggccaaggagggcagatcatgaggtcaggagatcgagaccatcctggttaacgcggtgaaaccccgtctctactaaaaatacaaaaaattagccggacgtggtggcgggcgcctgtagtcccagctactcaggaggctgaggcaggagaatggtgtgaacctgggaggcggagcttgcagtgagccgagattgcgccactgcactccagcctgggcgacagagcgagactccatctcaaaaaaaaaaaaaattaaataagtaaataaataaataaataaaaataacccatgagtcgaagaaaaaaaactgcaaatgaaattagaaaacattggaacaaatgcaaaggaaaacatggcatagcaaattgtgaggcatgcagatcaggtcagactttcgtaggctgacatgtactgagttcaaggacatcatgatcaattagacaccaccgaagatctctctgggccaagccatcctgattattgctccaacccaccttatctctggcagtatggggctacctcccgtactctcctgcttcctcgaatcagttaacttccccaaaacttagtggcttaaacactaaccttttgttttgctcgcagttctgtggagcagctgaacggttcttgtgttctgggtaacctggactgattcctgctgagctctttcatgtgcctatagacagctggtggctgaacaagccaggataacctcactcgcatatctggcaattggctggctgttggccagagtgcagtggcactggacacacatgcctctcatcgtccagcagtccagccagacttcactggggctgggctccaggggcagaaggaaagggaagagcaagcaagccccaatgcacaaggtctttgaaagccttgccctgcatcacctttcctactgttccatttttccaaagcaggtcacacgtccaaacccagagacaaggtgtggagcaatagactccacctgggaagagctgcagagtgcggtggatgagaggagaagtattcatggccattgttacaatttattcagggagctcatttcaatggggacatctcccactatcatcgctggcctgcaaagaatagtcaaggcacagcctttcaagatgcccatgcttccctcaccaatgtgttacccaaagctttggtccagaaaacatcgtctgaactcctcaccccagggatcatggttaggtggtagatgagtatttgactgctcaaatctcaataacttccagagccctagctgtgagggagtccagaaaaggtactttgtatccttccagcctctgcagtacaggaaggaccccaaaaggtggtgacatggatgctgagcaccagtccaacatgtccgcccacgctgaggagcttcatgaggagggaggtgagccctgcagcaacagggaaggagacaggcaggagttccctgttgcctgctcctatctagaggcctcaaactccagctaatttaagccatgtcagcagggacctcccacgtgctgactcaggccagccatgactaaggtccaaatcagtctcaacaggagcaaggcggcccccatgccggccagacccctcccggcacacactgtgcagacccagagcctacaataatcacaattgtcaccagccccaccatgtgccagggacagtgctctgcagcgagagagaccatcttgtttaatcctcaaaaccaccaggggcagggaggggcagttccattccaacggggataaaaagcaatgctcagagaggtgacgtcacttaccaacatcacctataatagtgactgagctggggtttgaatacagatctaaatgacagggaaaccttcccgctgggttgcacagctgctctgcctgtcatcttccaatctcactggttgtcaagggaggacctgctccctaggcacccaaggtgttctctgcccttcacttcactccacaccatggagagctgcccccaagcctgtacctgggtctctgaggaggtcttacccagaccctgtcctgctgcccacaaacatgtcactggctaagagggatgcattcttccctccaatccaaggaaaaacaagtgtgtgatcacttgaaagatgaccctgtatttctaactggatgtccctggagtctgctgtattagtgtgggggatgacagctgccctgattctatttccccttccctgaagaacaggcttttcctaagggaaattccttaggatattttatgaggattggcatcacctctcacagaggcaccagagttcaacctgtggcctatgcagggccaatcacagtcattgtgattatttcaaggatgggcatatgacccagtttgagccagtagtcagccagtctggtgatttttttctggcccaaatggaaaggggaagttttctttccactggaattattgagctgattaattatgagcctgaagcctttgggaactatcctgttaacacaaggagaaagtctccagagaaataagccaacccagaagccctagagccagccattcctgaagctggtggagctttgaagtacatagaccaacaatttctcttttatcctgaaggtgagttgggtttctgtcacatgcactcaagtggaaccctgacttcacttttacaatttattgtacccaacaggatcacgttttgcgaggcataaactgtgcccatttctcatcgagtaagaaataaaatcctccaaacccaacccatcacatcagtcatcctgctgtctccctgccaggcctgtccaatcacctccttatctgaacaccctcccaccccacacacaacgtggcagttcctcagtagccgaggccacccctccctccttccttgacacccacagtctggccctctggtccatcctccctccaagatggcccaggactccccacaggggacacaggctccaggagtggggctgagcagaacagcctcaggctgatggtctttgtggaccatgcaccctatcaggaaaaaaacagggacacacctccataatcatttctttataaatgacatacattgcaacaccatttgcattttatgtcttaataaagctgcattaatttcttcttttagatgaacgtttaaatagaaagtctcctgttttcttgcttttcatggcctattgtttctattttcttgtctttcacactctgtggtgactgcagggtccgtctggtgggggtggggccgtggctggactctccttcccgcccccaggttgttttccaaactttcagtatcgtgagtagaaggaggggccctgcctggggagggccgtgtgaatcaccccatggaaatactggcgccctgggctgggggcagggtgggcctggtttccaggaagggcttgggcaggaagccaggcaggaagaggctggggagtttctggaaaggcagcgcggaggggcctggggaggccagtggacctctcggggcagggcactggcctcccctctcacagatggggaatccttggcacttcctggcacatgccagggcatgggggtgggggcagaaggccagggaaggaggtggcggccgatcctcagcaggcctctagggtgggtggccgtggacaaagaggggagggtgggatggacttggaggaggtgccctaggggctcctttgagcctggccccagcacctacagcctgtgcttggggctgagggtcccattgtatgacctgtagtttcagccagaaggatacttggaataagaggggacaaaggaggcggcagtttaaagcggtcgctgagcagagaatcccgctgatggatggggacggtgctgctccatagggggccctctctcagacttctgtagcccccatggcatttagccaagagaggctccctccccacacaagtgaacttacaggacagaaatccagaatgcaagtgggataagcagtgtagaagtgtttctctctcaaggcggagtggttgattcactcattcatccactcgtctgtgcacgcatttgctccaaaaacactgctaagctccaggctgcccactcctcattcatgaaggtcctgccaccttcagatcctgtgccccatcccacagtgactggcctagggtagaaatgccatcccagctggcccaacttgggcaaatatcaggactctggcaggcaatacctggacaaagatttacacctgggagaacgagggccctaaagcagctggaggccacttgtcaacctacaggaagaactgtactgagagtggatccaatggagaagggagcagacccaacaggtggggagagactggctccttggatgctgtttgagcgcctggattcacctgcacctgaagcaaagtgctacacccagaaaacaatgtccactgaagccagtttgaagctggtgctctgttgtctacaacccaagaatgctagctgacagggatgagttgagggtgcgtgggcacagagcaccaccaggaccgggtgagtgagaaggagagcggggcaagccgcggagggggtgggggagggcactggccccactgcaggggcagcctccaccctaccgccacagccccttcctccatctcaccaggacccaactcgctgacatcatcacggtgggaaacaggaactcctcgacctcaggccaaaagatccatctgttagagccatcgggccagccaaggctgctcagagaggcaggtggaggccatgtcatttctaactgacccgggaagaaccatgtggtgtgcagggtgggggtccctgcccacccatactgggcatcatccatgcttagtgatcacatccagctcagcaaccacaagcacagaggccagcgtgtcccgcgtgggacacaacgcagggtccttgctgctctagccgctgctcaggccacttatgctggcgccctaagaagtctccctcctcacatgtcctccctggagtttaagccgagctctcccctccagtggacatcctccttcccagcctcatgaaagattcaagacagatagatagtttttgttttttttttttgagacggggtttcgctcttgttgtccaggctggagtgcaatggcgcaatcttggttcactgcaacctccacctcccaggttcaagtgattctcctgcctcagcctcccgagtagctaaagctgagattacaggcatgcgccaccacacccgggtaattttttgtatttttagtagagacggggtttctccatgttagtcaggctggtctccacctcaggtgatccgcctaccttggcctcccaaagtgctgggattacaggcgtgagccaccacgcccgacctgatgcaaaatattttttaaaagctcttccttaaaaatctgtgtaggatggacttactgcaacctagcaggcacctaaagagaccagggataaaagtcgacccacgagagccccaggagaaaggacaactgctgccgaggcagaaagcctccaggacagcctgtgggagctgttgaaaggcaatgcaggcagcaaacaccacaggacagaggggagggctgccgcagtagtgtgggcttgaagaccgttcccctgtgggtccctcccagcacaggggaacaggaagacatggtgtggtcccttcttcacagagcgagcagtctgtggagaagacggggctcatcgggcaatgcctccactggggccagaaaaggcttcccctggctggacctgcaggacgagggtcagggctcagccaggtggccagccctcagcgtctgctcccacctccttctgtgtcccagaccctaaggcagaggctgggaaactaacaaactacattccccagcctccttcacaactgagttcaaattaggttccgccaataatgtgcacttttgtgatgtggaaggcaaatggaagagagacaccatctccacgtgactttgggggatttttctgctggtaagtgaggcatggagttggtgggtctctctgcaaggacaatccagggtcctggcttcagcttctcgggtgtacaacagcagctgcagcagttgaagtggcttctaatccctggatcatagctgagaagctacattctttttttttcttttcttttttgagatagtgtcttgctctgtcacccaggctggagtgcagtggtgcaatcgcagctcactgtagctttgacctctcaggctcaagcaatcctcccgcctcagcctcccgagtagctgggaccacaggtgtatgggtcaccacacctggctaattttttttttttaattttctgtagaaacagagtttcactatattgacaacacaggtctcaaactcctgggcttaagggatcttcccacctcggcctcccaaagtgctgggattacagggctgagccactgcacctggcctcagatgctatgtccttaaaccagcagttcccatggtgatctcatgactcccctactccccaattacagcagaggtctggtggcagatcccctgacaagccagttccgcagtgtttttctgggaccatcttcagcctcgacacagtccaccagcctctccacaggtattgaagcacccaagtccctgtattaaatctcctcccacttaaaacacctagagtgacttctgtttcctacaaccaatacatcaggcaaagagggcaccaaataatgttccagatgaagccactggcatgagtgtaatcacctagccaaggatggaggagggcagggtagaggcaggggcgggggcctagttcggagttactgcatgatgtgatgagagcaggaactaaggcaaggacactggatggagcagcaggaaggatgggggtgaggaataagccagactcggccactgcttgcctgaggccatgaagaatgaccttgaggtctcaacccaggcagatgggaccaaggagattccatgtatctaaggaggtaaataaggccatatgtgtgagcacgtagggggaccttggcatcaggcatgcaaggggaagacagacacacccccaagcctcatggggcttttattccagcaagggagatggatgacccagtggataaaataatttccaaaatgacaactactgcagaaaagtccgagggagattggaatagaaagcaatgaatggttggagaaggcctctcagaagaggggacaatgaagttcagaagtgaatgaagaggccgggcacagtggctcatgcctgtaatcccaggactttgggaggccgacacgagtggatcacctgaggtctggagttcaagaccagcctggccaacatggcaaaaccccgtctctactaaaaatacaaaaaaaaaaaaaaattagcagggcgtggtgacaggcacctgtaatcccagctacttaggaggctgaggcaggagaatcgcttgaaccaggaggcagaggtttcagtgagtagagatcgagccactgcactccagattgggtgacaagagtgagactcgatctcaaaaaaaaaaaaaaaggaagtgaatgaagagcaaaaggagaccactgtgggcaactaagaacacagtccaggcagagcgaacagagggcaaagcccttggtgtggtaaggaaatcactgtgtccagggagcagacacagctacatgccccggtgtggccgtgtggcttgaagctgagtaagcaagagaggaagggaggaacaggctcacagaggagctggagaggtcacagaagctccctgatgaccagagcctctgttcagccagaacactccagtggaacaccttgtgtccactaacgaggccttgccactaatttggcaaagaagtaaataatgtgttaaaactcagatgtcctaagttctggttttccaaaaaggcaggaaccatacacaccaatcaccagggaccagacaaaaagcacgaaaagtgaatcacaggagagggaaccagagggaaccactggttcccaaacaccagaccagagaggaccaagcaggtccacccagatgagagggagagaaggtaaggatttcaggtcagattctaggtcaaacaggacttttctggtggcaggtggcagtgacccaacagaactgtcttaactgaaatgagcattgttgatataggtagctggaaaaacccagacacgggtaggctctgagtcactggggcctaaacacaactggtcagccagcgctagcttctgtcttggagctcagcccacctcctcagatgaccgcactctcctcctggtggcaggatggctgcagcagttccaggccttacctctgctcagccctgaggccatggagaaacaggcaatgcctctggttgactatggtcatacccatctccgagtcagctgctgtgggcaaaggaatgcaaggattgactaggtatggctgaggtgacccccattagggcgtgatggggtcagccgcagtcaaatcacacgggctaagagtgggtgagcgaatgaaggtgaatgtcaaaagaagagggagcggatgctggtccaccggagacttacagcaaaggggcacctacaccgcagcgccactgctgctaagaattagcagtcacggaggctccgagctcctgtcagattgagcactttactcgtgacccctcagcccataccgacaacggcaggacgggcactcctcatccacgagggcaatgactgtgtatcaagcaccttctgagcgccaggccttgttctaagtgtcccggcgtccccagtgaagcaggcgaaataagccacggtgtggaggcagggagtgcctcccaagaccccgagaccgctgagggcagaggagggttatttaaaggcagcacttgaagacccaggaatcactcctgggggcgcagccttgcacagctagagggcctgtgggtttgaggagcctcagggttgggggcgccgtggccggtgagggagtgaggtcagaggggaggggagggctggcatccttgggaaggctcgaatagaggggaggcttggtgtgaacgataccctgccggctgcgtgtggaggggaggctgtggcctgggcggaaggcaggagtcccgggaggggcagcggggacggggaccctgaggcccaggggattgggctcaggggccggattcaggatgctttccgcgcagagccagccgcagaaggggcatgggaaagagcctcatctacgcacgagaaaaccgggccgagagtcaagagccaaggcggggctgccgttccagggcgcgagccgggccgtcccccacctcgatcctgtgcgccctgcctcgggcggccagggtgcgcgcggcggccgcgggcgctgcggagagaccggcggaggccggggcacccggcgtgtttttcaggaaggaagccttcgctcctgtaacaggctggggcttggcccggcccgcggccgccccgccaggaagcgccccgtccgccccctcggggcgcgtccgcggcaggcacttttgaggacaggaaggggagaggtgacctgagcatccacgcagctgtggcattcggggacgggccgaggactgggtttcttgccatcctcagcgctgggggtgactccaagcccccgggtgggggtggggagtggccgggcatggcgcccggctccacaatgcatcgccttacccggccggaattcctgcaggacgctttgttctcagatggcagcgctgctagagccatcggacctgtgaggggggggcgcccggggcaggccagagccaggcctcaggaagcccgcagcggctgcggcgctgggcattgccccacatgcccgccaccctcccccgggcaccccccacccaccggcgccacagtccccccagcgccccccgcccctggagccgcctggaaactgggccaggtccagctggacaggctgtgtcaactccagctggggggcttcgcggaagccacccatttcctgcggccgtgcaggctgtctgcagcagagaccaccccaccaagttcccgcctctccctcccacctagccctcaatggcaacctactggacactgagcgagggtggtctctggatggcccccaatggacactctgaaacctgtccctaccccagcccctgccccagccctggcaggccatgtgacatcaggagagcagtttaccctctctgggcttcagcttcctgctctaaaggagaccagagactcccacttcggtgcagtaaagcaaagcatccctgagaaaagagcctttccgctttggagaactgaagcggaatgatggaaccagaacactctggagggaaagcacattaatttcagtactgccttgtgctgttacttcggttggaatttttaaaaacaaccacatccagcacttactctgcactaggcactgctctaactcctcacctacatgcaggtgccagcagcagccgccttgccctctctaacaagggggcgaaggtagcagggagaggtggacacggtgcccagagccaggtcactgacaactggatgagaccctggcatcttggcccagggcccacggtcacagacgctgaaccacacgcattcttaggacccaatttttagaggaaagtaggttgttgcccaaaactgcgtgccggtgtggtgtgcatgtgtgtgagagtatgagagtgtctgtatgaatgtgcatctgagtgtgttctgagcgtgtgtgggtgtggtgtgtgagttgtaagactgcgtcatgtgtagatgtgtgtgtgtgtgtgagagtgtgtgttgtgtgtgtgatagtctagaaacctcctgagaagagctggtgaggaactagagagtggggcaggggtgagactttgggatgcgcctgaaaaacttaaagcgccgttactcaaagttgaattgtttttctaaagtcctaatgcaaacaacatgtggggcagggcccagatggtgcccgggagcccctgacagggtcctcaggaaacaggtgctcctggaatgtttcctgccgcggggctgtggcagcaagcaggtcaccaggctcttcattactgtcaggagggcccagctgcagccccgtccagctgggtggaaacccatggccaccggtcacgaaagtgcaggccttggtggggacaggcccacagctctgcgttcccagcttccccagccggtgtgaggtgcagctctgggctgggcccccgtgtgaggaagccttgctccaccagctccatggggttagtggcaagaaggttatgagcatccttaagttgcaaagctattgccaattatttccccaaagtgttgtacctagctgtgaatgctaggaattgcttctctataccttctacaagcagggagtatccttgcagtctgatagaggacaaagacatcttccaaaggaaggattttgagcagaagagggagcgcatcatgcctatatctatgtgttaggagggtcatcatggtggccaggttgactatagactaaggtacagttaaggttgttttcagtcaaaaaaataaccaaaaaactacttcagtgatttaaacaaacaggaatttatttttctcacgtgagaaatctaaggtgctgttcaatggctgaggcatgcccggctgaaactgctgtcagtctctttcctcatggtcacaagatggctgccttagctcctgccattagatccatgttcaaagcaaggagaaagaggaaaggggaagggttgcaccagctgagtccctctctttctgtcaggaaagaaaggctttttaaaagctatgcccagaagatatctgctaatatatcatgggtcaaaaatgagccacatgccacccctagctatagtgaagtctgggaagtatttggctgtcagcctctatagtgaaaggcaccaagggagcagagggctggggacagatgctgggacaacctacgcagcagctatctggcattgatgctgtgggtcacccaaggccccaccccatctggctccaccgtgcaatgagccaccagccacccgcacacagctgtgctcagtgctagaaccaatgagagctcagcccgcaataccaggagcgttcttcaaactccaggcaggcctctaaaattatctccaggcttctggtgagggttacagggcaacttccttgtctgtccagtgtgagggcagccaactgggtctcaggcctctagaatgttccaccttccttgatctctggcacccaaaagaagtccagtccggtgttcaagaaacccactggttcccaccggccccctcctggcatggtatcctctctagcatgcccatctgggctgcacctggctaactgtttgaccacctgccctacctgtccatctcactcccctgatgtggacttcctgatgcttcctgggctggcgttgactcttctgcctcgccatggctgctgccgtcttgctgttgccccaggcttctgtgtgtagccacacaaccccgtggtgtcaccaccctttttttttttttttttttgagacagagtctcgctctgtcccccaggctggagtgcagtggcgcgatcttggctcactgcaagctccgcctcccgggttcacgccattctcctgcctcagcctccctagtagctgggactacaggcacccgccaccacacccggctaattttttgtatttttagtagagatggggtttcgccgtgttagccaggatggtctcatctcctgacctcatgatccacccgcttcagcctcccaaagtgctgcgattacaggcgtgagccactgtgcccggccatcaccatccttttaaaaataatgtcaaattgactgggcgcggtggctcacacctataatcccagcacattgggaggcccgggtgagtgaatcacgaggtcaggagttcgagaccaacctggccaacatggtgaaacccccgtctctgcttaaaaaattttaaaaattagttgggcatcgtgacgggcacctgtaatcccagctactcgggaggttgaggcaggaaaatcacttgaacccaggaggcggaggttgtagtgagccaagattgtgccactgcactccagcccgggtgacagagtgagactccatctcaaataaataaataaataatgttaaatcaaaaaagtatatgggaattccatttctggcaaaaggatagtgggcagcatgcagtcatcattctaatgacagctgccacttacatagcacttactacaaccagacaccgttctgaacgttccatgtgccagccagcgacagccctgtgtggtgggaatatcagcctgtttcccagataaggaaactgagacacagaggttaagtagcctgcccaggtcacacagtcatgagtggccttgtatttcctagaaatggttaaagtatgttaagtatctttttaaatacacagcagggcttgcaaaaaaaaaaaaaaaggaatattcattagagccaaaagtggcaggggcatcaagaaggtggaacccaaccccacccccgatctccccactcaccctcagtgtgggctgcacatggagacttccttccagggagcacagcacggaaacagagaaaaaagcaactttgtaaacaagaaacctgaccaaggcagactcacccgcgcaggcgctgagtcatgttgacagcaggtgcccttgctaggatgtgatgggcagggcgcttacctctgcgggcatcctcccccaacaaacaatcccggtctaaccaggagaaaaacacctgttttttccgacagagggacatgctatagaatgcctgactgtactgccccgaactgtcaaggccatccaaaacatggaaagtctgagaaactgtcacagccaagagaagagcctaaggggaagactaaatgcgatggggagccctgcacgggatcctggggccactgggtaaaatggggaagcctgaatgaggcatggacttcagttacactgcatcggcctcggctggctcaaccgcaccacagtaagagaagacattaacaccaggggaaactaggtgtggcgtctatgggaactctctgtaccatcgctgcaacttttctgtaaatctaaaagtgctctaaaataagaagtttatctaaacataagtgaaaggcagctgaaaactctgaatgcagcacacagaaacaggtccagcacagcaaggagacggaaactatggaaaagagaccccacgtcgaggagagaaggaaaatgctctccccgcatcgaccaggattcccgaatgggggaactcagaggtctggggagagtatgtatttgaaaaaacgatggctaagaactgtccagccagactcgattgaaaatataaattctccggccgggcacggtggctcacgcctgtaatcccagcactttgggaggccgaggtgggcggatcacgaggtcaggagatcgagaacatcctggctaacacggtgaaatcccgtctctactaaaaatacaaaaaattagccaggcgtggtggcgggcgcctgtagtcccagctactcgggaggctgaggcaggagaatggtgtgaacctgggaggcggagcttgcagtgagccaagatcgcgccactgcactccagcctgggcgacagagcgagactccgtctcaaaaaaaaaaaaaaaagaaaatataaattctccaaatggagaagcaaaaatcccgaacctgataaataaaactaaagcaacacctggatacgtcgcagcgaaactgcagaccatcacacacagagagaactgtggcagacgctgtggcacccagagccccccaggacagagacctggtccccagtggcagcagggctggcggcctggctctcggctatgtccctctccaggaactgctgccagctgaatacagctgcctctccccacttccccgtgggtgcagctggcatggaatgactggtccaagtggggacccaaaagcccagctccggagttcccacggggtccaccgagggctatgccgatgctgctacctttgctccctcagaggcactgtccccaagaacacaccccaggacactccccagagtttgttttctggaaaaatcaaccgacatcaagatcttcattaatgtagtcacacgattcaaaagtccaaaagcccagaaagtagaaaggtggtcgctaggggttggggagggaatggggagttagagttgattgcggacagagcttcagtttgggaagatgaaacagttctgtggatagatggtgggcatggtaacgcaatactgtgagttcactaaatgcctctgaactggttaaaatcaggccgggcacagcagctcatgcctgtaatcccagcactttgggaggccgaggtggtaggatcccttgagcccaggagtttgagatcagcctgggcaacatagcaagaccccatatctattaacaaattaattaattaaaatgaaataataaatggttaaaatcataaatattatgttccatacattttaccacaataaaaaaactgtcaagtagcccaaagtataaaataaatatctagccgggtgttgtggcaggcacctgtagtcccagccactcaggagactgaggtgggaggctcacttgagcccaggagttcaaggatgcagcgacctatgattgcataactgcactccagcctgggtgagagtctgagtccatactgatatcaataaatgattgaatacattcataaataggaaaaagtctctgatacagaataatttcaaataaattatgaagctactccattctaaagcaaggatagaaccccacccctcaagtgtgggcttcccagagtgacatccttgaaagagttcaggatggaaagggggaaggagtaatctttcaggacagcaacctgagagacacgacctatgccaggtggtcaaggccagcatcactgtggtaagtcatgtgccagtactgaccacggatacgatgagatgagaaggacgcttacctctgtgggcttcctccccaacactcattaacgtcttacagaaaaactgcaaagctctcacagagagctcctgtatatcccacagccggggaatatacagccagcgccctctattattaatattttatggtagcatggtgcattttttactgttaatgagctatactgatctgttattaactaaaatccatactttatttagttttccttagttttcacctaatgtccttcttctgtcctgggacctcctccaggatacacattacaattagtcgtgcttgaggctcctctgggctttgacagtttctcagagtcaccttgttcatagtaggggaaggggaggaggtataaggtaactccctgtaccaagtgctcaatttttccatcactctaaaactgttctaaaaaataaagtatattaataataatttttaaagtaccaagtagcatagggtttataataaaaagcattggccccaatccctctccctgggagcagacagccttaattagttcatctccatacatttaaatactaagcctaaaactaccattatttcatgtatcaacttaaatcatgctctgttgactgcctaccaggacagccaagctggacagtcagttaaaacctagctgccgccacctgcacctcccccagttttatttaatgtgtttagttcctccattgcagagttatcaaccctcagtcattcttgtgccacttttgcaatttttgctttatctctctagtgcctacctgcattaccatttacttactacttatttttttaattgatttgctttgttaaatgaaagtactttaaaagaaagcatttacttcactatcattctttaaatcttatgctaagacacatttaaactagtatcactgcccactgatatcccacctgaaacccttgtaagcacccttcccacactttcaactttaaatcatatacttaaaccttactgcctccgtgtattttgacatctctgggggagacagctgcttctctccccaaccttcccaacctgctcctccctcagatctcctaccttggttgacagcaattccatccttcccatcattcaggccaaagcctcagagtcaccctgagcgttctctttcacaccccgtgtccaccttggtttctaacaggcactgcaaatctaacctgacaatgctggagtcggcagttggatttatgagcctggagtcaggggagaaattggggctgaagataatccatttggaagtcatcagtgtgaagatggtgcttaaagacatgagactgaggtgaggtcaccaagggagcaggcagatagaaaaagttggaggactgagtcccagggccctccaaattccagcagcccagagatgagaaaggaccagctttaaaggtggattcagagataccagcaaaggagaggagatacagcgtgtgctgataaacctgccctctgaaaataaagaaataaacgcattgatttgtagagttttccagtttccatggtgtaaataactcccactgtggtccatttcaggctaccaacatgacgtcactgaacagggagtcaggagctttgcacatagtcaactcttgcaaactattatgagtttgtcctgctccccactgcctggaaaccaagcaaacagagagttacaaaaaaagaattacaagcatgaagggtgaacaaccatgttaaatgccgttgacatgtcaaattagctgaggacttccgcagtgatggatgtaacactttgccacgcaaaaatgttaaacgtagatcaggcaggatgcaaaaatagcataacttcacactctgtaaagttacactccccagtacaactttcaaaccggagcaataaagagagaaacaattccctggatcatttatttttaatctctcctcaattctaacatatgcattcaggccataattgtccctctaagcatggctttaactgcattccaacgtttgtacatgtaatattttaattatcgtttgttcaaaacataattttaattgccatcacgctttttctcaggcctgagagttttttaagactgctgttcggccgggcatggtggctcacacctgtaatcccagcactttgggaggccaaggcaggcagaccacctgagatcgggagttcgagaccagcctgaccaacatggagaaaccccgtctctactaaaaatacaaaattagccaggtgtggcggcacatgcctgtaatcccagctactcgggaggctgaggcaggagaatcacttgaacccaggaggcagaggttgcagtgagccaagattgtgccattgcactccagcctgggcaacgagagtgaaactctgtctcaaaaaaaaaaaaaagaaaagaaaagaaagagtactgtttaatttccaaacatttgaagacttggttatcttttttttttttttttttttttttgagatggagtctcgccctgtcacccaggctggagtgcagtggcgcgatctccactcactacaagctccgcctcccaggttcacgccattctcctgcctcagccttcagagtagctgggactacaggcacccgccaccacacccagctaattttttgtatttttagtagagatggggtttcaccgtgttagccagggtggtcttgatttcctgacctcgtgatccacccacctcggcctcccaaagtgctggcattacaggcgtgagccactgcacctggccaacttggttatctttttaatgagtatttctaacttaattatattgtggtcagagaatatattttgtataatttcaattctttgaaacgtttttgagagttgtttcccagtatgaatccattttggtaaatttccaatgtgggcttgaaaaaaatgtgtaacctgagtagttgttgtatctgtctgaagttggctgatcatgttatttaaatctgtatatcctactgatatatttctgcttgttctatgagttagtgagagaagcaagaagtatataaaaacctcctactataattgtggatctgtccatttctcactcttttttttcttttttgattttccaaaatgagaggcatccgtttcttcttgtctgttttctgttatctgttgtctctcctggcattcgttcgtgcagtcttgtttctgcttgggcctagctactattattgtgtgcttgacgttaaaattttaaacattgttaatagaaataatgagacctagaatgctgctatcttcctccagaaaggtattcaaatggcttcttccaggtgccgagggcatgggcaatcctaaatccagctgtagagtttgatattctctgaaactgagcagcaaatctcgccaggactggtgcaggtctccagtccacccgtatgcccgggtgtagtgctgcgcggtcccaaccaaaaatgcaagccaggaacaagctcccaccaccttctctccgttatcctcacaatctgcgaaagcaccgctcagccctcagccacctcttctgacactggcaatcgccctcaaggaaaaagtgaccccaaatgctgagctcacctttccccatgtttcctttgcgtggatcttcatcccaccgtcagctctccagtgccttccggcaggccttcgactggactgttttgtgcagctcctctgggcgtcctcagtggaagggctgctacaaaccacctagtgcctttgcaaaaatcaaaagtctcacctcatttttcaaaggaaaaagacaagcttttcactccacggaaggagtctcccctttccattcctaaagagatctctaccatgatgttatatcaggaatgtaatgagaatctgagggaaaaggtctgcgactatggactcctaaaggcaggcagtattaagaacagagttggcaactcgcagcagccaaaatgctaatacagaattctgtttccaccaaaaaaaaaaaaaaaaaaaaggccagacatggtgattcacgcctgtaattccaacatattagggggctgaggccggaggatcacttgagctcaggaattcgagaccaacctggtcaatatagtgagacctcatctctataaaaaaattaaaaattaattgaatatagtggtacacacctgtagtcccagttagttgggaggctgagacaggaggattgtttgagcccgggaggtcaaggctgcagtgagccatgatcacaccactgcactccagcctgggcaacagaccaaggcttgtcgcaaaaaataaaaataaaataaaataaaatttaagccaatgtcttcagttctggttgaattcacagccaccgttaaatcttccgagcacataggcaagatagaaacaccactgccacttggtgacagtgtgctttaattgcagggaatgggaaacaaaggcccaaaagcaagtcacagattagaacagcatcaccacaggaggtctgagagccaagcctctgcctcaaaatctgacagggaaggaacaatctagaagacagattctgaagacattctggaaaagagagactgagtacagtacaacccctggtcctttcttccttctgccctaggccccagctcagcccatctgctcaccttccctatccctagttctcacggtagggaacagcttatttacaaagggaactctaaggtctcaggaggaattttggtcaatattttagccacttcctacattcagcctcgctcaaggtctctcttcttgattgtattgtcctaatctactttcccaccaacataaatagtatttctagctcttgtcctaactgagagaaagtttgtgttggaattgctactgggaaatctctagtgactcttcatgttaaaagaggaggaaggggctgggcatggtggctcacacctgtcatcttagcactttgggaggccaaggtgggaggatcatttgagctcaggagttcaagaccagccttggcaacatggcaagaccccatctgtgttaaatatatatatattcaataaaaaagaggaggaagggaaattcagagagctcggctagattgcacaaagtcacagccttggtcgtagggccagggtacagcagccacctcccgacttactgcccctctccacattacctcttggccacaccaccttgtccaggccagggcttttgcagcctgagctgtggggggtgggtgtcaagattgagaaactgacttcccagagactatctacatggggtctgcggaggctcagagcgtggtgctggtgagtacaaagggaggttccaagccctccctgagcccgtgagcaccttacactcccagccagaccatagtcgggcatgccggggccaccaccaatgtggcaaagggacacggctggacacagggcacttagctggccagccttgtgggtctgcagattgatcttctcttgagcaagacttttgcagtcagactctggccctgccatttaactggttgtgtgaatctgagtgagtccctttgcactcctctgcactcctcccctgcccgttccatgctgcggctatgacaacactgcccattccacagggctgtactgagaatgtgagttactgtattgaaattgcttagcaccatgcctggcacatggcacatgctcagggttagctgttattagaaagaaaaactgaggggggcttcatggcacaggggatggatttggctaaggctgggataatcaccacctgccaagggtccaccctgtgcctgatatttcccagagtggctgccagcatcacgatgaccgtgaccttgtgctcagaagacatcaccacccggcttcagagctgaagttagtgacactcagagagattgagtgacttgccctgctggcaggtgatggaactagagtcttgttccaaactaggcactttacatattttacctaatgtaatcctcccgagagcctcagctgatcagtgctactcactgggccgatttgacaggcccagaaactgttagtcccctgcctatgtttaagctcctgggcagtggcaaagtcaggattcgaacccaggacctccacgctccagagtccttgcctttggcaattgcgctctgctgtccggcaagtccattgcagctgcttggtccattttgcagaatcaaagcagcgatgtgtgctggctgttgggggcggggggcagcatggccccagctgagggcttgctgagggagggagagaagctagaactcgacatttggatggaatgttcaagggtcctgttgcccaggccaagcctctgcttgaacaccctcagggatgggggagctcactgccagtctgctccactgtgaatggacttgatggattaggaagccctttactccaggagaaggtcaccacctgcaactcactggtctctgttctgccttcctgagccacacagattttaccatcatgtgaaacgatgataacaataataagaatgtcgtggtgactacgaattttttgagagggtccagtgccctaatcactgtgttttgggcttttttttttttcatgtactatctcatttagtatttaaaactaactactgtgcccatcctcactccaccccaacaaagacaggaagtgaccaatttacaaactaattgtgttcctaacattcttttgtaaggctgttgtttggatgacgaaaccgctttcccacataaacaatggtataaatggctgtgggtgccccagctagccccccgaagcctggtttactcatcccgcctaaagggcccccacacatttacaatgaaagagaacagaacggagtcagattagagccgcagtcattaaacaatggagggaaaaactgatgttgggagaaagatggttgttgtctccagcactggctgcctcaggaagcgccagcccagaagagaacggccaacttcccgcgctggggcaggggcggcctgggaatggcttcaaagccagtctctcccactgatagaaccagacagcacccagcccaacattttacccaaagaatgaacccaatggtgggacagtgtggagcctcagaggggtgagccagacctggccttgccacttcctgcatgtgtggtcccaggagagctactggacttctctgaaggtccccatgcagggagcagaagcactacggtccttcctggggtgcactgaggacacagagacagcgggtgtcaagaacttagtataggccaggagccgtggcttacgcctgtaatcccagcactgtgggaggctgaggcagaagggtcacttgaggctaggagtttgagaccagcctggacaacatagcaagaccccatctctaaaaaaaatttttttaacaacttagcacagtctctggcacatagtaggtgctcaataatggtgagtcatattgttaaaaataataaaagttgaagccgggcacagtggctcacgtctgtaatcccagcactttgggaggccgaggtgggcagatcatgaggtcaggagtttgagaccagcctggccaacatagtgaaaccctgtctctactaaaaatacaaaaaattagccaggcgtggtggcgggcacctgtaatcccagctacttgggaggctgaggcaggagaattacttgaacccgggaagcggagcttgcagtgagccgagatcatgccattgcactccagctggatgacagagcgagactccgtctcaaagttaataaataaataaataataataaaagttctgcatggcccatgcctgggggagaaaagaagaaagaaatcaggaaagagaggtcccaaatgccaaaggcatggtgcagggtccataatctggggagggggtttttcttatctcagatcttgcatagcctttctgcatggcaatgcattgggagttaaaagtgaaaaagccacagggtgcggtgactcatgcttgtaatcccaacactttggggagctgaggcgagaggatctattgaggccagcagttggccagcctaggcaacaaagtgagaccccatctctacaaaaataagtaaataaataggcatggtggtgcacacctgtggcctccagcgactcgggaggccgaggcggaaggatggcttgagctcaggaagttgaggctgcagcaagccatgactacaccactacactccagcctaggggcagatcaagaccctgtctttaaataaataaataaatagaagtggagaagaacccgacaggtgcctcgtggggactcggatttggaaatagattgagatgctatctgcagtcagccagcacagccttgaagcctcctgataaccagggcgaccagagagtaacttcagacagcagagaactacacaggcaggtggaagcaacctgaagaggaggttggaccaccgcctctgcagctggggccaatgggcatggtctccagactgctagttcaccaagagtttttaactttaggaagtcattttccatgattatttgcacctgcaaaattccagtcccaatgttcagtttggtcatggcctgagagccattcggtgcgactttaatggccacaggatactaaggaaagaaaggtggatgtcagatagaaaggacgcattcatgacaagagaagggcaatggcacttggatgtgttttaagacactgaggctttgcaggagttcaaacagagaaaaggaggaggaaaagggagttgtcacagtggttacagaatgtgccagattccacggaagctgcactgagcccatcagcaccacattcctgtttcaagcaagacagcattattcattggcatagactaataccattcacttgaattttattcatcttgtaattttggttggatttaacttatctttcattttcatcttgttgtaggagtagacagtaccaatgtttagctttaggtgagcacagattgattgaacgattgattgattggttggctgactttttagagacagagtcttgctctgtggcccaggctggagtgcaatggcttggtctcagcttactgcagcctcaacctcctaggctcaagcaatcctcccacctcagcctcccaaagtgctgggattacaggtaggagctaccatgcctggcctcattttatataatgttaaaataagccaaagtcacaatagccaaaaggtgggagaaactcaagtgtccatctacagatgaatggataaatgaatgcagcctgtcccacaatggactattacacagccttaaaaaggaaggaggttctgagctctgctgccacatcggtgaacctggaggacatgatgctgagtgaaataagccaggcacacaaagtcaagtcctgcatgattctattcatataagatccccagcagtcacattcacagacacagagaagtagaaggtggttgccgggggctggaggagggagaatggggagttagtgtttaatgggtgcagaatttcagtttgggacaatgaaaaacattctggagatgaacagtggtgagtgttgcacagcaatatgattgtatctcatgccaatgaactctatactttaaaatggttatggtggtaaattttattgttttgttttgttttgttttgttttgttttgtttgagatggagtctcactttttcgcccaggctcgaatgcagtggtgcgatctcggctcactgctgcctccacctcccaggttcaaccgattctcctgcctcagcctcctgagtagctgggactacaggtgtgtgcagccacacccggctatttttttgtatttttagtagagacagggtttcaccatgttggccaggattgtctggatctcctgacctcgtgatccgcccgcctcggcctcccaaagtgctgggattacaggcgtgagccaccacgcccagcaattttattgttatatgtatttcaccacaataaaaatagatatataaaataaaggtatgaaatcaacactgggaatgggtaaagtttttttctgttaaaagaccttgggtggtctcaggccaagacaaccggaaccctcagactcatccttcctccgaggagtcccctccggggactacagagaagactgctctcccggcagcgtcatctcggctgacctcgctggaaaggcagctctctgtggccaggtcaagagggctggggagaccaggaatcatccacccatgatgttcctaaaacctgcctgcgcatggcagccaccgggacggcctgtcaaaatgaagatgcctgggccctgccccggatactgagtcacagtctctaagggtaaggaggcctggaatctacacttttaacaagctccccaggcacctctgaatacccaacctgctagggtatcaggccgggcagcgcagaggcctggaggagcccaggtatacaatccatagagccgacttcactactgcctgccactgcctgctgtgtgactgtgagcatgtcattcagcctctctgggtctcagtttcagacctatgggtttggcacaaaagcgcttatgttgggaagggcttgttttgagggttagcaataagatacataaagtgcctggtgcataacaggtgctgaataaatggtggctgcagttaggattcgagagctgggagagacccacccagctggcactggctgagaggtgagcaagccgctcccgcacagagggctccatcccaagtgcacatgtgtttcctgcagggggagcacctttaaccagggacgtggatgtggcttgtcactttagctctgaaaaatgggacagaagttgttgaggggaaatcccttctcacagaaagcagaatggtgctttgggaaccccccctccttttccctctgccacccccaatctagagctgactgcacctcactcttatcatccaaaagccttgcccctgaccgcaggctagcccaggaagagaagtaaggctcacctgccaaatcttgctgtgtggctttgagaaaaccacataacctctctgagcctgaggtccttatctctcactagggggaggagggtgacacccattcattcagggcatactgactgtgatagacacgtcctcatcctcacaggccgacagtccagtgggaagatcaggctttagtgaaaccactgcaaatatctcattgcaaaacaaaatagctgccttagaaagttgtgatcaggtggtttttccgactttttttttttttttagcagcagaacccttcattcaaatgaagccttacccaggactgggtcatggaaaatagctgaaagcaaagttgctcagaggctctgtggctgtcaccagagagcccgacggcttcaaggaacacagctggaaaccagagcttgatgtctgggagggaggggtgaggaaaggcccacagtggcacagcagagtcctggcacattgtgggcactggagaagccatccctgcctgagctcgtcatctctctctctctctctcaccatgtcaaatggtagtgggtgggtacagggcccaaactcggtccccagacccccgagtgtctctggtgccagagaccccacaatgcctagaagcttccaaccaccctggcccagggtgcctaggggctgagagtctgggggtc

SEQ ID NO: 1388 - DNA, 40001 bp, Homo sapiens
gaaacgtttataatgcagttaaatctcagctttttgtgcttaaaaagaaagaagaaacactctattggggcatcctctagcagtaaaaattctgctgagggtctattacttcctttcctttaaaactcccagcttcatagccaatattgccagacaaacaaaacagtccttttctttccttttcgctgcagtcaattgtagaaaagaatctgtacttcagtggagataattttaaacgggaattcaaaaggctgtgttcttttataatttcaacacctcatttaacactttgcttaaactcaaatattcctgaggaatagtgaaaatatacatttgtgatttgggagaaaaagaaagttgctattgaaatttacacacaaaacaaatggtgaactgggtccaaaatgagaataggatgatggttttatttttatccagaaggctgtcagatgtaattgaaacaatcttataaacattccttttgttaatgccttttattctcagtcttcacttttctcaattggtttctcatatttaaaaagtgaactacaatttctcaaaggaaaagaaaaagaaaatagtgataatgtgtattcctatctttctctttcattgttttactctctgataaaagtgggcaaatgggaagcctgagtctccagactggcttcatccagctcacatcccaaactgtaccccaggagggatgaccagcacttccctaggacatatccttggactttcccttttctgttgccttctatgatcattgatgcatataccacaactcctatccatcttgaatgaataggtcggacaccagaacaaacaagatgttcagtcagtccaaggctagattaactcattagcagagtaagcaggctttaagggcaccagcaaaactgggcaccagaaacagacacaaacagaaacagagacagagaaagcaaacatttctaccttgatgaatttactcatgatttcaatgtctgcaatcagaatgtctttaagaagctattttaattttagcatgcagatagttttctatgacatttggtaaaactagctcttaccttagatcagagaggatatactaatctgttcagaatttaggtcctctaagtcaggcccttcagttactccccaaagccaattgacagctatggccctgacaatatacgggaagctgcagtcttacttatatcctagagacatcttctggggaagaagcataactgaatcaaagtcataattggaactacagagttctctgaaagcagcttttctaaatccataggtccaactcccagggacctttattgcactgcaaaaagatttgggatccatttccttgtttcaaaaataacacctaccacaagatttcttaaagtggaccatggatcactggtttcagaatcaccaagagggcttatttttaggggcctaaccctcaaatgacttgacctaactctatagtttgtagttggacatttataaactgccagtacttcactgagttttgggagtgaccgtgtagccaggtatacgtgttccacacaataatttactaggtaagaaaaatattaaaggcatgagtatgagttcaaagatgtttgtaacccaactgtttaatcttgacagaggcatccctcatttggatgaaacttaaagccaaggtccttacaatttatcctaaaaagttatttacatttattaacaactttccttccacttctatatatatttctcattgtttagtttctataagcctaatgaataaattttacataacattgatagtattattttattaaaatatattggtcatgatttggttggcatttttaaaattgttaataggaaaacatagaagactgaatgataaatatattaaaatgaaatcatttctcctgtataagaactaaattataatagtgattattcatactaataaactatagagtacagggatggaaatagaaatacaatttttgaatatctctctttacattcaccacaaaattttaaaaagcagttactctctccccccacagagatattttctgtttccttcagaatccaactagcaaggaatatcaacatatttcaaagagctttatttcagatgtagttcaaaggcagggcaaggttaacagcagaattcttcatgggagctaaccttatatgatatcatctaataaaagatgccaatgtatttgtgaagaaaaaatgcaactggaaacattttcaatgacattgcacaaaaagatcaaaaagttatcatgacataaacaatttgtgttgattagatttcactgtggagatgttgagatgttgagaataaatagtatttggctatagtgactctgtcatcatgtggattttaaatatctaaatatctgccatatataacatgccttcttttgcctctttgaacaattctttgtgtcactgatgattgctgctttattttcttgttatcaaattcacttcttcctattaaatagaaagttcccaggtgaatgaatagatctttaaatgttttttaaaaccacagtctaacaaatgcaccataaggataaacttgctcagatgaaaatattggtgagttatctcgaacttgccaaaatgggacttgtaaatttctttctactataaaaataaatgatgcacttgatgttgataatccaagaactgttttttatatttttaatattttttaaactttaaattgtgataaaaaagcataacataaaatgtactgtcttaatcatttctaagtgtacagttcagtagtgttaagcacattcatactgttgcacagctcatctccagaactttttcaccttgcaatactgaaactctgtatccattaaatgctaacttctcattcctcccttcccctcagcccttaacaaccacaattctttttttttaactgatatattgtatttgtacatattttggggttacatgtgatattttgatatacatatacaatgtataatgagcaaatcaggataattgggatatttatcacttcaaatatttattttttgtgagttgggaacattacaattcttctagctattttgaaatatacaataaattattgttaactttataagtttcctactacaatattgaatactagaacttattcctactatgaactgtacttttggatatgtttaacggcttctcctcatcaccccgcccgcccccccacctcccacccccccacacaccccacattccctcttcctttctgagcctctggtaaaaaataaaataaaaaataaaataaaataagcttgccagcatgattgtggcagggagtttcagttttaggtgtagaaaccatgacggcactaccatctagctgctttcactcatttaactctcctctgttggtgcatactctgtgacagatactgcctggagaacaaaatgggccttgccttcaagaatcttatgttctggccgggcgcagtggctcacgcctgtaatcccagcactgggagactgaggcaggcggatcacaaggtcaggagatcgagaccatcctggctaacacggtgaaaccacgtctctactaaaaatacagaaaattagcagggcatggtggtgagtgcctgtaatcccagctactcaggaggctgaggcaggagaatggcgtgaacctgagaggcggaccttgcagtgagccgagattgtgcccactgcactccagcctgggcgacagagtgagactctgtctcaaaaaaaaaaaaaaaaaaaaaagaatcttatgttccgttggagtagattaatgagcaaaaaacaaatagtatatataagagaaagaaaataattgcaagttataaaagttatttctatggaataaacaagcaaaaagctacaatagaaaataaagccatgagaggccagggagaccctactttcatagcgagattaggcaaggcctcccagagcttgtgatgtttaactgaggcctaaaagatgataagaagacagtcatgtaaaaagaaaggaagagatttcagattgcaggcacaggatgtacaaagagcctgcagcaggaaagagcatggaatcactggtgacgtatccaacatctaatgttcctgaagcataagaaacaagagagagacacaagaggaaataggagtctgaccatccagggtctggaaagccatggtaagaaacttggaacatattctaatggcaaggaaagctaatgaagagttttaagtaacagaggctgcttgcacctttttaaatcttcaggtaacaaccacttcatcaaaggctcttctgcctctctatcaaaatacagaggacaaagcttattttcactgccatgtgcccctccccagtttgtaatctctgttccctgacgatgaacctaatcccacctacctgtctggagctctaacaggtgcccaagaaaatactacattctctaccattctttccacagctgctcattccttttttttttttttttcttctttgaggtggagtcttactcttgtcccccaggctggagtgcagtggcatgatcttggcttacggcaaactccacctcctgggttcaaaggatctcctgcctcagcctcctgagtagctgggactacaggcacgcaccaccacgcccggctaattttggcatttttagtagaggcgggggtttcgccatgttggccaggctgtcttgaactgctgacttcaggtgatccacccacctcggcctcccaaacttctgggattaaggcgtgagccactgagcctggcctccacagctcattcttaatagtgtattgtctgtgctttttatttcttctgggttatagctacctctttatttctgccattttttacataatatcacaatgcatacattttgcttgcttggcttttatctgtttactcttcatttccactacaaaactataagctccgcaagggcaggaaccacatctgactagatcaccatcatatccccagtcatctgcacatgtctggcagtgttgagtaaatgaaataatttttgaatctttgcttccactataagaatgttaacatcaatttggattatgttgaaaactatggcaactgccacagttcagctttgatataaggacaaatgtttcatttgctatttattgtgctaccaaattcatatcgaaatatagaaactgcgtgtgtagcttcaacagtaacccagtctttcttttcccggatctaagtttcttggccctttgttttccctggcatgggtagaagaaactctactaaccaataatcacaaagtcttcaagaacgtgctaatacgaccatggttgctatttcaaaaccaactatgggaagggaatgtgagtagaggaattagaaaagacaaactttttaaatattcttattaaaacatgaatgaaccttaaggacattatgttaagtgaaataagccaggcacagaaagacaaataccacatgatcttgctgtggaatctaaataagttgatctcataaaaatagggagtaacattgatatatgggagctaaaagttgatcttacagaggtaaagactagaatgacacttaccagaagctgggaaggtgagggttggagagaggtgaagagaggctggttatgatgaggacaaacacagttaaatagaaggcagaagttctagtgtttaatggcatagtggagtgactacagttaacactaagttattgcatatttcaaaaaagctagaagatttgaaatgttcccaacacaaagaaatgaaaaatgcttgagatgatggttatcctaattaccctgatttaatcatttcatattgtatgcatgtatcaaatatcacatgcactccataaatatgtacaatgattatttatcaacaaaaaaggaaagaaagaaaaaagcaatagagagtaaaatgatggttaccaggagctttgagtagggaggagggaacatggaaaacagatggtgggagtgatacaaaatacaaacaaattaaaattcccattctattctaataaagccaccatcctcttcgagatcaatatgttcttagcttcctcagaactaaaacaactgagaaggctgaataagatggcactgttcttcatcgcatctaactgttcaggcttttaggagagaataagaaaaacagatgtagttagtgcccaacaagcatttcacaattttcagccaatcgttaattatccttgatctttgcctaagagagtaatgaaaattttacagatttcgctatttcaacaaactaatttatattgtaattaattttgtaatgaacaggtaaaatgtgcatgcattttttacatgtaaactagagaaaatactgcccatgaactggatatgcataccgtctggttatatactgtcttgtatacaatcaatattcaacaaatacaatgtaataaataaggaaatggtctaacaactcacaaaaggaaaccaattataattattttcaggtaagccagaatgttttagaagtatatattgttaatatgatccacaaatcaatggggcttgttctactcatgtagcatcacaagtatgttaattctcaaaaatacttttggagatttttgttgttattaattttcataacagttatacaccctgctaaccaaaagtctgaaaatgatttgtgcacacaaataaactatgtttatctacaatgtaatgaagcaggatgttctatggaacatgacctaaaagagacccattccatagttagatctgttcagatggtatgatgagcaaagacttacgaaaatgacttcacatttcacatcagcttcctagggaatatcactaatttaagtaaatttgtctttgcagcttgttttcctcttcttccttggaatctccctcatgaaaatttttcaaataatgttgacttcaaaaattgtcattttgtgaattaaaatttggaaagaaaaacaagtcagggtgttcagatgataacaagttcttattcaggttcaacaccaaatagatgactgatggtaattagctgcagttcaagaattctcagatataaaaatgctttaaaggattagttgagggttagcatgataggacttcttaaaattacatgaagcataggaccttcaggaaagtttttctttttaatttaataggcaaaaacctggaagtgaaatgttcatatgcccttcacaagcctatttgaaatagtttagctagtcggtaataatttgatttagacaatataaactgctaataaggtacagaaagcatctcctaggatgttgttttacgtaataaagtaacatttgaaaagccaagtcaaagctcaaaggaaaaagagaagagtaaacttcagaatctcagtatcttttttcctaaaataattgagcataaaataataaaccataaacaatgtagtgattagaggtacttttttaggatgtttatcttgaaatactctcaaacttacagaaaagttgcaaataattacaaaagaaaccacctttgttcaggatgatttgacagtaaatcactgatcagatgcccatctaccctcgaatactcgagtggacggttaccataaaccaggacattctcctgctagataatgacaacacgaccatcaaaatcagaaaattaacactaatatatttctgacatctcatcttcacatcctattcatgttttgccaattgtcttaataactgcttttacatttttttaaaaatcacacattacacttagttatattgactttttaatgtccttcactaccattgttccacagtcttatcttgactttcataatgcttacattttggaagattatagtcctgttattttataaaagtttcctcaaatgggattttttttaaagttttctcctaacaattaacttccgattatacacctttggcaggaatatcacagaaataatgctctcttttcccctttgtaattagtaaataattttgtgagaaagttcttttaaactatgaaaatatcccatttctcatcacgttttcaatttattcattaattgtttatatcagcatagactcatgctttccatttttattcaatggcttacaatccactattatctttatttttattgatgttcaatttatcttaaatttggtcagcagtaacaacttccagctggagcctgcgtccttttgatatgtccctgccaatcggcaagcatttccttgctctatggtacgagatgttccagcatcatcttgtcgtgtccctaccgctgccctggaataagcctttccttcagtggagaatggtattttgaaatcaagatctggacactagatgtgccagcgaccactggggagtcattgctcccaaattgccttagttaacagagctaagtgtgtatgtgtctgcgtttgtgtgtgtgttcacaaacatctatgtttatttctatatctatttatctatatatttaaaaccatgtatttacaccaatacctccaatcccaatctaacaccataagatttgttctcgttttctccctttttgtattcgtaacttccctcaggaatttgactcatgttgtctttaatacacatttattcactcagtcccccaatatgtattaaattgctcatcataaccaccacctcctcccttgcgtgggagccctttcaccctttttgggctccactgctctaccctgagagcatcccttagatggacatcctccttactatggttagcctcaggcgctgtgcagctgatcccacgcgcccacgccctccgcaccaagctccgggttgaacacaccacactctgtagatgtcctgatcaccctcctcaggctcccacatcttgctcccatccagcatgactattctccccacaaccacaaccccacaggggcagttgtactgcacagacaactacctcaccctgccccacctaatggctttgctattgaattgtttaataggacaagaacagaagaagaataggaaggggaaaggggaaaaggagagctactgttacttttttgaaattactttcagcttcctttgtggggatggaaagcaattgtacagtgagactatttgtggcagattggcagatttgatgacagaaaatctaagttctacttacagagtaaacagtccttttaccctaactcagaaaattgtattacaattttattacacaatattatgtgaagtaattcattttttaacaaattacatgttaaattgaatatgtcctaggaggatagatttaataatgcaaggaggactctttttatctaactacactaggatgattaaggcagtatattcacacacataagagcagtagaagagtgaagaaactatttggagaacttaagacaaaaaaaagcacttcaaatttgccagatattgacaaaataaaagattattttgtctggagtagccagataattgctttaattcttttagtataaagtattctttaccacgagaatgtcttccctgctctattaaaggcaattatcccttaatacaggctctgacaatttgtagtacaagtattttctaccaagccaaaattatgggtacttaaggattctaaaaaacaattattagagaaagagaaagtttgttgcagatgcattgcctttaagggtggcccatgcatttaattccaggacagaaaacaaaaataatttgggtcgtttcttatgaatggaaatgaaaagtatgagaattatggaagtttgtagacatgttctcatggttaattttaatatggcctattagcatctgatatttcagccagaacaaatacatcccctcctcccaaaaaagcaatatgcaaaaatatttcacattatgtaagtctttttttcaaaagagtattattaccctatcaagataattaaatctctaaaagaatcttcacgatgatgtgcagatcttttatggacagttcacctcaattttttctgtctacggagcatttattattacatttagtacaagtacaatttgtctttatagacttttgttattagagaaaatgttgcaaggagagagagtaaaaatgaatttaagagactgaaatagtgtacattagtgtgttctattatggaaaattatggtataatagcgaaatatcttaactcatcacttctaagtggccattcattaaaagatcctaaaaacagatgatgttttctcagttctttttttttcttgacaagtaaagaaatcttttctattatggggaacctagttttcatcatcacttttaaatatttaactgagaatgtaaaagggaatttttttcactaagcagagtcacttgttctgcatgttctcctttagtacatactacagtcctgtcagttatattgcctgcttgtaccttttcctacctttgagctaaccttcagcttattctttcaagatacaatagagaaaagcttgcacttcaaagttgaacatacccaagtatagaacaggttccaaacacctcacacctagataagcctctcccttcaagcctctcaaataaatatagtaaggctcaaagagagctttttgctgtgctgaatcatgcttataaaattcagtttactactcataccactgagaattttttccacattttacagtgtgaaagtgttgtatgtactatatgtgtacctatccaatgcatgtatatatgtatttcatatgtatgatatgtagttagactatataataaagtgctctagttctcatttgacattgtcttcaattattttcattaatcctctgctccgttcataaactacatattgtaaagttattttagatttttatcttggaaagatgattagactaggtagggcagaccctcacctggaaattatgagaaaaattctggaacccacagcgaacagatcagattagctggtttccttaatgaagtagccaccatcccttctctgtacacacagagttcattcaaatatctgtgcctgtgttcattacacatcttattccaggaaaattttacccactcataaaggtcccaatcaaaagtcatgtcgtttctgactgcttcctaaactacccagtctagtttcatattctcactcccctcccctcccattgtcctttgtacatttctctgtatcattggccataatggtttattagattagatttgagaagtaccctgcctattagcaattactagttctgagggtaaataattttgggttctatatttgcttctagtagataagtccttctcctcaagaagatgtctcccccatgttaagtggtctggatgttttgaaaagacataatctatagaaaatacaggccaggcgcagtggctcacgcctgtaatcccagccctttggaaggctgaggtgggtggattacttgaggtcaggagttcgagaccagcctggccaacatggtaaaactccatctctactaaaaatacagaaattagctaggcatcatgatgggtaatcccagctactcaaaggctgaaaaacaagaatcgctggaacctgagagacaagaggttgcagtgagacgagatagtgccactgctctccagtctgggtgacagagcaagacatctaaaaaaaaaaaaaaaaaaggaaaagaaaagaaaatacagaatttaccctgaaaaaaatttaattgagcaaatatgaaacaaacagcaaaaagagggcaaaaataaacctatgaacatggacatttaaaagtactcacttaagtagtacttcaattaaaaaggaaattgtatcaaacacctcatacatcctcatatcctctgggcactctccctaatgctgccacagctgtggtaatcagttccacacaagctttgggtatatttgtgcatatgcacctgaggggaccatgacattgggtcacaccccactctctcttcctgccctggaacttctctgatgctatgaaatggcatcctcataggaacctgttctatgcttaggtatgttcaaccatgaagtataagggacttaagactcatataagcaccactgagcaattgaaaacttggatctaatggataagtgtttagccatcttatcaccaggtggacagttctaagtcataccttgaaaggcttctcaaaagactgcacaaaatttagcacctgttgcccttattgataatatattatactcttggcattctttcttccctgttcatcctcgtcttcctcacacttgatacctagggtcaccattctaaataaatgacccacaaccatgctcttgtattaggcactgctttaaaggaaactgagatgaagatgtaaaccaaaactgcaattatcatcacattagaaatgagcacaaataagaatgctgtatattaaaagcccatattaaaatatggccaaagaacaattcagaagaaaatatgcaaccttaagtgcatatgtgacataataagagagaataaaaataaatgactaagctttgaattcaaaaagctacaagagaagcaataaagtaaacccaaggaaagcaaaaataaaaattaaaaaaggattaataagataaaattataaataaatacaaaagaaaacagaaggctggacacagttgctcactcatgtaatcccagtacttctggtggcagaggcaggaagatctcttgagcccaggagtccaagactagcctgggcaacataaacagaccttgtgtattagtctgttttcatgctgctgataagacatacccaagactggcaatttacaaaagaaagaaatttaattggatttacagttccacgtggctggggaagcctcacagtcatggtggatgattgtgatggcagcgggcaaagagagaggcacacttgtgaagggaaactcccctttttataactatcagatctagtgaaacttattccctatcacaagaacagcacgggaaagacctgcctcatgattgaattacctcccacgaggtcactcccacaacacatgggaattcaacatgagatttggtggggacacagccaaccatatcaccttgtctctacaaaaaaattaaaagctagctgggcatgttggcacatgcctgtagtttcagctactcaggaggctaaggtgggagaatcacttgagccccggaggttgaggctgcagtaagccatgatcatgtcaccacactccagcctgggcaacagggtgaaaacttgtctcaataaatgaataaataaaacaaaataatacactgtgatcaagtgggatttatcacagaaatacaaggatcacttaacatacacaaatcagtaaatgtaatacatcatgtcaacagaatggacaaaagccataggataatctcaacaactacagaagaaaaacaattgataaaattcaatatccctccatgataaatactctcaacaaattaggtatagaaggaacatacctaaacacaataaaagacatatatgatgaacccgtagctaacatactgagtggggaaaaacagaaagcatttcctctaagaagtgtcacaaggatggcccctttcacaactcgtattcatcatgggactgaaaatcataaccagagcaattacaaaagagaaagaaatttaaaaagagaaagccaaattgtccctcttcgcagatgatataatcttatatatagaaactctaaagaaccaccaaaaacttttagaactcaaaaataattttagtgaagtttcaggatactaaatcagcatacaaaaatcagtagcatttccatacaccaatagtgaactagctgaaaaagaaatcaagaaagcaatgccatttacaatatctacagaaaaaaaaatacctaggaataaatttaaccaagtaggtgaaagatatttaccaccccccccccaaaaaaaaaaccaactacaaagtactgttgaaaaattgaagaggacacaaaaaatggaaagaaatcccaagctcaggctaggcatggtggctcatgcctgtatggatcacttgaggttaggagttcaagactagcctggccaacatgttgaaaccccatctccactaaaaatacaaaaattagccaggcatggtggtgtgtgcctgtaatcccagctacttaggaggctgaggcaggagaatggcttgaacccaggaggcggaggttgcagtaagctgagattgtgccactgcactccagcctaggtgacagagtgagactctgtctcaaaaaacaaaaaaaaaagaaaaagaaagaaatcccatactcatagattggaagaattaatattgttaaaatgagtgtagtacctaaagcaatctacagatttaatgcaattcctatcaaaatatcacagacattcttaatagaaatagagaaaaacaatcctaaaattcacatggaaccacaaaagaccccaaatagccaatgcaatcttgagcaaaaagaacaaagcttgaggcatcacactgcctgacttcaaaacctactaaagctatagtaaccaaaacagcatggtattggtataaacacaaacacattgaccaatgaaacagaatagaaaatccagaagtaaatccacatatttacagtcaactcattattaacaaaggcaccaagaacgtacaatggggaaaggacagtctcttcaataaatgatgctgggaaaactagatatccataggcagaagaatgaaactagaaccctacctctcactatacacaagaatcaaatcaaaacagattaaagacttacatgtaagacctgaaactatgaaactactagaataaaacattggggaaatgcttcaggacattggactaagcaaagacttttttgaataaaacttcaaaaacccaggcaacgaaaatgaaaatagacaaataggaatatgtcaagctaaaaagcttctgcacagcagaaggaaacaattaacaaagtgaagagacaacccacagaataggataaaatatttacaaactgtccatctgaaaagcaattaataaccagaatatatcaggaactcatgcaactcaatagcaaaaataataataataatccaattttaaaatggcaaaaaatctgaacagacatctctcaaaagaagacacacaaatggccaacagatacatgaaaaaatactcaacatcattaatcttcagggaaatgaaaataaaaatcacaatgagatatcatcttaccccagttaaaatggctattatcaaagagacagaaaataacagatgccgatgagcattcagagaaaagagaatcctcatgaactattgataggaatataaaagactatagccactatgcagaagaatatagaggttccctaaatatatgttaggagattcctcaaaataaaactaccatatgatccagcaatcccacttcttggtatacattcaaaagaaaagaattaagtatatcaaagagatatcagcactcccatgtttattgcagtgctattcacattaatcaaaatatgaaatcaacctaagtgttcataaatggatgaatggataaagaaaatgtggtatatatacacaatggaatattatttagccataaaaatgaaattctgtcattcatggcaacaaagagcctggagaatactatgttaagtgaaataagctaggcacaaaaagacaaataccacatgaactccctaatatgtggaaactaaagggaactgggaggaagagagagacagagacagagaaagagagagagagggacacacacacacacacatatgctaatggatataaaattacaactttgggaggaataggttctagtgttctgtagcactgtaaggtgaatatagtatattttcaaaaagctagaagagaggattttgaatgttcacaacacaaagaaatgataaatgtctgaggtgatagatatgctaattaccctaatttacttattacacattgtatacatgtatcaaaatactactttgtatcccataaatatgtataattattacatgtcaattaaaaataaaagaaaaaaattggacaaaagccaaatactgcaaaaatcccaaatgatcatcaacagatgaatgaatacataaagtatggcatatccatactcatcataattaattaactgctaatacatataaaagtatggataaatctcaaaatcattatgttgaatgaaagaagccagactctttcattcaagtattgttccatttatatttgtaaaaatttgtataacattatagaaaatgcaaaccaatctatagtgacagacagcagatccgtgattgtcttgggccagggacagaagaaagagggactacagagggacacgggacaattttacaggtgatggaattgttctccgtattgttatggttgcggattcacaaaaatatatccctctaaagactcatcgaatatgggcaatttactgcacttaaattacatcgattaaaatttatctttaaaaataaatgaacaagccaggataaaaccagaataaatagtacttacctcatggagttctttgagtaatatatgagattatacgtttaatgtacttatgatagtgactcacatattataaatatttaatatttgctgtttttatcattattattgatatgactaagattattaataagtcatttgtatgtgatgaaaagttgattaggtttcatctttccttcatgatgatctgtatattaattgggcctccatacaatattctacttagtttcaaaaatgaattattgagttaaaaatgacttcagatagttggttctttggcttaagtctgcattcacagaacccatatcctggtgaacatggtggcctgggtcaattgcagaaaatctaaagaacagaagctcctttccctcacttccttttttttttatttttaattacacaaagaagtcacttacagatgctagcccctttgccttcaaagaaaatgcatgcagacctttctctggtgttttagattcttgttgcttgctaaaaaaagaaggcaaaatagtgctgagaatttcccctgccagatgttaatcaagaacagaagtaaaaagtgctccatattttacaacatgccatctccaagtcttcttacagtcagctaatagaccaagaacacagatacagcatgtcaaagtggtctcaatatattctttttaaactctaaagcgttagtaagtagatatgataggggtgccaccagaagcatatctggctctggattttaaaatttgaacattatagccgggacccaaaatattaaagattaaaaaaattaggaagtggttaatcaacctcattaaggaccatgcatttcatagatgtttgttcaagatagaagggctattttttccttattctaattgttacatgggttttaagtctgtttacctgcttatatccttgaattaattcaagttgtacaggctttaggagtatagctccttgagtgttcttggaaaaaaagaacgatcttatataaagacccaaaaggaacagtacccagtgtctgtccactttagacagatctagaaagccactagaatactaaagacagcttctgggcagttttcctagcccagtttgtgtagcatcaaaataaaatataagatcacagatgctttggacatggaaaaaagtcttgaacataggactttgggaacaacattaaagagctgagtgcaaaagtgcaatatgcatgagtaagcaaatgcttagagtatatatgtgtgcaggcaaacatttgttacaaagacaccttgcctaactcctgcaaggttggggaaggaagactagagaggggaaaggaagaacatctagaatttggagaaaacagaaatttttggactgttcttcagtttttgctgatttttctcttgctcgaggcatttttttcagagtaagatattcctcagggatgtccattttatctaatagcatacaagtgggtcctatgccttcctttagtgtatgattaatctgtttgccatttgaaaacttttgttctgggatccatccaaggtattttacataattatctggtatttcatctgatacacaaagacccataaaagcaagatatattgcagtcctgggttagcattaccagagtcatgagtgatgtctgtgctgaaagtcaggaaggcattcctgaatgtgaccatcattaggccatgactctcctgaaagtgagacctaggaaactttcctgattgagttattcaaaaccagaccagaacttacacttggcacagtcagaagaaaggctggacaaccaaccaaatgagtcttttcttctccaattcctacattccttttggaaatttgttcttcacattaataaactcaagagtacaagtaattttagaaaaacctgtatgatttacaacccaggggcctgactttcttgttgataacacgtaattcaataatgcttctctggaagttccttatatgtataggaacaaaagcttgtgatcaaaattggaacatatggactgaaattatttctaaatatgagaccaactacttgaaatctaggctttgtggtcaccatggatagctgctaactctggctatccagaacaaccgcaaagaaaaacagcaaaatcaatatgaatgttaacaagtccatgtacaaatactccagtacttcactcacaggatacaccttgggctttttccatgatcacttctattattttagacataattctaatagtctagttaattaatcttgggccctgagtaatcagaagaaacaataatatgaataagaagaccgattcttagaggcaggcatacatacatcagagagaagtgacccatcacagaagtgatatgggaaggatattaaaaacatcccaaaatccaatagtttgtgatctctttattgtatttaaaagatgtctaaaataggtagggacaaagaaatctacatgacccaagaatcccaaagagtctcctggaatacagtaaacattgagattaagtgcagccatagcctgaacttcaatcctgttcagtgccacctggtttcagttctcagtgttctcaactataaaggggggataatactattatctaactcataaaattactctgacagttataagacattataactatgaattcgtatatgacttaatgtgtacctggcacattgtattgtaagtactacgtaaagtattagctatgataattatgcatgtacatataaaccgaatagtctggatcacaataataattacaccataaccttgtatagtgcttcagaggatccctggaagataggcaggacagatatcagtttgaaaaagactgtcttagcacattctcattttttgacctacattctgatcacttgcttacttcctggagaaatcacttttagcctctaaatctcagctaaaacagcttcttttcgaatcctcctgtggccaagaatggcgtgggcccgggaggcagagctttcggtgagccaagtgagccactgcattccagcctgggcaacagagcgagactccatctcaaccaaaaaaaaaaaaacagaagcctcctgtggccaataaccagatgaaataagctacttctcccctaaggtctcccactgtgttcctataactctcctaccatggcactctgctctgtgatggtgttcttgactacctcttccaccaaactgtaatttttctaatggcaaggactacctcattcagtattaagcaaccaatccctggcacatagtatgtgtacattaaatgtgttatttagcatagaatggaatgaatctattagtctgaaagcaggccaattcactaaaaaatcaatttgcagaatgacaaattcatcaaatgtactaatttataaaatatattttaagaaacattttaaatatgtgttcaatggctatgagcatattattcttagtattatattccaattacttgttattgaattggtaatttagtgaattggcttgtggaaaacttcagtaaattgcttttaggaaaattgctttagagcccatgacttttcctatttagtaaatagttagaataatttttttcttctaaaaaaattgcatgtggaaaatatgtgaaattggtgcagagtactttgaaagtctctatacattcctaagaaaatgttatgacctatttttatttatgtgctagtatgaacaaaactgattttacctgaattggctatgtgctactcaaaaaaaaacatttttgcttgtctcagcttcagactccttatctgaaagcttcaaaggcatttttatcaacttgtctgatatgtgaaatccaactagaaaaagagactccaatttaggactacattgagtgttaaagattgcatatgccatcttactaagcaactgaagaaagaactcttatttcaccactctcttttagtattattcataggctgttcataaaagatggctataaaaataactactaattcttttttttttctattcaaaataaatctaaggaatttagcacagggctcaataaaagcttattatgattgttgttcttagttgtcattgatagcttaatctaatatcttgaaatgatatacaattaaaatttaaattagtcttatcctctgtaagctttcacaacacaatatagtacaaagacttgactctacaatccataaaattcacagtagattaaagaaatgtatcaccctttcagaacatctgaattgttctcttccttataatcttcaattatatgcttgtaatagtcatttaaccatgctttgtcccctacagaaacaaaaaagggtaacgagtttaatattatctttagttaacagaatacacattaacacctccacaccaaggtaataagaaaactctttctcaaccaactttcttcactgtatgctgataacagacattaatgctgtgtagtagcacctctgtcgacaattcagctataccatgatttcacacttcctgaatgagctacaatctaatatgaggaaaagagagggactattgctcctccccactccaaaaaaaaaaaaaaaaaaaattctgcccagagactcttgagcctgccagagcaaacaggacacattgaggaaggctataacacaaccccttgggagaagatgtatattttttccgtaatgaaagctattaatttcttcagtgtatctcacacacataaaaggtaatgtagttatgcaattaatcagttttgtgctgagtgtagttcatggagggacgaattgaatattcataactgttttctgtcatatttaaactaatgttcactcttaagcattaaagctgttcttggaagttttccctactaacatcaactctctcttttaatagtaaacgttctgcctgcttagtagttatgtttttccgcatacacctatttcccttggatgtttattattatggtattgcatgtttgttgatggcagagaccatgtccaatctcccaggtcctcattcgctaatactttatctacaggtgctgagacaaagctcattcattgactgactagatacaatgcaattaaagatattcctttaaaaatactttaatgaggaaacattttctgtagctttgagaagcctgatgttttcagactagtcatcagctggatagaagtggtcccaggcatttcacctgcctgtcttttctgatctggatgtgacagagtgtcatctcttgctgttctctgaaccaaacagagaaatcagctgttcacaggaccctgggaggtgaattagaaggcaagaatggctaagaaaggaagtctttaaaatttcaagtatcttagtatgtttaaaagaaggagctatattccaaaacctcaagctgagcagtgaaagaataataagagtttttctcactgcaagcacacccggtcaaagggtatatcagaaaacccctagtctaaggttcccatggaaagacatgtgcgaatcgagtgattcagcagattttaagtgcttatttccttaggcagaggttaaacttaatgtcaagtgttgagtgaggtttgactgcttttccagctgcccaggccatctttgtaaacacaggagttagagatgaatacaactcatttattcatgatatttgcatgacttaaaccttttcacatgtgcctggaccagaggcactcttaaaagtctgagcaaatctcaaaatgatttatggagaggcttccactgtcacactaagtccacaaacatttaaagtggatgtagtccaaggtggcaggagaagcaatttcctcagccaacctggagaaatgagtgccgcacaatctaagaagatcgaggaaagcctggtaccactgaaaagataacccacttaataaaggttaaaaggccccctttggggagaagaaatctttttgctttgcccctgctagtgcaactgcctttagtgtctgggtctgtaacaataagaagttttatatttgtgttcagcctgagaagaaactacatatcacagatttaagaaaagataattcaaagaaatagaaaaacaagttacaatgacaaacaggtctcttttacttacttacttacttatgtattttattaatttatttgcccctagtagaatatttttgaaactaaatgtttctcttctagggaccatttgactattctttcttcttaagattggcctttggcagagcttgcagtgagccaagatcacgccactgcactctagcctaggcgacagagcgtgactccatctcaaaaataaaataaaataaataaaaaataaattaaaaaaaagattgtcccttgtatgagctaacactcccttgaactatagttaagttctctagtctcccaaatccctgccaatgagataaaagttgaatgtgtttcctcataacttttacttgtgaataggaccgtatttatttttcagaaactatttggggaaggtcctctttttaccataaatgacactgacaaccactaattcattttacctactggatgtccaaaggaaaaaactttcaattggcataaattgattataactttaacaatttaattgtgaacaaagaccatgctactctgaacagcttactttcatagagttttgatgaataaaatatataaaaatatggaatataaagtgtttttaagtctgaagagtattatgtcattgatttaaagtttattgtaatgcccaaggcaaaaataaataaatacaaactgcaatgaatattttataagtttgttgctctcttcaagcattaaaaacctatttcttaaaatttataagataaattttaaggatcatagattccgtgaacatttctccaaagttcacaagaaaatgagtaaaaggagccagtcatctgtacataatgaagactatataaattgtcttgaggcaatttaattttgctcatttcctattccagctccaaaggcaaatacaatggaactacatcccatctctaccagccttgccagaaggcaccacagagggagaaaatcaagttaatgagggatgggagaagacatcaaggaccatctgagtcccagagacataactgcaaacccatcctaggaggctgccagactataatagccacatatgacaccactgtacaataaaaaatcataattcagttagtttcaggtaatttttagagtattttttaagaaaagggggttaaaagatcatttcaaagtctaaggagatgtttcagtaataatacctgttactgagttattttaaagcagacaacattagaagaattttcttctttgtgtcaaccttcttttggcaatgaatggaatcgagctggtgaaagactaatcaaaccgtaatgggtgtgggactgtcttgaaataaattcttcccctgggtttttaaggcatcagctctggcagatgagacctgccaccaattagatgtgtgattgcagcagataaatgacacccactggacttgccatatttgctcttatgaaattcctgtcagttttgagacataaataatttaagcaaatggccttggacaccagaggctgccaattattgtgtcaccaactcaccaccatttgttttggtcaccagagtatttcttttaaaaaaccaagacttccagactcaaaataagttccacgttaaagcaatttctttccctccaatttcttccaaactagttttatttgcattttgaaagaagaaatggaagtttatcatttagaatgccttttgtgtctctttgattcctctacaaaagttcaaatataattgagttgggaattaatagtaaaagcaattacatcagaaaaaatggaacaaacacagtatttttaaaaagaaccatcaaattcccagagtacaatcaacacatttaagaattcaaaagaaagaattacaatgcttgcatcagcctaataactgaaatgaatccaacatttccattttaaagccactaatccaagaataaaggggagatgaaacaaattcagacggctataaaaagcactatgtttgggactgagtgttgtggctttgcctgaagtttagaattacctctgatagagacagaagttgctaagtggactgcaaagtcatgttgctttcctgattctgtcccttttgtcataagcagcttaatgaacaaggcattggtgcctatattatcgactccatttaataagaactttattatagcaatgtatgcattctcttctttttttcagttctacactgtgcattgtaaatcattgtgagactgttttttctattgatacctctaagtatattgctccaatttctgcagattcagctagctataacaacaaatctcctgcaaattattaataatatcacgtcttattcttggacgcaagcaactttcagaactgaggctacttcatttagttctgctcttcacatctccataggagaaaaaaagaaaaaagaattctagagcctgaattagtcactgaccttcttctgcagtttaaattgttgttctgtggtgattaaatgaagctccatggggcacccagccagagccagttaataagttattagttccatcaacactgttttgtcatagccaagacccaaattcagtgattattcctgttatcaaagtcttagtcactccaagaaaagcatacttggtattcctgaaagataaaccacactattttgtgatatcttcccacaaagtttgagttgtatgagctctttcctcactgctaagatttggaaagcggccctaatgtagcattgccagatttagcaaatcaaaacacaggatgcccagttaaatttgaatttaagataaacaacaaataactttttagtataagtatgtctcaaattttatgcaggatatacttaactttaaaaattatttgttgtttatctgaaattcaagcttaactgaccatcccatattttatcttccaaccctacctgatggcatcactattaagtgaacaagagaaattagagaagaaggcatccatgactgcaggtggctcaactacaaactgagattcaggaagtagtcagcacaggggcctttaaaaatctttttttcctggaggcaaagggaagctttgactggcaaggtaaatgcaactgggctctggtgagaggctgagccctgaagcagtggccgacagcaaaggcctcagcagtgctcaggggctgctcaataacggacacacctgctcctgttgggctgcttccataaggtggcttccctgtgagtatgcttttcaagattaatgatgtgcaacaaaaatagtcaggcaaggccaagaaaaggcctgaaattgagaaattagctatacagcttgttttaataaccacccctatttaggtatctccaactgttccactcaatcattcaaaggagtcaaaggacaaaggacaaacatttattactcggggtagattttgttttgcagaaatttcccaagtatgttttagtacaaacctcagttatatcttttgtcaaaaatgtattaaaatagtagaaaacaaattgcatttacattccacacattatatgtaaaattgtgaataaacatagatggtggaaggacatagacaatacccaaggctaattgatattttggagataatttttgcaaggttttcctaaaagccatgattttcacattcatcttcaatttaatgactctaagccctatgtccagtgcccatgaaaatttctaaatatgaattttatgatccccaaagtagtctactttgtgatcctctttgcactcttaggaacattattaggtaagagtaatataggaatgaaagcatcctttcccttattatggattctccctcattaaagtctttatctctttttccttttatgtctaattccatagaagctagctgacaggtgcacttctaacttatgaatcaattagtataattttcataattaattttaagatatgcttaaacaataaatgtgttaaagactgtgctgtccaatatggtatctgctagccatatgcaggtatttaaatttaatctaaagttgattaaaattgtaaaaaatttaaaattcagtttttcaatcatacgagacactttgcgagtgctcaggggccacacgtggttagggtcaactgagctggacagtgcagctctgggacatatccatcattgtgggaagttcttttggacactgttgtctgtagacaataatattttcataccgaactaggaaggatatgcatatttttaggcaccactctgttcaacagtaattataggaaaatagaaaagaaaaatgaaagatatatttgagcaatttagttggagaaaaattaccaggttaggcaccacaaatgcaacaattctaagacagctttgagggagtaaagacagaaagacatcatatacataaatgtgcttgcaaatgtgaataaagattactattacaattgtgattaaatatagccccattgtgggctctcaaagaagactgccagggtaaactccatttactactttacagctgtttgatcacaggcaagttatttgatatttctatgcttcgcttttgtcatctataaaatagggataataatcatacctacctttttcatcagggccacctcatctctgtgattggtgctccctaaagttgtacagcacatacctgtgcaactgtataaatcaaccctctgcattgagatttgaaaggattaaaaaagtgaattcatttaaaggactgaaacagtactaagcatatattaaaacgctcaataagtgttaactatacttgaggtatttctcaaaagaaaatttcccaaaggaaagaatcaaatagtagaattgaaagtcattcataactagggttacgaaccaacctggtttgccactaaatggatttttggagtgtggaaatttcagttttaaaacctaaaaaagaaaaaagaaaaaaaaaaaacaagcaaaccagaataagatagttacccatgaaaaacaaggaatatatttagccacaagaaacacccacaagtgaacaaaaatttattcattttatccagtgattaccaatattagtaacagcatatggctaaactttatgaattcttcaaactaaatgtaaatgtataagagttagtagcaaatgaagagaattaatatggttcttcttggcatttaatgtgggtatctacatgaaagccagttatacagctggagcagaaaataacacagtccctgagacttgtggcttttaaataacagcactggatacctcagcataggatcagatggttgaactaggattgttttttttccctccttttttttttttttttttttttcttttctgactggagtgaaaaggcttgaatgtaccaccctggctgctagccctggaaacctcaactttaaaggaaactgcttaccaggaaatgcttaattactacagggcatcttattcttgtgttgctctatcttttacaagccataaaagaattgtgttttctccctatgtatttatcacatcaccattgttcaagtgtaatctataccttggcacttgaagaaatgagatgaaaagtggtgttaataatggttttaattaaatcagatgtttatgatttcctctaaaactgtttctttgcacagcctagagcaagaacacagcagggcagcagcggtcaaatcaggagaagagcagatagaattagcatggatcctaaaactagcaagttgcttttcatgctacaagtctctactcaactgagcaccaaattggattttactgggcaagcccccacccagtcaatgcttttgtgagtcctatggacgacagtattatcattcatccacatttatttggaatgctgaaagacaataagtgaagataacaggcaggtcattccaaatagacatctcctcactccatagaagatctcttttcagtgagaatgttctcttacttaatagatatctttctttcctttttttttcttttttttgacaagtctcactctgctgcccaggttacagtgcagtgacatgaccatagctcactgtaacctcaaactcctagtctcaagcaatccttccaagtagctggaactacaggtgtgcaccaaaacacccaggtaactttttttttattttttattatttatttatttatttatttatttattttttgggagagatggggtcttgctgtgttgtcaaggatggtctcaaactcttggccttaagtgatcctcttgcctcccaaagcactagaattacaggcatgaaacactatgtctggcctttaagagatatacttcttaagcggtgttcaggttgtcttatctcttccccttcaggagagtggtcaatgtgagctcctgggcataaagaaaagggatattttttcccctaatctgtttccaaatcagcatctccaatctttttccttacaaacagatatgcaaaatgttatacttgaccattcttttattagtttatgcatattaaatgagtcactgattggggggtaggatgggagttcatactgggttgttacaattcacacagagcacactaagagagaaaggcaacatgaattcaaagaaacccaaagttaacctgcagtttggggtgatcagcaatgatggagggcagcagggatagaaataatgttctaaaaatagaaatagatatcatttttatttctctttaaaatatttaaaatagtttgagaagaaagtgaggaggagtgtcagttttattttttggataatattttaccaggatcaacattaaaatcagttttgactctgaatactcacaaatcaatcaacatgtctggtggcttaggagaatactagaggagaagttattaaaatcagataaggaagactctgcaacacagagtttcttgtcactagtgaagagattaccatgcaaaattatttggctttaaaagctattagatgaacactcatgaccaatagttttcaccatcaaatttgtatcaggtagctatataattttaaacaataggtcaagaattgagtcttcatcttgaattccacatcattagccctgctcacagtattagtcttcaacaaacatccttatgaatcccaaggcagaataccaatcagtctaactgcgtgtttcttctcctctgtgtaggaatgcctttgaaacaaataaagcttcatgtatggaataaagagaccacacgtggggatggaaatcagactgaaaaaagacattaacaaggtagagatcttctaatcacatagccatagcgaattaagtgactgagacctagtttagccattctgctgacttgtagtgcaatctttcactttattatgtctctcagttttctgtctgcaaaatcagaagcagtaatcctacactgacatgtggaaaactccagattacctcatcaagttttacaaattatcacagacacttgggactaagtcttcaaagaaattaggccatggctaaaataaattatgtccaggggaagataaattgtttcataaaaattaaaactattgcccctggcaactgcactagacttctcaaagcctctgatactcactggaattgaagcctgacactattaagtgagaaaagacagctgaaaattttgtagattaataaagcattttaacaacgaatattttaaaatctatctatctgtaagacaatttctaaagatagccccttggattcaggacgggaaagtccatctcaaaatgaaagaaagatactttttctaaagactttctgtgaagaaaaatcgttattatccttcagtaactgatccaagcaccctatatatttcatgtaggttttgaaattaatttctatgaaaactgaaaataaagcaattagctagtagaaagtaccatgtaaatacaaactgtcactgttttaacattgcagaagtggctcaaccaatggtttagagcccaccaattctgatttctagggattctgtctaactttgaccctctgttcttcaaaaattagatgaaaataggaaagcttttctcaaaaggaggtttgaagaagatttttgaaattgaaaattttttatatttcccaaaattcaaatgcaaatattaaaatggtagtcacaaaaaaacggaagcagagaaactaataaccaaactggtaacagtttagcattctgatattttctctacctctgattcagtccaggccttcagcagattatccaactcatcctgttatttaaataagttaatgccaaataattttgtttggaagattaatccttatttcaaatatttaaggagggcatattctcagataaaattaatttttgccccagaaatatcctttattcattccattaatacatattgagtgtctgctatgtgtaacatactatgctaactgccataacaaaagagttaccccttctcctttaccaccttctttatggaaagtggtggtgggagggagaatgtggcatgtccaggacccagctttctaactattcttttttcctttttcttgcctcttccttccccttcattttaatggtgggtcagttttaggcagatacaactagaagttggttagctacagagaggttaaacaaatacataaacatattatgaataaaaagagtcaggtttcttattaatgaagaatagttttacaaggggaaaggagaaagaggcctaaggtggtgaattggaatgtgaactcatgatagacagatagatggtagacagatagatagatagatagatagatagtgtatttgaatacatacacaaattttttagctcttccaatagatagagaaagcctccaataatgcaactaattataatgagcacacctagcactcagaaaatggtttctaaatctcatacttcattaaaagaaaccaggactctctgaaaaaacagctgactgttacagctaggaatggaaaaatatgaaatggaaatgggccatcttattgtactacaaagtaaggaattgctcaaaaaatatcaggacatgtcaaataaaacaagcaaccagcctgcttgcaaactgtaggaaaatttgcacatccaaaataaattatattaatggagtatatccctttgcataaaaatccataaatcatacagataaaaataagtaaattggcaagaagggaaaactctaccttatagtagattgccaattgtagttctagtgctcattattaattattgtttgttttcattgtgctgatttttggtgatcaagcctcagtccccttcatagtgccctctcctttttaaaaattatgtgtgcacagaaaggccatctttttcaggacattgcattttcaggcttgtggtgataaataagattgaccaatgcaagtgttcataatgactttccaattggccctgatgttctaacatgtgattgcttcatgcctggactgtgactttcagtgggagatggaagtttttcagagaaatgaactgtggaaaaatgtcctttccttaacttgaagctacttttaaaatttgagagtctggaccaaaagaagaagaatatcaggttgaagtcaagatgacagataaggtgagagtaatgactactccaaagatggcttcactgaagaaaaggcattttaagattttttttaagtcttgtcacaagatcccagaaaagtactaattttcattatcaattaataaagctatacatgcagaaatgaatacaacagaacactgctgttttttatttgtactttttggcctgggatatgggttttaaatggagacattgtaccagcttcattaaaataaacaatatttgtaaagaaaaaaaaacagtagattgccaaggaataatcagattagaaaactacaatttgggaaccacaatagtaataattgactcagacaagaatcatccttggtgctaaaactgaccggtgaaattgtaatgaggaatacaacattacatagtctcaatgcatctcctcaaaatattcttatgaattcataagtacaacatacttgttaattaaattttcactggagagccttcataaacctcatcttcaccaagttaatcagagttaacagcaccattaatgggagagttgacatatgtgatgtgattcactgaggagagcatggcatcacttctggggcattcctgccaaaaatttataaatcatgaggaatcatcagacaaatctaaatagacattctacaaagtaattgatctatgctcttcaaaaatgcgaagattttaaaagttaataaaagactgagaaactatttcttattgaaagaggccaaggacatgacaactaaatacaatgcatgatcttgaattggatcctgagatcaaaaagaacattattggaacaactaaacaaattttaaaatagtctatagatttcatggtaatattgtaatttcttgattttgattattttgctgtgattgtgaaagtacattatcattataattaagaaataaacactattcaaaaattaagaaataagacaggaatccaaggagagtaaaacttgagggacagtgaaattcctggctctctgtctctgatctttatgttggggacaaccttgtctgtctcaatatagaaatcttcctactcaggggagctaaagaccaagtacctgcatttggacaagtgggtatggaggaggcaatgtgctagaactggaataagtagtcatggaaggcacatgctaaggcacatctcctttgaaaaacatgtatatgcagcatgtatcaccccacccccccaaaatggcacttttaatactataacatctacaatgacttataatgaataagctttcactttaaatctgaaggccatgtgcattctcaatgtcctcatataactcatatttgaataataagcataagaaagtacaagaaatgactattccagaaggaatttcagaataatgattgcttaggtcttttcttcctctgaaaacaatatggtagtcaagccgagggtaagtagtaaagataaggtagacaaaacagccccagaacacagaatcccaggaaatatgaattgacctaaaagacaaataaaaaggtgactttgaaggtgttcctgcaggaagcaggaacagggactaacttgcaaggtcatcctgggcctatggctttgtctgctgtggccaacacctcctcacgtggactaccctgagagagattgctacggtctaccattttgtgaagaagtaactgtaaaactgttaccaaatcctaacaccatcaaaatgtgacctccaaagagggaccatgaaatcaaattgttttatttccaattgtaaagtaaatattttcaagcaacccatctgaatgttaagatatacccaaacaagatggttgtagaaagaaatccacagaagatgttctttcctaagcaatgatagccaaaggtccctggctttgcctggtgcaatgaagccaccatgagctcattgccactctttgcctctaaaccagaggttcactaaccaggaacactggggcccaatcaggcccttcattttcctttcatgcagttttattatgaaaattattgctccaactccccaatgtcgttcacctggttctgagcaaccagcgacctgagttagaaattatctgtgaaatgccagtagtatgaacagataagagacactgtttcctgcaacaaacattatcttgattggttgcataaatttattcaaaaaatctgggcagagtaaattcagttgaaatttatatcccaacgaacattagaaattgtaaagagaaatttcatactggaaggaatatcatttacttttatctactcttctccattagtgacatagtttctgaatttagaaaccaaattatcacagatagacaaattacccactggctaaaataataaggataattttttgtgcatcattgttaacagcttagacctgataatcttaatgaacagttttcttaatggtgcctgttactaactgcaagaagtataatagacctcatatactatgagtgtttaataaatattaattacagttactacttaaaatgaagctaatgttctcattttaatggctaccttccctattctaagaacataagaacagggaaatacaatgcctttatgaaaatattcctaactaaatttggcttgaatctaatttgaatctaatcatactcgcttcccaaaacagggagaaatccttgaatgctaaacttccataacaactacccaccaacatataatattacataaaatttcaaagtaactattattttaataactttaatgtttgttgaatttattttcatttttattatcagtttaaaaagttaatttgcaatacaattttcaggatcatgcttgggctatgatagatataagatgatgcttttgtctgtcctaactagtccttgaggacagcttgctacttactgcccctttgaacagcaggaagaactaagaacacagttgttctgatttataatgtcaaaacacaaaggaagaatgttatttagaaaaaaaagtttttaaagagctagtctaattaaataggggattgcatgtgatgaaatatagacattctctttggatgaagacactttggttctaaaagccaacaaagtgtcaaatagagtagaagggctccattctgcatgttagtctgggcgttcttgttaacactggaaatacgttcgtgagggataaaggaaagtatttcttatcctttgttttctacatacaagatgtagataatttttacagggcacagatgatgggctactatctttcataacataaaacacaaattcaaacatctttttcaaaattgtcagttatgggcttgctctttccaatgttaaaataaatgggtagattttattcttatgaggtaaatacaaccagaaatacgaaagccttctccagtctgcactgaaacagagaaattgaaccataagtaagttgtagagatattaataaaggactggtaagtggaggtattagagaatgagtgattgagagattagtgagatagaaagaagtgatggtttgcagagataattccagatgaaggtaggggttctgattacatgtcctgaagaatgacattctgaaaaaaaaaaaagatgagttgatgggtgcagcacaccaacatggcacatgtatacatatgtaactaacctgcacgttgtgcatatgtaccctaaaacttaaagtataataaaaatatatatatataaaaaaacttggaactttgagaagatagtttaatcaaattttaaggctaattgaaggaaaaaggaaaaagaatgggagaacagttaccttgaaatagtggattaagatattacatacccaaaatataaaaaaggcaatatgagagaatgtttgtaagaaactttggcagctcaggattcagctggaacctagaaaagaaattacagataaactgaacattgtgcctaaacaaaaaggattcttaccactgcaagttatagattataagacagttccatgggaccaagacttaggaaaaaataaatatatccagaggaagctagtaaatttaaaggattgttacaggaagattctgagcacacgtgttctcatctttggggaaaaatttcccttcccttagcacacatgtactcatgcatacacactcacatacacacacacgcacacacacggactcaatcacaaacacacattgaaatttagctaaaattgaacacagagaatcttgaccagagtcactttcagacacttctctttaatgaaagactttagatatctcttctgtcaagaggtcaaatgtcacaagggcagattattacatgtttattttaaaaaagctaatattaaataatttgaatcagttatccttgaagaaatacatctctttaataaagttaatcatgccaaactaaaaaacaaaaaaatgagtaattttttcatattttttcttgtctctattttcaccatcaaattttttactcggaactgggcacagtggctcacgcctgtaatcccagcaatttgggaggtagaggcgggcaaatcacttgaggtcaggaattcaagaccaccctggccaatatggtgaaaccaacatatctaataaaaatacaaaaatagcaggcatggtggtgcatgcctataatcccagctactcaggaggctgaggcaggagaatcgcttgagcccaggaggcagaggttgcagtgaactgagatcatgccactgcattccagcttgggtgaccgagcaagacttggtcaaaaaacaaacaaaaaaaaaatcacttgcgtcagctttgtgagaaaactgaatcagaacttttacaacatctatgcctctcgtcaataaacttctgctataacatctgacttaattatatacagaaagatccattatcatcacaatactttggtatacttcaaagtcaaatcattttttcaggaaggaaaaatttatgacataagtagactttggaccctattttgtccaaatctttcaaaaactaagaaacatttttctcaaggggaaaaggagagaagtttttatatgttgctttatgcagtttccattttgaattctctttttggaagttaatatcttaactaaattgcctaagaatttgccccaatacagttaaggtttatatatttcaacaaagactctgctcataatcaaggcatgctatcaaagatataagaaagaagattgacagttggcatacattgtagggaattagtgcaaatcaaggagagtaagaaagctaaatccaagaaggttccatgttggagtaatcccattaattcattcaagcaacatttactgagagcacttattatatgctgggcattgtgataggcacagaatacataaagacaaataagccattccatatgccttcctaaagttcagactttgctagggaaaacggacaagtaaaacagtaactacaaattaatatgatcattgtttggattgaagaaagatttcctggatgccttgatacttgaaagataagaaccaagtaactacatcaaaaagagagataggttctccagacaatgatagcaacatataaaatggtatggaggtataaaacttgatacatttgaaaaattggattgcggagcaaggaaagagagcagggagtggggaggtcaggtaaggaagtagaaacatcagtcttatataataaaccaaggagtttgaactgaattgcactaccagaaactgagggaaattattggagaattaaacaagcagtgacttgagcaaattttcattttagattcttcacttggcaagcaatatggaggatgaattaacgggtagaaagcataaagaaagttaagccagagtgaggtatgtcggcatggccagtgacagggcaagaaactaagttcatttactggatgcttttcaattgaatgagctcaaatcagaagctagatgggataaataggctcaaaacataccatcaccctgtcaggttcccgtatgtggtgagaaacttggcactctcagaatcatgtcctttgagcttgaaaaacgtgggttaaaaagagagatgacctggacatgactcacacctataatcctagcactttgagaggccaaggtgggagaatcatttgaagccaggagtttgagaccagccagggcaacataatgagtccctgtctctacaaaaaaaaaaaaaaaaaaaaaaaaaaacagccaggtgctgggtgtggtggcacatcatgcctatagtcctgtctactcaagaggctgaagaaggaagatcccttgagttcaggaggtcgaggctttactgagctattatcacattgctgcattacagcttgcatgacagagtgagaccgtgtcttaaaaaaaaaaaaaaaagaatgaaacattctaattggccaagcttagtactcacctccatggccatcaggtaccgtgatagggaagcccaaaaacacctgtaaatgtagtgttacctaaaagaaggtgggtgtactagaagcagaaagaggaaaatattttgtacagacagaaatagcaaatatccactatggtttagcagctagatggaaaccaacaaggacatgaactaacttgaggaattgttgactaaagaaaaaaaacagaactaggagatattaggaagcaaaattgacaagacttggcaagtggctgataggattgtgggtattcagtttctaaacagatggtataacattcaaattttctgtcagaaatagaaattgtgcaaagagcagaaacctaaatggaatacacccatcacaaaaatgtaagtgtgcctgatatttcgtttaacagatacagcaattaaaagaaagattggggaggaggtgagaaagagagaagttagagataattcctggttatctgactggacctgctgagtggagagtggtgccatccaccagagtaggaaataaacaattgttggcacagatgatctattcagttttggctgtgtctggaacattttcagaaatataatacatcatcacaaaagagaatagcaaggaatcgatgccaaaccatcattctgtaaagcatcctgatgcagtagtttcagagccagacaaacctgaatttggatccagaagccctgctgtatagttgtgtgactctaagtaagttcactgtcaactggttcctcaaataaaatggggagaattaaaacacctacatcatagataatgtatattccctggcatgtggaaagaattcaataaatccaagttctcctctgagtggcaccctgaggaattaattatcaaagattaagtaccaattcagagtgcaaagagaaatatttatccagttcatactctatcccaggccttctgagtatataatattatataagagagagaacacttgtaaattcaaggagtttgcgctctgcttaggattaatggacaagtaagataatttcagaatgtggaaagtatcttgaaagaaataaacagagtgacatgataaagagaaactgcagtggtctctattgattgccaggttgattggcttgggctttttcatactggagaaggcagagtcttaactatattaaaatgacgtctattccaaacatgggttttccttccctgtgtatagactctcaccatgagaactaccatccaagggcttacagaatgcctgactgatctgtgtagaatctcctacaatattgccttagaccaaattataacattttatggcagggtaggggggagtacaggaataggaaagtgacagaatccccctgccccactattgatcatgccactctgaaacagtaatgtaatgggctactataagctcaggtatgtataagcttgaggacaataccctt

SEQ ID NO: 1389 - DNA, 20001 bp, Homo sapiens
aagggtctgtctccaaaaaaaaaaaacaaaaaacaaaaaaaaacagaaaagacaggagacagctgtgatggagtggtcagtgagcagggtctgccaaggcgaggaggtagacagtgcaggcctggctcacaggccagtgtcggggtcagaggagctggaggctgatctgtatacctgggaggctgcaagagaggggaaagggttctggaggcacaatgtggctcagccacttacctgctctgaggcttgtggaaaattattaatttgccatttttgttggatgatgatgaatattgacagattcatgtggttcatctgaatattttgcctccttgaaccttggtttctttagtgctgagatggagatgatagcatgtaccccgaagtgttgacattgagattagagataacacgtgccaagggcctagtcccatgtctgggaattgggagacacaataaatggtagtcccttttgttaccaggttggccaaggtgggcacaatggctgagacatcacaagaaggaactcgggatcacttagcttaagaaacaaagaaccatattcattcctgaccctctctaattcacttaagcagcctcccttcctatctgggcctctgagttcccattttaaaaatgaagagattggccttagaaaaactctaatggccaatgaagctgggagataaatgaaacaaaatactcacccccctacacggtataaattgctgtattttcactaggaaagtggagcatcaagctgatgaaataagtaatggtaattctagccctacattttgttattaaggttaagttgtctctgtgtgtgtgtgcatggggaagtgggggaaaggggtatatgtgaacgtgtagtgtgtgtgtgcctgtattatgttgtgtgcatgtgtcctgttaggtgtctggctgagtctttgggtgtatctgtgtttctctgtctttgtctatgggtagagggatgagggaagaagtgaaggtagtagccagaggggagagaccatgaatatttactgtgcttctctcagtgccaggggctcgggatctagcagtcacaggtgggggtctctgtctttgtgggactgttgctttagtaggtccaacactgcttcattctgcactctcagaaacagagtgaccctcggtttctgagttggagaatggagtttccagagccttggaaataatataaggcccatattgcaaatgtttatcttgcagtcagaagctgcaggcccctgaggaggtcagtgtggattattcctcttactgggagttctactagagaagcctcatctctgggtaggactaggggctgcaatgattgatgtggcataggagcagggggcagctggccttgagcttgcgtgtagagcaattaacatttttattgctcccccacccctgaccccttcagaaaacaacacttggctaaaagccgagctttccaattatgccatctataaatttagtgacattggcaagagaagcaaagaaagagagtgtttgctttggctcagggctgatttccatcctctcactctgtccctcctgctgagagcttccccatggagcatttgaggaaagataggaaataatcattcaatggttacaatggagattgttggtttacggagctaacatatgctcccatatgtactttctttattggaagattatacctcatcaactcatttccttgtcaacccaggcagaaactaaagtgcacccagatctcatcaataaaaggggcaaaattaaattcatcaaagaaatggatgaaacagggtctgaaagcacatgcccaggatcgtggctatgcttgcactaaggcgaatattctggctacactggaagttgctttccttgaagatgtcttctgatatttatctcagtaagggtttctgcagctttgtctgtgtatctcttatattctaagttccttgagcctgggactgcatgtatatgttacccaggagggcttaagaaattcaagagctctctggatgaatggacatgttggagagtgggcatgcttgggtcagggcttgttgtgtgccaggcactgtgctcagttcaccatataggtgaggatccatgtaggatctcaactcttcccgaggcagcaaccaatgtaagttgtggctcacagagaatcagtagagaggagtaagagaatgagcagctctcatcctccctttgaagagggtcctaaggcatgcagtcccaacagctggcagaagggatgccccagcggccagccatcttcttcgccatcctggttgttgagttctgaaccttatcgttaaacaatagtcaattccaccaacagatgtcatgccctgagatagaaatgggtactaaaatgagaagcaggaggccagtgagtgtgggcacattttggatgactgcacagggcagacatagtagctctaccctccaggctggtgtgtcatctatgtctggggggcatggagcttaatgcccactgggcatcaggcacaagttggtgtatctgttagatcaggaagtgagccagccgaaattctcattgcaccaggcactaaggagcctcctggagagaacttatcctaacggcagaggaaccaggcagggcaaacttgagaagtgtcaagtgttatccaatgaaaagaccttcttccttgtttatctctgatcttgtgctctgtctgatggatgactgaggtctgtggtgagcaggctgctggagggggctctaagggaagtgaccaaggaacattgcttctgggcccctctgagagcataggaaccccgcctccaagagcatataaaccatgccactccccacacacctcttcatgatcttttgcgattttgagcacccagggacctctcagagagcagcagcatctgggtttggcactggggccttcagagccactgatatgtccagtagtatggtgctgcccagagaaatgatggcaccaggggaagtagaggtggagctcacagggtggccttgactcaaatcacatggtagtgtggtctcaatggtgagattctactctcctgtgcctgaaactaggtgagtgccctcttaatatttcgcgcattgttgaatgcagaactcaccctttcttggctgttcataatacaatagtaggtttttatctcttactaatttgggtccggaagtccacttctttatttggaaagaaaaaatcgaagcattttcaaagaactgatgtgctgagttgggccatcatgtttattatatcattttcccctaaaggcttcaatttaccaaaaactgtactttaatacttgatcatgctgttccctgtcttaatttttttttaaacatagctgcatttgcagagaaccccttgtggattaagaagcctagaaacatccatgttggtatctgcactgagagggtcctctgaatgcatcagaggtatgcattggtactatatggcaggtactatatattttttagaagttggagatgctgccatttgaggagttgaaggcaatttccacatttttgaatgaacactgcaacttgtctttgggggtagatcctcctacgtttccgcaagcactctctccggtggggttgggaggggcttccagtcatgcagatgttgggtaattaaaaaccacctcatttttcttggggaagctcccacatgtaccaaacaacaaaatggaagtcctacaaactgagattctgagtgttctgttctgaaaagacagctggtaatgctggcagtgtgtcctctctgagctggagcttgttcagtttcattctgttttgttcttacctctgtgtttgacctgcccatgcccagtgttagaaaacacatgtgtcttctcactctggcatctgctgacagaagaagggagctaggaccagatgagggcgagaggggcacctgtctgaactcatctctttccggtgaggaaagactatgaacaggaccagggtcaagcttaggcagggtagattggaccattgttatagttcttgggctgttattttatttatttatttttttgagacaggatctggctctgtcacctaggctggagtgcagtggtacgcacgatctctgctcactgcaacttctgccgtccaagctcaaaccatcctcccacctcaacctcctaagtagctggactacaggtgtgcaccaccacgcccagttaattttttgtattttttgtagaaacaggtttcaccatgttgcccaggctggtcttgaactcctgagctcaggtcatcagcctgccttggcctcccaaattgctgggattataggcgtgagccaccatacccagctttgggctgttatttattgtagtaaaaagccagatactgttgggttttatgacttttttttccagggtgcacttgcgggtggcttcctgaggaagtagaggtttccattgtcaacctgagaagaagttaattctagagcaggagggttgctggcattggatagagggtatagaaggactatgttcctaatctggggccaagagtgcagaggggcttgggagacaatgtgcatgaagatgtctggagcatcctggtggaggcgatgagtcaggtcccgccatcggggacaggctgggaggtgcacaaggaccagcctctctacacactctgtgtgaggcagagcccatgggcctttgcaatggccagctccaggagaatggagttgccttttgggaagatgtatgcttccctaaatctgtgcaatgagaaattgaaaagcaaaatgtcctcatcccaaagctgggatgatgtggtcatcagcagccagactaggaagaagcagcagctgtgtctggccagacaaggaggtctgagaggaagagcctggagcaattactgggaatttgctagagagatttctataaacagggcttaaatgctaatcatttaggtataaaaatagttactttgatgtgtgtcatgggttggtgaggatatggattcctggtttccatggggatccccacaaatctcaacaatacgttgtttttctttataaaaattaaaattaattatattagtgtgtgggattcatgccaggcctgtggaatggaaaatgcagggagtactctttggaccagaaagaaaaaggctgggaggggttaggacttatgtgcacagggtcaaacctatgcaagtgtagacacagggaaataaatttgttctgtacacttacacacactggcactggagggtgacagggctgagtctgtcattctcctttactgtaaaccattgttcctggggcgggatacctacagggctgaccaccaggtttttaaaacagaaaagagaacccaacagtgtggcattcttcaagatgatttgatggaaaatgtaagagatgaaaggttcaaacattttgccttttcagactctggtatgaggaatcagtaagaaaatgaaaataatgggtttctgaaattagcactgaagtctgattttagtccaaggtgagattccaatttcctgttaccttgacctgcccccacgacctcagtttcccctcagtgaaatgccgggttatactaaacgcctgctcctttgcagttgtgatgctctaggcctctgcgatggggctaccacttgcctgagacttggtctctcaaatggagatgcttagcctgctgcccttggctatgcacacattggtggcttaagcagaggaaggctgtctttcagtcgccaagcatgacaaggaaaaaggccttcattgcctagacagcctgcatgcctgaaggccctttgccaccctgcagcgccccctggtgtttctaggtgtcatgcataggcatcctcccgagtcccttgcatgaagccaggaacctattctataacgcagagaatccaagttgggggtgtcaggattgctaggtcatttctctctgcccaccagataacaatattaaaatcccggttatccccagtagaaaaccagaaaggcgcattaagcatgaatgctgtcatatttcatttctgtgttatactgaattcaaagcacacaaaacatgaaaagaacagaacttctttctctagaaacagctatttctcatcagctttaaattaaaagcatgttctgggcagtccttggccttcgacagcctgcgttcatatcaagttctggtttacaagcagctgctgtgtgattctgggtataacagttatctgtaattgaaatcaccataaaacaaatccccccttcactggtggagtcggtaatcaacatcaggaatgcagcattcaggacccataaaatatgcaagattaatttgctgaactccgttcaggcttccaacagctctgtcacctggggccagaggagcagcaaattcattctgaacctccactagtttcaagatatcaaaagtggcctccttcatgtcgctgtcttctgcagtgcgtctctgcctttgcagatactttctggaaaaatcaaacagtctgccaaggttatttggctgtggagatgctgaagtgctccatctagttcctttcttccctcttcatttcttcccatctcagtaatcttcctgcagacttctatagccccagactaggaaaaacagaagatcctgactttggtcagtgcaccggacattcctgcttagatatcatatcaaggaagaagaaatacctaatggcaaagcattaggatttgagttaggtcatcagcagccagaccaggaagacggctcagtgggttgcagtatcttgctcaggctcccccagaaagactccagagctggttgttggttgggttctagtaatggttaaacagtgtgtaacaggtgtccacagtacagtcaggcccctttcctcttcgtatttttcatgcccttgctactccagccaaatgaagtgacttgcagtttgcagcatgactggtcacactttgcacccatatttttgcacatgctgctgcttctctctggcatgtcatgatctaatctggtctcgttccagctctgcttcttgctgccatgtctccctgagcaagttgctgttctttgagtcttaggtcccattttaaagagagaaccttgattgccaaaataccttttaattcttttatacttggattttacaagaaagtctgggtagacatttttaggtttcaacttcctctgttcagtctggtctgttactttgttacttcagcaattttcgatattccaaaaatcttgttgatgccactctccccttttgcctactctgttttctttgggcttgcatgtaatacatcctttgttccttaactattatcttcaaaaagttttgagagtagtcaatatcaacatacttgttaattgccatgcttatcatgaagactcccgacatttcttctttcaaataaggtgatacagtaatagtctaattattacagatgaggaaatagaggcccagagaggtttagaaaattgcccaaagccacacaggtagtaagtggcagtagaaagattagaatctaaaggttgccttttaataaaacccctgttcttagtgactaggttgtgctgtcatgaacacatgacaaatgtgttcatctgtcgatactgtgaactgggctcctgtttgtccacctttacatgctgctcagttcttagcacactgacaacaccaacattctgagctaaaaaacgaaacaaaacaaaacaaaaaacaaaaacaaaacccaaaaaaacacatggaccaggcaaagagaccaaagcaaaggatattctcacaggcccttgagaggctgattgccggcctttccccctcaagcgcctgtcagaatatcctttgcttcagtcactttgcctggtccatgatatattatgcacagacagaagtgtgccttttgtcataattttaatttctacatataaaatatatactcctgtgtccccctgatgtggtggttgagattacagtgaggaagacagtgtagggatttttttccccccaagaacacactatcatttttttttttaaattgaaatttctactgatgcacttatagattcacatacagctgtacaaaacaatacagggagatcttcctgtgtgccctttctcgctttccctggatagttacatcttgcactttattcattcttttagctgcctaaatattatattgacatattttcattatcaaagattcaaataatatggaagcataaaggaacaaacatggaggtccttctttaaccacctggctcttctcctgggctctctcttcaccccaggtgccactttattctgctctgacttcttcttccttcacactccttccttgttttgttatgatggccaacatgatcctggggcagagtgggatctggggatttctggctgactcatcaccttcaacactccggggaatccggcctctcttccatgatgatcataggtggcatgggcaacctttgatctcaactcttcttctaattatctggcatcttttcaattcctgttgccatccttttctctgtacccagtcagaaaggaataatttctattctacaatagatacaataatacattttctatacctggtaatattaataacaaatagtacaaataattaattagtagaagacagatattttatttgttttatttgacagatattgccagacattgttctaagcactttataaaatattaattcatttaatcctatagcaactctatgaggaaggcatcattagtatttttaccttgcaggggagtatatgaggcagagagaggttaagtattttgcccaaggtcacacgcagctagtaaatgatggagacaggatgcaaacccatcagtctggctctagagtctgtgctcttaaccccttatcagactcactgagagttggaaggttcaccccctttccttcccttcccttctctcccctcctctcccctcccttcccctccccttttttaatattgacacattcccccaacattgacacctatcttgcaggctataaatatgttctaatatttaaaccttgaaaaggcacataccctaacttatcatttgtccctgtgcactgtctcaagctcctaccccatctctctctttcctatgctatttcctacaagcctggaaagactcttctataactgctgtctcaattcctcatctaattcacccttgggctcaccgcagtcagagcttctatctcagtcactcagtagaagctactctgccatgatcaaaactgtcatttccttttatctctccatatattgatgtgattaattatattaatgcatttcctaccatggaaacattctgccattaacatcagttttcattatttaaactcagtgctggattccatttgctaatattttatttatgactttggttagtatcagatggacagactcctttttgaaactcgggaaacataggaagttctttctagttcatttagtttccttgttaatttataggggtcagtttccttgtataaatggttttactctgtatgtagttcatgtctctccccatgggatgtctaccatttaccgtttaaaaggtaaacagctttctgcctgtggatgacactgaggaaatattgttaaagtccctcttctgactgtcattgtgtctaagtcagagtctcctaaagaggctgaacagctgcagaagctctccatcaaagagttgggctttgaaacaaccgatgaatgtatgaggagccattttgagcaatggggaacgctcacggactgtgcggtagtgagggatccaaacaccaagcactccaggggctttgggtttgacacatatgccactgcggaagaggagtggatgcagtcatgcatgcaaggcacacaaggtggatggaagaaacacggaaccaaagagagctgcctcaagagaagattctcaaagaccaggtgcccacttaactgtaaaaaagatacttgctggtggctttaaagaagacactgaagaacatcacctcagagattattttgaacagtatggggaaattgaagtgattgaaatcatgactgacagaagcagtggcaataaaaggggttttgcctttgtaacctttgatgaccatgactctgtggataagattgtcattcagaaataccatcctgtgggaatggctacaactttgaagtaagaaaagccctgtcaaagcaagagatggctagtgctttatccagccaaagaggtcaaagtggatctggaaactttggtggtggtcgtggaggtggttttggcaggaatgacaactttggtcatggagggaacttcagtggtcatggtggctttggtggcagccctggtggtggtggatatggtggcagtggggatggctataatggatatggtaatgatgcaagcaattttggaggtggtggaagctacaatgattttggcaattacaacaatcagtcttcaaattttggacgcataaagagaggaaactttggaggaagaaggtctggcccctgtggtggtagatgccaatactttgccaaagtacaaaaccaaggtggctatgccagttccagtagcagcagtagctatggcagtgtccgaggattttcattactgccaggaaacagcttagcaggagaggagagtcagagaagtgacaggaaagctacaggttacaacagatttgtgaactcagccaagcacagtggtggcagggcctagctgctacaaataagacatgctttagacaaatactcatatgtatgggcaaaaaactcaagaattgtatttgtgactaattggataaccagtgattttagtttctgttctgtggaaagtataaagcattccaacaaagggttttaatgtagttttttttgtttttgcacccatgctattgattgctaaatgtaatagtctgacatgatgctgaataaatgtgtcttttaaaaaaatgttctgtgtaaagttagtctactctgaagccaccttggtaaacttccccaacagtgtgaagttagattccttcagggtgatgacagattctatttggaatttatttacaatcttctgggtagaaaacccattgtcttcagaaaccttggtgtagttgacctgatggttactgttgtgacctgaagtttgccattaagagggaaatcatgaattatttgttataaagatgattgttagcacatcctatggaatacatctaaattgattaatggtagcagataaaattaaagatggaaatgaagtatgtgtatcacccattgtcatgtgtaatcaataaatgatttaattatcttgaacaaagtaataaaagggataaataaatgtgttttctaattagcactgaaatagtcacataaggcaatattttcacattggagcatgaagtgtgaaaattaggaaagcaagaatcatctgattggcttttacatggagtttttgggggtgagatccctaggaaatgaagattggtaggaagaacattctctcttgagataagccaaagagtaataataatgaggttagtgaccaaaagtaaaagacaggtcagttagaatattttaaggacttatactatgctttttattgggccaagcatattgcatgtgttacttaccaggatgtgaagtccatgaaggcaaaacgatgtacattatgttgattactagttcatttatagctctatatggaagtgctgctattatgccccttttacagacgagaaaatcgaggttcagggagttgaagtaacttgctgaggctcccccagaaggactccagagttggttgttggttgggtcctagcaatggttaaacatagtgtttaacaggtgtccacagtacagtcaggccccctttcctccccatatttttcatgcccttgctactccagccagatgaagtgacctgcagtttgcaacatgtctggccacacttcacacccacatttttgcacatgctgctgcttctctctggcatgtcatgagccctgttcacctggctcacttcttttgccctttgagttttctttatgtatcaccttttccttcttccttccatcacacctctccctcctccctggggctgggggaggtgcttttctcctctgtcctccatgatcatttatgtcatgacttcctgcccattggagtttctccaggttcttttctgcagggtacttattgttccccatttgcactacaggctacctggatctctcagaatgggtttgttggatgaatgaaggctgagaatctcttgctggttcctctacaacctgagcctgacctgatgactggcagtagttgctgaattctaccctcaacagtggtgcaagtttgggcttctgggcccataaacctatatcccctgaccctctgaccatctctgaccctcttgtgaaccatctgttatttcaaaaggtatcatacattccttccaaataaaacttcatttagctcacttatttgaagagtaataaaccatttaactcatttataactcactgaacaggaggttgaacacagttataacaaaaatcaggctgaggtcaaaaccacccaaatttgggggaatacatacagccccaataattggtatgagtatatgaaaatccctttgagttttctgactggttctcaaaaagaaattatatcccatcttttttcttccactgtggtaaatactatgtcattcaacttagaataattcagttcatttttatttccagaggatacataactgatcagaagatcttctttacatttagaaacaaatatttctttctgtggggaaataaatggaaaaaaatccagaaaaatacatcctgcaattagcttcagagatatacaatttctaagaagattcttgcccagggtatagcaagaacagaaaaagaaaaagccttatttgtacttaaaaattggatgaatattgtagttctctcttccatatgcaaatctctgtagcattttgctattaatctgccataaactctcaactcttcctgagactgaactagcaggtcaggacaacacagaggctgcagttgtcaatgcagcatgtcagtttttgaaagcaagtgtgtgttcacgtgagagagagactaacctacctctctgtgcaggcctggaccagttctaccagagtcccagttggattctcaccactgagcactgacttggcaccttgtcagaactcaacaatatacatagaatgaatgagtgagtgagtgaataagtgactgaatgcattcacccttccaagacatcacgctgtgactggcccatgtatatattttttacacacaatgcctccagaatcctacctattctttgagcccagctacagtgccacctcctctgtgacatacaagaattgtgagagcactaaagatggagtatcaactctgccctaagttatctgaaagccttcatggaggagatgccattggagttgggtctgcgtgaacaaagaggctgcaaagaaggagaaaggagtctctaggaggaagtggggacactcctgcaggtgaagaagctcaggtgaagggaaagagatatcaacactcttgttggcctgctcccagagtccaccaggtcagagcctctgcagctccccaacaggggtggtgacctctgcagctccccaacagaagaagagtctttctgccccatatgtctacataccgtgtaatcagagtctctgagctgaggacttccatgccctgagtgccaagagcatctcccaggctctgctctagtatgcctacagctccaatccagccccacattccacaagagccaagaagcacctgaggtgtctccagagagctctgatgggaacatgtgaaccaccttctcctgtgccctcatgacccctcaggacccccctttctggtagcccccagtatacagcacagggcccagaacattgtagggctcaataacaacttatggaagaataactacttgaaacttggaggtggagtcattaccacaattcccatgtcaggtgtagtagattgtttcttcattctcagaactctcagtggagggacagcttggaccatttccatcctcactaaatattcaaagagtaattgcccagtctgctgtttctgttttcatctgagtaaacatgccatgacatgaggggataacctcttgtgcaagctgccaccagacactaaatagagtggcatggttctgcaatccagatctcattaggataaagagaattatcctcatcctgggtatgtgggagaaaaatgaatggcaagattaaatgtaaactccagatttacagacactacagtgtgcacaggaatttcaatcaaccttgaagcaagactaaagggcaaggtcaaaaacaagtttcccatccaacatgctttagaaaggcaatcagtacccaaaaacatggcggtgaccactattttgaaattcttgccaggcctgttgacttaaagagaaactataatgcgccaatgctcagaggtggtgtatcccttcctttctaaccacagcgaggttaaatataatgaagaaaatactctggtaggacttatgtaagtgttaggggaacccaagaggggcgatcaactctgccaatagtaggacttccacggggaggtgccaaccagagctgtggagggaaaatcagatatgctagaagaaggaatcctaagtggtggtaatgaagaactcagtggatctataactggatctactgaattagttttatgatggctgaaggggttgagatgttagggtgagtttcattttgagagagataatggacttggacttgtgcctgcttcagggattttggcaggtgctgaactctgccccttctcttcttatcacctccttagcgccccctactcccgctgctccaggatattatctcttgcctcagtcgctgtcttagactcctatgatctctagcatctcttcctgttcctcctctattctatgtcccatggttcccacagtgagctttctgagatcaaaatctggccacggtcttctcaggttaatgcctcccaatcacttccaaaggacacatccgaattctctgatgtatggggcctgacgtcacacacccgcatccacattttccttccatggtgccgcatccttcatccattttgaacttattccagaaccaagctctgctcttctctgctcctttgcctctgcctatcttttcttcattaccaccacttaggatttcttcttctagcatatctgattttcccttcaccgctctggttggcacctccccgtgcaagtccccttattggcagagtaggtcgtccctcttgtgttctcctaacacttacataagtcgtatcagagcattttcttcattgtgtttaattatttgcacccttcgctacctagtgtgtccatgtgggcagacctcagatttgattgcctgacacaggattctcctttcctgccagaggatatgggacataaagagagataaagactgctgtctccatgtgtttcccttcacctgctggtgtgccaccgacatccctctcctaacaccacatggaacttttaaacatttatgtatcagcgttgcaggtataactgacatacaataaagtggagtattgtaagtgcacaagttttgaaaaatgcacacaccaatgtaaccgtcactctgattaagacataggacattataatcattccagcaagtttcctcaggtcttttccagcaacaggttgttcctcttatcagacaaacacagatctgttatctagcataaggagttagttttgccagttctaggacttggtggaagtgaaatgacacagtatgtactgtttgtgtctgtcttcttatgttcagaatatttgtgaggttatctatgctgtgtatgtcaataggtttttaatttttttttctgagtattattccattgcatacatacagattgagtatcccttacctgaattgctggggaccataagtgtttcagatttcagattttttcagattttggaatatttgcaaatacatgtgatatcttggagatgggacccaggtctacacacggaattcatttatgtttcatgtgcatcttatacacatagcctgaaggtaattttgtaaaatattcttaataactttgtgcaagaaacaaagtttatgtatgttgaatcaacagaaagcaaaggtatcactatctcagccatctatttggacaattggtggtgtttggcatcactatcattgatgaatttatatactacctggctctgaatttatatgctatcaataagcagttattttcttacatttattcacacataactacttaagagtagaaatatgatctaccatgcacagagtgaaaaaacaatgtgttcagtgtaactaagcagcacagaagcatcaatggaatgcctgtatcagctgttagcaaaaacaaacaatgccaggctctcaatccctatctcggatgctgtgttttaattaaaaggttactgtatactgcattttattttgttttttggtgagaagaagcatcagaagcaagtgaaggaccaggaagtgggtctcctaggaatgaggaggcattctgctggatggctttttaaaatgtctgggagggttattcctgccttggggacgttgaatgaaatgtattgtgcacatgcattttgacctcatgtgcacaacatgaggtcagatgtgtcattttctacttgtggtgtcatactggtgctcaaaaggtttcagatgttgtagcattttggatttcaaattttcaacctgtattctgcagtttgtttattcatccacttgttgacagacatttgggtggcttctggtttggagctattacaaatgaagctgctatgaatattgcgaaagtcttttggcacacatatttttgtgtttcttagacaaaataccttggagaagaatggcttggtcatagggtaaatgtatgtttaactttctaagaagcaattaaattgttccctaaagtgatggtttcattttatatgcccactagcaatatatgagaggtacagttgctccataattttgccgacgcttgcaattatcagtcttcttcttttttttagagccagggtcttattctgtcacccatgctgaagtgcagtggtgcattcataactcactgcagccttgaactcctggcctcaagtgatcatcccaccttggcctccgaaagcactgaggttacaggcgtgagccactgcatcaggcctcggtcttaactgtagtcattcaagtgggtgtgtcatggtatctcattgtgattgtagtttgcttttccccacgtcgctgagaatctttttatgtatttattgtccatttgtatatcttttttttgatgtgtcttcttcaaaccatttacccatattggattgtttgtcttctcattaatgttttgtgtcctgtataaaatatttttgactatgtcaaagtcatgaatactttgtctcttgttttcttccagaagttttatagggttggcttgtatgtttatgtatacaattcattttgaattagtttttgtgtatggcataaggtaagaattggcattcattttttccatatgaatatataaatactccagcaccgttttacaaaaagactatcacttacctattgaattaccttggcacttgtgttaataaagtaatttatcatatatgtaggtctatttctgaactacatacttggctccactgatcgatgtgtctgtatttacactaatgccacattctcatgattattgtggatttataataagtcttaaaatctgatagtaaaagtcctctaattttgtttttccttttcaaaatagttaaagaatcctatgttctttaaatttgcatataaactttagacaaatgagatagaccatttctatttttaaaaatcctgctaagattttgattgggatgatattgattgcataggtcaatttctgtcagagatgagttttagtttttagcatataggtcttacacatcttttgttgaacttatttctaagaatcttgtagttttgatgtgattataaattgtactacattttaaaaataaacattttattttagaacagttttagatttacagaaatactacaaaaatagtacaaagagtttccatatacctcacacccaatttcctctattatcaacatcttacattagtgtggtacattgtttacaattgataaaggaattttgatacattattattaactaaagtccacacattattcagatttcctttgttttatctaatgtcctttgtctgtccaagatccaatacaggaagccatattacatttagtagtcatgtctcctgaactcctcatgcctgtgacagtttctcagacttacctcattttcagcacctttgacagttttcatgagtattgctcaaatagtttgtagaatgtccttcaattggaatttgtctgctgttttactaaagattagactggaattatgtgttcttggaaggaagatcacagaggtaaactgccatattaatcacatcttttcaagcgtatataccagcaacatgatttatcactgttggtgttcatcttgatcaccaggctgaggcagtgtgtgtcaggattctttactataaagctattttttttccctatttccaggccatattttttgaaattaagtcactatgtgcagcccacacttaagaggtgggaatgtatgctccccttccttgaaagtgaagtatttgtgtgcgttatgtggaattcgattgcacagtacatttgtctcttgtcccattgatttatttatgtttttattttatttcagtaaggactcatagatatttattttatactttgggttataatccaatactacttcatttatctcgctgctcaaaattttccagccttggggcattgggagctctttcatttggtttctttgaccttttgaaatacctccatcattgtgtacttttttgttgtttttttaaaaaagcatgttcttacattctggcaccacaagatgctcaaggttcatcttgtgtatcttctgactaagacatagaatcagtcatttctccaaagaacactggctccttttaatggagaataatgttaaaaactaagatctgaatgctaggtgtgcttgttggtactacaaggtgcttttcctatatctcagcagacagaagaaatatatgtgtgtatactaaccgactaacttgtgtaacctatcatttttttttttgtgtagccatctataactatatgaagctaaacatgagttcacactgatgtctccaactctaattctttaccacccaaatccttctagcctcttccccttgctcatctgtaacttcccactccagcaataagaaacctggatcccgccatccaccaaaccatttacttaattattaaattccagtatacgtgtaaaaccctatcagaactggcccatactcccattagaaatgactttatcaactacagcacagtttttatgtacaatttgttttgcctttagtcttacagatttaactcatttcgaagttacttaggtcagcatcttttacccccaactccttcagcaaggttgtttcattcatttgtaatacagttaattattttgttatattctacattttatcttgggatctcccaatttcctagataattaaacaatttgcatacattaagattcactctttgggctgtaacatttgttttgacaaatgtattgtgtcatatattcaccataactgtgtcatatagaatcatttcactaccccgaaaataccccctgtgcttcacctgtttagcccgaaaccctactcttgaaccccacacaaccactgatagggttattattgctgtcattttgccttatccagaatatcttatactgtaattgaaatcattgtgtatgtgccttt

SEQ ID NO: 1390 - DNA, 20001 bp, Homo sapiens
ccccgcccggccagcctccccgtccgggaggtgaggggcgcctctgcccggccgcccctactgggaagtgaggagcccctctgcccggccagccgccccgtccgggagggaggtggggggggtcagccccccgcctggccagccgctccatccgggagggaggtgggggggtcagccccccgcccagccagccaccccgtccgggaggtgaggggcacctctgcccggctgcccctactgggaagtgaggagcccctctgcccggccaccaccccgtctgggaggtgtacccaacagctcattgagaacgggccatgatgacaatggcggtttagtggaatagaaaggggggaaaggtggggaaaagattgagaaatcggatggttgccctgtctgtgtagaaagaagtagacatgggagacttttcattttgttctgtactaaggaaaattcttctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgttcacttgtttatctgctgaccttccctccactattgtcccatgaccctgccaaatccccctctgtgagaaacacccaagaatgatcaataaaaaaaaaaaaaagaattgaggagcaagcttcacattcagaatccagtggctgaggaagtatccatatccctaagagaaagaaccttgggacaccatgactgttacatgctgggacaattccatcagcccttctgcaaaggagcctatagccatttaatcaggagatgggataagtgttaacattgggtgtgagctaacattgctgcccagattcccacagcaccattatgtccctatcacagtggggcttacagaggccagggaataaacctggacaaattatgccccacggtggaatcactgggtccataaatcctgtcctggttatctccccattctctgtaaaaaggattctctgtaaaaagattacatcgccctaaaccaggacctgagctcttggactgcggcggccatggcggctcagattacccagcgcaagtgggaggcggcccatgaggcggagcagcagacagcctacctggagggcaggtgcgtggagtggctccgcagatacctggagaacaggaaggagacactgcagcacacctgtaccagggaccacgggcgcctccctgatcgcctgtaatctcccgggctggcctcccacaaggatgggagacagatgggaccaacactagaatatcaccctccctctggtcctgagggagaagaatcctcctcagtttccagatcctgtaccagagagtgactctgaggttccacactgctctctgacacaattaagggataaaatctctgaggcaatgacgggaagacgcaattaagggataaaatctctgagggaatgacgggaacacgatccctcatttagtgatcccaagtcactaaatttgggagtagtttgttacacagcaatggataactaatgaagccctcttacatttccattattctctagaggttaactacatctgttttattttctcctattttgataatattagccacacataggtttctagtttctcaacacctattcttttctttattttagtttcttttctcctttgttccatcctttttttttcttttttcttttcttttctttttttttttttttttttttgagacaaagtctcgttctgtcgcccaggctggagtgcagtggctcgatctcggctcactgcaagctctgcctcccaggttcatgccattctcctgcctcagctttccaagtagctgggactacaggcacctgccaccatgcccggctaattttttgtatttttagtagagacagggtttcaccatgttagccaggatggtctctatctcctgacctcgtgatctgcctgcctcagcctcccaaagactgggattacaggcatgagccactgtgcctggcctcttccttccctttctccttccttctagccctccctccatctctttcttctctatttccattcaaactatcgccttccctccttctttctccctttccttcccctccccttccttcttttcttcttttgctttttcctccattcctccttctttctctctcttcctccattttttcctttttattatgaaattttcctaatatataaaataactctatgtgattgggttgtaagtaagcattttctgaatctatatgtcaaaaatataatgtcatgtatatgagaaacaagtaaacaacaggaagttattaacagagtctgaataaaaatgcctgctataattctacagccaagacagtggcttttaactcaattccttcaacacagtgttttcagaacacatcatcaacatcaagtattacacatttattgtaaaagtttaagtagccacaatcactttggaatttgtattatcattatctagtatggttaaagtccatacaacgtatcatccaaccaacccattcctaatcatccactctggggggctttcttgcctatgtgcacaggagacatgcacactaatatttatggcaaaaactggaatcagccacatatacatcaataggaaactagtgaaattgtggtataaccatatgtaagccttcagcagtaaaaatgaatgaatgacagtctcccacaccacagataactcctacacataatgtgcatcatgggaaaataaaggcagtaggaacttgctgtacaggaagcttaaaaaccagcaaaacaaactgatatttgttttggggatatatatatatacacacatacatatatatatgtgtgtgtgtatatatacacatacatatacacatatatacatatatgtgtatatatacacatatatacatatatggatacatatatgtgtatatatacacatatatacacatatatgtatatatatacacatatatacacatatatgtgtatatatatacttattgcacaaatctttgaagaaatacaaaggaataagtatcacaagactcagcatggagtcttctgctgagaccagctcggtcagggagatcctaacccagcggtgctagaggaattaaagacacacacacagaaatatagaggtgtgaagtgggaaatcaggggtctcacagccttcagagctgagccccaaacagagatttacccacatatttattacagtcattagcattgtttctataaatattaaattagttaaaatatcccttatgggaaacgaagggatgggccgaattaaaggaataggttgggctagttaactgcagcaggaacatgcccttaagacacagatcactcatgctattgtttgtggcttaagaatgcctttaagtggttttccaccctgggcgggccaggtgtcccttgccctcattcccgtaaacccacaaccttccagcttgggtgctagggccattatgaacatgttatggtgctgcagaaattttgtttatggccagtctcggggccagtttatgaccagattttgggggacttgctcccaacagtctccttctggaggatgactgggtagcagcccagggtagttttacagttttgtgttttacaccagtgctgggccccctggtagttacttgattataattccttaaacagagttttccaaattaaaatatacctgttttttatagaaatgaaaaagaaaagaatttcaaagttcattgcaaagattcttaacaagaactacttacattggaagaaaaccacagagaattgtaaggagctatgtgacagagaggaccaggatgccatgaaaacggccttggctacatataggtcattcgatccttggctcactggcatctctctagattttcaataatacaatgttcaatatgctatgcaaggtaatttcatcttgcaaagattctacgttacattttaccacacatacaactgaattaaacttttacagaattggaaatgcacatcactgatcaaaataaatgaaacatgaaaagagtaggaaggaatacccagtgatggaatagcaaatatgaatggaaacagaataggactgctaaaaagaaaaaaaattcagaagcacataatagcagtgctatttagaatcatagtggtgtccaaatcacttctatcacatctcattcaataccacaacaaaagatgttaagtgtgttatagaatgcccattggatagccagtttttgaaaataacttgtctctcaattcaagctaaccatttcgggctacagcatcaagccaaagttattggcatcatgctaagctagatgtgttaactgaagtatgagattctcatttttgtaaatgaaaagcaatcagattaggcaatttttttctgcacagcaaaagaaactatcatcaatcagagtgaacagacatgctacagaatgggagaaaaattttgccatctgttcatctgacaaaagtctagtattcagaatccacaaagaacttaagcaaatttacatgaaaaaaaacttcattaaaaagtggacaaagaacatgaacagacacttctaaagaagacatacatgtggccaacaaaaatatgaaaaagaaagctcccatcactgatcattagagaaatgcaaatcaaaacgacaaatgagataccattttatgccagtcagaatggcaattattaaatagtcaagaaacaacagatgctggcaaggttgcggagaaataggaatgcttttacactgttggtggaaaagtaaatggttaatccattgtggaagacagtgacagtgtggcgattcctcaaagatttagaaccagaaataccatttgacccagcaatcccattgcagggtatatacccaaaggaatataaatcattctattataaagacatatgcatgtttacattcatggcagcactattcacaatagcaaagacatggaatcaacccaaatgcccatcaatgatggtctggataaagaaaatatggtacatatacaccatggaatattatgcagccataaaaaggaaggagatcaagtcctttgcagggatatggatgaagctggaagccattatcctcagcaaactcacacaggaacagaaaaccaaacaccacatgttctcatatataactgggaactgagcaatgagaacacatggacacagggagaggaacaacacacactggggcctgttgggggagggtggtgatgggaggatcattagcaaaaatagctaatgcatgccagggttaatacctaggtgatgagttgacaggtgcagcaaaccaacatggcacacatttacctatgtaacaaacctgcacatcctacacatgtaccctggaacttaaaaaaaaattaaattaaaagacaagcttaaagagttaatgaaaaataattagatacaagaagactttgattttcagaaacctgaaacaatagttataattttgcttttaacatatattcaaatcctttgatactgttcctttctagaggtgcagcttaattccctctcttgagtgtggcttggacttaatgaggcacttctgaaatggcctggttctgtgttcccacccaaatctcatcttgagttgttatgcaaattgtaatccctacctattgggggagggacctcatgggagttgattggatcatggggacggtgcccccatgctgttctcctgatgctgagggaattctcatgagatctgatggttttataaggggcttttccctgcttcattgtgcatttctctctcctgtcaccacatgaagaaggacgggtttgcttccacttctgccatgactgtaagtttcctggggcagcctcctcagtcatgcagaactgtgggtcaattaaacctctttcctttataaattacccagtctcaggtatttctttatagcagtgtgagaatggactaatacaacttctaacttatagaatagtgccaacataacagtttgtgactctgggtgtagaacataaaactaactgcggcttccaccttctctctctctgaatctgggatcatgagctctgggggaagccagccgctgtgccataagcagccctgcaggaaggtccacatgactgagaactgaggccttctgggaacagacaacaaggaaccaggccttttccaacagccatgtgactgatccatgtttcttgtgaattcccagccccagcgaagccctcagatgctgcggcccctggctgacaactggagtgcaaccttgtgagaggccctgagcaggaagcactcagggaaacctctcctggattcctgacgattggaaactgtgggagatgagaaacatttgttgtttcgagctaagttttacgtaatttgttatgcaacagtaaataatatattttcacaagagaggatgtattattacacatcaaattgcatttgctctaaatgtgtcatcatcatcattattatttttgagacagggtcttgctctgtcacccaggctggaatgcagtggcatgatcaccatgcactgcagtgtcgaacgcctggggtcaagggactctctgacctcagcctcctgagtagctgcgactaccatcatgaactaccatgcctggctaattttctaattttttgtatagatggaggttttgcccaggctgatcttgaacttctggagtcaacaaatctccattcctctgccttccacagtgctaggatgacagatgtgagccaccacacctggcctaaattaattataagatattaaacatgtaacttagttttaaaaagtaaggacaatttccatggctgaagaggatgtattttatgaccattcacaatgatcacgttacttgaacttcactttccaactgtgtcccaattaaacacaaaaggaagatccaacccttgctaggctgattctatgatggcctcaacaagcagctcctggtcattcaccttcctccagttattcaaccaactctaatgtaggtgctgctgtgaagggatttagcagatataattaagggtctcaattagttgactttatgctgggtttatcctgcttggactgtcctaatcaggtgagtccttgaaaggactgggttcttcatgagcatagagacttacagtgtgaaagggactcagcatgaggggtttcctccaccatgggctttgaaaaggaaggggctatgggccgggcgcggtggctcacgcctgtaatcccgacactttgggaggccgaggcgggcggatcatgaggtcaggaggtcgagacaatcctggctaacaaggtgaaaccctgtctctactaagaaaaaaaaaattagagcatagtggtgggcgcctgtagtcccagctacttgggactgagacaggagaatggtgtgaacccaggaggcggagcttgtagtgagcagagatcattgggccactgtaccccagcctgggctacagagccagactccgtctcaaaaaaaaaaaaaaaaagaaaaattaaggggctgtgtaggaaagaacgctggtgagcaccgggaattgagcccctcccagttctctacattgacagctagccaggaacagggacctcagtcttacaactgcaagaaactgcattctgccacctctgtataaacccgaaggaggattcaaaatgaaaacacagcttttggaagcccagaatggagattctatccacatcttgcccagatttctgaccaaggaactataagcagataaatgtgtgttgttttgccaggcatggtagtgtgcgaatgaattgatgaattgatatacacactagttgcataaaataaaatctttctgaactttttcagtgttttacagtttataattatctgtgatgcaatttaatacactcatatttcattcattaagtcaacaaaaattaacttagtccctacaatgaacgaggtatcccctcatatgctcaagtgcctgacactccagaagcttcacaagaccgaggtggagacactggagtgttttaagtggagaaatgacacactccgactcacaggagcagggccactgtgaaaagaacagttacgtagcaggtcatgggacagtgctagtgtcacaattcatgagtgacagtgtggtgggaactaaggggagaggagggcctgaaggatgagaaggatggagggaagggctggagaagcaggaggtgaggaaaaggagcagaggaaagaatttgaaagcagcagaattcttaggtttaaagacattgttttatggattttaatacatcaatctacagagcctaggagggtgtccttggcagttgtcttttaatacctcatgtgggtctgcctaaaaactattttttatgttaatcaggtttaaaaattactaagtgttcctataaaatatacacaacacttagaagtggatacttcctaaaaacaggcagtgcatgagcactagtgaggggcattgtgactgccttgaacagttgcaactttgaggtgaataaagcctgtaatggcttctggttgcaacatataggaacacagtggctactttgtattgaggagatgtcgtggactcacacagaaactcagagctaaggaatgatggcaaatttaaagtaagacaagcaggagtcacagatacattgtctgggaaagtgcaacttagtagctttgtgagtcctgttgtaatgcttttggacacatttatacattaaggggccaaagtcacattttttacctattagattcctgatcattcaggggttaccaagattctgctacccactgtagttaataaacaaagagcaaattggtctctattctgtctcatgcactcaggcacaacttttccggattaaaaacaaaaacaacaacaacaaaaatctacacctccattcccagatcaagcttactctctggcaccaaactccatggggtgatttttcttctagaagagtccaggtggacaggtaaggagtgggagtcagggagtccagttcagggacagagataatgggatgaaaagtgaaaggagagggacggggcccatgccgagggtttctcccttgtttctcagacagctcctgggccaagactcagggagacattgagacagagcgcttcgcacaggagcagaggggtcagggcgaagtcccagggccccaggcgtggctctcagagtctcaggccccgaaggcggtgtatggattggggagtcccagccttggggattccccaactccgcagtttcttttctccctctcccaacctacgtagggtccttcatcctggatactcacgacgcggacccagttctcactcccattgggtgtcgggtttccagagaagccaatcagtgtcgtcgcggtcgctgttctaaagcccgcacgcacccaccgggactcagattctccccagacgccgaggatggccgtcatggcgccccgaaccctcctcctgctactctcgggggccctggccctgacccagacctgggcgggtgagtgcggggtcgggagggaaaccgcctctgcggggagaagcaaggggccctcctggcgggggcgcaggaccgggggagccgcgccgggacgagggtcgggcaggtctcagccactgctcgcccccaggctcccactccatgaggtatttcttcacatccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccaggagacacggaatgtgaaggcccagtcacagactgaccgagtggacctggggaccctgcgcggctactacaaccagagcgaggccggtgagtgaccccggccgggggcgcaggtcaggacccctcatcccccacggacgggccaggtcgcccacagtctccgggtccgagatccaccccgaagccgcgggaccccgagacccttgccccgggagaggcccaggcgcctttacccggtttcattttcagtttaggccaaaaatccccccgggttggtcggggctgggcggggctcgggggactgggctgaccgcggggtcggggccaggttctcacaccatccagataatgtatggctgcgacgtggggtcggacgggcgcttcctccgcgggtaccggcaggacgcctacgacggcaaggattacatcgccctgaacgaggacctgcgctcttggaccgcggcggacatggcggctcagatcaccaagcgcaagtgggaggcggcccatgaggcggagcagttgagagcctacctggatggcacgtgcgtggagtggctccgcagatacctggagaacgggaaggagacgctgcagcgcacgggtaccaggggccacggggcgcctccctgatcgcctgtagatctcccgggctggcctcccacaaggaggggagacaattgggaccaacactagaatatcaccctccctctggtcctgagggagaggaatcctcctgggttccagatcctgtaccagagagtgactctgaggttccgccctgctctctgacacaattaagggataaaatctctgaaggagtgacgggaagacgatccctcgaatactgatgagtggttccctttgacaccggcagcagccttgggcccgtgacttttcctctcaggccttgttctctgcttcacactcaatgtgtgtgggggtctgagtccagcacttctgagtccctcagcctccactcaggtcaggaccagaagtcgctgttcccttctcagggaatagaagattatcccaggtgcctgtgtccaggctggtgtctgggttctgtgctctcttccccatcccgggtgtcctgtccattctcaagatggccacatgcgtgctggtggagtgtcccatgacagatgcaaaatgcctgaattttctgactcttcccgtcagacccccccaagacacatatgacccaccaccccatctctgaccatgaggccaccctgaggtgctgggccctgggcttctaccctgcggagatcacactgacctggcagcgggatggggaggaccagacccaggacacggagctcgtggagaccaggcctgcaggggatggaaccttccagaagtgggcggctgtggtggtgccttctggagaggagcagagatacacctgccatgtgcagcatgagggtctgcccaagcccctcaccctgagatggggtaaggagggagatgggggtgtcatgtctcttagggaaagcaggagcctctctggagacctttagcagggtcagggcccctcaccttcccctcttttcccagagctgtcttcccagcccaccatccccatcgtgggcatcattgctggcctggttctccttggagctgtgatcactggagctgtggtcgctgccgtgatgtggaggaggaagagctcaggtggagaaggggtgaagggtggggtctgagatttcttgtctcactgagggttccaagccccagctagaaatgtgccctgtctcattactgggaagcaccgtccacaatcatgggcctacccagtctgggccctgtgtgccagcacttactcttttgtaaagcacctgttaaaatgaaggacagatttatcaccttgattacggcggtgatgggacctgatcccagcagtcacaagtcacaggggaaggtccctgaggacagacctcaggagggctattggtccaggacccacacctgctttcttcatgtttcctgatcccgccctgggtctgcagtcacacatttctggaaacttctctggggtccaagactaggaggttcctctaggaccttaaggccctggctcctttctggtatctcacaggacattttcttctcacagatagaaaaggagggagttacactcaggctgcaagtaagtatgaaggaggctgatgcctgaggtccttgggatattgtgtttgggagcccatgggggagcccacccacctcacaattcctcctctagccacatcttctgtgggatctgaccaggttctgtttttgttctaccccaggcagtgacagtgcccagggctctgatgtgtccctcacagcttgtaaaggtgagagcttggaggacctaatgtgtgttgggtgttgggcggaacagtggacacagctgtgctatggggtttctttgcattggatgtattgagcatgcgatgggctgtttaaggtgtgacccctcactgtgatggatatgaatttgttcatgaatatttttttctatagtgtgagacagctgccttgtgtgggactgagaggcaagagttgttcctgcccttccctttgtgacttgaagaaccctgactttgtttctgcaaaggcacctgcatgtgtctgtgttcgtgtaggcataatgtgaggaggtggggagaccaccccacccccatgtccaccatgaccctcttcccacgctgacctgtgctccctccccaatcatctttcctgttccagagaggtggggctgaggtgtctccatctctgtctcaacttcatggtgcactgagctgtaacttcttccttccctattaaaattagaaccttagtataaatttactttctcaaattcttgccatgagaggttgatgagttaattaaaggagaagattcctaaaatttgagagacaaaataaatggaagacatgagaaccttccagagtccacgtgtttcttgtgctgatttgttgcaggggaggagagtagatggggctgtgcccagtttctgttctggccaccatgggctttatgtggtcacagctcacctgggtcatctttgctgctccattgtccttggcccttcagtagaaccttgtcccaccaagacctgtgatcacagggagttggatgtcacctagggtggtccctgcatacaaatctccttgtggtatcaagagacaaattttcagacctgtccaggtcttgccttcctcccagggctttttccttaatggtattttcgatttttctccaatctttttaaaggaaccagattgtgacatttgcagagaggaggggtcccatagtttctcatcatggttaactttctgttggaactcctcttctgccctcctactcttcttcctgctctgagttgtagtaatcctagtgctggctccaatccaaactcatagatttataaagcagagtctaatttagattcatatgtggttggaaaattgtacccataaggctagggttattgttcctgaagagaaatatatggttttgtgctgaagtgtgcaggagggttggtgtgggaggagggaggacatacaagcagccctggtgagaaaagcactggcggcatggatgtccacgtgaacttatgttctttagctgccacaaaacagcatttgccctgtggctacattaataaagatatgggctttagaatagggaggtgctctacagtgatcattcattcaactgacatttgttgtctgctagggatatgactgcttttgcatttagaaagcatccttaaagtaaaaacagaaaaatgtctggggttatggtgcatacgttctagatgcaggcttgtccaacccgcggctcgtgggctgcatgtggcccaggacaattttgaatgtgaggacttttttgcttatctgtggtgaacctgagtcctggagtgagtgcacccacctccctcagggtcaggagtgaatgctttaggaaccctccttttcagtgacctgcaaaagatagagggcacatttactgtgataacccagagtatcagccaagggggcttgaccttcaaggagttgtggggaaggttaataaagggtggtgtcccagggtcagaaaagatgggcagacagcaagggcactgcttgatatctatgataagcatgtggaattgaggagcaagcttcagattcagaatccagtgactaaggacatatctatatccctaagagaaagaaccttgggacacgatgatggttatatgctgggacaattccatcagcccttctgcaaaggagcctatagccatttaatcaggagatgggataagtattaacattgggtgtgagctgacattgctgcccagattcctacagcaccattatgtcccccatcacactggggcttacagaggccagggaataaacctagatacattatgccccatggtggaatcaccagttccataaatcctgtcctggttatctccccattctctgagtgcataattggccttgatgcactggcaactggagtcaccccacactgtgtccctagtctggagagtaagggatctcactgtgctgaagcccaaagggaaacatccctcatccaagccaaaccagaagcaatattgtgcctcagggtgggtcttgtggagggtactgcaggtattataggggtggcactgccattacagacctgaacgatgtggggtggtgttgggattgcctgttatctccatataactcagcaatctgtacctgcagaagcctgatatggctaaagaatgaatggaattactccagacttgaccaagtaggagtcctgattgcagctgccatgctggctggatatcactgcctggggagattaataaggcctcaggcacatggcaagcagctgtggatttggtgagtgcattccctcccatttcatttagaagatggatatggaatgattcacattcacatgggatttataatacatttattgatagcttgcatcagggctaccttaactcctcaaccttctataaatatcaccttaagagacctggacgaatcagacatcccacagaatactaaatctcttcatttcattggcaatatcacataaattgggaaggatgaacaacagcaggaaagtacgctgaattccctggcaaaacatgtgcactacagaaggtgaagataaaacttacagagcttcaagagtggccactgcagtgaagtgttatgggtccagtggttaggggcatgcagagctccccgccgccacacacacacacaaagtaaaagacacacttgcatcttgcatcctcaccagaaggaaggatgcacactaccttgtgagcctctctgggttctagcaacaccacattccacatctaagtttattgctttggctgacactctgggtgatataggaggaggccagctttgagtggggcctggactggaaaggacactgcagcagacccaggctgtggtgcagtcagtcaccatccctcagacccctggtgctggaggtggcggtctggggaaagaagcaggatggagctgaaccaagcatcagtgggaaagtcagaatgcagggcctgggatcaggagtaaggccatggagtccacagcagagaaacatgctccatgttagaagcaacttttagcatgttactggccctgataagatagaatgcttgagcataggacaccaagcaaccatgtgattccaagtgcccgtgtgtattggcttctatgtgacccatagagtcattcactggacaggcccagcggcatctatcatgagacgaaaacggtccatgtcggttgagcctcaattccatgttaacacccacagaaaacacccagtcctgatgtggccctgaataaccaaacaaattgaagacaaattgaagttagccagtctgcatcatggatcagcccaggcctgataggaaggacccgtgagtggagcaaccacagtggcagggatgaagctacaaatgagtccagcagcactgtctctccactaccaaggcccacccagctactgcttcctctgaatactctgctcgtgagcattgcagaccaatgataggcaccaatagggcactatttcttaaagtaactgactagcccctaagtgacaagttgaatagcttgagcaccatccatcctggaaggggcagaagtttatcctcacagggataggctcacagggatgcgatgtggtgtggttttcctctctgctctcagaccctcagtcaacaacactattggcattcctgatccactggctcagaatttcagtacactatctgcctgggggacacacctgttggggaaggggatgaagtgtgggccctgaccatgggatcccctggtcgtatcaccacctgcgcctctcaagtgctgccaggcacacagagtcatggacaggactctacaggcacaattcagtaccagcttggatgaaaccctctgaggaatgggtgccatctttcaggatgtgatgcatgtattgaatcaaagacgtctctaaggcactgttttcagaaggaagaatacgcgggtccaaaaaccaagaagtcaaagcaggtgtgtctcattccttatattcacccccagggtgatttacttataagtaaataaatacataacatgaatacttaaataaatttatttatgcatgtatgtatgtatgtatttattttattcattatattcacccccagggtgattttgctcttcttacttccaaaatctggactctgcagggtaggaggtcctggtttcccaaagagggcaccctggcaaggagacaaatgagagtccatggaactacacattgtggttgcacccagggatatttgaatagtatgtgcccagagacaagcaggtgagaagaggaggaggcagcgctgctatcacacaatgagggcaggagaagtgtgtgtggaaaccaggaatccacttggggacgtcctggtttcccttgtccgttgtgtgagcggaatcatccagcaacccagcctgagagggtttgatattcaagagcccagaaccctcaggaaggaaggattgagtgatactcctaggtaatgtcccacgtctctgcttctgtgctctgacatcctcagcaggattagtgcagaagccctgcttccatgagttgttcccagccagtgaccggtcacagcaagcacactaaggcaggccattactgggagacatgggactcctctgatggccaaatgtggctccaggactcctccatgcccttcctcaactctccttagactgcctctgctctaggatgcgtcgaacagaccttgtctccttctgtccagcacttggggtcacacttgcatcattgtctgccgccttttccagggatttctggctcgcgtctcatattcccttacaggtgtgtcccctcataagatgccgtagactttaagctcatcttggcatctgctccttggaggacttggactaaaaagcattgccatgtgcacaccaataactcttacttattccaacctgtaaaatccatctctttaaccaacttctgccacccccataaaatctattttgcgcgcgttcgtagtatctctttgaattaacagatatttgttgtattaagccactaaattttgaggtagtttgtgacacagcagttaataactattaaggctttcttaagtttctgttattccatggatgttatctacatcttttaatttcctgcattttaataatattagccacacttgctgtttctaatcctttcctcctattcttttttgaaaatgttcattttgtctttctctgtccttccatctttctttcctcctttcctccctcagagctttctccctccctccactttttcataaactctatgtggttaggctaaaaagaatcactatttgaatcttatgcttaaagtataatgccataatttacaggataaaagtaaagaaaaggaaggtattaatggaatatgaaaaaatgcctagggtgattctgtagccaagacaatggttttttaacatgtaatctccaccttcaactgaatgttttcagaacacatgagcaacataagttctttcccattcttggtacaagcacttgggaaatcaaattagccttatcttgtatgattaatgtccatacactgtataatcccaccatctgctcctgatcatacactctggggatatctttggctatgtgtcccagagacgtgtacaccaatgtttatggcaaaaaaactggaaacaatcacatatgcatcaatgggaattaacaaaattctgatataattacgaaaagtaaaattttagcagtaaaaatgattgaacagcaccctcccacatcagagataactctcctacacataacatgcatcacagaagaatacatatagtgtgagttctctgtacagcgaagttaaaaaaacaggtcagactgtgatttgggtatatatatttattgtaaaaatctttagagacagtgcaaaggactagtaaatacaagactcaagatagaggttccttttggtggataggattgggcaacagtctagggtggcttcataggttctgtttcttatgccaggagaggatgtccaggtaattagttacttgatcataaatctttatttatttatttattcatttatttttgagatggagtctcactcttgttgcccaagcgggagtgcaatggtgtgatctcgtctcactgcaacctccgcctcccatgttcaagcgattctcctacctcagcctctgagtagctaggattacaggcacctgccatgatgcccggctaatttttgtatttttcgtacagactgtgcttcaccatgttggccaggctggtctccaactcctgatctcaggtgatccacccacttcggcctcccaaaatgctgggattagaagcatgagccaccactcctggcccacaaatatttatagtggcaattttcaaaatgcaccttgtgtgccattcctgattatttggaaatgaaagagaaaagaaaacacaaaagttcattgcaaggatccttagcaataactacatgagttaaaacaaagccacagccaattgtaaggagccatgtgacagagagtaccaggatgccatgaaaaaatagcctttgatagaaataggtcatttgattcttggctaattggcaactctctacattctctggtgtacaatgttcaatctgatgtgcaaggcaattgtatctcgcaaagaatttgagaatttgatatgttgctcaattttaccacggatacaagtgaattaaacttttacagaatagaaaaaaagcactgtcgagcaaaataaattaaatgaaaacacataaaggaataactagtgatgaaatagcaatacgaatggaaaacacgaaagagcttcttttacagcaacattagaagcacaaaataactgtatttttcagaatcatactggagtccaaatcacttctaccacatctaattaaaaaacacagcgaaagatgttaaattgatcaatggatgcacactgaatacccagttattgaaaaatcgtgttcctagattggagttaaccatttccgcctaccacatcaaaccaaatctttgtcgtgatgctaagctagctgtacagacaaagatgtgagacacattttctctaactgcaaagcaccctgattaggcaaatatttttgtagaagcttgagtaagaaaattgacattttgggcattcttaaaaggaattagtagcttctgaggaaaaagaaagatagttatgattgtaaaggcattattatacggcaccagtcgtgggactctttggtctagctactgtattttctcaactttcttgcaactcatcaaagagaacattaatattaaaggcatttgcaaaaaaaatctgagatattgttgtatctccattctctgtctcaaagttttattcattactttacaaaagataattttaaagtattaaagaaaattagtcagatacaagaagt

SEQ ID NO: 1391 - DNA, 147633 bp, Homo sapiens
cacaacaatgctgaccactatgcttcttaacaattcgtagtcatcacatgaatccacacgtttaactactttttttgtcttttccatagtttcaatacatcctgtgtctatgttactgagaagtgacagcgtgctggcagtcctcagagccctcgcttgctctcggcacctcctctgcctgggctcccactttggcggcatttgaggagcccttcagcccaccactgcactgtgggagcccctttctgggctggccaaggctggagcccactccctcagcttgcagggaggtgtggagggagaggctcgagcgggaaccggggctacgtgtggcgcttgcgggccagctggaattccgggtgggcgtgggcttggcgggccccgcactcggagcagacagccagccctgctggccccgggcaatgagggacatggcaccctggccagtggctgcggagggtgtactgggtcccccagcagtgccagcccaccggtgctgcgctccatttctcaccgagccttagctgccttcccgcggggcagggcttgggacctgcagcccgccatgcctgagcctccgacccactccatgggctcctgtgcggcccgagcctccccgacgagcaccaccccctgctccacggcacccagtcccatcgaccacccaagggctgaggaatgcgagcgcaccttgcgggactggcaggcagctccacctgcagccctggtgcgggatccaccaggtgaagccagctgggctcctgagtctggtggggacgtggagagtctttatgtctagctcagggattgtaaatacaccaatcagcaccctgtgtttagctcaaggtttgtgagtgcaccaatcgacactctgtatctagctgctctggtggggccttggagaacctttatgtctagctcagggattgtaaatacaccaatcggcactctgtatctagctcaaggtttgtaaacacaccaatcagcaccctgtttagctcaaggtttgtgagtgcaccaatcgacactctgtatctagctgctctggtggggccttggagaacctttgtgtccatactctgtatctaactaatctgatggggacgtggagaacctttgtatctagctcagggactgtaaatgcaccaatcatcagcaccctgtcaaaacaggccactgggctctaccaatcagcaggatgtgggtgggtccagataagagaataaaagcaggctgccgagccaacattggcaacccgctggggttcctttccacaatgtggaagctttgttgtttcgctctttgcaataaatcttgctactgctcagtctttgggtccacgctgactttatgagctgtaacactcaccttgaagatctgcagcttcactcctgagcccagcgagaccatgagcccactgggaggaacgaacaactccagatgcgctgccttgaagagctgtaacactcaccacgaaggtctgcagcttcactcctgagccagcgagaccacgaaccagccagaaggaagaaactccaaacacatctaaacatcagaagggacagactctagacgcgccaccttaagagctgtaacactcaccgcgagggtccccggcttcattcttgaagtcagtgagaccaagaacccaccaattccggacacattgctttagcactttccaaagcaatctcatgtacacatcagtgagttttctctttctttttctagacatacggtattgttgactcataacgttgaactcatggccaacagcactgtaacacatgcctgaacaaagattatctagcacacatttcttcttaaggaacatcacagccttcttgtgcttagaaatattagacagcacttcagcctaacacatataaagaccattttatacatcaaagtcacccccccgaaaagcacaaaaatgtgaaaatggcattacgtagactgtgaaaggagcacatttacagtgtgagagctgaaacaagaaggtggagtcttgcctcgttccaccccatcagagaatgtatgtgtgggtgacacaaagatttcaatgccctgtacatgtgagcgtataaccacaaaaccatagtgaatattaattttggagttacagatacatttagcatgcaaattcataagtactgaataatgaggattgactcgtgtgtgtgtgtgtttgtgtgtgtgtgtatgcatggagagggagagagatttattagaaggatatgagtcaacactcatggaattaaagaaaaattgaacaatgaagcgtaagaagtggtatgaaacaggcatgtggggatccagttggaagggaattacagaaagtttcctcagatgtcataataagcatgaatcagatttatggattttcagtgccctttttttttttttttttttttggagattcaaattccaggaagagagtctgatgggtcttgttaggtccatgactctcctcaggtcaggcaaaggctgcgtaccaaggctgacgtctcatcaagactgcaagcatcagacaattgagttgctattactaaaacaaagtgccatgaatttgaaaatgcaaaaaataacatatgtgcactctcttctctatatctatttccttaaatttataccaaggaaagaatcatggatttaggttggtgtttatgttaaaaatacttaaataatttaagtctgagtcatctaattgttatttgcaccatgatttgaaaacacatatttacgtgatttctgttgctgcataaaaagttactacagatagcagcttaaaccatttattaattatctcatgatttccatgggttaggagtccaagggtggcttactgagtcctcttctcagggtatcgcgaggctgcaatccaggtgttggctgggctgcattccattctcagggttctcttccaagctcatgtggttgccagcagaattccatttgtgtgtatgtgtgattataggagtgaagtccctcttttctatgattttatgtgattataagactgtcagccaggatttgctttctgctcctagaggccacttgcagttcctggccttatggcctctcctagtccctctctccacatggcagcttactttttcaagacctgcagaagaatgtttctctttggggatggccaagcatttttttttttttcaagaactatcttgattacattatacctatccaggataatatcccttttgatgaactcaagggaccttagttatagctgtaaaatatttgcacctgttatataaagtagggtaattatggtactaataccccatcacctctgccaggttctattcattagaatcaaatcacaggggagaggataatgcagggtgtaacaccaagagttggattctcaggggcatcttagagttctatctaccactttgaggaatatttaatttattgaaaaaatgttttatatataatatttaatttagaaaaatccaaaacaccttacataatattaaaacagtgtaacagttaaaggacaatgtagaactaaactaaatacaaccaatggccttcccctgagttgtataattaagagtgatttttgtttattcttcacagcttatttataaattccatattttctacagcaagcaagtgatgcttttataattagaaatgttgtatctaggttaagagcatggatactggaaccaactgactgaactgtaattgagatctgcaatttaaaagctctgtgattagggtaaactatccacactgagcctttgtttttgttttttaaacaaagaatctgactccatttctgttgattgctatcagctttcatgccctgccactccttatggaccctctgcttcctttctagagaatgtgataagagagcctgagtgttccctcctgtggctctggtaaaaagtttaaaccatacaaaaaccctaaaagccaagcccgtctccttccctactctcaatccatttcgggactgcttgggagcctcccctctcctcagaaaacctcattatgtgggtaacaaatatgttcataccctctgtgcatgtgtagtgtcatcattctcaacaactcaaccaacttttgagtggggagagcccattctgcctcttcagggtgaccacaacactttatttgtgaaatggagttattaatagtattgacacactcatttattataaggaaaaaatttattaatgtatataaaagcacttaaaacagtgcctgcacatagtaaatgcaaggctcttgtatcggttcgaaccccaagagcatgccaacaaacaacacaaggtggtgtggagcaacacactgtttttaatgagcgcctgggtgcagatgggctgaggcctaaaatggcgtcagcaacaaattaggacgaggcaggggttttatagtctcctataaacaggaagtgtctcagtctgacgtaactgctacgctgtaccgctgtacccggacggcctctcttttggtcttcagcgggtaccgtttcttccagccagctctcttcctacttctgctgtcttgctgacgcaagtgccttgggactgggcctgaggaggggggagttattaattcccttaagctttcaggcccctgggagaatcgttcagtaaacatcatgtaagtaagtgttaactgtagatacttataaatattattggtgatctgattatttgccttatgctgctgattctgccaaccataattgttttacaaaagaaaattaacataatattgtatgctatagcaaaaattttttaagtcctttagaaaagaaaaaaactacatgctatatactgtaatgtaatttagagagtaaattgtgttttcagtcatttccaaaattaaagaaaatggacttcatttattataatttgaattttgattatttttagcctttaaataacatataattatacatcaagcacctatttatctaaaacttaaagttacagcatgcttttacaaacacttttccttaatctatggatacataaaatgtttgtaaatgggttagaatcaggaatttgttctttaaccagcttctggaatttattcatggagatctgttaggtttcctatttttaaatctggaggactatagaatgaaaaaaatattagaatgatggcttatggcattagaaatttttatagcagctttattcatgattgccaaaacttgaaaggaagcaagatgcccttcgtaggtgaacggataaccaaacagaagtagaagtacatccatacaatggaaactacttagagataaaaagatatgaggtattaagccacagaacaacatggaggagccttaaatgcacattgctaagtgaaagaagccaatctggaaaggctacagactgtatgcttccaacaatataatgttctgaaatagctgaagccatggtcaaaataaaaagatctgtggttgcccaaagctcaggggagaggaggttaaggatacacagatggagcacagaagatttttagggcagtgaaactattctgtataatactgtgatagtggatacatgtcattatacactgctcaaaaaagaaaacttgaggtcaatatccttgataaacatcaatgcaaaaatcctcaaaaaatactagtaaatcaaatccagaagcacaacaaaaagctaatctaccgtgattaagtaggcttcatcctgaggatgcaagattggttcaacatatgcaaatcaataaacgtgattcatcacttaaacagaactaaagacaaaaccacatgattatctcagtagatgtagaaaagacttttgataaaattcaacattccttcatgttaaaaactttcaatgaactaggtattgaagaaacatacttcaaaataataatagtcatctatgacaaacccacagccaacattatactgaatgggcaaaagccgcaaacattccccttcaaaactggcacaaggcaagatgccctctctcaacacttctatttaacatagtattgggtgtcgtagccatagcaatcaggcaagaggaagaaataaaggacatccaagtaggaagacaggaagtcaaactatctctgtttgtagacaacatgattccatatctagaaaaccccatagtcacaggccctaaactcctctagctgataaacaacttcagcaaagttgtaggatacaaaatcaacatacaaaaatcactaacattcttatataccaacaatagccaaatcagacaggcaataccattcacaattgccacatatacaaaattaaatacctaggaatatagctaatcagggaggtgagagttcttcacaatgataattacaaaacactgctcaaggaaatcagagaaaacacaaacaaatggaaaaacatcccatgatcacagataggcagaatcagtatcattaaaatggctatactgcccaaagcaatttatagattcaatgctattcctatcaaactaccaaagacattcatcacagaactagaaaaaactattttataattcacatggaaccaaaaaaagagcccgaatacccaaggcaatcctaagcgaaaagaataaacctggaggcatcatgctacctgacttcaaactatactacaaagctacactaaccaaaatagcatggtactcatacgaaaacaggcccataccagtgaaacaaaatagaaagcccagaaatgaggctgcatagctatgaccatctgatctttgacaaagctgacaaaaacaagcaatggggaaaagattccctatccaataaatggtgctggcataactgcctagccataggcagattgaagttggagccctacctttcaccatatacaaaaataagtcaagatgggttgaagacttaaatgtaaaacccagagctataaaaactctggaagataacctaggcaataccatcctggacataggaacaggcaaagatttcatgacaaaaactagcaaacaaatctcaataaaaattgacaagtgctatctaattaagcttaagagctctgcacagcaaaagaaagtatcaacagagtaaatggacaacctacagaatgggataaaatatttgcaaactatgcatctgacaaaggtctaatatccagcatctacaaggaatttaaacaaatttataacagaaaaacaaccccattaaaaagtgggcaaaggacatgaccagaaacttctcagaaagagatatacatgcgggcaacaagaatattaaaaaaagctcaatatcactgatcattagagaaacgcaaatcaaaaccacaatgggataacatttcacaccagtcagaatggctattatcaaaaagtcagaaaacaacagatgctggcgaggctgcagagaaaagggaacacttacacactgttggcaggagtgtaaattagttcaacaattgtggaaagcagtatggagatttttcaaagagctaaaagcagacctactgttcaactccacaatcccattactgggtatatacccagaggaatataaatcattctaccataaagacacattcatgcaaatctccattgcagcactattcacaattgcaaagacatggagaaatgtccatcaatgagagattggataaagaaaatgtgatcgtgtacaccatggaatactatgcagccacaaaaaagaatgagatagatcatgacttttgtgggaacatggatggagtggaggctattatacttagcaaactaatgcaggaacagaaaaccaaatactgcatgttctcacttataaatgggaactaaatgatgagaacttacaaatacaaagaaggaaacaacagacactggggtctacttgatggggaggaaggataagggagaggattagaaaagataactattgggtactgggcttaatatctgtgtgatgaaataacatgtgcaacaaaccctcatgacacacgtttacctgtgtaacaaacgttcacatgtatccccgaacctaaaataaaagttaaaaaaattaaagtctatttttttaaataatatgttagaatgatgacttgaaacattctaaattttcttttaaactatcaaagaatgattcaattaagttgtgttggtcaatttttgcattgctataaagaaatatccaaggttgggtaatttacaaagaaaggaattgtattttggcttacgattctgcaggttgtaaaaacatggcgccaacagcagttcagcttctagtgaggccctcaggaagcttacaatcatggtggaaagccaaggtgggagctgatgtattacatggagagagatggagcaagagaaagcaagggaggaggtgccacactcttttaaacaaccagatctcgtgtgcacttggagcgagaactcagtcattactccgaggagagcaccaagccatttatgagggatctgcccccatagcctaaacacctcctaccagactccacctccaacattggggattacattttaacataagatggaggagacaaatatacaaaccatatcatatgctcatgattatgtaagtatcatttttattacacttatatcttaaaacattgttttgctcatggtttctatgaggaatgaacattctaccaatgtttcagaacaattaaataggtactgtattttctaaataatctagataaatgactcacatttactattttttcttaaaattaaagattctcacaaaaaatcttttcatatgctatatagaatcatatacaaatgagaacagtaatgtacactcagaggtatttaggtggtagtaaaatagtgaaactagaaagaaaatccattccctcattaaatcactggcatgtactcttttcctgtgtagaagcaaatcattaaagccagagagttatatttagactcaataccacagtgaaagaactctattcctccaggaatattgattctgtccttgaatttcagtgaatgaggcatgtattctttgtaaacttgccatccaaattatttcttattcattcaaatgatttcaaatagaagtgatttaactcttaattgatttattgctgccacaaatatgtttatccagagatgaattcaggagtggggagcatagagatgtgagggtgtgtttacatggcacagggtgtgtaagggagtggttagatcaaggtctctggaaatatcacatcaaagcattaaagtgctttgcctctcagtggctgtgggtagtgtgtggctcactttttgcctggtgcataggagaagttcaagaaatgtttactgtacatatagcatggtagtttgtagccagtgttcttagagctaatttgtgtgtaatattggctctacttatcattgtttatgtgattagctacttggataaatcaaatcatagctcagagctgagttccttcgtctgtaaaatgaggataatgagacctacttcttagagtttaaatgagatggcattaaaacataagccacacaaattctggaatgttttgttttgttttgttttgcttttccatttggttaattgttgtaacccaagtgcctaaaatgtgcttcatgcctatttggtgttctttctatctatctgtcgatctatctatccacctatctattaatttaatgagttaaaattgcttaatacttgctagattgttataagattcttcaagtagtttaatttttacaacaatctcataaggtaggtgttattagtacttttttgtgataaagaagtgaagcaaagataagttaaatagtttgctagaatgctgcatatagagaattccaagtacttatactgtgagtcatattgtaaatatcttccttactgtagacatggtcataaagggtttcactgacagttaggtgaaacctatcccaagttatattgttaaatttgcaatcatcctcacccccaccttgtgtgttataagccacccccattgtctttgaacatttatgagctaaagtttaagaattgtctttagagaataaagtgaaaaaatgaatatataaagatattttaatgtaaataactttcaaaatcaaaagcaatctaatggctgcttccagaagaactacaatatacaaccttattttctagggggaagctgaaggccctaatctgtgaaaaggatcaaacaataaagaggactgtatgcagcttacaactaagtcacctgctgtgatctctgtattagttcattgtcatgcttctgttaagaactgcccaagactggttaatttataaagaaagaggtttaattgactcacagttccgcatggcttgggaggcctcaggaaatttacagtcatgacagaaggggaggcaaacatgtccttcttcacatgatggcaagaaggagaagtgccgagcaaagggggaaaagtcccatataaaaccatcagattttgagagaactcattcactatcatgataacagcagcatggggctaactgcccccatgattcaattatctcccaccagcttcctcccatgacacgaggggattatgggaactataattcaagatgagatttgggtggggacatggacaaaccatattgatctcccagtttcctttctcttcttacttcaatccataggctgtatacgggacgtcccccttatctccaggggatacttttcatgactcccattggatgactgaaattatggctagcatcgaaccttagatatactgttttttccaacctaataactgagaaggctactaagtgattaatgggggggcaggcgcagggggtactgtaaacagcgtagaaatgctggacaaacagattatttgcatcacaggtagatggtgtgagattttatcatgctactcagaatagtacacaatttaaaatttatcaactatttatttctggagtttcctgcttaacattttcaaaacatggttgattataggtagctgaaactgcagaaaacaaaactctgaaaggggtgactactctacgtggtagcccaactatcgattagagtccccagtattcctttcaggtaactgtggccatgtaactaggtaattaggcaatgggatatgaatagaagtaatgtgtgcaacttctgcttcaaatgattttaaaatgcaggtgccttttttctttcttttaggacaggatgtagatgtgaagctgaggcagatttgactaaggaaaattcaacccttttgaggatgacagagttgtgaagtacccgattgccttagtcacctgatagagcaggattgtttactctgtttggatcacttagctatttttggacttgtacatttaaaagcaaaaggaaattctgttttgttttaatcatgaaacgttgtggtctgtttgtcattgtacatttaaaagcaaaagtaacttctgttttgtttcagtcatgaaacgttgaggtctgtttgtcctagcagcttagcttatattccaaataatgtattcttcaaattaaaatgtaggtaataacactatcacaatcaccaccaacaatgagaataacagttacttattcaacttatcctttgtgcttggccttgtgctgtatgttttgaatgcataattttatttatacctcaaaacaacccaatgatgtatatacattattctgagacttaggtgaaatttttttttaagccgtttgctctcaaccaaaagtcaagaagtgagaaagctagaattggaactcaggtcagtatgactacaaaccttgtgaattttaatgcaaagtaattccactttcagcatttccaacaattcttttagtgcctcattataaaatgaggtcttctataccaagtcctgtattatcattaattatttccagctgaaaagaaaatgtcgttgtgttctcatggcactaaattaatttgtgctaagtttgttatttctcatttgatttcatttattcacaaggtatctattgaatacctactttgtaaaggctgtttctatagttagaagaacaaactagtacagtacttgtctggctcagtaggaagtgggagagggcaatgtacaagtggattaatacataacactattcaacaatacacaatccatgttatcacataacaacatttttgtgaagagcagaccacatatacaatggtgattttataaaattataatggagctgaaaacttcctagcctggcttgtgacatcatagctgttctaatacatagcacaacacattgcacatatatttctggtgatatttgtgtaaacaaacctactgccctgacaggtatataaaagtatacaggctcagcaacgtcacttcatagattccacaaaaagagtgtttggaacctggggaatcaaaacacaggttccattctgtgatatgaaagagcatatcacaaagcattttcacaggtagcttgtttctagattttagagctagaaactctatttactattatgtaccacatactattatgtataatacacaatagttgataataaatgactgtgttgctggttatatatttactatactatactttcatcattcttttagagtgtattccttctacttataaaaaagaaaagttcactgtcaattaacagcttcgggcaggtccttcaggaagtattccagaagaaggcattcttatcacaggaaatatcagatccatgtatgttactgcccctgaagaccttccaatgggacaagatgtggaggtggaagacagcgatattgataatcttgcccctgaataggcctaggctaaagtgtatgtttgtgtcttagtttttaacagaaaattttaacacagccaccttcccctgcctaagcatttcatctctgacctgttgtccttctgggagcccagcctccagaggcctgttatctgccttggggcttccaccactgtcaatgccaacatccagccaaggagggagtggggagagtgggcatctttgtggattctgtcactgtttctgtgggagggaggcctgagcaggcctgtcatgcctgacagctgctggcctccactgctctcattgatggggactatcctccctgtcgacaggcactctgtacaactgccctgcccctgcctaatcatttcagctgtggcctggtgcccacctgagagcccaattcctaaagtcctgtgatcttccctggcacagctgtcatggaatgttctacagctgcctgagtgttttgcttgcccctgcctgagtgttctaccagtggcctgggagctagccctcccttccctaacacagccagcacctgaaacctgaggaactgagaacaagtccactggtctggacctgccctagtccctgtaggattgtgcacactatccaggggaccatccaggggcctgaggattggaggaatgtctagcccagtccacaaccactggcacctccacacacccaaccagccaataccaccacaggtgacactcacccacacatgttgaaaggcagagcccctcctcctctctatacaaagcagcagtattcatgcatcagagtacaagtgagccacaaagatatatccaccccaaagtcactcccatgaagatcttgggacaggtgttttccatggctctcagctacattgtggcctggagatagcagtgtctttctgaactgagagtctcgagtcctaggacagggatgtgacagagaaacagttcacattcctgcctgcccaggacagggagctggtgcagccccttttcataaatgacaaaattaaagcggaaacttacaagccagagacctcagcacatttcaccaggagctcaaccacccacccctatcagggctggtgcctgtgcttgtcactggggtatttatgagtgagcttggtagttggtggcccaactctacccagcttggtcctccccaccctctccactccctgctgaccaaggaacttaaggcaaggggcactccacagagaagcccatcacctgaaataccagagaacacctctcaataagcaaagactaagcacacactcaactgctgttgcagccagttcttacatgtaagtgccacctactggcctggaggttgaactgctcatcacaacacaaaaactactgacagaagtgtaccaggctaaaaaagtaaagtcaaaaaaaccctaaacaacagacactacagtcatactttcaatagttagaaaaaaaatcctatccaaataaaagtaaattcaaaaataagaagtaacagtttctccaggtgaaaaggacccaaaactccggcaccatgaaaaatacagtatcgtaacacccttcaagaatcacactacctatctagcaatggatcctaaccaacatgaaacttctgaaatgatagattaaaaaattcaaaatatagattgtaaggaagctcaatgagatctaagagaaagttgaaaaccagcacaaataaatcagaaaagcagtgttggatgtgaatgcagataggtatcggaaaaaacaaacaaaccaaacaaatggagcttctggaaatgaaaaatttactgaaggagttacaaaatacagctgaatgctttgaggatagtctagaccgaacagaagaaagaatttcagagcttaaagacaggtctttcgagcaaacccagtcagacaaaaataaagaaaaaattttaaaaaatgaaaacaatctttaagaaatatgggattatttatagtgacaaaacgtacaagttatatgcattcttgagggagaagaaacagtaaaacattgggcaaacctatttaagaaaatctccctggccttgcttgagatacacacatccagatacaagaagctcagggcataccaggaagatactttgcaaaatgaacatcatcaagccatacaatcatcagactttccagtgtcaatgtgaaagaatcccaaaagcagcaagagagaagaaccaaatcacatttaaagaaaattccttcagactaacagcagacttctcagcaaaaaacttacaagccagaagggactagggtcctattttcagtattcttaaagaaaacaattggcagccaagaattttgtatcatgctaaactaagcttcataaatgaaggagaaacaaagtctttcccagacaagtaaacgctagggaattaatcactagaccgtacctataagaattgcttgaaggagttctaacatgcaaataaaaggacaatactcaccattgtaaaacacatgtgagtacaaagctcacacatcctataaagtaattacacaattgagactacaaagcagctaggtaataacattatgccaagagcaaaacctaacatatatatattaactttgaacataaatagcttaaattctccacttaaaggatatagattggaaaactgtattaaaaacaagatccaattatttgctgcctacagaagacccatttaatgggtaaagacacccatatactcgaagtaaaggggtgaaaaaacatatatcacgcaaatgaaaaacaaaaacaatcaggagtggctatagttatataaaacagactttaaatcaacaacagttttaaaaaaaagacaaagaaggtcattatataattctaaagggttcaattcaacaataaggtacaactatcctaaatatatgctccccgtaccagagcaccaaggttcataaaataaatactactagatctaggaaaagagctagacagcaatacaaaaacagtggggagtttacaccccactgacagcattagacagatcacagacataggaaaacaataacaaaactctggaactaaactggactctagactaaatggaagtaacagatatttacagatcattcaatccaacaactgtggaatatacatttttctcatctgcacatgggacattctctaaaataaaccatatgcttggccataaagtaagtgtccataaattttgaaaaatcacaatcatatcaattatcttcttggaccacagtgaaataaaattagaaatcaataccaaaaggaactcttaaagctaaacaaacacatggaaagtaaataacttgttcctgagcaatcttttcataaatgacaaaattaaagcggaaaaaaaatttcttgaaaccaatgaaaatggagacaaagcataccaaaatctctgggatatggcataagcatgccaagtggaaagtttatagcattaaatgcctatataaaaaagagagaaagatctaaaattaacagcctaatgtcacaacttaagaaactagaagaagaataaaaaatcaaacccaaagctagcagaagaaaaaaaagataacaaacatcagagcagaactaaataaaattgagaaaaaataataatacaaatggtcaataaaacaaaaagttggggctgggcatggtggctcacacctgtaatcccagcactttgaaaggctaaggcaggtggatcacgaggtcaggagttcaagaccagcctggccaacatggtgaaacctcgtctctactaaaaatacaaaaaatatctgagtgttgtggtgggtgcctgtaatcccagctacttgggaggctgaggcaggagaatcatttgaacccaggagatggaggttgcagtgagccaagatggtgccattgcactccagcctgggtgacagggtgagactctgtctcaaaaaacaaaaacaagaaaaattggtttttgaatctataaaattaaaaatttttaaacattaaaaataaaaaattaaaattattttttaaaatttaataaagatacaaagaaatatttctgcacagctgtaaaatgtttttgtgttttaagataagtgttacataggagttaaaaatttaaaatattaaaaaagttaaagtaaaaaagttgcagtaagctaagtctattattaaaaaaagaaattgttttgtaaacttagtgtaacctcattgtacatatttataaagtttataatagtgcacagtaatgtcctaggtcttcacagttgcctgtcactctctcactgcctcatctagagcaacttctaatcctcctagctcaatttatattaagtgccctttacaggaatacattttaaaaatcttttatactatttttttattgtactttttctgtgtttagataaacaaccaccattgtgttacaataaaagcctacagtttttagtgtagtaacaggctgtatatgtttgtagcctaggagaaatagctatacaatacagcccaggtgtgtagtagtctgtactatctaggtttgtgtaagtacactctatgatgttgtcacaatgatgaaatcacctagcaatggatttctcggaatatttcctgtatcctttttcaagctactcaagactgtataattaaattattagagaatttagggatcatctagggtagctggaaaaaactttgcatagtatgaaaatttaagttgatgttgaagattatgtttgataagatgaaaaagagaggtgaacagcataggcaaaaatttggtgacaaacttgggtctaatatattatagaaattctgagaaatcaatttagtgaaacttaagaatgtcattaagtaggacaacaaggaatgatcaatacagattgaggctaaaaggccaagaaactgttatatgaatctggaacacttgattttgtaaaaatctcaagtaaagatatcatcaggattgaaagattaaacagatatttaaaaaagatttattgatctgatttatgaattgtgttcaaagaaggaaggactgaaaatggggaaattcgttcagttattgaagtaatccaggagtaaaatggacatataaatactgatttactgggttaaaattggaaatttttaaaaatgttaatactataaaagaaaactatgcaatagttgaagactgattagtgaaagtgatattgcaagtgttatctctaggtcactatttgctatttctttcttttttttttttttgagatggagtctcactctgtcgcccaggctggagcacagtggcgtgatctcggctcactgcaagctctgcctcccaggttcacgccattctcctgcctcagcctcccaagtagctgggactacaggcaaccaccaccatgcccggcgaattttttgtatttttagtacagatggggtttcaccgtgttgtccaggatgatctcaatctcctgaccttatgatctgccagccttggcctcccaaagtgctaggattacaggcgtgagccaccacgcctgacccactatttgttatttctaattccaaaattacagtgctgtgggcaacaattattgggtaccattaattgctaagtattctcatcctctttgttctattattgagaggtcaggagggttgaaaatggaaggaggactttcatggtgggaatattgaaggatagcacaaaatggcatgagaggtagggagatgtgagggaatgactaggtagagtggccttttctttttttgcttgttgttttgcttgctttgtttgctttcataattacagaggcaaatttcaagctaaaaatgattgggaaatgatccttgacaaaatatctaagttgtctcaaaattcctaataacaagccacctagtaacagagtaaatgagtagtatttgttttatgaatatgaaaattaccactttcacggcttaaatcctggtttaaacatgagactcctagatgatttttgctctgccgtgtagacttctttcctttatcccaagaaaattcattaatgtaaaaaacctgcttacctttcatgtaatgtatagttggatattgcataatcatctatattttatacttttccaaaaaaggatcttcacatttatatgccgctgtatatatttttcagcctcaggtaaaagaaatacaaaaagttttcttctcaaactaaagtttggcatttttctacgcagatttaactttttactgcagatgtactcatataatttttataccatttaccagttggctgcaatccaattctcaacctctattatttctgtggcatataccaagaaatttaatttatgtattaatctttttgctaaaggctttcttcctactaagaagatggaagacagattaacataaatcccttcaaacagagtcccagcacgaatgcaccacaaaacaggcaatactttttcaaatttctagtgtgatggtcacacagtacaagaaaacttcagacttttcacttgtaaaactaaatgcataatcaagtacagtataaatacttttattttgaagcaaagatgcagagtggagaattaaaaatacaaagttttgttagtttctctatctctccccttccaaatgaaccacattatatgtatgcgtttgaagagagaagaaaaaattgacagagaaaatgatactactgtttctagagtcagcttgttggaatttgtgtcttcctatcaaaaatgacagaggcaatcaaaatcaaaacttcttgattataaagacatcatctccaattataagcagagcaaaacacaataggtgtttattactgaaatgtagctggtggctgtaagatgataattttacaataataaaataatgttatttattatttatacagcaaaatcaataaatgtaaaagaagaaattaaaatttatgtaatgaatttaatatctcaggaattagtgggaacagaaagattaaagttagtaccgaatatgagatttgcagattcagtatgtggcattgaatattctaatcgtagtagttgaattggtcaatatgacaaaaatgtaaataaaagatataggacaaagagatcaatatgtgaacattgacctcattagatcagagaatcaggtgtaaagagtaaacaaagaacagtaaaaaccagaggtcagcatagtataacacaacccaaaaatgtttaccgataatgttcagtgaaggttatatcttgtcagtaatagcagaaatcattgtgtgatgaaagctaatctgagactgagcacagcacataagagatctgggagctgaagatagcaaatgagcgaggatctgtaagaaatccaaaaaaattaaaccacaggatacagaaaaaaaaaaataaggcagcacgaggactgagattattgtctctagacacctgtgaagagacaacttgccattcctttattgtggaagaattagaaactaattaatactttacctgtgacacattcatggtaattcagtgtatatatgcatttaaataattattacacaaaattttattaaatgatacatagggtgttttctttttgcattattctttctggtttctaattccatggttaataaagtgtcatggcattgcaaatgagacatgtctaagataaatttggcagctggccatatgatttgtatcttggggcctaggcaggcggggtttttgtatagatcttctgagttgccatataggcaaacccatattactccaagggtgcctgaaaactagttctattttgttactatgaagtaattgactcctacatgtgactctgaaaagggaaatgattatttgctatttcagtgagcccattgtagcgcttaatacaacctttctgtctaagtcgtttccttggttttatatttcattcctaagaaaacacaagttggccgggcgcggtggctcacccctgtaatcccagcactttgggaggccgaggcgggcggatcacgaggtcaggagatcgagaccatcccggctaaaaacggtgaaaccccgtctctactaaaaatacaaaaaattagccgggcgtagtggcgggcgcctgtagtcccagctacttgggaggctgaggcaggagaatggcgtgaacccgggaggcggagcttgcaatgagccgagatcccgccactgcactccagcctgggcgacagagcgagactccgtctcaaaaaaaaaaaaaaaaaaaaaaaaaaaaaaaagaaaacacaagttatctaagcatactttacaatgaataaccaagaacagaggaaaggccatggcaggtagaataaataaaaagaaaagtttattcatatattttttacttatcatttgaatttggaacatgacttttttaaaaacaaacaaacaaaaaaccctactttactttcttagtccacttgggctgctgtaacaaaataccataggtggagtagctaacaaacaggcatttatttctcacagttctggaggctgaggagttcaagatcaaggtgtctacagatttggctcttgataatgatcctcttcctagcttgcagacagccaccttctcactatgtactcacatgactgttcctcagtgcatgctcatggaaagagagagagagagagagagagagagagatcttcctcttcttcttatataggcactaatctcattatgagagtgtgacccttgctaatctaattatttagcttccaaaggccctacctttcaataccaacatgttgggggttagggcttcaacatatgaattgagggagagtactaattctctacattttttcattttctaatattttatttttttcttaagcatgactcttccaatatttctaaattctggaaggaagaaatggacagatcaatgctctgcccttctttttattttaaattcaaatcttagattacaattttatagccacaaatattctctctctctcctccctttctccattctctctatttcttattattatttgtttaaagaggattaaaaaaatgacttacaagaacccatcgcaatttatttttagaggacaactgtctcagatggaagacagactgaaactctttgcaaacaaagttgtaaaaggaactttcttatatgctgaaatcagttgtcttttaaaaacattatttataaacagatttttgttattccctgcaatgcatcattatagcaaatatggtcagtgccacatacacatctttcacatttagccttttaggccatgaccccccaaattccaccttctagtatagaatattatgtgcctgggcactctctcagcacaagagcccattcaggctgagcccagcactgacaaacatgttgagaacttaatggtacagtggcatggataaaggtcccaactgcctcagctgtgagctatgtgttctacacttgttcttaaagttcgctagaacaatcaagttctagttgcccacagtagtaatgttcttgataacatatatttaatgtcccctcctcctttcttctttcttgtctcacttccctacacaagtaaactgcttctcctcaaaacttagcttaggatctaattctgagagaattcagactaagtctgcctcattccaaatatttatgaaaatggtgaaatagtacttttgtaagtaacaacagagtcttgaaaggaattttcttttttttcccctcctcgagacggagtcttcctctgtcgcccaggctagagtgcagtggtgcgatctcggctcactgcaacccctgcctcccaggttcaagcaattctcctgcctcagcctcccaagtagctgggattgcaggcaaccaccaccatgcctgggtaattttttatatttttagtagagatggggtttcaccatgctggccaggctggtctcgaactcctgaccttgtgatccgctggcctcagactcctaaagtgctgggaatacagccgtgagccaccatgactggccaggaaaggaattttcttatggaactttaaatgtaaatgtaaggctagtgattcaaaacaaggaaaattctgttaaactgagctgaagcaatggtattttatcatctaaatttcactattttcaattaggtttaaaaacaaaagtttaaaaatgttcttattaaaggtctcacaatacttttctggttctattgactctttattttagttcacttaaattcattttatttcagatgttcattatacccagacagagtgaataataccagaataaataaataaataagtaagtaagtaactaaataaataaaggtcacttcccctgaagagcttaaatagtaggtatggtatctatatgaaacagaattaaccatcactgaatatcatgcttaggcctttgaaataattggaataagatgaaaatgtaattttgggctggatgctgtggctcactcctgtaatcccagcactttgggaggctgaggagtgggaatcacgaggtcaggagttcaagacctgtctggccgacatagtgaaaccccatctctactaaaaatacaaaaaattagctgggtgtggtggtgtgcacctataatcccagctactccggaggctgaggcagcagaatcgcctcagcgattgaacccaggaggcggaggttgcagtgagccgagatcgcaccattgcactccagcctgggtgacaatgcgagactctgtctcaaaaaaaaaaaaaaaaaattaaaaaaaaagatagaaagaaaatgtaattgttataatggaaaaattgagaaattctattttataggtcctctactgggatcactatatttcctctcaatatcagatcctatgacttcaactgccagccaattgctaatgtatcctaaatttatttctccatccttgactactcttctgagttctaaaattatatatcttacttactactttctgtttctattttgatgtctaacaggcatgtcaaatccattatggttaaattatacctcttttctttggccctcaaacctatttatccccaatttttttggtaaatatgtagagaatccatttatgtaaccagttgttcaagaacctcagccttactaaattcagcaggtagtcatgttgcctgtagccttcaacctaccttgctaatggactattctctctatcctcattgtcctctgacaacctaagcctgtatcacttctcctttgggatcattattctttcattcttacttctgtataagccattctctgcttagcagccagaatgatctttctacaagataaattcaatcacgcttcttcccttttaaaaatcccacagtgacttctatcacaattaacataaagattccttgccattacttctatctccaatctcatcttctactactgttttcctcactcaccatgttccatataaaccatacctaaaagccttttgatgtatttcaaacaaaccaaatttctatttactttagagtcttcatacttcacatctgaaatactttgcatatctgcacaggttggcttcttctttctactcagtttaaacattccttccttattgaggctttcttagcacccaatttaaagtagccccatctgggtactctttgtggctctaggtgtaaatacccctagtttactagtatcatcagattgtcttgtaagtttcacagctaaagggacctcactgtgctggccaccactgtattttctagcacttatatcactaccacatatcaaacaggtgctcaatgaatatatacgtataatgagtatataaacgaataaatagaaagaaatgaatttcctgataatgagaaatgctgagagaaaaaaacaagagggaaagggaagatgattgtggaggaacattcatcaggtaggactttctgaatgaggtgagtcacatttgaacttgaagaaacatgggctttgtccttggaagggaagacaaatgtatgcaatagacctgtatttcaaatagatatttggagatgaccagagctatttctagaatgtgaaaaaggaacattattggagtagggaggggggcgttgttgagcaagattggtaaaagtaggttttagtctataggctgcctagttcagattcagcctagggaatggaagtttgtactggtgaatgaattacatttttaaaaatctgaataatttagcacctcatctctgaataaaagccttatggtgtctgatatctcaagtgtttttctaaatcggtgcctggaacaagatgttaaaagcaagagctttggaaacaaacagatgtgagagtgtatgcaggcatcaatttgccagttgtctgacattgaacagttacttaatctcacctcctgaactccaaattgcagtttttttacaagattaattttaagaatataaataactcaaagccatgagtgacaccagaaggattaataaatgtgtgatcattatcatattaatatgttaaagcatagtatctgatgtgagtttcaaacctgttattgaaattgctcatttcactatagtagtaccagccagctcattatcttgtctctccacccaccacacgggtgctgacaaacgttggtatcactgataaaaatggtagggtaggcttagttttagaaatgttttgtaatggagaaaaataagtagaattatcttataggtggcagaatactgacattttggatgtaacaaattgcatttggctaaacacttaagtgaaattttaaaaactaaactatgtaagttaactttcttagtcaggtctttgtactcaactaataatggaatgactgcattcttgaaaagttcattcattcactcacactcactgagcactgacattgtgccaatcaatggtccatgtgctgagaaaatagtgcttaaaagcagacatgacccttggctctcattgagcttatggtattgtggaaaagacaattaataaataattcaaaaaactaaaattacacagtgataagtgctataaaagagagttacatgattccatggaattccataatgaagaaagcttactagaaatataaatttctataaaaatatttataggttccattaacttgaattaaatgcatggcaaactgagaaaatggatctattataaacctagttaaaaaacatttttttaaatattttttcttggtagtttgttttgttttcttttttcccccctttatttcttcttaaaacaaaaggggatacatgtacagaactttgctgaagttgctcatcagttccagaagtttttgggctgagatgatggggttttctaaatataaaatcatgttgactgcaaacagagacaacgtgacttcctctcttcgtatttgaatacccttactttctttctcttgcctggtttccctagccagaacttccaatactatgttgaataagagtagtgagagagggcatccttgtcttgtaccagttttcagagggaatgctttcagcttttgcccattcaatatgatattggctgtaggtttgtcataaatagctattattttgagatatgttccaccagtacctagtttattgagagttttaccatgatgaagggatgtcgaattttatcaaaggccgttctgtatctattgagctaatcatgtggtttttgtcattgattctgtttatgtgatgggttacatttattgatttgcgtatgttgaaccagccttgcatccaagggatgaagccaatatcatcgtggtggataaattttttgatatgctgctggatttggtttgccagtattttattaaggattttcgcattgatgtttatcaggaatattgtcctgaagttttatttttttttgttatgtctcttccaagttttggcatcagaatgatgccgacttcataaaaggggttaggaaggagtccctcctattcagttgtttggaatagtttcagaaggaatggtaccagctcctttttgtatttctgctagaattcagctgtgaatctgtctggtcatggactttttttttggttggtaggctattaattactgccttaatttcagagcttgttattggtctattcagggattcaacttcttcctggtttagtcttggtagagtgtttgcatctgggaatttatccatttctcctagattttctggtttatttgtgtagaggtgtttattctctgatggtagtttgtatttctgtgggatcaatggtgatatccgctttatcatttttattgtgtctatttatttcttttctcttttcttctgtataagtctagctagcagtctattgtgttaattttttcaaaaaaaaaaacaactcctggatttgttgatttttttggagggtttttcgtgtctctatctccttcaattctcctctgatttatttcttgtcttctgctagttttggatcagtttgctcttgcctctccagctcttttaattgtgatgtttgtatgtcagtctgagatctttctggctttctgatgtgggcatttagttctataaatttccctcttaacactgctgtacctgtgtcccagagattctggtatgttgtctctttgttctcattggtttccaagaacttcttaatttctgacttaatttcattatttacccaggagtcattcaagagtaggttgttcaatttccttgaaattgtgtggttttgagttattttcttaatcctgagttctaatttgattccactgtggtctgagagaatatttgttatgattttagttcttttgcatttgctgaggagtgttttacttccaattatgtggtcaattttagaataagtgccatgtggcgctgagaagaatgtatattctgttgatttggggtagagagttctgtagacgtttactaggtccacttgattcagagctgaattcaagtccttaatatacttgttaattttctgtcttgttaatctgtgtaatactgagagcgggttgttaaagtctcccaccattattgtgtgggagtctaagtctctctgtaggtctctaagaacttgttttatgaatctgggtgctcctatattgggtgcatatatattcagaatagttagctcttcttgttgaattgttccctttcccattatgtaatgcctttctttgtcttttttgatctttgttggtttaaagtctgtttttcagagactaggattgcaatccctgctttatttgctttccatttgcttggtaaattttcctccatccctttattttgatcctttgtgtgcctttgaatgtaagatgggtctcctgaacacagcacactgatgggtcttgattccttatccaatttgccagtctgtaccttttaattggggcatttagtccatttacatttaaagttagtattgttatgtgtgaattttatttatttattcatttgagacagagtttcactcttgttgcccaggctggagtgcaatggcacgctcttggctcactgcaacctcagctcactgcaaccttggctcactgcaacctccgcctcctggattcaagcaattgtcctgcctcagcctcctgagtagctgggattacaggcgtgtgcaaccacacccaaataatttttgtatttttagtagagatggggtttcatcatgttggtcaggctggtctcgatctcctgacaagtgatccagctgcctcagcctcccaaagtgctgggagtacaggcatgagccaccatgccccacatatgtgtgaatatgatcctgtcatcattatgctatttggttgttttgcacactactcaatgcagtttcttcgtagtgtcattggtctttatattttggtgtgtttttgcaatggctgatgccagtttttcctttccatatttagtgcttctctcagaaactgttgcagggcaggcctggtggtaacaaactccctcagcatttgcttgtctggaaaggattttatttatccttcaattatgaagcttagtttgactggatatgaaattctgggttgaaaattgttttcttttttttttaacaatgttgaatattggccccccatctcttgtggcttgtagaatttctgctgagaggtctgctgttagtctgattgtcttccctttgtaggtgacctggcctttctctcttattgcccttaacagtttttccttcatttcgaccttggagaatctgaagattatgtgtcttggggttcaacttcttgtggagcatcttaatggtgttatttgtatttcccgaatttgcatgttggctgttaggttgaggaagttctcctggataatatcccgaaatgtgttttccagcttgtttccattctccccatctccttctggtactccaatcaatcataggtttggtctttttatgaagtcccatatttcttggaggatttgttcattccttttcattcatttttctctattcttgtctgtatgtcttatttcagtaaggtggtcttcaaactctgttatcctttcttccgcttggttgatttggcttttgatacttgtgtatgcgtcaccaatttcccatgctgtgtttttcagctccatcagctcgtttgtgttcctctataaactggttattctagttagcaattcctctaaccttttatcaaggttcttagcttctttgcattgggttagaacatgccccctttagctcatcatagttttttattacccatcttctgaagcctacttttgtcaatttatccaactgattcatccagttctgcacccttgatggagagacattgcaatcatttccaggagaacagaaactctggccttttgggttttcagcatttttttctttgattctttcttgtcttcatgagtttgtctagttttggcctttgaagctgctgacacttggatggggtttttgtgggggcctttgttgtgctgttaatgctattgctattgctttctgcttgtctgtttttctttcagtagtcaggtccctcttctgtagggctgctgcagtttgctggggtttcacgttaggccttattcatctgatttgctcccatgcctggagatgtcactcaaggaggctggagagcagcaaagatgggtgcctcctccttcttccgggacctctgacctcaaagggcaccaatctgatgctagtaggatcattcctttatagggtgtctgacaacccctgttggagggtctcacccagttgggaggcacagggagcaggacctgtttaatgaagcactttgtcccttggtggagagggtgtgttttgctggggggaaacccacttgtctgggctgcctggattcctcagaactaccaggagtagaggctaagtctgctggtccacagagactgtggccacccctcccgctaggggttcaggaccagggagagccaaattctgtccctgagcccctggctggagttattggagatcctgcaggaaagccccacccactgaggaaggatgggtcaaggctagacctgaagaggcactctaactgcagacagccacagccggtgacttgggctgtggggacaagttttgggacctagccatccagcctccctggctccagaaggggaaaagtgcagcctgtaactatggaaatgggtgctgcccttccccccgcccagggagctcagcgtgttaggcagttgcaagtcccagtgctggctgctacccctcccacaaggagctcaaatggcttagacagcaggcagctgcagcttgttctggtcgcccctttccccgggagtttggtaggcttaagcagattccagctgagaggctgaagaatcttcacattcccgggttgggaagctaggtcccagtggcgtgggttcgtgagtgggatcttccgatccaagggttccacagttccgtggaagaagcagtctccctggctgggtagcgcgctcactcaccgccttccttggcttgtggggacagggtacccctttcccctgtcgctctcaggtgggtcgccacaccacactgctcttccttttatccgtgggtcacgccagccttctagtcaattttgatgagcgaacttggataccttggttgcaggtgaagacttcacacgcttattatgttttttttttctatggtagactccaagcaccgctgcttttaattagccatcttggccccacccgaagttaattttttttttcttttctttagacagggtctcactctgtcgcccaggctggagtgcagtggcacgatctcagctcactgcaacctccgcctccctgtttcaagcggttctcctgcctcagcctcccgagtagcggggaatacaggcatacgccatcgcacccagctaatttttgcatttattggtagagacggggtttcactaagttggccaggctgctctcaaactccggatctctggtgatccacctacctcggtctcccaaagtgctgggattacaggcattgagacaccacaccccagcctaaatgtttttaatgagaatttactgagactatatttagctgtttttcatgttgacacagtacaagaaattaaacatggtcatttggtctttatcatttactatatatgcacgcacatgtacatatatgcatgtatgaatggatgcatgtacatatataaacacttgtggtgcttcattcacgccaggatttctcaacttaccttctccaatagaatgtttacctcaataagaatatgtaggagctgaaaagttaatctcatggaggtagaatagaagagtatttaccaaaggctgggaagggtatgtatattggagggagatgaagagaagttgataaataagtacaaccatacagtaagacagaaagaataagttataatgttctatagcagagtggggtgaccatagttaataacaatgtgttgtatatttcaaatagctagaagagaggttttgaaatgttcccaccacatagaaatgataagcgcttgaggtgacggatagcctaaatacactgacttgatcattatgcaattctatgcatgtaacaaaatatcacaggtattccataaatatgtacattattatatatcaatcaaaaaataattaaatatcaatcaaaaaaatctacaattcctagtgcttgtgcaacacaagttctccctcctgtttgaccgttttgagaaactgcttgtgaagtggtgcttttatatcaagcatcatcagacttcacttccatttgtaagtcaatgacccataataaattctacagtttaacaatttttcgtaagtctagaactatatatgcaaattgatactagatattggcatctaagtgtcacttctttggggactaaattcaaagtatctgaaactgttattgttgttcttcaatttggattctcctcatgtaatccaatacttggtgaatatcctcaccatccatctcggtacctatgtaactttgctaaaacttccataacaaaataccacagcctgggtggcttaaataacacgttttggggttacaagagcaaggtaaaagtactggaaggtttagtttcttccaaggctcttcttcttggcctacaggtggcccccttctcactgtgttcttgcttgatgtttatctctgtgcatccctcatgaatctttgtgtgcccagatttcctcttctacaggcttccaatcagattgaattagggtccaccctaatggcctcattttacgttaataatttctttaaaagctccaaatacagtcacattctgagatactagggggcaggtcttcaatacaggaatttttgggggacacagttcagcccatagtagtacccacatcagagtgttagaggctattctagaagctttacttttcctcattacttaatattcaatttgtgaacaggtattatcaatgtcaactcttgaatgttatcatatcttacctcttctttctattctcactgctgctgccttagatacattcctaatcctctcttggctatattgcataaatattctaatttttccctcctccaatctagttctgtctccatgttgtcctctacattattattagagcaagcttcttagttttcaacattgaagcccttcaacggccagcccttgccattgcccttgctgctgcctgtagaaactattcctagcactgtttcaccctaatgatttcaggttggttcttttaagggtatgaggcaagttctttccacgaatatgtacacatcattactcaggcaaagaatccaagaacgttctctatcatttctgaaacccttctctgggcagctgacttctttctctgttattctgtttcataaagtttagcttccttcacctttttgaaatagaattttctgtcttctcaactcaatgacactgccatgctctgtttagatttccctgttctgcactgtggcctggaaactgcctccaggcattaagctgggacaagccttgtgctcgtctcatttgtttttctgctgtcagggatcacaattccatgcttcctgatgtccagtatctgaaaactgtggcttcatatatttttatccagttttttttttagttgtttgaaaggtaggagaatgaatacagtccctgttaaaattctattataatcagaaatagaaatttagcaatatgtattttttaaagacaaaaatatgggtttatattgatatttacagtcatatttaagaatatgctctcttttttaaaatgtatgcttctttgttagcataattattttgtcatacagcatgtatataataatttcaaaataacaattttattgtaactagaaaccaatgaaaaaactgaaatatgattaatttttttagcatatatcccattgaagacactatgatctaagtcagatggaattattgttttcttctctgacagattccaatagaggaacattttgcattatacaggtatttctcaaaactgtcaaggtcatcaaaaataaaaaaagtctgagaaactgtcacagcctaggagaaacctacaggagacatgataactagatataatgggatgagatgctagcatgcgcatacacacacacacacacacacaagtagataaaaactaaggaatctgaataaaccatggatattatttaataggaaagtatcggtttattcgtggtaacaaatgtaccatactaatgtaatacggtaataataatggaaagtatatgtgtggtgagggcatctatggaaattctctgtactatctacttaattattctgtaattttaaaactgttctaaaaatagtctactcaatttttaaaaagctgatttaaaaccaagtagtttcataccattatactccagactgggcgacagagcaagaccctgtctcaaaagaaacagacagacaaaaagcttagtagctgttaatagtagtgaatctttgttttcctttactttctctcataaaattacatattgcttaatttgaaattattttataacttaaatgaatagaatatatattaatttcagaatatattttaatatatacacataaaaataaatctgtttatattttcccaatatgttaattctatggtgagaacaattaaagcattttaagtggaaaaaaaatcatagttctttcactaattgtaccaacatttttaatgtaaaaatttccatgagttctgagtctttttaaaaaattttctattctatttactttctcttcttgtttaatttaattttattataattatttattttattatttctgatctatttgctttccctgctcatctgttaatactgcactgtttaaattacagagatgtttaatatttatttaaggatcatggtatttttatacattgatatgtaacttaggagccaagatgccatatgcattagttcatggaattgccaatttacaaagaagccaacattattgaaatgatatttctttctagctaaagaacttgacacatatttccatagtaaatgtattactacagcattctcaatatagtttttgcaatggctatatttaggtttcctgaaaatgaaagtttattttttaggtgtgagtttgtttacatatttaacttttaaaatatcttgatatccacttttagctaggtgtgtgtacagttacaagttactttagagaagtctaattgaatgtgtattacagttcttatactataaaataaaatgttacatattcagaaaatgttctactcatcttcaaattggataaatcaaataatactattaacttatttagttttttatgctgttagcttgccttgtatgaggcttgaatcacacacgctttgaagactatatgctcagataaagtatgtttaagaagatcacactaaagcatggtgcctccgaaataaaaaaaagttgagggaatagctctctgggttgcagataaataaatttgtattcaataccagctgttgatagctatttaaatgttacttgggcctttggagtattaaagggcaggcatcacatttataatgttaaaagtttctgagtaaattaaaggtgcaaatgtgcttagcaattagcagtgctgaaaacacatattactgatttaaagttcttccatatcatgtattttataagaaagttttaaattttaatgttgaggttattcatattttaatttagcctgaggcagacacagcaagatttggaatgcatagcttccttctggttgtattatagtctttcactgatatcagccaaattggattttgcaaagcttacattattgcatttcagaaattttaggtcatgccatgttcattttttaactttaatttatgcatatttgcctttcactgttcatttaatgaaaacataagccagctggaagttctcagtgtttctctagtcagaaaagccagcatcagggacagagttgtgtgaagaggaatatactatttcagaactatcccagcataattggaaagcctatatatagactgttatccagtacaataaattggcatctgatccaatctattaataaacagcataaccaagtcaatggcagagtagaggaataagaggcacaagagggtggcaaaagacagtttgagaagaatgcatataaaagactactgcctcatccctacttcctcatgaggtgtgccatctcctgctttcagagtagactctaaactcattatcttgcttagggttgctctaatgagtcagtgaggtgacaagacagcagatgggatgaataaacaattacacagctccttaaaaatttgtcccctctgccacttgagtaagaggaaatttagtcagggtgagataatgagttaaggtggaaaaatgcttgctaggtggcatccgcctcaatagttgatccctcaccccaccaatgcacaaaatatgataacttgcccaaagaaactgttcattctcatgaaacacaaacttaattgaaaaccatgtgctttattgtacataattttgtgtcctgggtgcataagtatttcgcagaattctttttggttagtattgacaaatatagaaaagaccattaagtatttcataagtattaaatctgacacgttgttattttatagcatcagtgtgtgtatactcattgccagaaaatggtggattaaagacagttactacaaaagttggcatttgttatattgtcaagatttgccaaaaaaaattttaatatctaaaacttagtcttaacattagaattactatttaaataaataaatgcttaaatacatatttacacatacacataaatatttctttaagtagatattctattatattaaatttctattttctgtagttggaaaagccaacatcatgaacagagttgtgtgaggagaaatatactgttacaaaactattttagcatataccagactgtaatctagcataataagttcacatctgattcaatctgttaatggtaaatactaatattttaattaaaatttaagtgattattttaattaatacattgatattaatatctatttaaatagatgttttgataaacatttatataatgaatatgatagcattaaattgtagggtaaattaaacatctctttgatatttgtttgagactatgaagttgacatatgtggacagatagcaagagtaatatttgtctttatactctaaaaattgcagctgttcatacattgaaatatgtgttgcattttaaccagcaacagatttgtagaaccatttcattatctgaaaacaaaaaaaagttgttattaaatatttgctgtatactatttttagagtcctttttaatgtggtttttactctagctttttcgatggcatgtttttattaaaggatccacattttttcttgcagctggaccacagcaaagttcataggcagccaaggcaaggaagaaaatttgctatgtgtaaaataaaatatttgacagtaaattgaatcttggctaactgataaaccatatatatatttactataagtcactgagtaattattaggaatttgcctttatgttgtaaaagagaaatcagatgttgacattatttctcttaaatacattgtgctttcctttgcattgataaaaacgtgaagaaaaaaatagaattttaaaatttctcttaagaatggtagcaatgccatttatgtcccctgtatataaattttggatgctggagataaagccctgttccttggcccagggctcagcaatctttggaacagagctttctggactctctggcacataccacaccccaaactggcaaatgctcatatctgcaaaggtcaatgtactatgagggttggaacaatccctgatgactaagatgggaaaagaaaaatcaaagtacaaagcaagcataatgtcattgatcaaattttgtttgagaaatagctgtgatccaaatctttagttcagtctgacatgcactttctatatgtggtgtagactcatagttacaaaaaaagtacgtaaaaagttttattcacaaaaagttaaatctgttggtagacacaatgtctgtcacacttggacaaaccacccatttgttaatcactcccagattaatatctctaggttggaaatcttccctaaactgtagactcaacgtccagctatctacttgacactagagggtttaatagcccccaattaatatgtcctcatagaacccctaaaactttcttcacactcaaacttctccatgctggtcgatggcaatgccatccttccagctggctcaggccaagagctttggagcctttataacccctccctttctctcatcctgcctacctggtccatcatatagactcttggcatcattgtcactcacctggatattctgagagcctcctaactactttcgctgcatccgtcgtaactgccttcccacacagtttttttcaatacagcagttagaatgattctttaaaaacatccgtctgattatgtcatacttctattcaaaaccctccaatagcttccatatcacttggagtaaataccaaagtccttaaaatgggcacaagatcctaccaaatgaaactccctatttcttctcttgggaagaaagtacagagagtttccatatcccccacactcagtttcctctattgttaatatcttacattattatggtacagttgctacagttaatttatgaatattgatactgtgttattaactacaggccatcctttacacagatttccttagtttaaaccttgtgctctttttctgtttcaggatctcatccaatacaccacattatatttatttcttatatcttcttaagttcttggcttaaggagagttgagtttctcagactttccttgattttgatgaccatgactatttctgttttgagtagtagtgtacatagtttgtagaattactctcaactgagatctgtctgatgtttttgtcatcattaggctagggttatgggttttgtggaggaggaggtaaaaagccattctcaacacatcatttcaaggagatacactgtcaatgacagcacaattgatggtaaccttaatccatgactgagttaatgtttgtcatatttatcagctgtaaagttaatgttttatgctcctttccatatgctattctttggaaggaagttactgtatgagggccacatttaaggagtgagtagctatgcttttataagggctggaaatctacatcagatatttagctttcttctgcacagggagtttgtctcttcactcccatttatttatttattcgattatttaggttatgagtatgaactcatggatatttatagtttggattatgatccaatactatttatatactttacttctcaaattattccagctttgtttactgggagcttttttagttggctcctatgcttctttgactgtatgtgttagtacttccttatgttttggcacttacaagttgctccaggattgtatttttattcttgcttcagttctagaattaggcatttctttaagattcctgttgtagactgaatgtttgtgttccctccaaaattcatatgttgacattctaacacccaatgtgatagtattaggaggtggggcctttgagaactaattaggtaacaagggaagagtctttggaagtgggattagtgcccttataaaaaagaccacagagctctctagttcccttcccaccatatgaggatacaaggagaaatcaacattctgcaacccacaagaggggcctcagctcagaacctaaccatccttgtgccctgatcttggacttccatcttctagaactgtaagaaatacatttctgttgtttataagcccccagtctatggtactttgttataacagcccaaattgactaagaaagtttcttttattggaaaattctattagaaaccacaatctgagtactgggtgtgcttgctattactagggtggcattgcttctaggcccactcagctgaccgagcaagaagatatatgaatatctactaagctttgtacctgtacatctctacaaatatttctatatgtatctgtgtttatattaaactaaacatgagttcagagttcatactgatatcttcaatgctaagctagtaccatacagattattccagccccctcctcattcttatctataaattctcactcttggttctcactgtccacttacctaattgttcaattcttgtatacatgtataatggtctcagagttgctaacctgtactcccatgaaacacaactttatgaactagagtacaggcttgcatatagcttcttttacctgtagtctcacaaactccacttatttccaaactcagcacatttttctcctatccttttcagttaggctatttttgtatatttttaatatagctaaattattttgtcatagtctgcatttcatgctgggatcagctgacttcctacattaaaaaaattgtagactttaagatacaatctttttattgtaaatttctattttacaaattgttttcacaaatgcttagtgttttgtatcatacattattgtcttataggttatagtttcaccaccctaaacaatcccctatgtgacacttattaaccctctccaaatctctggcaaccactgatcagattaccattaccattatcattagttgccctcccagatagtccaataaagagaatcatgtattaaatcattttcacactttgttcattgagcaatatgcattggcattcatttacatcttttcacagtttgatggctcattcattttttatcactgaataccattccattgtatggatgtaccacagtttgtctattcatatctaaggacaattttttatacctccagtttttggtaactataatgaaagctgctataaacacttacatgcagattttgtgtggacatgagtttccatatcagttagataaatacctagcagcagtattgcaggatcatattgtgagactatgtgtagaaagaaattgccaaattgtcttctaaattggttttggcactttgtattcccaccagcaatgaatgtgagttcttatttctctacatccatgccagcagttggtattgtcagtgtactggatcttggccatcctaatagttgtgtagttgtatcttgttttaatttgcattttcctagtcacagttggttttgttcatcttttcatatgcttatttgccatctgtttatcttctttggtgagatttggatctatttcctcctttttaaaattgatttgtttgttttcccagtttttaacagtgtttttgtatattttgggtacaagtcttttactagacctgtgatttgtaaatattttctttcagtctgttacttgtttttctgtgtgttttaaaagtgtgttttacagaggaaatgttttaattttaataaggtcctacttctcaactttttctttctggtagcatactttgagtgtatctaaaaactaatccccaaacccaatctcacatagattttctcatatgtttttatttgtaagttttatggtttatattttacatttaggtcagaaatacattttgagttatttattaaggtataaggtctatatctaggttttttatttattattaatttgttgcttatgcatgtcccactgtttcagtgccatttgttgagaagactctcctttctccatctaattgcctttgcgtctttgttaaaaatctgtttcttatgttcgtctgtatctatttatgggctccttattctattaatctgtgtgtctattctttcaccaatactatgttatcaatactatactgccttgattactgtagcttaatagtcgttattgaagttaggtagtatcagtcctccaacttatttctctccttcaatattgtgttaggtattcagttttttaatatttttttttgtaaacttcattaatagagtcagtttgtttatacctgcaaacaaacttgtgattttgtctggaattgcattgactctatacattaatttaagaataattgacatgttaataatattcagtcttgcagtctatcaagtagaatatctgtccatttacttatgtctttgatttatttcatccaagttttgtagttttacacatagagttccctgtttttgtttttttctttagatttttacataagtattccttttctgatactgctataaatattcttgttgtttgtttttattttcaaatttcaattgttcattactggtatatagtaaaacacttgcctctagaatattaactttgtatcctatggcctttctatactcagtaatttcaggagattttctgtaaattgtttgaagttgtttacatagacaatcatgttatctgtaagtaaaaacacttttttcttttcaatctgtaaatattttactcctttttcttgtcttattgcaacagtgagctcttccagtatgacttaaataggtgtggtgaaagaagaccaccttgctttgttccagattgtagatggaaatcatttttatgactgaaagctcattgtagaatttgtgtgccacaacttcttgcgcttctaatacaattttttaaataataaagtcacccaattcattgagaaaatttatagcacaaaacgattttcctacgagggcaatggagaaagaaactctattgttaagacactgggaaaaaatacagttatctgtggtcagctgaatggagtgagttgcttgttttttttttttttttttttttgagatgaagttttgctcttgttgcccaggctggagtgcgatggcacaatgtcagctcactgcaacctctgcctcccaggttcaagtgattctcctgcctcagcctcccaagtagctgggattacaggcatgcaccaacacgcccagctgattttgtatttgtagtagagatggagtttctccatgttggtcaggctggtttcgaactcctggcctcaagtgatctgcccgcctcagcctcccaaaatgctgggattacaggcgtgagccgccacgcacagctgagttgcttcttaatattctactcttgttatattttattcgtgagatatatttattcctactttatttttaatactttctgttaaacaagtggtgacaatgattttcccacatgacaaacatttattcttatatttaaaaaatgaatcataaaagttagcagagaggtattttgttggcattatttttaaataatgttgtttctttctgatcattgaaaaaacatattttatgctctattttgttctatcaaattagctactttgggaacatatgtaaacacaaaaacgtaaaaagttataacaaatattttatgtttcatctccctaatggtaattcagtgtttaacaatctagtgtatttttacaaatattttatataaatacacacatctacacacacaaacttttatataattgaaactataattgttcttatatattttatatatttaatacttaggaattttccacaactttgcttctcaagaaagataaattttaatggcttcctaacattttatcatatgaatgtgctagaacgacttagtcttttttattattgcatatttgttttttctcaaaaaagtacaatgcagcaagtggcgttgagaaaactgcatatccacatgcaataagaataaagttggatcattatgttacattatatgcaaaaatcaactcaaaatgcattaaagacttaaacataagtcctgaaccataaagcttctagaaaaaaacataggggaaaagctccttgacattggccttagcaatgatttttttgaatatgacactaaaagcataagcaacaaaagcaaaaataaacaaatggaactatgtcaaaataaaaagcttctgtatggtgatggaaaaatcaacaaaatgaaaaggcaacctttgggtttggagaaaatatttgcaaaccatacatctgataagggattaatatccaaaatatacaaggaactcacacaagtcaatagcaaaaaaaatcaaataattcaattaaaaaatgggcaaaggacttgaacagatatttttcaaagaaggacatatgaatgaccaacagatatctacaaaggtgcccaaaattattaattactaagaaaatgcaaatcaaaaccacattgagctatcacctcatgcctattagaaaggcaattatgaaaaagagaagagataacatcttggcaagggtatggaaaaaggagaactcttgtacaccgtgggtgataatgtaaaatggtacagccattatggaaaacagtatggaggttcctcaaaaaaaaaaaaaaaagaactaccttataatgcaagaatccctcttttggacatatctccaaagaacatgaagtcagtatctgaaagagatgcctgtgctcccatactcactgcagcattactcattatagccaatatatggaaacaacctgtgtcaatcaacagatgaattgaaaaagaaattgtgatatatatatatcatatgtatatcataataatatatgaatattattcactcttaaaaaagaaggtgtttgtgacaacgtgaatgaacctggaagatatgatgctaagtgaaataagccagatacagaaagaaaaatagtgcattctttcacttgtatgtggaatctaaaaaagccaaacacatagaaacaggaagtagaatggtggttaccagggtctgggtgtgggggaagtgagaagatgttggtcaaagtgtacaaagttgcagttatctaggatgaataagccaagagatataatgtacaacgtgatgactacagttaatagtattgcattgtatactgaaaattagctaggaaagtagaattcaggtcttctcaccacaaaaaatggtaactgtggggcaatggatatgttaacttgcttaactgcggtaatcattttactgtgtatatgtatatcaaaaaatcatgttgtacaccttaaatatgtaagatttttattaaaaacagtaattaaaaaactcaaaatatctctatgtgtttcatgtcaaaattttcaatttcttatatggctttgtagagataaaaatatagaatccaagtgcataagcattttcaaaactctgggtagattttaacaaattattttctatttagaagggttagatcaatctgtatttcatataaaactagtacatgaggtactttgttaaatctaattcaaaattaggtagcatcactaataaaaagggtaaaagtatctttgccaatctaatagtcaggaatggtattttattttgatttacatcttagatctaactgaatcttcttgaggtttatgttttgcttttttttctggcatgggtttagggcttcccttttccacttttagaaggtcttttttaaagagatgaagtgtttagcttagaatgagtatgcatattttatccatcttcccactcgccttttacatttatggccatttatcaggaagcagttaattagtgtaaactgaccctttcctctgcacatcttctacatcattcattgcttttaagcttacatcattcattgcattaactgatttttacccggttagagatcatttgtgttttcatcttttaaaaatagccttatttgtaaacttcaaccagaagtttgttataagatgaatatttaaattctttttaaggtacatacttaacttagtatttgagcagtatctttggaagaattctgtcaaattatacatatgtgtgtgtgtatgatatggtttgactgtgtccccactcaaatcttatcttgaattgtagttcccataatccccacatttatgggagaaacactatgggaagtaattaaaccatgggggtggttaccctcatgctgttctcgtgatagtgagtgcgttctcatgagatctagtggttttataagaggctttttccccttttgctcatatatctccttgatgtcaccatgtgaaggaggacatgtttgcttccccttccgccataattgtaagtttcctgaggccttccccgccatgctgaactgtgagtcaagtaaacttctttcctttataagttacccaaacttgggtatatccttatagcagtgtgagaatggactaatacactatatgtgtgcttgcatttgcatgttttcatttcttccatttcattaatctgcctgtcggttttcatattgccaacatattatgttaattattataatctcattaaatatcatattttaataccttataggtcaagattcccattaccattctttttttgatatgttttcacattcttacctatttttcactagacaaaatttaattatcatttaatcatattttaagatgtgtcttactgatattttaattagatatatatattttaaatcttggtaacagttcactttttgtatttttttattaatctattttatcacccacagaacacattctgtcaagtatcatccaagtagtaggcatggagaacacactggttaacaatactcttgcagtctactgggctatatctttcagtttattcaagcttttagtattattctgaatggtaatttataatttattcttataagtatttcacattgtatagtaagaccattttatactttacagtgtaagctataatatatgtgataaatattgttttgactgtattttacacaataattaccattttcaaattttttccttattttcttttttggcatgtgaactatatgataggattcatttgctttaatctcatttggtagtttggaaaatgtttattttctatttgtcaccttttcaaaaatgtacaattatctttgcctggaaataggaattttgccacattttaatttcttccgtttattgtgttcctggccaatcgtgtatttttgtgctctatgaatcttttcattgttaataatttatttgtatttggtagaacatattgtcttggctgcaacatggtttatttctttacccagtcttgaactaggcaagaaatattcatacagtttgttaacaaattaaatttgtgacactttggaaagtttttttttgaaataataattattttttctttatctcattgttttaggtgattttaatagaaagataaatattttctacattccaaaatattgcaaatatttgtgggttgaggctgaatgtgactctgcagttacttattggtttcattttctgaatttcataggcaaagcagacttttgcattcaaagaatacaaagcccaagagaactgtcatataggggtctagtcccattgaaagaaacagattctaggaactcaggagagtgtagccatgtctcaaaggggcaagtggatagtgttttgttttctttattattattattattaatttttttatttccttaggttattggggaacaggtggtgtttggttatatgagtaagttctttggtggtgatgtgtgagattttggtgcatccatcgcctgagcagtatacattgcacccaatttgtggccttttatccctcacccccctcccaccctttccctctgaatccccaaagtccattgtgtctttattatgcctttgcatcctcatagcttagttcccacatatgagtgagaacatatgatgtctggttttccattcctgagttacttcacttagaatgatagtctccaatatcatccaggtcactgtgaatgccattaattcattcctttttatggctgagtagtattccatcatatatacataccatagtttcttaatccactcattgattgatggacatttgggttggctccacacttttgcaattccaaattgtgctgctataaacatgcgtgtgcaagtatcttttttcatataatgagttatttttctctgggtagacaccctgtagtaggattgctggatcaaatggtagttctacttttagttctttaaggaatctccacactgttctccatagtggttgtactggttcacattcccaccagcagtatagaagtgttttctgttcaccgcacccatgccagcatgtattattttttgattatggccattcttgcaggagtaaggtggtattgcactatggttttgatttgcatttccttgatcattagtggtgttgagcattttttcatatgtttgttggatatttgtatatcctctttcgagaattgtctattcatgaccttagcccactttttgaggggattgtttgtttttgtcttgcgaatttgtttgagttcactgtagattctggatatcagtcctttgtcagatgtatagattgtgaagattttctcccactctgtggactgcccatttactctgctgtttcttttgccatgcaaaagctctttagtttaattaagccccagcatttgcttttggtttcctggtcatgaaatccttgtccaagtcaatgtctagaggggttttttcaatgttgtcttctagaattgtttttcaatttttatttatttttctcagatagagtctcactctgttgccgtctcggctcagtgcaacctctgcctcctgggctcaagctattcatctgcctcagcctcccaagtagctgggactacaggcacctgccaccacacccagctaatttttttagtgtagatgggatttcaccatgttggccaggctggtctcgaactcctgacctcaagtggcccacccaccttggcctcccaaaatgctgggattacaagtgtgagctagcacatccggcattgtcttccagaagttttatagtttcaggtcttagatttaagtccttgatccatctgaagctgatttttgtataaggtgagagatgaggatccagtttcattctcctacatgtagcttgccaattatcccagcaccatttgttgaatagggtgtcctttccccactttatgtttttgtttgctttgtcagagatcagttggctgtaagtaattacggtttatttctgggttctctattctgttctgttggtctatttgcctatttttatgccagtaccatgatgttttggtgaccatggccttatagtatagtttgaaatcaggtaatgtaatgcctccagatttgttctttttgctttgtcttgctttggctatgagggctcttttttggttccatatgaactttaggattgatttttctaagtctgtgaagaatgatggtggtattttgatgagaattgcattgaatttgtgtactgcttttggcagtatggtcattttcacaatattgattttatctatccataagcatgggatatgtttccatttgtttgtgtcatctgtgatttctttcagcagtgttttgtcattttccttgtagaggtctttcacctccttggttgggtatattcctaagtattttatttttttgcagctattgtaaaaggggttgagttcttgacttaatgctctacttggtcactgttgatttatagaagaattactgatttgtgtacattgattttgtatccagaaactttgctgaattcttttatcagttctaggagctttctggaggagtctttagggtattttaggtaaataatcatgtcatcagcaaacagtgacagtgtgacttctgctttaccaatttagatgccctttatttctttctcttgtctgattgctctggctaggacttccagtactatgttgaagaggagtggtgagagtgggcatccttgttttgttccagttctcagagggaatgctttcaacttttctccattcagtgttatgttggctgtgagtttgtcatagttggcttttattacattgaggtatgtcccttgtatgctgattttgctgagagttttcatcataaagggaggctggattttgtcaaatgctttttctgcatatattgagatgatcatgtgattttttgtttttggttctgtttatgtgttgtatcacatttactgacttgcatatgttaaaccatccctgcgtccctggtatgaaacccacttgatcatgatggattatctttttgatatgttgttggatttggttagctagaatttttttaaggattttagcatctatgttcatcagggatattggtctgtagttttctttttttggttatgccctttcctggttttggtattagggtgatactggcttcacagaatgatttaggaagggttccctctttctctatcttgtagaatagtgtcagtaggattggtaccaattcttctttgaatatctggtagaattatgctgtgaatccatctggtcctggattttttttttgtttgtaatttttaaattaccatttcaatctcactgcttgttatttgtctgttcagagtatctaattcttcctgatttaagctaggaaggttgtatctttccaggaatttatccatctcttctaggttttctagtttatatgtgtaaaggtgttcatagcagccttgaatgatcttttgtatttcagtggtgtcagttgtaatatctcctgttttgtttcttagtgaggttatttggattttcttgttttctttgttaatcttgctaatggtcaatcaattttatgtatcctttcaaagaaccagctttttgtttcatttatctttttaatttgttgttgtttcgatttcatttagttttgctctgatcttggttatttcctttcttctgctgggtttgggtttggtttgttcttgtttctctggtttcttgaggtgtgatcttacattgtctgtttgtgttctttcaggctttttgatgtaggcatttagggctaagaactttcctcttaacaccacctttgctgtatcccagaggttttgataggttgtgtcactattgtcattcatctagaagaattgttaaatttccctctagatttcatttttgacccaatgatcattcaggagtgggttatttaatttccatgtatttgcatggttttggaggttctttttgaaattgatttccagttttattccactgtggtcttagggagtgctggatataatttcagttttctttaatttattgaggctcattttgtggcccattatattgtctatcttggagaaagttccatgtgctgttgaatagaatgtatattctgcagtgttgggtagaatgttctgtacgtatctattaagtccatttgtttcagggtatagtttaaatctattgtttttgtgttgattttctgtcttgatgatctgtccagtgctgtcagtggagtattgaagtcccccactattattgtgttgctgtctatttcatttcttaggtctattagtaattgttttataaatttgagagatccagtgttaggtgcatatatatttaggattgtgatattttcctgctggacaaggccttttatcattatataatgaccctgtttgtcttttttaattgctgctgctttaaagtttgttttgtctgatataagaatagctacccctggttgcttttggtgtccatttgcatagaatgcctttttccatccctttaccttaagtttatgggagtccttatgtgttaggtgtgtctcctgaaggcagcagatagttggttggtgaattcttatccattctgcaattctgtatcttttaagtggagcatttagaccatttacatacaatgttagtattgagatgtgagatgccattccatttattatgctatttgttgcctgtataccttatttttatttttttaatgtatttttactttgtaggtcttgtaagatttatgctttaaagaagttctgttttaatgtgcttccaggatttgttccaagatttagagctccttttagcagttcttttggggttggcttggtagtgtttctttgaaaaagactatatctttccttcacttatgaagcttagtttcactgggtacaaaattcttggctggcaattgttttgtttgaggaggctgaagataaggccccaatcccttttagcttgtagggtttctgctgagaaatctgctgttaatctgataggtttttctttgtaggttacctggtgtttttgcctcataggtcttaagattctttctttcatcttaactttagataacctgatgacaatgttcctaggtgatgatctttttgcgatgaatttcgcagatgttctttgagcttcttgcatttagatttctatttctctagcaaggctggggaagttttccttgattattcccccaaatacattttccaaacttttagatttctcttcttccttaggaatgctggtaattcttaggtttggtctttaacgtaatcccagacttcttggaggctttgttcatatttttttattcttttttctttgtttttgttggattagtttaattagaacaccttgtttttgagctctgaagttctttcttctgctggcttgattctattgctgagactttccagagaattttgcatttctataagtgtgtctattgtttcctgaaatttctattgttctttatttatgctatttcattgaatatttctcccctcacttcttatatcatctttttgacttatttacattgggctttgcctttttctggtgcctccctgattagcttaataactacccttttgaattctttttcatgtggatcagggatttcttctttatttggatccatttctggagagctattgtgaaacaagtagaaccttgttttttcatattaccagagtttgttctctggttccttctcatttgggtagcctctgtcaaagggaagttctaatgctcaaggctattgttcagttccttttgtcccacaggatatttccttgatgtagtactctccccattttcctagagccaagctgcagtgattgttatctctcttctgaatctagctatccagcaagactaccaggctctgggctggtactgggggttgtctgcaaagagtcctgtgctgtgaaccatctatgggcctctcagccatggataccagcacttgctcctgtggaggtgggagggggtaaaatggactctatgaggatccttagctttcgttgactggtgcactatttttgtgctgattgggctcctgctggtagctggcgctttcaagagagcatcagttatggtagtatggggaggaacaggtggtgggcaggaccctagaacatccaagagtatatgttctttttcttcagttaccagggtgggtagggaaggaccattaagtgggggcagggctgagtatgtctgagctcaaactctacttgggcaggccttactgtggctgctgtgggggttgggggtggtttccaggtcaatggacttatgttcctgggaggattatggctgcctttgctgtgtcttgcaggttgtcagggaagtggggaaagccagcagtcacagttctcacccagttcccatgcaacccaaagagactgtctcattcccaccttgtccccaacaacagcaccaagtctgtttccaggcagtgggcgagcagggctgagaacttgccccaggctacctgcctcccagctgtgaaaataaataggactttccttcttttcccacctgtggagtctgtacactggattaataccttcccccaagttctggccaggagacttcttgatcagttcaaattgttaaaatgttcagctggaggtttccttctcccttggccttttcccagtgcatccagcagccctcctcaaggacccctgtgaggcaaggcagaaatggcttggtaggggacccagcgagcctacagggatttttctgctgcttcctctacccctgtatttcacttggctctctaaactgactcaactccaggtaaggtcagaatcttctcctgtaatctagaccttcaggttccccagtgggggatgtgtgttttggggtggacgatctccctttcccacttccatagtttgggcactcacagtatttggggtgtctcccgggtcctgcaggagcaatttgcttccttcagagggtctgtgggttctcttggatttcctaatgtattcctgcagacattctggagcaaaagttcatgatacaagcctccacatactgttctatccatctgagtgggagctgcaatctagttctgtctcccgtccgccatgatccccagaagttctagtgttttgttttctatattggtgtgagcactataagcatcaagagtttatatatttcctcatgcttaatctattttatgatataataaaatgtaatctgacaatagggttttctgcccccccccccattaaaatggatcttgcattcttctaatttgggaaatatggtactaagagtactgaggaggacagtttgaaaaccactaatctagtttgtctttttgtagtggtaaatgggacattttttaagtcacaccaccagattctctatatcctaaaggaagagccatggcacagtgctttactttgagaaattccatctccatgactgtatgaacctctgtatactctgtctttccaatccctgttttctggtctttgtgggatcccaatggctgtagaaatgtgcatgtgtgtgagaatgaaaaggaagaagaaaaaagatgaagaagcacagaagcagtggtgagattactttcagtttcctaattaatgcatatagttgggtaaatgggtcaagagacaaaaaaaagtaaacaacaaacaacaactttcttcctagctgttctaggcaattaagatttctctcttttatgtagtagcacttaattagtactcttatatacacatttttcaaacttgttttattgataaaatagttttatatgtgtgtgtgagagagataacattcacatatattaacacaagtgtatatgtaggttttattttcataccgatgtatacatgcatacacacatatattttatactaaataaatatatacttccaaatggaaaattaaaattttttttaatacatatatactttatattggcatctgccaataaagtgaggttaaactctaattcaattaagaaatgcggttgcttagtgcaaattttttaaatgaagtgtggacataagctctgaggtttgtgagtttgagaaaaacataaatcttaagaaggtgacatattccactgttctgaaatctgttgagaaaaatgagatggagacacgaataacaaaggctaaaagatacagttagaaaatattatattctataaagttctagaagcatataaaaatattccaaatacaataatatctcccttactataaacctgttttctaaactccttgtatttcaagttttattttaggcatttggattttttttcttttaaaaatagaaaattaatataatgggaatctacaatcaaataaaaattaatttaacaataggcaatcaatgagcacccattacatacctggtatagtgctggaagttgatggcaaaaatattaaaaagatatggtgtcagcattaaaaaatcttacagtttacctgggaaaacaaacacatgtgaaggagtcaaatcactttataaatatggccttttgatcacttagctgaaacatattttttggggggcagggggtgaactgtagaggacttttgctctgttaaatctctagcttttatcagtctgtactgaatatttacaccaaaataacagatacagcaatcccttttcatgcttctttctcattttctttttttttttactgagtctagctttaatctaaaatttcctttctagctattgccatcatttttctctctgaagttgctccggcctctcttttcttatcaggctcacatatgtcagtcttcacctcccactgcatttcttgccctctaaactgactttttacatttggctctttgttttgcatgtgctttcaaattagacattttcttttattttctttaaaatacatttttattgacatttacttatagccaatatactcctgaaaaagtatttttaatagctttattgaattataattgatactaaaaaatgcacatatttagagtatataattttataagtttgggtatatgcctacacccatgaaaccatcgtctgagctccggtctcattcatcaaaatatcaaatctctcctttttggtgctgaaagggtgtagaacagaattgtagtttgttttttttcttctgcccacaaactgtagacttcctcatattctttatttgctctgtttcccaggctggtgttcagtggtgtgaccactgtttccttccgcctcactctcccaggctcaattgatcctcctgcttcagcctcctgagtagctgggaccataggtgtataccactatgcctggctaatttttgtgcatatatatctatatatatacacatacatatatatatatacacacatacatatatatacacacacatatatatatacatatatacacacagatatatatatatacacacacacatatatacacacgtatacacacacacacacacacatatagtagagacacggtctccctatgttgcccaggctggtcttgaactcctgggctcaactgatcctccagccttggcctcccaaagtgctgggattactggagcgagctaccgcaccaggcccctcctcatattcttgatcatggctcaattctaagattccttctttttttctaactctattttacctcgaatccaaatttagccctcatggctgtatgataaaggaacttcaaactggaccacttgtcactactgcaattagtactagctttgttccagtcactctttaccaagctacttgaatcactctaatttcttaatggtctccagttttctacatttgcttttctatagtgtattctcttcagtctttccttctcagccagaagcatattcattataaacacatgtaattatatcactcctctggtctagcactctaaacttggcctccccgactcatttaaaataaagatcggaatccttgctaagccctacggggtcctacatgatctggccccaaaaattcctctgctctccctctttctactcatccccctccttccatgcactagactgccttctttcagtttctcaaacaccttgaggccattcttatctcagagctttaacattggctcttctcctgcctggaaaactcttccaatggcctttatatcatttaggcctcatcaatggtaagcttcccagagatgccttccccgcacacacttttaccaatagcactgctcagcatgttctatccccttactccacttagctatcatcatagtatttataacagcataaaattatatcatttatttatttgcattttttatctctcctcctcctgctagagggctttccccataagacagagacgacttagatcatgtttgcttttcctttgacaagaataaggctgatacatggtagacagtcaaaatattgttgaatgaatagttgttgtttctatggctttattagtggaataaagaatatcatttatggaatttaaaatacttatagaattgttctgtatagaatatgctagtattcacttttcatacgtataaaatatttcatatatctttctatatttctcaatataatttcctaattttaatatatgatatttaatatctacctttcatttacattttttctttttttattatactttaagttctagtgtacacatgcacaacatgcaggtttattacataagtatacatgtgccatgttggtttgctgtacccatcaactcattatttacattaagtatttctcgtaatgctatccctcctccagcctccctccccctaacaggccctggtgtgtgatgttccccaccctgtgtccatgtgttctcattgttgaactcccacttatgagtgagaatatgcagtgtttgattttctctccttgtgatagttggcttagaatgatggtttccagcttcaaccatgtccctgcaaaagacatgaactcatccttttttatggctgcataatattccatggtgcatatatgccgcattttctttatccagtctatcattgatggacatttggattggttccaagtctttgctattgtgaatagtgccacaataaacatatgtgtgcatatgtctttacagtagcatgatttataatcctttgggtatatactcagtaatgggatcagtgggtcaaatggtatttctagttctagatccttgaggaatcgctacactgtcttccacaatggctgaactaatttacacttccaccaaccctgtaaaatttttcctgttcctccacatactctccagcatctgttgtttcctgactttttaatgatcgccattctaactggcgtgagacggtatctcattgtggttttgatttgcatttctctgatgaccagtgatgatgagtattttttcatgtgtctgttggctgcataaatgtcttcttttgagaagtgtctgttcatatactttgcctactttttgatggggttgtttgcttttttcttgtaaatttgtttaagctccttgcagattctggatagtagccctttgtcagatgagtaggttgtgaaaatattttcccattctgtaggttgactgttcactctgatgatagtttcttttgctgtgcagaagctctttagttaaattagatcccccatttgtcaattttggcttttgttgccattgcttttggtgttttagtcatgaagtctttgcccatgtctgtgtcctgaatggtattgcctaggttttcttctagggcttttatggttttaggtcttacatttaggtctttactccatcttgagttaatttttgtataaagagttaatatttggtatcaattttaatatgtgatatataatatcaacatttcatttacattttttcttaattatttaataatggcattggtaacattatggaagggagatatatctttaaatgctcattttaatccatgctgttgctaagtcttatatacattacccacattaccaaattttcttcattttatttctattaagagtatctttaatattctacatatatgtgcagcagcttcattttcaaattctcttattaattttcttttttattaacaaaatatctttaatattcttttttctctatatatttgtaaacgaatatgtctcttccaaattttatatcaaaaatttatctttctgattgcatagattaaaagtatcaaaacgaaataagcatcatgtaaaatgttgttcagtttcaaaataactgagcatcatgtgaatgtcttgaatattttctgttcctgtgtcttctttactactttcttttctattagatgaatattctctagtgtagcattttaattcctttaataattatatttttaaaattattttcttagtggtttctctagggtttacaataataatcttaacttatctatatctacctcagcaccatattaacataatctagtgatacgtagaaactttgcttctatatagtttcaattgcttattatttttatgctttgttattagtgattaacagaaaaccaaagatgttcaaagtccttcaaatctggcagtattctattgctaaactctataggatttgtagaattttattttattttttttcagatggagtcttgctctgtcacccatgctggagggcagtggcgcgatctcggctcactgcaagttccgcctcccgggttcaagccattctccgcctcagcctcccaagtagctgggactacaggcgcctgccaccaagcccagctaattttttggtatttttagtggagatgtggtttcaccatgttagccaggatggtcttgatctcctgaccttgtaatccgcctgcctcggcctcccaaagtgctgggattacaagtgtgcgccactgcaccgggccagcaaaggacttttaagaattttttctgccttaccttgttgaaaatctgaagtttttctatatttctacatttaataataagtctgatgttcaaataatctcgtcagaaatcttctttctttggcattgacttcattctcaagtaggacatcaaccagtatcttcaggcttgcaaaaaaacaatttattatctctgtgggggggtgggggggagtccccaataggtccagttgaggtccctgcatctgtggtttttgtcctagattaggttatatgaacatcttagaaccaacattggagccaggaaaatgaattgctctgagtgacctggttgggaacatgttacccaactgaactcaggtgtgcctgctcaaggcagtaaagccaaacatggtcattggtattgaagtgacagaaactgagacatttattggagagcaccaagtaaggagagttggacagataatgtttaagacccaaactcccatatggcttataagataagggcttttaaagattgagaggcagaggttatgggcaaagttataagtcaacatagaggggctacacgttgttttgacctaaagtgggagacatctcaaagcgaggaaccacaggtccacaagttataggtggatttagattttttgatttgagattggttacggaagtgaaactttgtctaaaaatttggaattagcagaagataaagtttgctctggctcatgagagtgacttttttgggcctccacaggaagaaatttagaacaaaggaaagtggtcagagtttagtcttcatctctctcttatttgaggtctatgtgtcaacacataaagacataaacctccttatctgagatatatgtttggtgggggtctgggttttttgaaaaacagctcagggacgtatgttaagatgttatcttcagtttttatagggaattattcttgtgactctgttatattttggctattattttaagctactgttatctttttgttatttattttgtggggcttgctaggtgtctggaatttcctttgaaaaaattcgagatttttttttttttaattttcgtgtttgggaggggatacctagcaccttcctaagaggggtccctgtttcatttcaatgtctaccataattgtggattaggagtggtgcaagctctctgaattacgggggttaagaacaggaagaaatgctttccccaaaaattggaattattacttacatgaagaatgaatgagtccttgtaagacaaaatcaacagatgtgatctatgtataagcttatattattatttaatacataaaccaggaaacttttgagggtgaaagttttaacaaaaactattttttaagaggcattagtcatcaaaataagtgagtcttaaacttatactgacttgtaaaacagaagaactagatgaaactgacatacaacacaaactaaattccaattgaacatcaacagttcagacccatatattccaagttaaaataaaagagaaactgatataacaggacttaacgtgttccaaagcccactgactggttgagcaacttcagtagtttacaaattctcaccaatctctgctagatcttctttactaactttttccctaaaaccactctatatgactaacttcaaccttcaaattccctaaaaccactctatatgactaactgcaacctcaaattcctcttttgagacacttctgagactctgccaaagcagtgctctcctatgttcaacacatttaataaattcggcttcatatggtcaacagctttcactaatggtctttgtaaggagacttcatgatgcccaggaaagtgcctagacttttaaagtgaaaacatggagtttggtgtggctgaagctgagtgaataagaaggagtatagtgggaaataacgtgagaaggtaagaggtgcacaccatggaaagccttattggccattttaaggattgatgttattgtaagtgaaaagtgagtcactgaaagattttgagaagagaaatgatatgcatttacttcatgtcaaaggtcttgctctagctgttgagctaggaatagaatataggaggacaaaggtggaagaaagttggccagttaaaaagctattgaaataatcaaggcaagagatagtgatagatcagctaatgtcatagcagtagagacagtgcaaaaatatcagactttgggtatattttctaagtgtggaccagtgcgatttactaatgagctagatgtgggaataagagaaaaagaagagtcagggatgattccaaagtttatgaccacagcaactagaaggataaaattgccacttccttcttggaaaagactggcacattacaggcttgtgagagaatttgagtaaattggttttggacattactatgggaagaattgtggtcttctcaaaattcatgttgtgaacacctagctccccacataaattgtaagtttacgtggatatagggccttgaaagagataatttagttaaaatgaagtgattgggatgggccctaatccaatgactggtgtcatagatgaggatattaggacacagacacacacacagagaaggcagccatctacaagccaaaaagagaggtctcagaagaaaccaaccctactgataccttgatcttgaatttctagtttccagaattgtgagaaaaatgaatttctattgtttaatccacccagattgtgttgctttattatggcagccctagcaaacttgggagtcattgtcatacagagggtatttaaggatattaaactgggtgaggttacaaggagaatgactgcagataaagaatagaaggtatccaagaaacaagccctgcaaaatttcacttttagaggctggagataagaacaaaaatgtctcaacaaaagaaactgtgaaagagtgaccagtcaggaaattaacagattgaaatatcctggaaaccaagtcaagaaattgttttctatacaaaggagtaattaattaattgttttaaatgcccctgattgtgcaacaggttgaagattgtgaatttttaattatattcagaaatgtggagatcatcggtgacactatcaaggaaactttgatgaaataggagaggaagtaaaagtctaattaaaatagatttaaagtggagaatgagagatgtggaattgagactaatttatctttttgttttattatgtgcctagcacagaagtctcattgaatctatatattagatcttttaaaaataaatgtttttatctgatttccaaatctgcaaagctgaagcacagagccttcatggaagtgatcttttaaaataccttgagaagttccctgctgagtttctcagaaacctttcaaaacattagtcatgacatgcttttatagagaaatttacttgtagagtagcatccctatcaataatgtaatatcagaatgtgcttcaaattttgtttactataaagaagtaataacttctttaggtaattatttgctgtttttcatttgatactttaatggatttcctcagagcacaaataaattacattaaataatttcaactgaagaattggttatataaattagatttactagtaaatcctattaatatgcctttttatatcaagacataaaggcattgttttagagatacagactttcaagagaatgaaaacattatctaatgccatatggaacttttctgtaacctagtagctttaactacattaggttgtatctgttggttatttagtacattttaatagcaatctgaatagtgacattttggttaatgcaattttcagctgataacaagtgggtattctgtggtttatttttaaacttttttcttagacgttattaactcattattaaaaacactttattttgtaaataaacatagtacacatatatatttaggaggtacataagtgatattttgatatatacaatgtgcagtgaccaaatcagggcaatatgcatatctggcacctaaaatagtaatcatttctttgcgttgggaacattcaatatcctctcttctagctatctgaaaatatataataaattattgttaactatagtcagcctctagtgctatagaacactagaacttattcctcctatctaattgtaattttatattccttaacagatctatccctaccctatcctcagtcccactttctcagtctctagtaaacattagtctactgcttacttctgtgagagcaacatttttagcttctgcatatgagtgagaacgtggctttctcactttctgtttctagcttattttacttaacataatgatctccaggttcatccatgttgctgtgtatttcattcttccccacggctaaatagtattctattgtgcatatatgccatattgtctttatccattcatctgttgatggacgcaggttgattccatatcttagctattgtgagttgtgctgtaacaaacatgggagtgcagatatctcttcaatacactgatttccttttctttggatatacacccagtagtagaattgctggaccatatgatagttctagttgtaggtttttgaggaaattccatatcattctccataatggctgtaccagtttacattccctccaatagtatgtaagagttcctttttctccacattctcactaccattttgttgttgttgttgttgttttgttttgttttgtctttttggtaatagccattttaactggagtgagatgatatctcattgtggttttgtttgcatttccctgaatgaaatgttgttaggcatttaaaagataaatttgttgtccatttgtatgtcttcttttgagaaatgtcttctcagattgtttgttcatttttaactgaattatttgtgtgtttgtttgttttgctgttgagttgcttgtgtttcttgtatattctggatattaattccttgttggataaaaagtttgtaaatattttctcccgtccttaagttgtcttttcattctgttgattttttcttttggtgtgcagaaaccttttagtttgatacaatttcatttgtctataaaattaatacttaagagacgattgcaaactaaagacgtttctaatatttaagagcaaaaagaggctatatggtagatgttattaatgtatcttcacatttattcatacattaaacatgtttttgtaggttcctcttttgggccctatattatgctggctattgtaaataaataggctaagcaaacaggcatggtccctacctcacagaccgtgtaatctaatggacgagaagactaacaaataaccaaacaatacataattaaagtttgtgataagctctaccatagtgataatattaggagtataattcctaaggtcaaataataaaaatgtaattgctacttgggaaacattttatgagagaaactataaaaagacttcagtggtctatagaatgtaaaggaaaatactttagatggcacgatcaagaaaaatcagagatgataattaatttgagatatggatgataagaggaaaccctctaagcaaagagtggaagacagagtgctcctagcaaagtcttgagttaaaaaagagattagaagctgaaaaagaacaggagctctcactcactaagagtgagagctcagtggtttgaagtaaaattataaagacagggagaaagatcatcttttttggccttgtaggatttcatgctaatcccaatgggagaccttctaaaggttttaaacaaagaaaaataatgttttagaaaggtcactctgctttctgtgtgaaaaatgaatcagaaaagtacagtcaaggagactggctggaaggctccagaaatattctaaagtaagaaagggattgtgtggaagaaatggttgtagaagtaagtagtggactgagcaaatattggaaatagaattaaatggacttactgataaattagatataggagatgtggcagtacacttccataggaattacataatcttccactgaagaatccagtattttgtgtgcctctccaatgaactgaagagcagttctttgctcttctagaaatatgtctaaataaatgaaagcactatttatgatgttgatgcttgtttcccagttattatgtgctcacattcaaaattccttaaagcataaaaatagaattaaatatacaactgagaaataaggatacatcctattagtcaaaaaggaaaggaatgctgaataggaactctctataaaacacatatacatgcaaacaaaacacacccttttagaatgcaactcttaaaacatttttttttcactcacaagaaaaaatatattacctcaacttagagtttattgcgtaaatcattcatcatagtggcccaaatgaaagtcatggccttcttataagtagaatcactattaaaaatctcttcttgaatttcagatgtgccaaactagtttaaatatatttaaagcttatattcatgctgttgtattgtaaaaagaaagagtatttcttactgattactttggaatttcattctagctaagacagcatagttgaaaccaaagagaaagttttacttagtcaataaaactgcattttagcttatttttaaggacatttttcttcaattaaagattgaagagaataaattagtaattctctcgtttctctctctctttgaaagaaaatttaaaaaagcaccccttttcaagaaaatggtgtaggaaggcaaaatgaatataactggtaccgttcactttagttttgtctttaaatcgaattcttattcaaggagaaagatctttctggaaatctgagaaccaaatcagtacaatttattcaaacattatatgactcttttaaaataacgtaacccaatggagaatctacttttgtctttcttttcttttcctttcctttcctttcctttcctttccttctttatccttctttctttctttctctttcttttctttccctttcttcctttctttttctctctttctctctttctttccttccttccttccttccttccttccttccttccttcctttctctctctctctctctttctttctttctttctttctttctttctttctttctttctttctttctttctttctttcttctttctttctttctttcacagagtcttgctctgtcacctaggctggagtacaattgtgagatctcagctcactgcaacctccacctcttgggttcaagtgattctcctgcctcagccccctgagtagctgggattacaggcatgcaccatcatggctggctaatttttgtatttttagtagagacggggtttggccaggcttctctcaaactcctgacctcgtgatccgcccgcctcagcctcccaaagtgctggtattataggcgtgagccgctgcgcctggccctgtctttcctttaaaaatttgattttattgaaaatagttttaaatttattctcaactcattctccacaaaacttagactatatatagagcagttgatgacacagagattttaaaatggcagagaaataggtgtttattctaggaagtctggtgcacatttcaaaataccagaaataatttgtgagaaaagtaaagaaaatttattttaaaaaattgtttctgagtgcagaaaaaaatgttttcataaagacacacatcacagtggcattcttgttcaccattattttaactttcctaaataaaaaacagaacaatgtatttttaaaaaagtgccagagcagcagaggatttgaaataacagattagatattatttcatttaatacattttttaaaggcagctaattcttttgcccagttggggagatgggagaatgggggggcaaggtggagtgagggtagaggttaagagggaggggccttaaccttaaatatggaagaaagggaaacaggattttttttttacatcaaacttctctgaaagtgtagtttcaaacgtagacatcatcattactccagaaggtcatggaaaggcaaagcatagttgagctaaactagctgtgatctccaataagactaccaatattgtgtaaataacacctagttgacaatgagttggaagatcagtatcatgagtagatgtcaatcataggtcaggttaggatatccagagaggttatggtttagtcatcatcgaagcatactaggtacacagtcccaagctctacagggtttccaaagcatttaggtaaagagcgagaccagcctaggagcaagcccatctcaattcaatgtgattaactcttatagtagctctgttccccagtaacagaggtcaaattcttatctttcgttgtcccaaacagcaggagctgcagcaactgcttaacacttgttagaaatacaaactcttggatcccagcccagacctaaatcagaaactctggggcttagggcccaggagtctgtgttttaacaaatcctccaggtgattgtgatgcaagctaaagtttgagaaacacacaagaagagttttcgaccttaacagccttaaaaaaaatactgattcgtgaatcccaacctcagagtttttaattattcttaggtgcagcctgggcattgcaatttttaaaatctcttgaaaggtttctagtgttcaacaggatggacaatcattgacaaaagcaagatttgagtccccaaaggggcatgtcacttcaatggggctggccttctaggtcattgtaagcaagtctttctttacccatatagcccacacaatcccagttttcaccctcactttgaaaacataatattgctacaaaaactgtgcagaatgaaactctgaaatactgtgtaatttcttacagacccaaaaaaggaaggtggcagcaaatgtcacaggttcctcaaaactctttctgagtaagggtttcctcttctccttttttcttttcgcagagaatgtgactcattcctgtctattcttggtgtccacatttaagttcattaataggttctctcacatggtggctttgtgactttgtggactttagggagtcacttttcagtcatattctattatatatctaggaaatctggcactagataaaatgattcatccttctaattttttacttaaaatattaaattacactatagtctgtggtgttctgtgacacccatttcctctcagcggtgactgtgactgtcagcttttacatcccttatctttgttcatagtgtcctatatatctacagaaagaatataaatttatatatatatatgcttttaaattgtcacagttctacttctaatgcttcattcagttgatgaaaattaccaggttttattgatcattttcatgatgaatgactcagccatttgtacagatgctttgtttcaaaaatacttgtggaaatgacattttgagataatgggatggcaagcagatattcagaaatataatgggtcatgtgtatatatagcagtggcttctctggaccttccagtggatgttttgagacaagataaataatcctttgtcacttggatcattagttcccttaaaaaaatcagctcccttaaaaaaaaagtacagtttagcggctggggagtatagattgtggagccaaacggtatgagtgaagtgtgaagcccagctctgttgtctactacatctagtctactacatacagtgtgatctcagataagctatttaatcatttaatgcctctattttacatctttaaactgggaatgaaaattatatattctcagttatgaaagtcttatggattaagccagttaacatatgtaaagcacttagaacaaggcttttcacatattaagatctcaatacatcttattgtgtgtgtaaagatcttgctattctcacattcagattcacgaatctaagttttgaaaagttgtattcactgaatagtatgagacaaaacatgaactcaaattagattgcaatcatctttatatcttggagaagattttaaacaaatgtgataaaactccttgcttttcactgttgtatcaaagctcagctgatttgttcctgtggagaccagtcactgggattcctccatgccctccactaaatcccataaagatgtgatgctcccacaaggcagcaagaaaggagagggcaaacaaaagtatacagttttgcttcagatttttacagttttgcctcagattttaagtgctggttatggacagtgtcattactagagtagaaatttaaataacagtaataattgagaatcacctgtccaacaagaacaaaaattcatggttgaaattacatcgaaagcatcaagcccatctaattatatggagtgctgaaaataatgaaaacacatttcttgcatggcttatagctcataaagcattctttttataataatgcattttatttgtaaaatgtattatgctttacaaattgtttttaaatgttatttcatttcagtcacccaacagcaatgtgaaggtaaaaataaatgtcttatacacagagcaaaggacaataccagaactagacatcataccctctgagttctagccaccttttcaacagagtgcattcatgtcatcaattctggtgctccataaaaccttaattctacacatatgtagaaatttttggataaccagtcaacattaacattagtagttttatattacacagcatatgccttttaatcatttataatttgctattaaatagtatatacaaaatactctgatggtctgaactattctactagaacatcgggaagataatttgtattgtacaaagggttttttttaaagtttttgtttctaacattttttgaagtatcgtcagtagttacatacgttttgtgggagaaaagcattgctcttagaaggaaaagcattggaaagttactgaggataatggaaaacaattgactacacacttccttccagagtaactacaataagtcaattatactgaatatatatatatatatatatattcatatatttatatatataggataaaatgtatgtgtgtatatatatatatctttagatatttcttacatattcaaatatggtacttattgcttctgtatacacttttaaaagaaggaatcttaaaacaactgctatttgggttttcagttaattttgtattggcttactaattaaataactatagcatttgaagagagagacagagtatggaaaagtgatgttttcttcataagtatgttgtgggaaaagccaaagaaacataagaagaagaccatgtaaaagattaggaacatgtaccatatcaagctatttttgtgactgactgattgggacaaaagaatcagatcacatccatgtgggtatgggaggacagagctgcctttaggagaacaaacattttcactttcagttctactgggaagaggttatttgtgaggaaggattaaatggacagaatttaaactatgaatgtcaagtaaagaagtcggagaaaaaacttagtgtctttgagcagagtattgtccagttattattattattattattattattattattttgagacagagtcttgctctgtcatccaggctggagtgcaatggcgcaatctcagctcactgcaacctctacctcccgggttcaagcaattctcctgcctcagcctcccaagtagctgggattacaggcacccaccaccacactcggctaattttatttgtcttatttagtagagacgaggttttgccatgttggccagcctggtcttgaactcctgacctcaggtgatccacctgcctcggcctcccaaagtgctgggattacaggcgtgagccaccacacccagcctgtccagttattattaataggagtagagagacctaatgtcactggggatggtggtgaatttctcctagctatttagaaaggctgggttactaacaagggtttgttcaggtaaggggggctgtggatgtttgggcactagtcaagtagtatggatggtcaccagtaggagagagctttgaccaacagaaacaaaattaccagcatggcagaaaaatgtggaaatgggaccaaaacaccaaaggtcttatttgtaggctcaggaaagaaaagtccctggaaaacactcagagttagcttaagcacattttgatgaggactacattttgttactaggatatttcactggtaatttggctatattttaaataaatgagacctttgttttcacgtttgtagaactgtgccaaagggattttagatgttagagtcacgcttcccaaaagaagcaaggtaacaactcctctcggtttcagtgagctttgtaagtctagcagggcaaatgacatcttttaaattagctttcttagaatacagggctccagttgtacataaccattttatccttttgaaatgattagcaaaaaatatagcatgtatgctcctcttcaacttacgtttagtgttgttgtgtattcactgtaataaacaaaagaatattagaggtgagaattcaaggcctagataattaagttacttgttcagagtttaaaattagttaaactatttttttttttttttttttttttgagacgagtctcactctgtcatccaggctggagtgtagcagtgtgatctgggctcactgaaacctctaccttttgggttcaagcaattctcctgcctcagcctcccaagtagctgagattataggcatgcaccaccaggccaggctaatttttttatttttagtagagatggggttttaccatgttggacaggctggtgtcaaactcctgacctcaagtgatctgcccaccttagcctcccaaagtgctgggattacaggtgtgagccaccacgcctggccaaaaaacactctatcttagaaaaaagtggtataaagaattggttatttaattttgtgactcttcactaacatgaaataattctaaataagtcactaggacattttgtcattattgaaatagataatcactgcaatttacaagattttcctgctggacatgtttgaacagagaagaaaatatatcttcaaaataagtcttagttttattttttgtaggcttaaattagggagaagggagcgagtaacctgtaccattattaactgggacaggcagggagatgcctagattgacttttggactgatgtagcctagaattcttctaggggtttctcacacacactggggtatctctggatgattgaatcctttctatactttatagggtattctcaggcaatctaggtcaaatcgaatatctgaagcataacacaaattcttaaaggaaattcaaccgcaatctaatcagattcctggtcttcatttcctaataccatccccttgaagactaaaatgctagaaaaacctgatatatactaatctttcttacttctctgcctccttacctccctccctgcctttttttgcttctttccttccttcccctctctgccttctaccctcctttttgtccttctacaagactttatttattgagtagccacagtgtccttagattgctctggacagattcaactaaataaattacataatgtgtgtcaccaagatgcctgaattgccatactaaatgacaatatttcaacacgaaatatatcaaaagaaagtatgtattaaaataacaaatgagtggcatgtaaagttttctctaaagtctgccactttctctgcatccatgctgtcaaccttaatttataatagtatcttcggtaacatgaactacttcaaatagtcttttaaccattttctctacctcaaggttgaattcttatcaaataattttctatccttctattagatggctttaaaaatacttaaataatagtggttagagtttattctgcatttacttggtaccaggtaagttatcttaaaaaactctaagatggagtactattgtcattttctttttcagacacagcctgacacgtggagaagttaaacatttggccaaattcaccctaaaactagggaagctggggagcaagcctaggttgcctgactcaggggcctttactttaactgatctctacagtgcttcaaatttaattttaagttctactgcttcaaacaaaagcagcccgatttacagaatggttcccattgcctgttgtttcaaagcccaaatccttttcatggctcacaattaactgacatctgatttatccctggtttacacactctggtccctgctttactcccaggtctcatcttatttctctctcattccaattccatgaactaaatgcagatctgaaatgttagcttctgcctgggagcttttgagaatactgtttgctctaacattcttatccatatttcacaatggctaacaattactcattatttagggcttgtttagagcattggatttttctctctagggtctcccctcttactggagtgcattttctgccctaagtttagcaaagtcctcctgtagcaccacagtgttctgagtctgcactgtcatacaactcaagttagcttatttgttattaaggtcaatgtccatcattaacaccagatttttggttctatgggcatccaaagagaattaggaactaaccctaaaggagattgcaactatatagataacaaaaaataaaattttgtactaagtgatttatcaaatttttcagaaaaatactgtgacattaaatatgcctatgaatgggtaagactcattccaatttcagaaaaattaaaatgtgaaaaaatacattttagattttaaaaatatggagttataaatagttgccaaatgttcaggacactttctgaaagtttttttttttttttaatcttttaattgtgatagtagccacaaccataatgacaaagatgcaggcttagatatttaggaggtaaatagatatttcagaggtaaaaaaatcaagcccaaacttccatatatgtggtatacatttttctacaaatgtgtactgctattaacatcctgttctaagttagttatctattttcttttttaaaaagagtgataaataagatataaaaatatagatgcctgagaatgttgctgatattagtaacctctagcattggagttttacgaagtgcacagaggaaaggagatgaagcttcaagttcaggacagacataaggcgtatttagaaaaaaaaggagcagaaaataatatgcccacgataatcgatacttcagcgttgtggcttctgctgtgacttaaatagatagatacatacatacatacacatttacccttgaaaagtaaaaccaaatcttggcttcacatgggttagggttcactttatatgtcacacacattgtaggagagcctaagctgaaatatgaacctaagattgtccaggattggtagagtcctggggttccaaggattggttccaggactcttgtggataccaaaattcttagaagtccctcatatgaaatgatgttgcatttgtatataacctgcacatatctcccatatatttcaaaatcttctttagattacctataatacccaatacaatgcaaatgctatcaacatcgttgttatactataattttatttgtatctttattgttgtattgttatttttattaattttctttgaatatttttagtctactgttagtatcatccatggatgtagaacctgtggatgtgaaggtctgactgtgttagtttgctagggtcgctgtgacagaataccacaaactgtgtggctttaactcattttctcactctctgaaggctggaagtccgagactaaagtgttagcatgtgtgcgtcctcctgagatatgttttcttggcttgtagacagctgtcttcttgctgtgtcctcacatggcctagagaatacatgtacaaacccttagcgtatctttctcttcttatagaagcaccagtcgtatcatattaggaccctacccatatgacctcatttaatcttaattgcatctttgaagtccttcttttcaaagatagtcacactggggattagggattcaataaatacatttagaggggacacaattcgcttcacaataaaatacatataattcttctttgaaataaagtaacttcagcacaggccttaaaaatatccatgaatttacatcaggcagttgaataaactctccaataaaaagagctacaaaacacctaaggaaacaaaccgagtgagtatgagcagaaacaatagatgtcaaaatagctatcctaaggattttacagatgagaagataggatatatttagaatatataaaaaaaagtttagtcaaaataggtaaactttaaaaggaatgaaaatagcaaagaacaagtgagtataagcaaaatagacttttttttttagtttacatgataatttcaaacttctaaaaattataaagacaaaaataatataaggaatatctctataatattttcctagatttgtctattaatattttatactatcttgcatatacaaatgtagctcgatgatgttacatctcaataaacccatcataagtcaaaaatattgtaaatcaaaatgcatttaatactctgataaacccattgtacattgaaaaaaaaagtgaattgaaccatcataagcctagatgctccttgatctatgatggggttttatcgacttttctgagttcaattgataaactcatagtaaagttgaaaaatcataagtcaaaaccatcttaagttgggaaccatttgcatgtgtatatatcacgaaaataaataaatcatatatatatgacaagtgagggaaacacaatatatgtttccataatgattaaaaattgctagtattttttaacccatgaatctttagattctaaagcttaaagaattttaaaaaggataagtgaaatttgttggtaggaattttagtgaaagttcaggccaccaaaaaacttgaaagctgaatgagtagaactatcatcaacaacaacaaaaaaaccctgacaatttgaattgcaggggattcctcaacatcaaccatgaaaatcagaagacagtagaacaacttcctttgaattcagagggaaaataattgctaatctataactttgttcccagataaacatccatttagaatgagggcaaataaaaacattttcagatgaaagaaacaacgataattaaaacaaaaatctttccagagatattcctactaacagtactttactataggcacttgtaaagaatacaattaagaatggaagaaaataatcccagaaggaggacctgaagtatgagaagtaggtggtaaaatgttgacaaacatgagtttaaacctaaataaatattgacggtaaaaaaagaaccatttgtagataataaaaagcaaggcagaactaaaatactgtatagcagctttatgagatggaaaaggactcctgtaatgactggaataatgaaagaggtatgaaagaagagaccaagggctacaataaaaatgaaacagtggacaataccaaatgtgaatataaatgcatatagatacaaattatagattactaccaaattatattaatgcagtttaaaggtggaaaaacatgatctcccaaaggatgcagaaaaaaaaaaatcattcagccaaattcagccctcatttgtgaaatatatatatatatatatatatatacatatatatatatatatattttttttttttttttttttttgagactgaatcacgctctttcgcccaggctggagtgcagtggtgctatctcggctcactgcaagctccgcctcccgggttcacgccattttcctgcctcagcctccccggtagctgggactacaggctcccgccaccgcgcccagctaattttttgtatttttagtagagacggggtttcaccgagttagccaggatggtctcgatgtcctgaccttgtgatccacccgcctcggcctcccaaagtgttgggattacaggcgtgagccaccgcgcccggccgtgaactatatttttaaaatcgatatataataattgtacatatttatgggatgacgtgatattttgatacctgcataaaatgtgtaataatcaaatctgagtatccatcacttcaaatatttatcatttctttttgttgtgaacatttcaactttcctagctattttgaaatataaaataaattattaactatagtcaccttactgtgttatcaaacactagagcttatttcgtctatttaattgtatgtttgtacccattaaccaacctctcttcaccttcctcccatcatggttcatagcctctggtaaccatcattctcctctctacctccttgagatcaacttcttaagcttccacatatgagtgagaacatgtgatattgtttttttgtgcctgccttatttcactaacctgacctccagttccaaccgtgttgctgcaaatgacagaatttcattgtttatggttgaatagcattccattaagtatagataccacattttctttatccattcatccattgatggacacttaggttgatactatatcttagctattgtgaacaatgctgcaataatcatgggtattcttttgatatactgatttccttttcagtaaatacctagtagagggattgctggatcatatgatagttctgtttttagcatttggaaaatattcatactctttttcattatgggtgtactgatttacattctctctaacagtgtaccagagttccctctccccatatccttaccagcatctgttattttttgtctttttgataatagccattctaactggggtgagatggcatcttgtggttttgatttgtatttctctgatgattagtgatgtgaagcattttttatatacctgttggtcatttgtacatcttcttttgagaaatgtctattcttgatctgttgttgaatttagtttgctggtattgtattgagtacttttgcatcaatgttcaccagggatattaatatgtagtttttggttgtgtccttgtcatagtttggatatcaggataatgctgaccttgcagaatgagttaagaagattccctcctcttcaattttttctttctttctttctttctttctttctttctttctttctttctttctttctttctttctttctttctttcctttctttctgcctgtctttctttctttctgtctttctttctttttctttctttcttttttctttctttccctctttctttctttctttctctttccttctttctttctttctctctttcttttttttttttaatagtttgagaagcattagtgctagttctttaaaaatttggtagaattcagcagcaaagccatctggtcctgggcttttcttttgtggaagacgttttattactgatgccatcttcttacttgttattggtctgtttaagttttctacttcttcctgattcaatcttggcaggatttatgtgtccaggaatttattcattttctccaaattttctaatttgtcaattatagctgttcatagtagtctctaatgatgttttgtatcctgtggtatcagttgtaatatctcctttttaatttctgattgtatttatttgggtctctctttttttttgtccttttctagtctaactagtggtttattgattttgcttttctttttaaaaaaccaaccttttgttttactgatgctttgtattgttaagtctctattttgtttaattatgctttaatctttattatttgtctctgagtaatttggggtttggtttgttgtatttctagttccttgaggtgcatcattaggttgtttatttaacatctttctaattttttttatgtagctgtttattgctataaattttcctctcagcactgcttttgctgtattccataggttttggtatgttgtatttcgatttttatttgtttcaataaatttttaaattttcttcttaatttattttttgagttaatgattgtgctgtaagcttggatgtttgtccctaccaaaaatcatgttgaaatatgattcccaatgttggaagcaggcctaataaaaggcatttgggtcattgagtggattcctcatgaatagattaatgccctcccttgggggttgagtgaaggattagttctcattctgttagttcctgtgatagctggttgttaaaaagatcttggtgcctccctctcaccctcttgcttcctgatttgtcatgtgatctctgcacatgctggctcctcttcactttctgcaatgggtgaaagtagcctgaggccctcagtagacatagatacctaatcttgaacttttacaaacatcagaaacatgagccaagtaaatctttttttcttacaaattatccaatctcagatattcctttatagcaacacaaaatagactaagatagttgttcaggagtatgttgtttaatttccacgtatttgtacagtttccaaagtttcttctcttactgatttctagttcttttttcactgtgatctgagagatactggatatgatttaaatttttaaatatgtgttaaaatttgttaagacttgttttgtggccagcatatggtctatcttggaaaatgttccatgtgctaatgagaagaatgtgtatttggtagttgttggatgaaatgctctgtaagtgtctgttaggtccatttggtctaaaatacagtttaaatccaatgtttctttgttaattttctgtcggaataatctgtcctgtgttaagaatgtggtgctgaaatccccaactattatcgtattggagtctctctctcccttcagatataatattagctttatatatatgggtgctctgttgttaggtgcatatatatttagaattcttatatccctttgctgaattgattcatttatcattatataatgactttatttgtctctttttacgcttggtgatttgtctgttttttctgatataagtatagctactcctgctcactttgggtttccatttgtgtggaatgttttatccatcccttcactttcaagtctatatgcgtctttagagatgaagtgagttattgtagacagcacagagttgaattatggtttttatcctttaattcagtttataccttttagatgggggattcaatctatttaccttcaaggttacagttgataagtgaggacttattcctgacattttgttaattgttttctatctattttgtatatcctttcttttttttactttctctcttattgtgagtatattttctgtagtggtaacatttgactcttttctctttttcatttgtgtcttttctctgccagtgagttttatactttcttgttttttcctgatggtagatattattctttcgcttccagatataggtctccttcaagaatttcttgtaaagccagtctaatggtaatgaattccttccatttttattatttgtttggaaaagactttatttctctttcatttttgaaggacaacattacttggtatagtattcttgactagcaattttttttcagcactttgaatatatcatctcgtcctctctagacctataaagtttttactgagaaatccagtgttagtatgatagagattcccttatatgtgacttgaatcttttctcttgctgttttaaaaattctttctttgtctttgacttttggaagtttgacttctgtgccttggagaaggtgttttcaagttgaatctatttggggacatttgagtttcctgtatctgaatgtcttccaagacttgggaagttttcagctccaattttattaaatagattttctatgctttaaattatctcttctccttctggaaatctccgaattcaaaaatttgggtgctttatggcaccctatatgttgtataggctttctgcatcctttttttttcttttctttttggtcttactgggttatttcaaaatgcctgtcatgaagtttagaaagcctttctgcttgatctagtctattgttgaagcactcaattgcatttttattttatttattgaattatataattccaggatttctgggttttcattttttaaaaaataacttctgttaaatttctcattcatatcataaattagttttctgatttatttgcattttttatctgtgttctcttgtatctcactgagtttctttaatattattattttgatttatttttcagacatttcataactttcctttttggaggaaatttgttactggtgaattattgtgttcttttggaagtgttatgtttccttgctttttcatatttttggtgtccttctgtagatatttgtgcatctagtgtaacagttgcttttctcattgtttatggattggctttcttaggaaaatttttttttctatagatggatttatagtgttggttgggtaaggtgctttggctttgattctgtgtggaggcaatagtgtagtatccatatgatttcttcagctgtaatcagcatgagtggtgtctgtgagttcctcagtggcttgcactgcacttgttagaggaggccgttgttaggctttgctggggatgggaatgccaggcaggctggcaattgggcaccagtggtagcagtggtgagcaggaaggcctgtcctcaggcccccagatggcatgtgcagatgcttatagtggtaggtgaggtggatcaatcaccaggctcccaaatgttctgttcagatgccagtgacagtgggtgaggtaggcctgttctcaggctcctgaatggtttgtataggcactagcagtagtggacagaatgggtgaatctttgtgtccccagatgctgtgtgtgaaagctggtggcagcatcagccggtagtatgggcttgcctcaggccctgatgttgtgtggaggcacaggctgtggcaggtgggtaggattgattcccagacctacaaacaatatggttgggcacaggaagcagtgggtgaggtagacttgtcctcaggccccagatgttaagcacaggtgctggcagtgatgacagtggacatggcaaccctgtcctcagacaccctgagggtgtatgttaatggcagtggcagcaagtggggtgagtcaattcctaggcccccataagatttgtgtaggtgccagcaggtggagtcgcctctcttcagtgtgctatgggtaccagtgtcagtgggttgatgtccaggcccccagatggcatatttgtgttcagaaagtagtggtcatggcaagcttgtcctcaggatctggatgaaatttgtaggcctggcaatgtcagctgtgggcagggtgggcttgtcatcaggaccctggatggtgcatgcaggcacaggttattgcagatggagtaagtagattcccagggccctggacaacatatgcagagactgatggtagcaagtggggcaggcctatcctcgggcctccaaacggtgtgcgtggaagcccacagtggcaggtgaggcaggttgatctccattgcccccagatgacatgtaccagatgacatggcaccagtggtagcaagggcagacctctcctcagtaactcagctctgtaaagcattttcctcattccctgccctgctttcatgctcagggccagaatctgccaaggaggtgcatgcaaatcatgacaccaggagctgccatggggattgaccatgttgctgtggtgtgcgcccacctgctctggccagtgcagccaggatatccgagtcatccagtgcttcacactaagagtcaaagatctggccgggcacagaagctcatgcctgtaatgccagcattttgggaggctgaggcgggaggattgcctgagctcaggagttcgcgaccagcctgggcaacatggtgaaaccccatctctactaaaataataataataaaaaaattatctggatatggtggagtgtacctgtaatcccagctgcttgggaggctgaggcaggagaactgcttgaacctgggaggcagaggttgcagtgagcagagatcatgccactgcactctggcctgggttacagtgagactccgtcttaaaaaaaaaaaaaaaaaaagagcgaaagagttccttttttttagtaaactaaaacatatgaattaaatatttacttcccaaaatcataggtttttgaaatcctaactcccagtatctcagaatgtgaacctaatttggaaagaaagttattgcagatgtaattataaaagttcagatgagatcctactggagaagggtaggtccttaatgcaatataacagatgtccttataagaagaggagaagaaacacagaaacagagacacacagagagaaaacagtcatatgacgattgaggcagggattggaatgatgtacctacaagccaaggaatcctaaggattgctgagaaacatcagcagctaaaagaggcaagggaatattctctcctacaggtttcattgaaagcatgtgcctgccaaaacctttatttcagactcttagccgctggagctgtgagataatacatttttgttattttaagccacttaatttgtggtacttcgttatagcagccatagaaaaacagtgcaccaagaatataaatatttaaattaacctgataaattgtatgtgccaaaacctataaaacaatatacttaatgctgacatgatacagtcatttattttatgataaaactgcatttttccccttacaccatgcaaaaaactcaaatccaagtagataaagccactaatgcaaaaagaacaccttccaaattcttagaagagtaacttgaaaatatatttaagacccccctttaatggtgtaggaatagatttatatttttaaaggcaaacaccataaagaaaatatagttatgtaaagacatatcaattataacttttcatagctgcatgatttgcaatagcctccaactagaaataggacaaggaataattggactgtggtatttttatgcaatacaatattatacagtcatgaaaatgcatgaactaataatatgctacccttattaatgtggaggaatttataagtataatctcaaaagtaaacataatttgcaaaagaatgcagagtatatagtttatatagatgttttgaaacatttgaaataatagtatatattactttataacttatactacaaatttatgtagaaaaatgcataagtaaatgatggtaatggtaaattcatctctagtagtgggagtagggctatggccagatgaaatctaagggagtttcctctataatgcctgattttgtgtttattatacttttcaggttcttctttgtgttataatgattttaaacaatgacacatctacagtccaggttgattacttctgacctacctgaaattttagtaatttcacagaatgtttgtatatccttgaaggagatattttcttggtacctctcaatttttttctcctttcttctattcaacaaatagttattgagtctctattatgtgttggatctagtattaggtacttagatttttcccccaaaagaaatagaaatttattatagatcattattctaattcctcccaggtctaataatgtttgatccatttggctcaaatttgggatgactcccttttttcacagagatctctctggaatagcctctctgagggcactagacggtagatggatacctcccactttagctccttccttttgcctataggtcaccagctgaaagctttcctagctgctatgtttctaaaacatggctttgttttatatccctctgaaatgagtccttacttttatttatctctctgaacagaaaaacaaataactcctttattaaaaacttttctcttctttttaaattgccctaaacctgacagacatggaaatatacacatggttcattgctgaggacttttacatgttcaggtaaagcttttgcacctatagccactactacaggctgagtgctaatcattttccaattcctacctgctcaaaatatgttttattgtaaatatttctaatttccaggaaatctgataagtagcattcatgcttttcatatttgcttttttaaaaaatgtggcttccttgtcccattgtgaaaagctaaaatgacttgaggaaattcattactttttttgtacattcttacttagctatttcctcacatgacatttgtcttgaaatcctcccacataccctttcagaaccttgctaagaaggagttgtcattcattggtcatgcagaaaggttatttgaggcaaaatacatttgtaatttaggaaagttatctaaaatatattactttttgagatttttctatattgaagtcacaaaacagtggttctgctcagtctaccataggaatagatataggacattatatttaaccttccaaatgtatttttccagtgtttttgcctgccattgcaagcatcagatgactggacagggcaccatataatgacatcatggagctgtcagtctttttatcgccatctgaggcaggcttcctggaccttggattaagtgtgctgctcttgtgaggaggaagaatgacaccaaacagtggctgtataaacagctagagcggaataatccaaagagggtcggtcaaactcatgctatatacaagcactgaagatcagcttaatgaactactgttgaattagagttatggaaactgtgttgtcataagggaaacagagatggaagactagacctgagtgtttgtagaaacatttcagggggtaaattttaaaatcacagagaatataactgcagtggaagaccacaagttgtgtcaaacgctaagtgttgtgttaaaagctaagtaaagggatctgagacaaataatgtggaaagagtctgtaagacttcattgtaaaaaaaaaaatcaaactcattcagcacctgtagataggggtgtatgtgtgtgtgtgtgtgtgtgtgtgtgtgtgtgtgtgtgtgtgtgtgtgtaggaggtataattgagccctgttccaaaaggtagtttgtgcagtgattatactcaaggtcaaaatcattcatcaaagacaaatgcatagtcatttaatttaacaaggacttaagattactcacaggctttttagctacattggtacttgtaatgtttgattcaaaccacatttgaagaggttacagtcatggctttttggctgaatgctgcaggtcagcccaagaaaaataggcaagctaaagcactgggcaaggaaaagggcccaatggaaagcaacagctaatattctagacttggcagcagtcaggaggacaggtggcaaaaatctttcatgctgaaaaccagtctgaaaggtgacattgaacatgggcaatagagaaaggtttaacagtctgattcctcaatttagaaatgctactgagaacacaatgttccatagaacaaggatcaaaattctcagctaaagacactttgtatgtagaaagaaaaagggcattgctataaatatcagatgctttattgcatggcatgccaaagggaagataacgaaagcagtatcatattctctaacagtgaaaatgaatctggggtgaatacttctaccagaatcacagaagtgtggatgttaaaacataaatgtgggatctttagcattttacaagtatagttgcctttaaaattcagacaaattgtgtagtactgataacataaatgtataatatagggataaaatgttcagattttaggacaatattagagaccttcttccaggtttcatgcaggtgattaaactgcccaaggactttgaaaagatacataagaaagctaaagagaaagggtgagaactggcagcagttatctaaaggaggatgtagagaaggaagatgacaaaaaattgaaggtactgaagtaaacagccaacccatgtagtatttgatgtagaaaactactgaaatgtagactcatgggttgtacaggctggagaaaggtaagaagaagaaatgagactactgtatcgccagagctgtaagtatccacgccaaaaccccagactggctaccctcagtgccagaagaggcaggaacaggatttcggatcagtattcaaatgctgcagatagctaccaagtgatgtaacttttgccatcagtgtggctcttttttatgcctggatattatttaatttccctgtaacttgggaatatttaggatttcatacacttctttttccttcttccatcattggcactcgttattttgccccgatcctttatgataagcacttgggtttctgagtgaaatatactgatattctgaaacctgtttttttgttttatttatttattttttgttttgttttgttttggtctgtgatatttcagcagcttacatttcttcaagggaactttagatttctgaaatttctgctccaagattttgcctttattcaattatttttactgcatacatttaaggtgcacgacatgatgttttgatatacttatcctgatatacatacacataatgaagtgatcactacaggcaaacaaattaacatatctatcatcatataattacttttttgtggccagtgtatctaaaacctactcttttggaaaattgtcagtatataatgcaatatttttaactatagtcctcaaattgtacattagatctctaaatatattcatcctacataactgcaagtttgtattctttgacctgtattttcccatttctcccttgctccaacccacccccgttaaccaccattctattctctgtttctatgtcttcaattattttttaagattccacatattagcaagaacatgaattattttttttctgtctttggcttattttacttagcataatatcctctaggttcatccatgttgttacaagtggcaaggtcctcttttttaaggctgaataatattcaattgtatatacataaatttttaattcattaatctgtcaacagatacttcagttgttttcagatcttgactattgtgaataattgctgtaactaatatggaaaagcaaatatctttactaggcggtgcctttactcctttgagtatatacctagaagaggaattactgggtcatatggtagtttcatgtttaatttctttaggatttccatacttttttccataatagttgcacaaattgaattccccaccaacagtgtacaagggtttcttttccttgatgccctcaccaacacttgttatttcttgtcttttcgataaaagccatcctgacaggtgtgagatgatatcttgttgtggtttttatttgcgtttctctaatgatagtgatgttgagcacatttttatataatacctgttgctcatttctatgtcttctttggaaaaatgtctattcaggtcctctgctcatttttaatgaggttattgttatagttattcctattatatgctattgagctgtgtgagttctttacatattcttatgttaaccccttatcagatatatggttcacaaatatttgtttcccaacacaagccatttcattttgtttagtgtttcatttgccctggagaagctttttctttctttctttctttcttttttttttgatgtagtcctatttgtttatttttgcttttcttacctgtgcttttggtgtcatatctgaaaaatcattgcccagaccaatgtcaagaagcttttctcttatgctatttttctttcagaagatacagtttcagatctaatgttgaagtctttaacacatttccagttgattttttaaaagataagggttcaattttattcttttgctgtggatatccattttttcctatgccatttattgaaaagactatcctttctccatagcatcttcttgctgcccttgtttaaaattaatggactgtacatacctgggtttatttctgacctctctattttgtttcattgacctacatgtctctttttatggcagtgccacactgttttgattactattgctttgtagtagagtttgaaattaggtactatgatgcctccagctttgctcttttcattcagggttgctttggctagtcagagtcttttgtggttctgtatgtagtgaattttaagattgtcttttctattactgtgaaaaatgtcattgaaattttggtagagactgcattgaatctgttggtcactttgggtagaatgaacattttaacaatattgaaatgtcttccaatccatgaacacgggatatctttctgcttacttgtgacttcaatattttcatcaatgttttatagttttctgtgtacatatattttatctctatggttaaatttattcctaaatattttattttattttattttattttattttatttttggaatagcattcctatacactaaaaataaactatctaaaaaagaaatcaagacattgctttttaaagggcctgaagggcaacccagtgccttctctggactggactcctggagtcttcttggcattccttcccttctccacgttccaatgagcacaccacagtctcttcttagactaagtgcaggacccagactcttggacttttttcagaacttctgttctattcctatttgtcttttctccagctgcctctcaaccctccatctgtactgccatctgctggttacgaacagccttgttctttaacagctttgttttggatctagttaatatcaagaaataaccacggtaataataaacagtaaaagatgatatatatttaaaaattattgtggacaaaacaaaaatttttttatatcatggaactttaacaataaaataaataaaaatgcatttgatattagatagagataactgctaacaagaacaaaataaaaaagagaaaggagtataaaatgtcttggaggttaaaatttgtgatggggtatgtagggaagatctctttaagaaagtgacttttgaataaacatttgaggaagtgaggagccagccatgtggctaccttgtgaaagaccattctagacaaagaagagcaggaacaaaggccctgaggtgacagcaagcctggcatgttcaagacacaacagaggagaaggcattgtagatggagaaggagtggtaaaggttgtgagtggtaagagaagttttcagagaggtcattagaaccagtgcatgtagggctcttgtggtcattgtagacattttgcatttgattctaaagcagggttctggacaaaagaaagatatgacctgtttcattttttaacagtactactctagttgctttatggataatatattgtgtcttagagatgtcaacagatttacttaaccttctgagacttaaagcctaggtgcctaaccaaaaatatatctaaactagtcaaattggtaacaaaagtggtttaacccagagccagtgagtaagacttaccgactttatagaataatcatgcttcttaaagcatcacaagaagattgaaaatgcaacctaaacctaggagggtaaagtagaatgcacaagccagggaagccttacctgaaatgcctctacggcagcagttctcaaatttcttgatttggagacttcccggaacttcttattctttaaaattattgaagaccccaaagactctatgattatgtgggttaaatacattggtatttaccataatgaaaattattaataaattaagatactttaaaaatagttatatgtttgttcactcaggaaagacaataataaatccattatgtttacataaataacataactttttgagcagtaactatatttcccaaataaaaacttgagtgggaagagtggcatcattttacatttatgtaaatctccttgacacctggcttaatacataacagttgattttttctaatctgcttcaccatttcttcttttaagaaaacacacaccatgtagcttgtggaaaactacactgtataataaagaaagtttgagagcaaaaaacacagataacaccttttttgattattaaaatatttttgacctgtggatttcctgaaaaacaggtctctgaactacactttaatttttacactcctgtaaaaaaagacaagttgttatatgtataaggatctactttgctccttaaaacctatgccagtgtctcagtaatagaggtaagatgaattattataaatcagaataaagcataatgaatatagtaaaattgtgcttggaaaaatatcctaaccacgtgagatttgcacacctaaattgtcttatattgtttaatttggcacattctttgtttttcaagttttattatttttattaggaaatacaaagaatattaagttatttgcgggggttggggcacaatctttgtcttgaagtataacattttggcaagagatagggtgagaaaagaaaaattctaaggaagtaaaatgatttgggtaaagaccaattccctgtgagtaataattggtgaaagatacttttttcctatttttcttcatgacttgggacagagttttagccatgagggcagtatttattataattcagtggacatgatgaggtctccaaaagtacttaaactagacctctagattcaatttaaagtcgtattctaatatctcaaactaaaaagaaaattgtgacttttaattctacttctttgaatttctgaggcaaatttcaacaaagattcaatcatatttttaaattaattcaatcttactttaaaaacagtaacgtttgatacaaataaatatacaataaggaaaaatctctacttcaggaaaaaaatctatcagctactgttttatagtgatcttaatttcttttagcacattcagtggcagaaattattttatttgattgtgttttctttagaaaaatatccttttattagttcttgaactattactagctttcacaacacaaaatttaaaaggattaactttctaatttgtcaaaattataataataacccatatttaaaagataatcagaaaaaaacttaagatttggacattgtatttttaatttttatattacatggtagttatatcatgtagtgacttcattaacagagaacttagttcaatagttattttcattttatgttaattcctcaattatttggttttatattatgtaggacatataaggataagcaggttatatgtaattttttaatcagcattttaataaaaataattgaagtcaacactgaaaagaaatgtgacctacaacatatcacggcatagcaaagcttatttttgtagcatgtgccagcaaatacaaggcacttgccgtgatgcacacatacatatcttcctaggcaccttcattcattctgctctcaaattgttaccttcaacacttcgtgctttcttgtttccaaacattgagataataatattagcatgattgtagaccattgttaccagcctgaaagcaaaaagggaattatgagagtggttatcaagtattttggcaagaggaggggaagcttagagtagaagtgcctttgtatgttagaggtgggccttaggaagaagaggagagcaaaagagataaatttgagtgtggttattcagaggagttgatatccgatgtcacaatgattctaacaaaatagatttcatcatagtgcttgactttgatacatttcgcatttatcaggaactgggctctatcatctacagtttccctctactccatccttaatcctcaacacctgtacccttttctcaccatctccttatgttaattttgagtttaagaatgtattgcggttttaaaataatatttcaaagggccggcgcggaggctcacacctgtaatcccagcactttagaaggccaaggccggcgggtcatgaggtcaggagatcgagaccatctgggccaacatggtgaaaccctgtctctactaaaatacaaaaaaattagctgggagtggtggtgcgcgcctctggtcccagatactcgggaggctgaggcaggagaatcgcttgaaccctggaggtggagcttgcagtgagctgagattgcaccactgcactccagcctggagacagagtaagattccgtctcaaaaaaaaaaaaaaaatcaaatatatcacccttttttgattacaaatagtttagtaaattcactatgctaatgcttttattttctctttaaagatttgtaaagaaagaaagaaagaaagaaagaaagaaattatattctcccagtttctggtctaacatgtaaggagcttggatgtcaccactccaccctaataaatgtggagatgaacgaactgaaaaatcaactcttcttggatctgcaagagaagtgaggattcagggcaaaccagtgcccccaggattggaaagacaaataggcaaagacagagagtcatggcttactggagtaccgattcatgaactgaaacatgggaacaagtgctggggtaggaaaaacggaactgtaattgactaattgctggaaacttagtgtggacaagtatgatagacaaaagcttccggtagacctagtcataggggagcccatacaattttgtgagttttatctcctggaaaactactgagttctcatagtcagtacctgagaaaaatcccctcatgattcctgcggttggaagagtaaaggaaccatcttgaaatatgtcagataattatttcctgagcaaggtttgccctcagaagaaagtatttaactagagctaacttatctgggaaaagggaaatatttaattccagctggctctagccttccacttgtaagaagagaaatactaaactcaagcccactctagtcattaaggggtaaggggagaagattgagaagcacttgtgaagtttagtcctgagacacacgcttactaaaagactgaaacctaatcataggactgtagaatgctttccctccctacactctaccagcacattactaaagttctgtttacagcagtatcttttacccaacacatcatgtctggctacatagaaaaaattaccaggcatactaaaaggcaaaaaatacagttggaggagacagagcagtctcctcagaatgagacagatacggcagagatactggaatgatcagattgggattttcaaacaactataattaatatgctaaaggctcttatagatataggagacagaacacaagaacaaataggcaatgtaagcagagagatggaaattctaaaaaaaccttaaacgttagagatcaaaaacactataacacaaatgaagaatgcctttgatggattaattggtaaagtggacatagaggaagaatctctgagaatgaggatatctcaatggaaacctccaaagctgaaaaggaaagagaaaaaaagacttaaaaatgcccagaatatgcaatagccatgggaaactacaaaaggtgtaaaatacaggtaatgtgcataacagaataagaaaaaagagagaaagaaacaaatgtttgaaacaacaatttctgaaaacttccccaaattaatgtcagacaccaaaacacagatatgggaagtttagaggacaccaaacagagtaagtgcccccaagcccacacacccaggtatgtcatattcaaactacagaaaatcaaagataaagaaaaaatcatgaaagaagctagagggcggggaaacatacgcttagaggccaaagataagaattacatctgactttcagaaaccaggcaaggaaaaaaactaaaagcaaaaacaaaatatttaaaatatatttaaagtgtgaagttaaatatttaaagtgttaagagtaaaaacccaccaacctagaattccattccctgaaaaactattctttaaaagtgagggagaaataaaaatcttttcagataaacaaaaattgagggaatttgctgctaatagatctaccttgtaagaaatgtttttaaaaagttatttagaaaataggaaaaagatacaggtcataaactcatgtctacattagagattaaataattgaaggtaaaataaaacttttatttttcttattactaattgttctaacagattttgttccaaataataatgacaacaatgtatttgattatgtatgtttatgtgtatatatgacatatataatgtatgtataatagattatatatatgcttatataccgtgaaatgaattacatcaacgatacaagggatgggagagaggaattagaattattttgttattataaagtatttacgcttcccatgaaatggtataatatagagttatttgaaagtgaatttggattacttgtaaatgcttattggaaactctatggcaactactaaaaaaaaattaagagaataatatatagtttcaacttgttagaaggaggatgtcgaatgttcccaatacaaagaaatgataaacatttgagatgctagatatgctaattaccttgatctgattactataaaatatatgtattaaaataacactaagtaccccgtaagtatgaataatcattatttgttgattaaacgatacaatttaaaaagcaaaaaagaagtataactgatgtactaagaaaagagatagcgtggaattatataagatactcaaaaccacttttgtggtattttgccttttggcagagagagtgaaagacaaatgtaagaaaaatgaataagagcaacacagaagaaacagtaacaattatggtagattttaatccaatcatattaatattactttgaatttcagtggtctaagtacacctattaaaagacagagattgtcagagtatatcaataaacaagacccaactataagttgtctataagaaacccactttaaatataaagacacatatagattaaaagaaaatcgatgaagaaaggtttgctgtgccaacactaatgaaaagaaattaagaatacctattttcatttcagacagagcagacttcagagcaaaggaagttatcatgaataaagaggggcattacttaatgataaaggggtcatttctccaagaaaatacaacaattcttaatgaatatgtgcttaataagtatgcatcattgcaacaaagtgtcaaaatacatgagaaaaaatgttataaaatcacaaaaagaaatagaggattccactattatagctcttctattagaaatggacagattcagcaggcataaaatcagaaagcacatagttgaactgaacaacactatcaaacaaatggatataattgacaatctatagattatttaacttaacaactgcagaatacacattcttcttaagcttatgtggaacattcaccaagagagatcacattctgaaccacagaacacactttaacaaattgaaagaatagaaaacaaatggctgctctaaaactacaattgaatttaactagcagtcaataacagaaagataactggaaaatcccagaacactcggaggttaagcaacacgcttctaagtaatacatgggtgaaagaagtctcaagagaaaattttaaattatttttaactaaatgaaaatgaaaacacaacatataaaaatttgtgggatatagtataagcactacttagagaaaaattatagcattaagtgtacatattaggaaagaagaaagatctaaaatcaataatttaagattctcccttagaaaattagaaaagaagagcaaatttaattcaaagagaagaaatccaacaaaaatcaataaaattgaaaattgagaagcaatagagaaaaacgaagaaaacaatagctgactttgttgatctttaagaagatcaatatatcaataaccccctaaccagtctaaaaaaaaagagagaagggaaaaaaatgactaatagcagaaatgaaagaggagtattactgtggattccatggatattaaatggaaggtaaaggagtactatgaagagctctatgcccttagatttgataattcacataaaattaatcaattcctcaaaagacacaatcagcaaaacttacacaaagagaaataagtgatctgaataggcttctatgtattagaatacttaattaacaactttccaaaggaaaaagcatcaggtccagattggttcactggtgaattataaacaacatttaagaaagaaattataccatctctttcagaatatacaatctctttcagaagacagaagcaaagagaatactttctaactcaccttattagaccagagttaccctaataccaagacttgacgatgacattacaagaaaatactgcagatcaaaatctttcaggaacataggtgcagaaattctcaacaaaatattatggaatccaacaatgcatgaaaaacactacaccacaaccaaatggtatttatcccaggtatgcaaaactggtccaacattgaaaaatgaactaatgtaatccatcatatcaagaggctaatacaaatcacatactcatagatgcagaaaaagcatttgataacatctgacgctcattcatgatgaaaactcccagtaacatataacctgcagaatgagagaaagtatttgaaaactatgcatctgacaaaagtctaatatccagcatctatatggagcttaaacaaatttacaaggaaaaacaaccccattaaaaagggggtgaaaaagataaacagagacttttcaaaagaagacacagatgcagcaaacaagcgtattttaaaaagctccatatccacatgcttacctgtgtaacaaacctgcagatcctgcacatgtaccccataatttaaaatttaaaaaaagctccatatcattgatgattatagaaatgcaaatcaaaaccacaatgagataccatctcacaccagtaagagtgactattattaaaaagtcaaaatgtaacagatgatggtgagcttgccgaaaaaagggaatgcttatacactgatggtgggagtgtaaattagttcaaccattgtggaaagcagtgtggtgattcctcaaatagctaaaaatggaactatcatttgacccagcaatcccattactgagtatatacccaaacgaatataaatcattctaccataaagacacatgcacacatatgttcattgcaacactattcacaataattccaaaaacatggaatcaacctaaatgcccatcaatagcagactggataaagaaaatgtggtatgtatacatgatggaatactatgcagccataaaaagaatgagatcacatcttttacaggaacatggatggagctggaggtcattatccatagcaaactaatgcaggaacaaagaaacaaatattgtgtgttctcacgtgtaagtggaagttaatgatgagaacacattgacactaaaaggagaacaatagacactggagcctgagggtgaaggttgggaggagggagagaattagaaaaaaataactattgggtactaggcttagtgtcttggtgatgaaataatctgtaaagcaaactcctgtgacacaaatttacttgtataacaaacctgcatatatactcctgaacctaaaataaaatttaaaaaaaaaacgagtaaaataggaatacagggaaacttcttcaacttgataaagaatatctacaaaaaatcctgcaactaacataattctttttggtaaaaactacaagttttcccactaagatcaggaacaaagcaaggatgtaccttcttaccattgcttgtcaacatcatactggaagtacaagctaatgcaataagacaagacaataaaggaagaggatacatattgaaaagaaagaagcaaaacggtctttgtttgcagccgacatgattgcctatgcagaaaatctgaaataattgacaaaaacttctggaactaataaatgattataacaaggttgtaggatacggggttaacatataaaagtcaatagctttctatgtaccagaaatgaacaaatggaatttgaaattaaaaacacaataccatttacaaaacactcctgaaaatgaaatgcgtagatataaatctaacaaatgagaaaaatgagagaacatagaaaaaggtctaactaaatggagagttattccatgttaactgagagaaagactcaatattgtcaagatggcagttgtttcaaacaatctataggttcaatgcaatctaaatcagagtctcagcaagttattttttatgctatgtatttcaacatttattttagatttgggggtattttgtgtgatgctgatatttgctgtatgaataatcccatcacccaggtactgggcatagtacacaacagttagtttttcaacccttgccccctccctctctctttcctctagtagtcctcagtttctgttatcatcttcatgtccacgagtacccaacttttagctctcacttataagtgagaacatgctgcatttgattttctgttcctgtgctaatttacttaggacaatggcctccagctgcctccatgttgctgcaaatgacatcattttattcttttttatggttgtgttgtattaaatggtgtatacataccacatttcctttattcaatctacacttgatgggcacctaggtttattccatgtctttgctgttgtgagtcatgctgcaatgagctactgcatgtatctttttggtatgataatttgttttcttttgaatgtatctcagtaaagggattttggcaagacacacacacacacacacacacacacacacacacacacacaaactgattctaaagttcatatgtataggcaaaagaatagctgacataatactaagaacaaagttgaagggctgatactaccctacttcaagatttagcataaagctatactaatgaaaacagtgctgtatcggcaaaagaacagataagtatatcagtcggaaagaatgaagagtcagaagtagacctacataaatatagtcaactgatcttggacaaaagaagaaaggcaatacaatggagaaagtctttttaataaatgatgttggaacaattggacacttgcatgcaaaaaaaaaaaaaaactagatgcagactttacaactttcacgaaagttatctctaaatgaattgcaaatctaaatgtaaaacatgaaactgtaaagctctgagaagataacataggagaaaatttaggtgaccttgcttttggagatgattttttagatacaacacaaaagtcgtgatccatgaaaaacggattggtaggcgggacttcattaaaattaaagtgatttttttttctgcaaaagatactgccaaagaataaaatgataggccacagattaggagaaaatattttcaaaagatgtatccaataaagaattgttatcaaaaatatacaaaaacctttaaaaacataacaatgagaaaagtaacaaacatttaaaaatgagcaagagatctgaacacatacattgccaaggaaggtatacagatcacaaataagcatttgaaaaaatgttccacataataaaaaatcagagaatgtaaattaaaataataatgagatatcatatacttattagaataatcaaaatccacgacactgatagcaccacatgctagtgaggacatggttcgacaggagctctgattcattgctggtggcagcacaaaatggcacagccatgttgaaagaaaatttcacaatttcttacaaaacataacatattcttactatgcaatcagcaattgagcttcttggtatttacccaaagttgaatacttatgttcacgcaaaaaattgcacaaaatcatttatagaagcttcattaataattgccaaaacttgaaagcaaccaagatgcgcttcaatagggaaatggataaattgtagcacatcctgacaatggaatgttattcagtgctaaaaaaaaacaatgaactatcaagccatgaaaatacatgggtgaaactaaactgcttatttctaaataaaagaagccagttaaaaaggctacgtcctggataattccaactatttaattaatattctggaaaagccaaaactaagacaactgtaaaaatatcagtggttgccaggaattgtgtggaggaagtgataggaggggccacagcatgttctgggcaatgaaactactctgtacaatactgtaatggtgaatacatgtcattatacttttgtccaagtccacagaatgtacaatatcaagagtgaaccctaaggtaaactatggactctgggcaataatgatgtgtcaagacaggtttatcagttctaacaaatgtacccctctgatggactatgtgggtaatggggacgactatgaatgtgtggagtagggaatgtatggaaaatttctgtctttttttctttcaattttgccgtgaacctaaaactgttctaaaaatgtgaggtctaataatttttaaaaaatatttcaaatctgaattaaaatactctaatattctgctttgaggattattttgcacattttctgggacatacaattcttgttggaaacaatcaaagaaagctgagctttggtttcctgaatgctatatgagatctgccatcaaaatactctggttttgataataccccagggtaactttcctatgtactcgactctgtcatgtggggaaagattttcttgctaactgtaccaataaataattagaccaatagcaaaagattctgtggaaggtcttaaagagtctcagctgagaagaaccaacagttattcttctgttcccgtaattactggggcattgttgtggatcacagaacttgacaagcagtccctagctcacaggtcatagctatattttccttctgctatggaaatactgagatttgtcattctcccgtagttctattatggtcatacttgacattcccttgtttccttagcatgcagatggccatagtacgcaactaggcaaattcccagaaagggtcagctgtgaaagtccagtttaagatttaaggtaggtctccagagcaagttggcaagtttaggtaactaattaagataagtactgtacatgaagagggttgttttaaatctatgcctactaaactataagttctatgaggacaataacattgcttctctgttttcccaaagtatttgactagctttacagcaccacacatatatttggcactcagtcaattatattaaatgtatgaatgattgaataggcaatagatgagtatcagtttgtttctttgttttttgagacagagtctcactctgtcactcaagtgtgcagtgtcatgatcttggctcactgtagcctcaacctcccatgctcaagtgatcctctcacctcagcctccctagtagctgagagtatgtgcacacaccaccacgcctggctaattttttattttttatttcttgtagtgacagtgtctcactattttgcctaggctggtcttgaacttctacattcaagcgatcctcccaccacagtctcccaaagcgactcaagcaatcttctcacctaagtctccctaagtgctgtgattacaggcatgagtcactgcacccagccccatgagtgtgggtttttatgtctgtagttatttactaccttcttccagaaaagacaaaaggcaaataagtatttaagagaaacttagcaaattagagcttttgaaccctgggacctgggttatttgctctaatcccagtttcataacacttgtcaggttgagtgaagactaggtccactggtataaacagtgggaactctgaggacagccaataacagtcgagtcagataaagatgcaaaatcacaggaatctaaagtagaataaagaaagtaaaacactacggaacctaaacatatttgtagtgacaattttagtgtgctgctctttgatggctcttatggcccactggctttatttctcattgtagaatttacatcatcttgtatcattatttcaaacccaacagggaaattagaagatgagcttaaatagcactgaaatattctgagacaaaaaaattaggtagtggctagacacctatttaaatgcttatgcctggagacagattctatattgcatttaaatggtacatgagaaaaaaatgaggaaattttaatgacagagacaaaatagttttaaaatttaaagcaaaacacttctgtaattaatactttttcctaaaatatgaacagcatgtgaatttagtaaattatatagtttctaaaactaatgcaatttaattataatgcttcccttttgtgtaatactttgtcttactttgcatatatttctattaccaacttattgattctttttgccaggaagacattggtttttagtttttatttgttatttttacctcttacttatataggcagtttctcttttctgaacatgtttaagcttattccattcctgtagcaatgtgtgttctacaatgaggagcctgttttttcctgtgggacacaaaatgattaatgtcagtggagaataatgtattttcatatatcacaaattgtctaaggttgcaagaactcagaatgcaatgatattaaagagatactgacaattggtcattatagatagaaatagtgcctattcagatatacttcctgtgatttcaaataataatggtttactcttttttttttttttttttttttgagatggagtcttgctatgtcacccaggctggagtgcagtggcacgatctcagctcactgcaatctccacctcccgggttcaagagattctcctctttcagcctcccaagtagctgggattacaggcacccaccaccacacccagctaatttttgtatttttagtagagatggggtttcaccatattggccaggctggtctcgaactcctgaccttgtgatctgcccaccttggcctcccaaagtgctgtgattacaggttggtttactcttgaggtaaaataatatatcttcccaatcagaaaacatgaaggttatttcaatttaatttttataaatgttataaaagaaaccagacaagtctaaagattcggggcatcatatattaatttgttttaaagattggaaagaaagatatatttttcttactcctagataaaataaataattttgtttatgaggtactttcaaatagtaatcttttgtatgcttaataattatgaagcaatgagtagaaaagaccaagaccaaactgattgaaaacgttaacaaacatacgcataatccagaagtttctcaatcagtaaattactaagaaattattttgtttttaaggaattagaacaatttacaatttcataatgcatgaatgttttctctgtcccctccttttttgttgttttggtttcagcatatacagtatatatggtcctgagttacagatatattttatagtcaaaacaaaattggattttaagaggtattttctcttgcactttagattgctttatcatacccttaaacttcagagagaaaacggctcctccagtctagcagtttctttgactaagcagtcattatatccaatatttgctctttgctatctattttcctctgaaagatatgcgaatttacatatctatggctaaaagtactgttattcgaagacatggtatcaacctaaatgccaatcaacaatagactgttaaaggaaatgtggtacataaacaccatggaatactatgcatccaggaaaaataacaagaccatgttctttgcagccacatggatagagctgcaggccattatcctaagtgaactaatgcaggaaccgaaaaccaaataccaaatgttctgacttgtaagtgggagctatgtgggcacttattgagcaaaatttcaggatacaaaatcaatgtacaaaaataagtatcatttctacataccaacaaagtcaaagctgagtgccaaatcaagaatgcaatcccattcaaaatagccaccaaaaaaataaaatacctaggaatacagctaaccatgaagatgaaagatctctaaagcgagaattacaaaacactgctgaaagaaatcaagacgtcacaaatggaaaataattccatgctcttggacaagaatgaatattgttaaaatggccatgctgctcaaagcaacttatagattcattactattcctattaaactaccaaggaatttttttacagagttagaaaaatctatttgaaaattgatatggaaccaaaaaagagcctgaatagccaaagcaatcataagcaaaaagaacaaagctggaggcatcatgttacctaacttcaaaccatgcaacgaacctatagaaaccaaaacagcatagtacttatactacaacagacacatagaacaatggaacagaatggagaggccagaaataaagccacacacctacagccatctgatatgcaacaaaattgacaaacaaacaaacaaaaaagaaatggagaaagggcttcctattcaataaatggtgctgggatagctgcctagccatgtgcagaagattgaaactggacccattcctttcaccatataaaaaaatcaactcaagatggattaaagacttaatgtaaaacctaaaactataaaacccgttgaggaatacatagcaaataccattctggacacaggccctgacatggatttcatgatgaaaatgccaaaagtgatggtaacaaaaccaaaaattgacaaataggatagaattaaactgaaaaactcctctacaggaaaagaaactattaacagagtaaacagacgacctccagaatggggagaaaatgttttcaaactatgcatctgaaaaaaggtctaaagttcagaatctttaaggatttaaacaaattagtaagcaaacaacaaacaacctcattaaaaagtgggcaaaggacatgaacagacacttttcaaaagtagacatacttgcagtgaacaagcatatgaaaaatgctcaacattattgatcattagagaaatgcatataaaatcacaatgagataccatcaccccagtcaaaatagctattattaaaaagtcaaaaaataacagatgctggtgaggttgtggagaaaagggaacacatatgctgatactacactgatgatgagggtgtaagttagttcagctattgtagaaagcagtttggaaatttctcaaggaacttaaaagagttactattcaatacggcaaccccattattgggtatatgcccaaaggaataaattattctaccataaagacacatgtaagcatatgtttgttcactgcagcactatttgcaatagcaaagacatggaatcaacctaaatgcccatcaacagaagactggataaagaaaatgtggtacatatacaccatggaatactatgaggccataagaagaatgagatcatggcctttgcaggaagatggatggagctagaggctgttatgctaagtaaattaggaacagaaaaccaaataccatctgttcttacttataagtgggagctaaacttcgtgttcacatcgaggcaaagaagggaacaacagacactggggcctacttgagggtggagggtgggaggagggtgaggactgaaaaactacctattaaagctacctttagagaccatgcttattacccaggtgatgaaatgatctatataccaacccccccatgacatacaatttacctatttaacaaatctgtaggtgtactcctgaatctaaaataaaagtttaaaaaaaacttggtcaaagaaaaggaggtattaggaaagcttcccagagaagtttatatttaatttgcatcatagaggagccataactaagaaagacaaaaacaaactagatggcatttaagtatctaaagttctaaatttccattattttattaacacattaggatgagtggttaatgacaggtaggtattgaatgcttactaattttcagtcatcatgttaagaactaaatggtttcatgtcatccacttgttgtagatttgattgtgtctcccccagttcatatgtagaatctgtaacccctaatgtgactgtatttggagatagggtctttaaggagatatttaagggagtcataatgttgggacccagatccaattctattggtgtccatataagaagaggaagaggtaccagggattcttgcatgcagaggaaagacagtatgaggatacagaatgaatgtgtctgtctgcaagccagaaagtgagatgtcaccagaaaccattcatgctggtatcttgatactgaactttcagacttcaaacctataagaaaataaatttctttttttttaagccactaagcttgtgatattttgttttgacagtcctaaacagactaatagagattttagaaacctgactaataaacctctaaaccaccatatgttgtatatgctataatgattctcattttcaatatgagaaatctgtggttccaacactttattatccatcactatgatccctaatcacatggatttcaatccagagaatatgacatcatagcatatacttgttttccttctactttagttattaaattctaattttattatgttgtgatgaaactctgtgatttgaacgatttcaactttggagaatagttagaggcttttaatattgggtcaattttttacttagagagcttgagtgtaagcatctgttagaacaagtttgttaatcatattaatttttatatatccatttgtaggttttatttactttgcttcatgtacttcatgaattttgatgctgtgtttattctatgcataaatattcatgtcagttagttgtttattgtggtgtgtaaattttatcactaaagttttttttgctttattgctctctgccacaagtttatttttatctgataattatattatgaccctactttaaaaaaattcattccttaatgtttttgccaatattttatgctttatatattttcattcactttaatttaaaagcttttctcatatatagcatcttcacttttgcatttttaatcaattaaggattaaaattttaaccatttatcactagtggttttacaggtatctttgatttaacacttttattaattttatactaggatttctgcttttaaagttcctgttgctctttttttttttaacatttaactctgcagcctgtattttcttgtctttaaaataaatgattgagtgttttccttctggtaatttgtaaggtttatggctgttttagcacttttggtgattaactttaaaatcttaagtatatttaccataaatatttgatttagcagctgtgaagatatctttgggtctctgctctaattgaaaaatcatccgtatttacagaatgtacctctctgactctgacatcaagagtctgattatttctgcattatcaaagtttataacatttatattatttcttgtaaccacattttgcagaattgtttacttacagccagtccctttaccacaagtaggccatccttctatttatattttgtgtggttagagttcatcaagaaatagctctttcaggctgggcacggtgactcacacctgtaatcctagcactttgggaggccaaggtgggcggatcacttgaggccaggagttcgagatcagcctagccaacatggtgaaaccctgtctctactaaaaatacaaacgtttgccagtgtggtaacccagctacttgggaggctgaggcaggagaattgctggaacccggtaggtggaggttgcagtgagctgagatcacaccatagcactccagcctgggtgacagagcaagactctgtcttaaaaaaaaaaaaaaagaaagaaatagctcttttaatgagggcaggttttaggtttcggactcccttagtttatatacatttgaaacagtctgacttaggcttcaaactgattaatatttcatcagtgcttaagatgtgcaagccattattttgaggatattacaaatatatagtttaatttcatatgaaatggataatgttatttcaaatgttcagatgagagcactgagatcaagcaaggttaagtaaattactcaaagacacaaaactagaattttacatcctgtgatgacaacttgtctgattttatagttattagaattcactttatttctctgaggacattgcaggtactatgtgttagtccactttgcattcctataaaaatacttgagatgggataatttataaagaaaaatgtttatttggctctcagttctgctatctggaagattggacatctggtgaaaacctcaggctgcttccactcatagcagcaggtgaacaggagctagggtatacaaagatcacatggcaagagagggaagcaagattaggagtgggaggaggtgccagtctctttttaacaaccagcttttacaggaactaatagagtgagaactcattcattaccatgaggatgagtcaccaagccattcatgaagggtgtgtccctaagacccaaacacctctcattaagccccaccttcaacattgaggaccaaatttcaatatgaaatttgggaggacagacatccaaactatagcatgttgctataaaggagtcaaaatttcctcacttatagatggctttatttatttatttttgctttactatacctacattcctttttaaaaatagagcataatatagcttttattaattaataaaaatattttatttcttactttttatgtttcactccttttgttacactccaaaggtgttttacctaattttgttttgtgtctcttttattaatgtattctgttaacttctctaataaacttaaaacataacacattttctcgatttgtttacgtaagcattatcttctgctctccccattatgaaagatgggaatattactatcattgaagttccacatgccatctctttcttcctctgctgccctcacctcctcttcctcttcttttcattccttcccttcttcctcctccatcctctttcaatgtctattagcaattcttggtattccttggcttgaagctacataactccaatatctgcacgcatcttcacatggccttctcccctgtttctctgtatcacaaacttacctctcctttctcttataagggcaccagtcactgggcttaggacccaccctgaatccaggatgattttgtcccacaatcatcagaggaaggattaggcagcaacatctgctgttctgcagcctctgctggtgatacccaggcaaacagggtctggagtggacccccagcaaactccaacagacctgcagctgagggtcctaactgttagaaggaaaactaacaaacggaaaggactttcacaccaaaaccccattggcacgtcaccatcatgaaagaccaaaggtagataaagccacaaagatggggagaaaccagacagaaaagctgaaaattctaaaaatcagagcacctcttctcctccaaaggaacgcagctacttgccagcaacagaacaaaggtggatggagaatgactttgacgagttgagagaagaaggcttcagatgatcggtaataacaaacttctccaagctaaaggaggatattcgaacccatcgcaaagaagctaagaactttgaaaaaagattagacgaatagctaactacaataaccagtgtagagaagtccttaaatgactaatggagctgtaaaccatggcatgagaactatgtgatgaatgcacaagcttcagtagccgatctgatcaagtggaagaaagggtatcagtgattgaagatcaaatgaattacatgaagcaagaagataagtttagagaaaaaagagtaaaaagaaatgaacaaagcctccaagaaatatgggactatgcaaaaagatgaaatctatgtctgattggtgtacctgaaaatgatggggagaacagaaccaagttatccaggagaacatccacaacctagcaagacaggccaacattcaaattcaggaaatacagagaacgccacaaagatactccttgagaagagcaactccaagacacataattgtcagattcaccaaagttgaaatgaaggaaaaaatgttaagggcaatcagagagaaaggtcgggttacccacaaagggaagcccatcagagtaacagtggatctctcagcagaaactctacaagccagaagagagtgggggccaacattcaacattcttaaagaaaagaattttcaacccagaatttcatatccagccaaactaagcttcataaatgaaggagaaataaaatcctttacagacaagcaaatgctgagagattttgtcaccagcaggcctgccctacaagagctcctgaaggaagcactaaacatggaaaggaacaacccgtatcagccactgcaaaatcatcccaaattgtaaagaccatcgaggctaggaagaaactacatcaactaatgagcaaaataaccagctaacatcataatgacaggatcaaattcacacataacaatattaaccttaaatgtaaatgggctaaatgctccaattaaaagacacagactggcaaactggataaagagttaagacccatcagtgtgctgtattcaggagacccatctcacgtgcagagacacacataggctcaaaataaagagatggagaaagatctaccaaacaaatggaaaacaaaaaaaggcaggggttgcaatcctagtctctgataaaacagactttaaaccaaaaaagatcagaagagacaaagaaggccattacataatggtaaagggatcaattcagcaagaagagctaactatcgtaaatatatatttaccaatacaggagcacccagattcataaagcaagtccttagagacctacaaagagacttagactcccacacaatagtaatgggagactttaacaccccactgtcaacattagacatatcaacaagacagaaagttaacaagcatatccaggacttgaactcagctctgcaccaagcggacattacaatagacatctacagaactctccaccccaaataaacagactatactttcttctcagcaccacaccacacttattccaaaattgaccacatagttggaagtaaagcactccctagcaaatgtaaaagaacagaaattataacaaactgtctctcagaccacagtgcaatcaaactagaactcaggattaagaaactcactcaaaaccactcaactacatggaaactgaacaacctgctcctcaatgactactgggtacataacgaaatgaaggcagaaataaagatcttctttgaaaccaatgagaacaaagacacaacataccagaatctctgggacacatttaaagcagtgtgtagagggaaatttatggcactaaatatccacaagagaaagcaggaaagatctaaaattgacaccttaacaacacaaaagaattagagaagcaagagcaaatgcattcaaaagctagcagaaggcaagaaatgactaagatcagagcagatctgaaggagatagagacacaaaaaacccttcaaaaaatcaatgaatccaggagcggttttttgaaaagatcaacaaaattcatagaccactagcaagactaataaagaagaaaagagagaagaatcaaatagaagcaataaaaaatgataaaggggatatcaccactgatcccacagaaatacaaactaccatcagagaataccataaacacctctacacaaataaactagaaaatctagaagaaatggataaattcctcgacacatacaccatcccaagactaaaccaggaagaagtcgaatccctgaatagaccaataactggttctgaaattgagacaataattaatagcctaccaactaaaaaatgtccagggccagatggattcacagccgaattctaccagaggtacaaagaggggctggtaccattccttctgaaattattccaatcaatagaaaaagagggaatcttccctcattcattttatgaggacaacatcatcctgataccaaagcccagtagagacacaacaaaaaagagtattttagaccaatatccctgatgaacatcaatgcaaaaatcctcaataaaatactggcaaaccaaatccagcagcacatcaaaaggcttatccaccatgatcaagttggctttatccctgggatgcaaggctggttcaacatacaccaatcaataaatgtaatccatcatataaacagaaccaaagatgaaaagcacatgattatctcaacaggtgcataaaaggcctttgacaaaattcaacagcccttcatgctaaaagctctcaataaactaggtattgattagacatatctcaaaataataagagctatttatgacaaacccacagctaatatcatactgaatgggcaaaaactggaaacattccctttgaaaactggcacaagacagggacgctctctcgcaccactcctattcaacatagtgttggaagttctggccagggcaatcaggcaagagaaagtaataaaggtattcaattagggaaagaggaagtcaaattgtccctgtttgcagatcacatgattgtatatttagaaaaccccatcgtctcagcccaaattctctttaagctgatatgcaacttcagcaaagagtcaggatacaaaatcaatgtgcaaacatcacaagcattccgatacaccaataacagacaaacagagagccaaatcgtgagtgaactcccattcacaattgcttcaaagagaataaaatacctaggaatccaacttacaagggatgtgaaggacctcttcaaggagaactacaaaccactgctcagtgaaataaaagaggatacaaacaaatggaagaacattccatgctcatggataggaagaatcaatatagtgaaaatggccatactacccaaggtaatttatagattcaatgccatccccatcaagctaccaatgactttcttcaccgaattggaaaaaaactactttaaagttcatatggaaccaaaaaagagcccacattgccaagacaatcctaagcctaaagaacaaagctggaggcatcacactacctgacttcaaactatactacaaggctacagtaaccaaaacagcatggtactggtaccaaatcagagatatagaccaatggatcataatagagccctcagaaataataccacacatctacaaacaactgatcttagagaaacctgataaaaagatgaaatggagaaaggattccctatttaataaatggtgctgggaaaactgtctagccatatgtagaaagctgaaactggatcccttccttacaccttatacaaaaattaattcaagataaagacttaaatgttagatctaaaaccataaaaaccctagaaaaaaacctaggcaataccattcaggccataggcatgggcaaggactgcatgactaaaacaccaaaagcaatggcaacaaaagccaaaattgacaaatgggatctaattaaactaaagagcttctgcacagcaaaagaaactaccatcagagtgaacaggcaacctacagaatgggagaaaatttttacaatctaaccatctgacaaagggctaatatccagaatcttcaaagaacttaaacaaatttacaagaaaaaaatcaaacaaccccatcaaaaaatgggcaaaggatatgaacagacacttctcaaaagaagatacttatgcagccaacagacgcatgaaaaaatgcttgtcatcaccggccatcagagaaatgcaaatcaaaaccacaatgagataccatctcacaccagttagaatggcaatcattaaagtcaggaaacagcaggtcctggagaggatgtggagaaacaggaacacttttacactgttggtgggactgtaaactagttcaaccattgtggaagacagtgtggtgattcctcaaggatctagaactagaaataccatttgacccagccatcccattactgggcacatacccaaaggactataaatcatgctgctataaagacacatgcacatgtatgtttattgcagcactattcacaatagcaaagacttggaaccaacccaaatgtccatcaacgattgactggattaagaaattgtggcacatgtacacgatggaatactatgcggtcataaaaaaggatgaattcatgtcctttgtagggagttggatgaagctggaaaccatcattctgagcaaactatcacaaagacagaaaaccaaacactgcatattctcactcataggtgggaattgaacaatgagaacacttggacacagggtggggaacatcacacaccggggcctgtcgtggggtggggggaggggggagggatagcattaggagatatacctaatgtaaatgacaggttaatgggtacagcacaccaacatggcacatgtatacatatgtaacaaacctgcacattgtgcacatgtaccatacaacttaaagtataataataataataaataaaaataaaaacaaacaaaacaaacaaaaaaacaaacaacaacaacaacaaaaactcagtggtctcactggttctcccttccatgacctcatagagttgaacccacatatgtctatcttatgggacagcaaggagcccatggaactccatgcaaatccctggagctcttttgttttgtttttaaatcgaactccctccagtctaaaacttaactctgcaacttccagctgcctcagcttccctgaaatctgatatctgtctactcaactcagtgaaaccaacatgctctgcagtaaggtatttccttgggcagaaagttagagtgattataggtctttctttactttctttctcttagagatcaaatcatatttttagtagagacggggtggtggcgggtgcctgtagtcccagctactggggaggctgaggcaggagaatggcgtgaaccagggagtctgagcttgcagtgagcagagatcgtgtcactgcactccagcctgggcgacagaaaaagactccgtctcagaaaaaaaaaaaaaaaagtgatcacataatggaaactgttatttgataaattttgtctagttttctggttgcttaagatgagaaaaatattcgctttttgatcctagtgtccctgttatatattcttacctctttaacatttttttttttactgtgtcttcaaattctatagctgtttacttatgtctattttcatcttttgagtttgttttcaatgtatttaaatgtatctttccttcagtaagccttttactaaaagacatttgcctgcctcttttgttgttatgttcactttgtggggggttgctggggaagtagtatctacgtttttatttctttccagatattttctgttcataattaatgagaaagagattttgtttggacctcctctttttcagacttgtataatgatggtcagaggaatgacttgggctaaatgtccatttggtcattcagtcttgaaacactttcttattaactttaccatgttctctgcctttgtgttcactttttccatcatatttccacattttttttttaatttttatttttatttttgtagagacagtgtcttgctcttttgcgcaggttaagagtgcagtggtgcaatcatatggctcactgcagcttcaaattcatgggctcaatgaattctcctgcctgaacctactgagtagcttggactacaggcacgtatgatcatacctggctaattttttttacaattttttttttgtagagacagggctttgtgatgttgtccaagcttatctcaaactcctggctacaagcaatccttttgccttggcctctcaaagcactgagatgataggtgtgagacaccatgcccagttaccacattttattttatacatcagcagatgaatcacccagatggtaagtctgtagtaacacttgtgtcttacaagtaacaggtctttagtttgtattttattcatttctttttagctcacattgatcatcagctgcaaagctaattttatcttctgtttgtttctccacccgattcacagacatccagtttctctgatttttaagtgttcagattgaaaagcacaatgagcaatgccactattcaaaggaatgataacaccaaaacttacctctctttctgtcctccttcatttctacctgccgcgaattctgcagtcaaataacttatttagtttcctgtggcttgttcataatctgtcctttcatttttgaattaaaaccttattgattatggtttctcaacaactgttttctttcaatcaaataaatccaccccctattgagattcatagagataagcacaatttttgtgtcctttcttcttttactaatatagcttgaagatttttctttttgtggtctgtggttgtccattctctttttctctatatataagatagatagatagattagatagataaatggataaatagatagatagatagatggacagagtcattgttgtttttgtttctttgcttatttgggttatttcccttgatttttgaaatgtccaactattctatgccagaataaatgtgaaattatgtttgcaccacatgctgcggtgtatatagcatgagagaaaagccaaggtagatataccatatcttaaatcatttgacttattttacattgataaggtaatttttctgattcacatagattggcagatacatgcagaaagtaaagttaattgctttccttgattttgagaaattatcttagcaaagttaaagccctactttcaagtgaagagtttgtttgtatatgcatgtataaaaatggaaatgcaagataaacattgcttcagctacatcaaagaagatgttaatggagctaccctttaaggccttgtgcttcttatttgtagtattatcacaggttgggaatccactctgattttttttgagacatgacaaaattgcattaactgttgtataccgaaaacttttcatctcttgagcatttattaatcattctacttctggctaggaaaactaagttccctgtagccctgactcttgggatctctcaaaagaatattatatgaatcctgggtcgtttaactgtcagaatctcagtactacctattgttaaactaaatatcctcacgccctggttgtggagatacatcctggtctaagcattattttcttccaagtgccttgtttctttgttacttcagaaaggctatagtcagccactttggcaaccgtatgtcatatatctcaaatcataaattaccttgattttgaagactgagtaggagaggcatctattctcctattttattcatatctttcttcctaagaaaagcttaattgtctctaatagggatatctccaaatcaaagttttataatgcagtgtgttaggcaaacaacaagaacaaagcctgcagaacatcctttatgctaacactaacaatgtatagctacaccatgctaagtgcactgagcaataacaggaggaagcgtagtgaattggaaagaggtttttctagtgtttgaaatcctttccaattttgttttaattattatatttcaatataatatattcatagttactatcagatttcaatcaagtctgagtttacagtgaacaaaatttaaataatcttttattagtttaccacaattagagacaattgatgaattaacaatgggtgatatatgtttggatatagaatagtgtgcaaatttttgcaatcttggtgatataaagtagatgagtaaaagaggtatgatgggagaagagaaaaaagaagagggaagtgtagaggaagaacattctcatttttcatagaagagcccacaaattactgattgaagttaatggaacaaaaatagagctataagagtataatttaagccaggcacggtggctcacgcctgtaatcctagcactttgggaggccgagaagagcggattgcctgagttcaggagttcaagaccagcctgggtgacacagtgataccctgtctctactaaaatacaaaaaattagctgggtgtggtggcttgtgcctgtagtcccagctactcgggaggctgaggcaggagaaatgcttgaacctgggaggcggaggttgcagtgactcaagatcgtgccactgaacactccaccctgggtgacagagcgagactccatctccaaaaaaaaaaaaaaagtataatttaagttgtaaaaataaccaaaataaggacttaaaggacttaaaatgtgtatgtgtgtgtacatatatagacaatacacatacatacgtatataatggtagattaggagtgtagtgtgagaaattcctcagttttgcagtagagagtgaattatgttatttaaaagtgattactcaatgcatatatatttagttatatttatatgacatttaaacaatgatattgtctaaaattgatgcctcaagacatagaaacacacacacatatatatatttaaagtgatgggaccaactgttgaaaaggctaaatcaaaggaggcacacggtttttgcctctgggggtgggctttccataataaattccttgcgtttttttttttttaagcttgttaatttggaattttaagcatctcttcatggtttcatgagtacgtgtctttagctcaggttgaagtatttaattctgatctcatatcttttaatgtaaaaattagaaatcaaaaataagaatagattaacaacacatatcttcaggattttgtaaatccaaccacccccttaaaagtgaacacacacatactatgtaggacattgtctggaacgtgtcttatttattatgatgccatcttgaagtagtggaaatagtgtgaacttggggttaaagtgacctgagtttgaatactggctgcaccatctagcattgttaccttctgatgccaccatgaagattaaaagaggtagttcattttaaatgactagttcagtgtcatatagacagtaccaattaatattagctttcctcagccaatgtaaagcagcacatagtaaaggaatccagttgaatgagcacctctcatttaaatgctgaagaaaataaattgtatagactactagaaaccaacttttggaaaatagtaggtacattcatatttttgtcatgcaaaaacaaagataaaaatgcaaattattagtcaacaaaacaatgtgacaggaaaataacagttgcacctttttctctttttctaaaatacaatataatatgaatgagaataggatacctttctaaacataatttatagctttgtatgagaaagctcatttaaccacatttattaaaataaaatattcaaatatgttcctttctcattttaatactcaaaataaatgatctttctgttgtgcctcactttatttagagaaaaacatccaaaggcacatttaggaagaaaattaattatttcactttgggaatgttgtgtttaacatgatggaaagataaatatctatttgggaaggtatttttttttataataagacataagggcctaaaataaagtcagagaaaacgggatgtagaaaatgagggatctatagcttcagatagaatcttgtggcacagattcagaaaatgaaaagaaattgaaaaatcaaatgtcagtgatgcaggagaattagagaaacttagggtcacagaaactgcaggatggaaagatttttcccaagtaagtaggtaaaactgtgaatgtgctcaatagtgaagaaaaggccatagttataacgaatcacttactttttagagaagttctgtcagggtttaggtaagtgacaaatggggctgtgggagtcaatccaggaaaccacacactgctagtgagttgtccttggaaagatcaagctctaaaacaaaataaaatttaggtagctttgatagacacattttggtacaatttggtctattttccataaaatcagtgtagtaaaactgtgttagagcaagcacagagttgttgttgatgaaattgccttaatctatgtcttggtttttgaatctgctttaaaatcagtcagtgttaagcatgactccttgaaaaagcatcacaatttgaacgctggcaccactttaaaaagtaacttgttactttatcaactcgctgagttcataatttcagagtcaagagagtgattgccaaacccagcaaagatcagaggcatgaaggagtctgcctcagaagtgcctatatacagaacaaacccagaagtgccacttaactctgccacctgggcagcatactgcttcagagctgtgctgaaagacagaagaagagaaaataaaattgtgaatgtcatctttgctttggaaagcaagggctagatatttttattccgtgttttgccagaattttggtgacaaagtaaatcaatacaaatattctccggctggtttctcattcttcatcagatgaaattcaacaaatatgtgttgcgtatcttgcatgtgagaagcattctcacataaattcaatatttttaatttgagtagcgctatttaaattgtaaacttgacctatttacatttctttttaacatcagttttatatagtgtattgctctctctttttcttttctgcattctttctaccaaccaccacactggtcaaaaccaccatcatctctcacctagtctagtagtcagcactttctagtttccagtgactgaaatccaaatgaccacttagctctcctttctgctggatttagcttggttagtatgcaccctcagaagctcagattgacatgatctttagcatcagctttccccaacaagggaagattttcttccctcagcatctgtattagctcctcaaaaagaactggttttccctctttgggtatattattaaatccaggaccaatataatgatgagaaaagtggctactctgggcatccaacccctggatagaaagagtggaattagcttcagcataccacttagattagaaataggggtgagatggttccccaaaaagataaaggatgaaattaaaaaaaagaaaaagactcactctacctaaatcactagagtcatactcatttcttcacattcattttttttctcccttatcacttcctaagcaaaggcctttttgtaaaataattatgacaattatctcaaaataaaataaattttcaaaaccttgaaccaataataagaggcaatatgattatatgctccccgtatttgaagtatctcaatggattcctattgcactaaaaagctatatccaaaattctgaatgtgtttgtaagacttttttagggtagtctctgcctctccagcttttctgtgtgccaccccttaggcccatgctctccactcagccatgtgggccttctttctgtgtcattacagtgtaccatgaagttagcgggttttttttagaaatgtctcctaaacacatctcattctttcattcccatgcttactctaatcctcacttctctcccctgaacccatctttttgcccagtccacatttactgattttcagatcttagaataaagatgacttctcagggcattcctttcctgctgtattagattcttttgatatatgttgccacagtactgtgcatttcttccttctaacacttagtaacacttgctattattttctaaatgtctgcccctattttcttcgacagattattaatcccatgtggttagaaatcagttctagtttttctcaccacaatattgtcactgtccagcatagtgcttggcacagagcagtagataaagaaatatttgttgtataaatatatagggatcaacaggtgcttttacttctttgcatgtagaacctagaaccgttagctatgaaggtgatgaattatatttgaatgatcttactttggttggcttttccgaaatataattctaatattacgaggtactccatgtgtgcagagcacggtctataaacagccagtgtattttcatgttaagtagatgaacatatttcattcttgagatactttgggaggctgatattattattctgaataattaatttcagtttataactgaggactattaaattctgatcttaaagaacttaattctggttccctagctattaagcagtgattcggatccaaattagattcagacactatctgttttacttcaaaacttaaatgtgtttcaatgcctcattctctgcattgctggttcctttttctagtttaaaaattctttaacttggtcaaaaattaggctggggagtagtatttatgatttatataatttaattcacttcatttcaaaaatgtattgaatattcatgttctgtcaatcacattgctgaatacacagaagaaaacatacctcttaccatttaaaagtcttgattatcttagtttatttgaactgctaacaaaatgccataaactgggtggcttgtaaacaacaggcatttattgcttacagttctggaggctgagaagtccaagatcaaggtgctgacagatgtgatgtctgctgaggtctagtttcctggttcacagatggcgctttctcactgtgtcctcatacggtgggagggacaggcagctctctggaacttttttgtacaagggctctgacctcttgatctaaccacctcctaaaggccctacctggtaatactatgacattggtaattcagtttcaacatatggatttgaggggtaaccgtaatcttaatcattcagaccacagcaatgatatattagggaatagagaattagggaagaatgaaacaaaaactgagaggagataattagtaagatcttcaagaaaggagaggtcattgatcataaatggcaaaaaaggaaagctccaagtcttccaatagcagtcatttggagaaggtagcaaaaataacttcaggttaagataaccatccataataagatacttaggaacccgaaatatattatagtactaaaaataaacaacagcataccttggcaagattagtaagtacacataggtaagtaagaaggtgaaaaaaattgggaagatgactctggttagtaatggcttaagtttggaagaaaggagaatcagaaattaaactaggagggctactgacagttatccagccatgaagtctttggtcctggatgagggcagtggtggtatgtcttacagacacgcagactctgtgactgattagagttggaattaaagaataaaatgggataaaaaaaggtgtttggaaaattgtttttgcttaaactctatagaaatatgtgtgctatgaacagaaatgtggaaattaaatgatgaaacttgggtaagtgcaagggttgttaaactcaaatgttttcaagaaccagtcaagcagtaggcaggcataaagcaggctgagggaaggaggaaagagaatgatgggaggcaaggaggagccagttgatattcagcttcagccattgggagatagaagtaatcagatcatctgacttgccaagagaacctaaaaattcagagatactctcactttaactgttggtaaataattcattttttaaaatgttaacactgtgtgctccaaataaagtatttccatgtgctttaggtaagctttggggaatggttaatgatatctggccaggaaacaaaggcctttggttaggttctatggcattactattaattcagtggttttcaggcgtcgctcttgatgggactcaatgaattcctatttcacaactcaagaaagcaagaacaaaggaaaacaaaaccatttacatgcttttttcttgtcctttgaagttctgaaatatattgcagttttgagtggctttctaagcctttgtatacaatctcaaatggactatattatacaacctaagttactcagacatctattttttgatatttttgatacaaattcagtaacagctttgatatgtatgttttgtgatgatctgctgtatacatttagtatgctttctttaaatgtctgaaaatacaaatccatgttatataagggatactattttgtagaaatattcaagtagaaacaaatatagcacatcctctggaaaaaaaatgtatttactaagcaaacatttctttcatagaaagtattaaaagatgaactggtttgcatgttaaaagaaatggcttcctttttatatattaatggaaaatctgaaagatatacatttgagggaagaaatacaatgactttaagatcattgatttgaaaatcctgtatctctctttctgttaagtccatatttaaaaatgatagtttcaccatatgtcttattagaatctcttgactaatttacactaccttttaaatgtagctgcaactttagggacatatggttgttatggggtggaagaaattactccctatttttatgcccttccttcaaatttgggatggatcaaagagaaacataagcaacaataataattatgccagtagcaatgcctcttaatcttttccgtcaagaaatgcaagactacggagacaaatgcacatctctgaaaatttctttgaagttttatcacaaaatgtgatattttacaatctgctctataatataaatactttattatcttaaatgagttaccataaaaacaataaagtttcctatccatctcagggagttatagaacaaggtttttcctgtagttagaacagggagtcaaacatcctgggttcaattttgtcttcaccacttacagtcttgggcaagccacttacacaattgggaatgaaatagtatgtcctacatacagttgttctcccttatataattaggaagaaagcagcacttactacatagcaagtgttgctctgaagtttcactgtaacgtcacatgcagaacttagcctattgcctagaacaatattaaacccccctgtatggatcaggcaatattttatgtgaatttcaggcaactgaattttcatttcatatcatttgcagcttcttggaaattcctactatctatctaggtatcatactattttaagagttttgatgtatatacatgtatggattcaaattatatcatattttcactgattaatgaatatctcatagtaatcactgaagagaagtattcagcatagcatttaccaaaggatagggtaaagcaatatttttaggttactgctgaaaatatcattagaaatatcttcctttcgagagtagagtcgcacatatatatgagagtaaaatggtttttgagcaaccagttagtattttctattggtcaaaggaaatcccagctcaagtgctttcctcaactaaatcagattactaattatgccttttttaatgtgtagattaatatactcaaattacttataccactgcaagaagctttctagattgaaatctaaaattctgtcttcactggagtggtcttgttaagtgtacttaaaaaagaaaagagaagaatattattataatgccttgtagtgttaatggaaattcagtcttaaaaaattctgctgagtttgtcaactatggaccattcttcactcttaaaaacgcatggaattactcacctcctatagctcttacccctttgtgctgactattttctcccacggagacagatattaattcaaccttgagtttaaaaactcttaccagcaacttccctgccaacctatcagagcacagcaagatctcaaggttactgcttatgtaattacaaaagatcttattacgtataataaaagttactgttttcagcattccttttgactcactgaaacaaatcaagaggtgaatatattgaagtgagttatttttagtgaaggtggaatttgagcattcaaggtatgtactttaattcatttactctatattttttctatttattcaagtcaattcaataaatatttattgaatagcaaccatgttttagaaatcgtcctaaggaatattctgatttattaaagacaatttattaaatattttgccaccatttttcaactttttgttaaccaccaagcattctacagattccgttttctcagacatcatcatggtaaatatatgaagctagtcctgacaaaaccctgggttaaattcagcctatgtgctgttattttatacaaatcttttgcacatgcctacatgccccttttgctcatatcactcatgtaggctgtaaaggggcctgtgtttagcttgtttattgaaaaagatacttaacgttttcaatctcagacagaggtgactatctgtaattcaaggagtcatgaaagcaccttctagtgtgactctccaaggtgattgtaagtgattgctatgactgtctttcttttcaaggtgattctgcaagtgattgcaaagggcacataagcaaattactgcttgctggtttatctacatttgtcattttcttactttccgtgtagatgtcttgtttgtaggtgcaaaatattttctggtaattattctttaaaattttatgatttttaaaaattgatcatttataaagtcttatagcattatctttgaaatggaaatgagcatgcttgaaaaaatattcaaatactataaaaggatatatgactcaaagtaagtcttcttcctactctgacttcttgcctcccagttctttgctccccaaagcaactcccgttactagctacttgttttcggtttcagagataatccatacatttatgaatatataggtatctttatttttatctctgtctctctgtctcttttcaatatataaagggaaaggcataaggcataagtacttacttactatacaaatatatgtatttctccctttttttctccccataggttctgtaacatatacactatagtttctccttgacctttttaaaaattggcagcatattttaaaaggtctaatctttaaaaaaatgtatatattagtattgttgcaaaaataatagtttcacaaaatgtttgacttgcttcagtttcctttcttatcaagttttacacatacataaatttcaaacaataagaataatattttaaatatacatcctggtatagttttgattttctaaatttactgctgatttttacaaccatctactcattgtaattagatgagtgcttatatcattttctgttttactcacagtcagcctctggaagtatgctatgactattgtaatacttcatgggtgtttctaaatacccttcataattttgtgcatattcattgcttatgatttgctgtgcttaaaattttctattttaaaccacctatccatacttttggttgaaaatataatagcactaaaatcagaaaagaaaaaaattgatacatgttaacttttattattatcaataaattcatgatgataagaggtaaaactaaatgaaattttaaaactgcatttaaaaattgttttaaaacatgctacatgaaatcaaactcctatatgataatcagtggttttattctgaaggcaactttttttattgcttcataaggagataaactttatacccttcagatcgggaaaatggtggataggaggtaggactaacttgcagctcccactcggatggacagaacagtgggtggagactcacattatgagcttttgctccaagaactaccacaggaacataccagtaaaaccaaaagaattcacagaccctttgaaagaagcagcttgttgctgcaaactccgagagacagctgaaaagctgtgagtgcccaaaatgtgagatggggaaagtctacctctgaacacacatcctcaccccaattcatttcagctctagataaggttaaatttttctaggtaaggttaaatccttctaggttaaatccttcatgagagagaaggatttaaccttacctagagctgaaatgaatttagagagctgaaaggaatataaaagtagaagcagcagcaggaagagccctgtaggcacttctggcccctaaggaagcccagggaacccatttctgactttatttcacaggtgtccttggggagggctgccagtggaattggggaaaggccacagggagaagaaaacatctggctttttgtaattttgtaataatttcaacagagtgcaaattttccagggcagaactggggggttggggtgaagggagagagcacagaaagcattgtggggaggggcgaagcctgaaatcctgcttgttttctcagcagggaggcttgtagcctggggcaagttcccagctccactcactggctgcctgcatataaactcggtgctgttgagggagcatggcagtccacctcactcccctcctgctacctccactggagcaggtgctggtatccacggctgagggacctgaagattgatcatatcacaggactctgcagacacttcccagtaccagcccagagcctggtagctccactgggtggctagacacagaaataacaatcactgcagtccagctctcaggaagccccattcctaggggaagagggagagcaccacatcaaataaacacatattggacaaaagaactgagatcttttctctgtcataatctacccaaatgagaaggagtcagaaaaacaattcctgtgctatgacaaaacaaggttctttaacaaccccagaagatcacactagctcaccagcaattgatttaaaccaagatgaagtatctgaattgccagaaaaagaattcagaaggtcaatttttaagctactcaaggaggcaccagagaaaggtgaataccaacttaaagaaattaaaaaaaaaagttataggatatggatggaaaaatctccagagaaataggtagcataagaaacaatcacaacttatgggaatgaaggacacacttgtagacatgcaaaatacctggaaattctcaacaatagaatcaaacaaatagaagaaagaatttcagagcccaaagacaaggatttgaattaacacaatctgataaagacaaagaaaaaagattttttttttaatgaaaaaagcctccaagaagtttgggatatgttaagcagccaaacctaagaataattggtgttcctgaggaagaagagaaatctaaaagtttgtaaaacatatttgaaggaataattgaggaaaacttctctggaggtgctagagacctaaacattcgaatacaagaagctcaaagaacatctgggaaattcattacaaaaggatcattgcctaggcacatagtcatcaggttatctaaagtcaagaagaatgaaagaatcttaagagctgtgagtcaaaagcatcaggtaacctagaaaggaaaacctagcagataaacagcagatttgtcagcagagaccctacaagatagaagggattggggttctatatttagcctcctacaacaaaatgattatcagccaagaattttgtatccagtgactaaggttcataaataaaggaaagatagtcttttccagactaataaatgctgagagaattcgccactatcaagccagcactacaagagctactaaaagaagttctaaatcctgaaacacaaacctcaaaatgcaccaaaataggactttcttagagcatcaacctcacaggacctataaaacaataacacaacaacaacaacaaaaacaaggtattcaggcaataactagcatgatgaatagaataatacctcacctctcaatactaacactgagtgtaaatggcctaaaggctctacttaaaagatacagaatgggagaatggataaaaattcaccaaccaaatacctgcaatcttcaagagactcacctaacagataaggatttatataaacttaaggtaaaggagtagaaaaagatattccatgcaaatggacaccaaaagcaagtaggagtagctattcttatattagacaaaacaaactttaaagcaacaacaattaaaaaaaagacaaagagggacattatataaagataaaaggtatagtgcaacaggaaaatatcacagtcctaaatataaatgcacctaacactggagcttccaaatttttgaaacaatttatagtaaacctaagaaatgagatagacagaaaacaatagtgggagacttcaatactcaactgaaagaactagacaggtcataaagatggaaagtcaacaatgaaacaatggacttaaagtataccctagacaaacaaacttaacagacatttacagaacatcccactgacaactgcagaatatacattctattcaactgcacatggaacattcttcaagatagatcatatgataggtcactaaacaagtttcaacaaatttaagaaaatcgaaattatatcaagtactcgttcagaccagagtggaataaaactgaaaatcaacttcaaaaggaactctcaaaaccatgcaaatacatggaaattaaataacgtgctcctgaatgatctttgggtcaacaatgaaatcaagatggaaatggatacagcaaaatggtgctaagatgaaagttcatagccttaaatgcctacatcaaaaagtctgaaggagcacaaatagacaatctaaggttacacctcaaggaactagagaaacaagaacaaaccaaacccaaacctagcaaaagaaaagaaataacaaagatctgagcagaactgaatgaaattgaaacaaaaaacataagataaatgaaacaaaaagctgtttctttgaaaagataaaattgatagaacattagtcagattaactgaagagagacgatccaaagctaaattagaaacaaaatggaagatattaaaactgataccacagaaatatgaaagattattcaagggtactatgaacacctttacatgcacaaactagaaaacctagaggagatggataagttcctggaaatatacaagctcctagattaaaccaggaagaaatcaaatctctgaacagaacaataacacgcagtgagattgaagtgatcatttaaaaattgccaacaaataaaagtccaaaaccagatggattcacaactgaattctattagaaattcaaagaataattggtaccaatcctgttgatactattccaaaagatagaggaaatcctccctaaatcattctatgaagccagcatcatcctaataccaaaaccaggaaaggacctaacaagaaaataagactaaagaccaatgtccctgatgaacatagatgcaaaaatcctcattgcaattctagctaactgaattcaaaagcatatcaaaaagataatccattatgatcaagcaggttttatagtagggatgcaggaatggtttaacatatgcaaatcaataaatgtgatgcaccacataaacagaattaaagagaaaaatcacatgatcatctcaatagatgcagaaaaagcatttgacaaaattcagcatccctttatgattaaaaccctcaacaaaatcagcatagaaggaacatatcttagggtaataaaagctatctatgacaaatgcacagtcaacattatactaaatggggaaaagttgaaggcattccccctgagaactgaagcaaggtgaggatgccaactttcaccacttctattcaacgtagtaccataagttttagccggagcaattagacaagagaacaaaataatgtgaattacagttggcaaagaggaaatcaaaattttgctgtttgccagtgatatgattgtatacttagaaaaccctaaaaactcatcttaaaagctgctagagctgatcaatgaattcagtaaagtttcaggatacaaaatcaaggtacacaaatcagtaacactgctttacactaacacgaccaagctgagtcaaattcagaattcaaccccttttacaatagctgcaaaaaaaaaaaaaaaaaaccttaggaatatacctaaccaaggaggtgaaatacttctacaaggaaaacctcaaaacactgctgaaagaaatcatagacaacacaaatggaaaaacatcccatgttcatggatatgtaaactcaattttgtgaaaatgacaatactgcaaaagcgatctacaagttcaatgcaattcccatcaaaatactatcattattcttcacataactagaaataaaaccttcaattcctatgataccatgaaagagcccacatagccaaagcaaaaagaataaatctggaggtatcacattacctgacttcaaactatactacaaggctatagtcaacaaaacagcagggtactggtgtaaaagtaagcatatagaccaagggagcagaacaaataacccagaaataaagccaaatacttacagccaactgatcttcaacaaagcaaacaaaaacataaaatggggaatggtcaccctattcaaggaatggtgctaggataactggcaagccacatgtagaagaatcatactggatcctcatttctcaccttatacaaaaatcaacttaagacagatcaaagacttaaatctaagacctgaaagcataaaaattctagaagataacattggaaaaacccttctagacattggcttaggcaaagacttcatgaccaagaaccccaaagcaaatgcaacataagcaaagataaatagatgagacttaattaaactaaaaagctattacacagcaagaaaaataatcagcagagtgaacagacaacccacagagtgggagaaaatcttcacaaactatgcatgtgacaaatgaggaatatccagaatctacaaggaactcaaacaaatctgcaagaagaaaacaaataatcccatccaaaagtgggctaaggacatgaatagacatttctcaaaagaagatacacaaatggccaataaacatttgaaaaaatgctcaacatcactaattatcaggaaaatgcaaatcaaaaccacaatgtgataccaccctactcctgcaagagtaattttatccattttaaccataattaaaaaataaaaaaaaaatagatgttggtgtggatgtggtgaaaagggaacatttttacactgctggtaggaatgtaaactagtacaaccactatggaaaacagtgcagagactccttaaaaagctcaaagtagacctaccatttgatccagcaatctgactgctgagtatctacccagaggaaaaggagtcatatgcaaaaaagacacttgtgcatacatgtttatggcagcacaattcgcaattgcaaaaatatggaaccagcccaaatgcccatgaaccagcagtggataaaggaaatttggtatatataatggaatactactcagccataaaaaggaatgaaataatggcattcatagcaacctggatggaatcggagaccattattttaagttaaataactcaggaatggaaaaccaaacatcatatgttctcactcttaagtgaaaatgcaaaggcataagaatgatacaatggactttaggaactttgggggaaaagtggaagggtgagggttaaaatactacagattgggtacagtgcacactgctcaggttatgggtgcaccaaaatctcagaaatcaccacaaaaaacttattcatgtaaccaaacaccacctgcttctcaaaaacctattgaaatgaaaaaataaaatatatcattcaaattaaaaaaaagtgataaacttgttctacacacaaaacaacacaaaatagaacaaacaactacctatgtgagctacttggaaacttcaatcccttttctcccctgattagttagcgttcatcctgctcaccaacactgttaacagtatttcctcccagtaatgctcctgtttccctgagctgagtacaatcaaatgacaatatgtttccaccaaattccgataacccagattatccaaatatttgaaagccattcagaatttctaccctctgtatttgcaacatccacctaccttgcacaaaaacaggatactaatatggaaaaggaaaatgctgctagttttgctgtctatacaatagttgcttaaaaatttataatttgtctccaaaattttcagatgatgagtataaagtgctgatgctataagaaacactccatattccaataaattaatgctcgtatttttataatttgacctacacaaaagcattatttgagctggttatctaatacagaaacatagtgcctattctgtagagtagaagatacttaccctaatcagagtacaaagtgcagcactcaagtctaagtttataattaaagggtgagtgggtgtggagaagcaaggttttcactaccaaagacccttgttttccaatgacactgctgcactttcagaggcatgcagacatacaaattagaaatgtgcaagctaaggttttggaactgtagtcaagtgacagagaacagagctgtgggtgagaattttccaatagtgtttgcagaattaaggtgtactaccttagcatagttagtataatcctgagtttattaccttatctcttctacttctgtaccttatcattcaaacatttctatctttcatttatccatgtatattctattgattttattaacttatgagttctccaacctacttattcaattttgactcttgtggcttgagcacagaatctaggtgttgatcacttctagttctcaatcctagagattcagagtagagacttttcatttaaaagaataatcaatcaggccaagttcaagtccttcaactgctaaagtagttgtattaaattgggctatttaatcaattttctaaacttctgcttagtcaactgtggcacaaatatagtaatatcaaatgcattgtgttgctaaagagtgtgtgtgtgtgtgtgtgtgtgtgtgtgtgtggtagtagtagtagtagtactagcagtagtagcagcaggtaaagtgcttagcgtagtgccaggaatattctctaaaatgcttgctaccattttattccagtggaattttagaatggtagttaccatttttattgttgttattgttattccataatctttattaagtcaaatggaaagcaattgacatgtccacctcaattttatgtagattttagtagatttagggatatcagctgttacttaatcagaaaatgataatagctgaaccatgagaagatgaaacataaataatacagagatattcattcaaactattactctaagttaaaatttaaatatatatatatatttgtatttttcaattactacatctcttttgtttgaggttgatattgtttccatgatgtatgtgtgtaaaatatcaaattatctatgcatgcatatgtttccatagagcttcaaaatgtctcaggtattcaagaatttttaaatccaaatttatttcttgtagcctcatgggattttttgtctcaagacatttccattttttttaacttttacaaaatattatcaatatattggcttgtgctgtggtaatagaaatttactaactccaaagagaaacagaattatatgtaaagcttgagaagttttcctcatctggaatctatggtctgaatgcagaagttcttttatttataagaaatggccagtaaaacagatagactgtatcacatagtataacattgtttactggcatgtatgagacttaaattattttgttaatgcaaattatttgagtcgactaatttttagtctgcataatcttgaaaatacttcgatgtatttagatttaattagggaatatatatatttttcatcactggtttttagttttaaaaaatactaaaagaggctaaaatacttctagggggagatagaaaaagagagagttggaagaggaagagggaaagaaaaaaatgggaagaggagaagaaaggaaagagggaagaagggagaagcaaggagagaaaagaatcaccaatttgtggttaaaattaaaaatatttcttcttgaaatacctagaatacaattgatctaaaaaaaattctttgttcatattcaattagacctggacatctgcttccaaatgattgtatcaaaaatagtggttattctgaacagtactgtaaagagagagagaaaaaaaaaaaaactcttattccagtggcaacagatcagaagcctctcctcaaaggtcataattatgaaaggtactaacagtctaatgatgagctccaagtgactaagttggttcagaaactccccagaactctaatttgtggtaaaaggaaagtgtgaagaagtcacaggccacaggcagcagatttccatccttgctaaacgtgctttcctcactcattagagattggacattaaataaaacatctgacaaagaccggggcactccatctacagttgtatataaaagagagaaccaatgaaaaacctacatgtacagtatgatgtcagatgatcaaataacaattgcattaaatggactgagaaaagctaagtcatgataattatctgaacttggacaccattcaaatagtgtctggaatatgatccatattgtaaaaatgtcaaagttcataaaccaaggaaaatgtaaatgtgagcaatacttgagtacaaatttataatcttttaaagcactcaaataccttgctatattagatatttgtcattgctctgataaattaagtgagaaagtatcatggtagctatttcattttacaagacaagctaaatgctcaaagaggttgaatcaaacagatctaaagtagtaaacaagggattagaatccaatatactgaatctcagacaagtgctctttttttgtttttgtttttttactgatacacaatcgttgtacatattcatggggtacatgtgatattttgcattgtgcatacaatgcataatggtcagattatttagaatattcatcacctcaaacattactatttacttgttctaggaacctgtaaaatcttctcttttagctatgttgaaacatataataaattattaactataatcaccctattgtgctctctttaattacagagcaattgcacctgttgtaattattttctgcatactctccatccacaggatttcacttcctgattccactgtgtagaaactggaatttctattgaggttttagccaacatgctgcacctgcccttgggataaagtctcaaaaaaaaaaaaaaaaaaaaagggaactggaaaacttatcctcttgccagttacttctaatttttacttccctccacagactgtttgtttttttttctgtttttcctttatttaacttttattttaagttcaggggcacatgtgcaggatctgcaggtttataatgtaagtaaacttgtgtcatggaggtttgttatacagattatttcattacccatgtattaagcctagtatccacttgttatttttcctgatcctgtccctcctctcaccctcactctccacaaggccccagtgtgtgtgttccccaatatgcgtccatgtgttctcatcatttagctcccacctataagtgagaacatgtggtatttggttttctgttcctgagttagtttgcttaggataatgacctccagctccatccatgttcctataaaggatatgatcttgggttttcttataactgcatagtatttcatggtgtatatgcaccacatttttttatccagtctatcattgatggacatttaggttcactccatgtctttgctattgtgaatagtgttgcaatgaacatatgtgtgcatgtgtctttataatagaatgatttatattcctttgggtacatactcagtaatgagattgctgggttgaatggtatttctgtctttaggtctttaaagaattgccacaccgtcttccacaatggctgaactaatttacactcccaccaacagtggataagttttcctttttctccacaaccgtgccagcatctgttatgttttaactttttaataatagccattctcactggtgttaggtagtatctcattgtggttttgatttgtatttctctaatgattattgaggatgagcttttttatttatatgattgttggctgcatgtacgtcatctttgaaaggtgcctgttcattttttgcccactttttaatggggttatttgtttattcttgtaaattttcttatttatttatttatttattcttttttaaattatactttaagttctggagtacatgtgcagaacctgcagttttcttacataggtatgcacatgccatggtggtttgctatacccatcaacccgtcacctacattaggtatttctccttatgctattcctcccctatcccccaaccccctaacaggctccagtgtgtgatgtttccctccctgtgttcatgtgttctccttgttcaactctcacttatgagtgagaacatgtggtgtttggttttctattcctatgttagtttactgagaatgatggtttccagcttcatccatgtccctgtaaaggacatgaactcattctttttcatggctgcacagtattccatggtgtatatgtgccatgttttctttattcagtctatcattgatgggcgtttgggttggttccaagtcttggctattgtgaatagtgccacaataaacatacgtgtgcatgtgtctttatagtagaacaatttatgtgggtatatacccgctaatgggattgctgggtcaaatggtatttctagttttagatccttgaggagatgccacactgtcttccacaatgcttgaactaacttacactgccaccaacagtgtaaaagcattcctatttctccacgtcctctccagcatttgttgtttcctgactttttaatgattgccattctaactggcatgggatggtatctcactgtggttttgatttgcatttctctaatgacaagtgataatgagcattttttcatacgtctgttcactgcataaatgtcttcttttgagaagtgtctgctcatatcctttgttcatttttgatgtttttttttttttgtaaatttaatttctttgtagattctggatattagccctttgtcagatggatagattgcaaagttttctcccattctgtaggttgcctgttcactctgatgatagtttattttgctatgcagaagctctttagtttaattacatcccatttgtcaatttttgacttttgttgccattgcttttggtgttgtagacatgaagtcttttcccatgcctatgtcctgaattatattgcccaggttttcttctaggatttttatggttttaggtcttacgtttaagtctttaatccatcttgagttgatttttgtataaggtataaggaaggggtccagtttcaattttctgcatatggctagccagttttcccaacaccgtttattaaataggaaatattctccccattgcttgtttgtgtcaggtttgtcaaagatcagatggttgtagatgtgtggtgttatttctgaggcctctattctgttccattggtctatatatctgttttggtaccagtaccatgctgtttttgttactgtagccttgtagtataggttgaagtcaagtagcatgatgcctccagctttgttctttttgcttaggattgtcttggctatgtgggcccttttttggttccatattttttccaattctgtgaagaaagttagtggtagcttgatagggagagcattgaatctataaattactttgggcagtatggccattttcatgatattgattcttcctatccatgagcatggaatgtttttctatttgtttgtgccctctcttaattccttgagcagtggtttgcagttctcgttgaagaagtccttcacatcccttgtaatttgtattcttgggtattttattctctttgtagcagtcgtgaatgggagttcactcatgatttggctcactgtttgttattgttgtataggaatgcttgtgatttttccacattgattttgtatcctgagactttcctgaagttgcttatcagcttacggagatttggagctgagatgatagggttttctaaatatacaatcatgtcatctgcaaacagagacaatttgacttcctctctttctatttgaataccatttattgctttctcttgtctgattggcctggccagaacttccaatactatgttgaataggagtggtgagagatctgttctgttccattggtctgtatctctgttttggtaccagtaccatgctgttttgcttactgtagccttgtagtatagtttgaagtcaggtagcgtgatgcctccagctttgttcttttggcttaggattgtcttggcaatgtgggctcttttttggttccatatgaactttaaagtagttttttccagttctgtgaagaaagtcattggtagcttgatgcggatggcattgaatctataaattaccttgggcagtatggccaatttcatgatattgattcttcctatccatgaacatggaatgttcttccatttgtttgtatcctcttttatttcgttgagcgtggtttgtagttctccttgaagaggtccttcacatcccttgtaagttggattcctaggtattttattctctttgaagcaattgtgaatgggagttcactcatgatttggctctctgtttgtctgttattggtgtataggaatgtttgtgatttttgcacattgattttgtatcctgagattttgctgaagttgcttatcagcttaaggagattttgggctgagatgatgggattttctagatatacaatcatgtcatctgcaagcagggaaaatttgacttcctcttttcttaactgaatatgctttatttctttctcttgcctgattgccctggacagaacttccaacactatgttgagagagggcatccctgtcttgtgccagttttcaaagggaatgcttccagtttttcccattcagtatgatattggctgtgggtttggcataaatagctcttattattttgagatatgtcccatcaatacctaacttattgagaatttttagcatgaaaggctgttgaattttgtcaaaggccttttctgcgtctattgagataatcatgtggtttttgtctttggttctgtttatatgctggattatgtttattgattggtgtatgttgaaccagccttgcatcccagggatgaagcccacttgatcatgctggataagctttttgatgtgctgctggatttggtttgccagtattttattgaggatttttgcatcgatgttcgtcagggatattgttctaaaattctcttttttgttgttgtgtctctgccaagttttggtatcaggatgatggtggcctcataaaatgagttagggaggattccctctttttctattgattggaatagtttcagaaagaatggtaccagctcctccttctacatctggtagaattcagctgtgaatccatctggtcctggactttttttggttggtaagctattaattattgcctcaatttcagagcctgttattggtctattcagagattcaacttcttcctggtttagtcttgggagggtgtatgtgtcgaggaatttatccatttcttctagattttctagtttatttgcatagaggtgtttatggtgttctctgatggtagtttgtatttctgtggaatcagtggtgatatcccctttatcattttttattgtgtctatttgattcttctctcttttcttctttattagtcttgctagcgatctatgaattttgtttatcttttcaaaaaaccagctcctggattcattgattttttgaagggttttttgtgtctctatctccttcagttctgctctgactttagttatctcttgtcttctgctagcttttgaatgtgtttgctcttgcttttctagttcttttaattgtgatgttagggtgttaattttagatctttcctgctttctcttgtgggcatttagtgctgtaaatttccctctatacccaaaggattataaatcatgctgctataaggacacatgcacacatatgtttattgtggcactattcacaatagcaaagacttggaaccaacctaaatgtccaacaatgatagactggattaagaaaatgtgacacatgtacaccatggaatactatgcagccataaaaaatgatgagttcatgtcctttgtagggacatggatgaagctggaaaccgtcattctcagcaaactatcgcaaggacaaaaaaccaaacaccgcatgttctcactcataggtgggaattgaacaatgagaactcttggacacaagaaggggaacatcacacactggggcctgttgtggggtggggggagggggaagggatagcattaggagatatacctaaagtaaatgaggagttaatgagtgcagcacaccaacatgacacatatgtacatatgtaacaaacctgcatgttgtgcacatgtaccctagaacttaaagtataataaaaatgtatatatataaaataataataaaaaataaaaattaaaagttaaaaaaaggagtggtgagagagggcatccttatcttgtgctggttttcaaagggaatgcttccaggttttgcccattcagtatgatattagctgtaggtttgtcataaatagctcttttttttgagacatgttccatcaatacctagtttattgagagtttttagtatgaaagggtgttgaattttgtcaaaagccttttctgcatcttttgagataatcatgtggtttttgtcattgattctgtttatgtgatggtttgcatttactgattcgcttatgttgaaccagccttgcattccaggtatgaagccaacttgattgtggtggataagctttttgatgtgctgctggatcccatttgccagtattttattgaggattttcccatccatgttcatgagggatattggcctgaaattttccttttttgttgtgtctctgccaggttttgctattagggtgatactcgcctcataaaatgaattagggaggattcctgctttttctattgtttggaatagtttcagaaggaatcctaccagctcctttttctacctctggtagaattcggctgtgaatccatctggtcctgcacttattttggttgacaggatattaattactgcctctatttcagaacttgtaattggtctattcagggatttgacttcttcctggtttaaacttgggagagtgtatgtgtccagaaatttatccatttcttctaggttttctagttttttgtctagaggtgtttatagtattctctgatggtagtttgtatttctgtgggatcagtagttatatctcctatatcatttttattgtgtctatttgattcttctctcttttcttctttgtctgtctagcagtctattttgttaatcttttcaaaaacagttcctggattatttgattttttgaagggttttttgtgtctctgtctccttcagttctgctatgatcttagttatttcttgtcttctgctagcttttgaatgtgtttgctgctgcttctctagttcttttaattttggtgtcagagtgttgattttagatcttttctgctttctcttctgggcattcagtgctataaatttccctctacacactgctttaaatgtgtcacagagattctggtatgttatgtcttcattctcactggttttacagaacaactttatttctgccttcactttgttatttacccagtagttattcaggagcaggctgttcagtttccatgcagttgtgtggttttgattgagtttcttaagcctgagttctaatttgattgcactgtggtctgagagactgttgcaatttccgttcttttgcatttgctgaggagtgttttacttccgattatgtggtcaattttagaataagtgtgatgaattgctgagaagaatgtatattctgttgatttggggtggagagttctgtagatgtctattaatctgcttggtccagagctgagttcaagtcctgaatatccctgttaattttctgtctcattgatctgtttaatattgacagtggggtgttaaagtctcccactattattgtgtggtagtctaagtttcttgtaggtctctaaggacttgctttatgaatctgtttgctcctgtatttgatgcatatatatttaggatagctgttcttgttgcagtgatccctttagcattatgtaatgcccttctttgtctcttttgatctttgttggtttacaatctgttttaccagagattaggataccaactcctgcttttttttttttttcactttccatgtgcttggtaaataatcctccaaacctttattttgagcctatatgtgtctttgcacatgagatgggtctcctgaatacagcacattgatgggtcttgactctttatccaatttgccagcctgtgtcttttaattggaacatttagccaatttacatttaaggttaatattgttatgtgtgaatttgatactgtcattatgatgctagctggttgttttacccattagttgctgcagtttcttcatagtgttgatggtctttacaatttggtatgtttttgcagtggctggtaccagttgtttctttctatgtttagcgcttccttcaggagctcttgtaaggcaggtctggtggtgacaaaatctctcagcatttgcttttctgtaaaggattttatttctccttcactattgaagcttagtttggctggatataaaattctgggttgaaaatgcttttctttaaggatgttgaatattggcctccactgtcttctggcttgtagggtttctgcagggagatccactgttagtctgatgggcttccctttgtgggtaacccgacctttctctctggctgcccttaacattttttctttcatttcaaccttggtgaatatgatgattctgtgtcttgggtttgcttttctcgaggagtatctttgtggtgttgtctgtatttcctaaatttgaatgttggcctgtcttgctaggttggggacgttttcttggataatatcctgaagagtgttttccaacttggtttcattctctctgtcattttcatgtacaccaatagaacgtatgtttggtcttttcacatagtcccatatttcttggaggctttgttcattgctttttattctttttttttcaaatcttgtcttctcactttatttcattaagttgaccttcaatcaatggtaccctttcttccacttgatcgattcagcgattgatacctgtgtatgcttcacgaagttctcgtgctatgtttttcagctccatcatgtcgtttatgttcttctctaagctggttgttctagttagcaattactctagccttttttcaaggttcttagcttccttgcattgggttagaacatgctcctttagcttagaggagtttgttattacccatcttctgaagcctacctctgtcaattcgtcaaactcattctctgtccagttttgttcccttgctggtgaagagatgtgatcttttggaggagaagaggtgctctggtttttggaattttcagccttttttgcactggtttctccctgtctttgtggatttatctacctttggtctttgatgtgggtgacctttgaatggagtctttgagtgagcctgctattcctttctgtttgttagttttccttctaacagtcaggcccctcttcagcaggtctgctggactttgctggaggtccactcctgaccctgtttgcctgagtatcaccagaggaggctgtagaacagcaaagattgctgccctgttctttcctctggaagcttcatcccagagatcccctgccagatgccagccagagctctcctgtatgaggtgtctgtcagcccctactgggaggtgtctcccagtcaagggtt

SEQ ID NO: 1392 - DNA, 20001 bp, Homo sapiens
aaaactcaagcctctcctttgttttccggagcacttcccagtgcacaacctagtcccaaggttgaggactgcagccagtcctcatatataaaccctctatattaattttgcctcagttttcttatttagatcaacagcctcaataaggttggtttttaaaaaagaacaaactcatgatgcccccttttgagtctgggctcaggttttatacatggctacctttgaggcttcaggttggttatgatgatggaaaaaccaaattctgccaaaatacttaaagaagtttagtctgagccaagatgaatgatcgtggcctaggagaaacagtcttaagaagttctgagaaagtctgcctgatgtgatgaggttacagtttagctttatacatttcagggagataggaattgcaggtaaaatcataaatcaatacatgggaaatatacactggtttgacccaaaaaggcagaacatctcaaagcagaggcctacaagtcataggtgggtttagggattctttatttggcaattgtttgaaagacttaagctttgtctaaaaacttggagtcagtataaaggaatgcttaaattaagataaaaaggtctgttatctgttatgtgatgctacacacaatcaggttggaaagtaagccacaatataatgagtcaaaaaaacctgtttaacaagatttatggtttgtaaggcatgactccccaggccccttagaaaggaatttgagcaagaaaaagaaagggtcagagttcagtcctcagttaactgcttagtgtatgaaataccatgatttttgagctttcatcatagaaacatctttggtggctgaagacagccttccaaacatgcccaccctctcacttgggactgaacctacctgtagtcaaggctcctcgatcctttttcccatttttgccactgaggttccatttttgttactgcgtgatgccaccccagtttggcaacttcagaaagtacaagaaatcataagattatgagtcccatggagcagaaaatagccatcattcccctttgtgatcctggaagtgtcttacccaggaccaggtgtgtcaagtatatatttgtatgctgaaatgaattgagtggaatcacaattttctttttttttcctgtttggactagtcaagttcagtaggggaaagagtagaaaaaggaattcaatctgtaactgaccgtgaacaatcaattaagataactcactatcttcactccagcccacaatcttctaaactatggctattgtatttactaacagatttactttggcccagaattttttcatccaaataatatttttgatctctgtgagaactgaggtgaaatcaaggaaaccctcatgtattaaatctttaaatatattcttttaatgcaaagtaggggtcaagaggagaggcataggttgtgggccttgtcccagcaaacaaagccacaaaggcattcactttattcaaataattttttttctctatgataactgaaaaaaatcaaagaaagcttcatatattaaattcttaaaagtaagaattgttacattcttactttaaattcaaagtaagggtggcccagaattttataaggagcctgtaactcaggttacttttgctttcagatccaaggtgcatggtcccatcacaggtaaactatctactcaagttcctgacccttcgcaagtccatgacaaatgatactggaatgttttggcaactgagcgtgattacctagaatcttggccggcaccttatgtctcacctttctacactgcaaactcctaactctctagtttataaacctatagtcaggatagttttctggatcttcttacttccatccttaaactcccgctttactgctccctacatgcccaacatatgcttcttgactgtctaccagcaacttccttcaaaacaaataaaactaaactaaaggcagcacaggctaaaattactttttcgatggttctcaaccttggccacacaggaggatcatttgcagagatttataaaaaacctaacccccgcccccccacacacatattcagaacaattaaatgagaattcctaagggtgacccctgagcatcaggttgtttgtttaaagctccccagagtagtctaaggtgcagccagttgagaactactgttaggttgctgatcagtggtttttgtatggaaagtcagtgcttgcttaacatgtctggaaaaacctaattgactgcttttgttttcccttctacaattctacaattgcattttcctaaaaggctaagattcctcattggttatgtacaggttatggcaattataggaatatttatcctgtaattaagaataaaatgaaacaatttctgtgggaaattacattgtactgtatagtaaattatacttttcattgggaaattatgaaataagattttggcattggctaatatagtgtttaatttttgaaactacataattaaaagataattagttgaataggtaataccttggcaaattgcaatgattaaatgattgcttccataatgtaaattaccttccaccatagtcagtgatctaaaatattgtctaaacatgtagtggcattttaaacattagattattttatgagtaagtggcctatgttggttaattgactccccgtaatcaattgtcagctgcactcgagcagtcaaccagagttgcaagggtctgttgggatttctgggtctcagctgagcaggttggtgtcccaatcctaagtaacaatgcaggggctgcaaagacgacagtgaaggtgcttgggtctcattgttggtgtactagatattgtctttgtttctaaaaaaaaaacctccaagtctcagtttcttcattagtgagaagggggataataaaaccaccataccggattgttcatacaatatgcatagtaataaagctcttagcataatacctggcatataattagtgctcaagatttctttgcatcactgcttttttttttttttttttttttgagacagagtcctgctctgtcgcccaggctggcattcagttgtgcaatcttggctaactgcaacctctacctctcaggttcaagcaattctcctgcctcagcctcccaagtagctgaagttataggcgcctccaccacgcccagctaatttttttgtatttttagtagagatggggttttgccatgttggccaggctggtttcaaactcctgacctcaagtgacctgcccacctcctattgctttaggccctttatttggctggccatagagaagacctgtggagatacatgggcattggtaatgtcactggattctggatgacagttctcgagggtgcaagatgaaatggcaggtaggggcgaggcaagtttatcaatatgagttcctcctccattgaggagggctagggaactggagcaagtctgagtctgtagggagaggttgtccttgtattcacattgagagagagcctcaattccacaaagctaggtttatagatccaaacccaggaagtgatgccagcagatgtaacagtggaattcaaaccaatttaacaaatatccctatataaatttgaagtctattttctgctggctgtgtttttcttttttgcaaagtttgtgcttcctgactttccctttctctgacattacacacactaactgaaattgagccagatgctctgcatccaagcagagaagagtgaggtaccttattgttgtatcacagaatttcggactcaaaaggctcatctagagttgtgcttttaaaaatgggttcgcatctcctggattccacagaagagactcagaggctaacacagtggaaggggagaggagagcatgggatcaaacggacagggctccacatgccacccaccctcttcaaattaaggaattccactttgctctgttttttatgttagggtttttaaaaataaaattccacttgcaaataaggattctaatccaaaaagaaaaagaaaaaaaccttggcaaaccagagaattagttaactcttccgttttataaatggagcttagagtggtaaagtgccttgtttgaagttacacatttaaaaaataggagaagtaggactggtaattagtactgctgattttcagtctaaggacatatatctcttatatcatattgcctcttaaaaggtaaagaaaggcaggttggacccatgacatatcttctaggccacagctctgaacacattgcaagagaaatattcaagcaaagtgaaaggaaagcagcacattttcagcatcttaatagtgaagctatcatactgaaggaaaccatatgagaaagggatatagaaagggcacctcttctcttcatttccctctaacactggaagcttctattttactgtcggttatgcaacatgatttggaaagcaccttggaaaccatataaagatttgcatgtcattactagaaatgggtagaggaccctgtaccacatcagtttcatggcagatccttaggataatgttagaaagaaactcaagtagatacgtttctcagtactgaagcttagaattccttatttgtggtatctcccttgtctggtacccagttgtagtattaatgggcatcaatatctgccaaaagggtgtgccttactcagaggtgtttactggaatcctgtgcttcccaccaaccatactccatgctcttctcctttgtctataaccctagctttagttatcgtctaccctggtagtctcagctcaaattatgatatgatttcttttcaggaatcttgatttctagcttgtgaggtctctcttacttcagcatcctccaacatcaccccaataaacctaccttcaattaacatacaactaactaaaacagagtgttttgtccttgccattcccagttccaagcagactgctcttcataagtttctctgataaaaaaattttgccactgccaaagagaagaaatctgctatatttgtagtgcgggtgaaaggaatgggtgttgaataaaaagaacagggcaaagcatctgcacaagtaaaaagaaaagcagtcaatttaaacagagaaataaaacccgaccactgatgagttttgagtaatcaggactcataaaattatctcactctctagttcattatggctgtggaggtaaagccatggaatcactcctgggatggtattgctattggaggccagaacacatagtaaatatatatcctcattagtgccaaattgcattagggaagtttgcaggttgctactgctaaatctccacctagattattctttcttaattcaatgccactcaaaattattcttctaattgggaatgttagatattatttgtgtatgtgtgtgttttgtgtcaaaaggaataaaatacagacaaaaggcaatcatgttgtcaatgagaagtattcaatataatatggttttggttgttttaacattacaacctaactgacctgaccttggttattagaacagttgaatagacatatataactctgatttcacaagaggatacaagaatcattaaaacataaaatatgtgcatacatcatctaactacctctctgtagttaaatgtaattgcagttttccagcaaagaatttgtggagaattaaaatgaaaagaaataaaggcttggggaaaatagcaacaaatggatggaaaatatgaaattaattatctctatctgaaaaatctgtttcttataaagaattagagatctgttgcacttcagaattatttacatttgagaaaagttctcgccgtcagtggaagaacattacatgaagaggtatctttgggcacatgagccatctaacatagagttagaagagtccaaagagctcatcctgcctggtcgtctgtgtctaaccagatgactacctcaactacttgaaataaagtggttcttgtctactttgcaagatgttttttcttttccttttttcttctaaaaataagcaaacaacaaaacagagggtcaagatctgtttctctctttgattcctaagatttgtttaaagaaaactttgtttcagaaattacatatttcagacacagttttaggtctattttgttctattccacataatatcgatactaagacaatgattgggccagcagcattttactaaagttttcccaacgacattaaccaatcaattaaataattaattttttttgagacagagtcttgctctgtcacccaggctggagtacagtggcacaatctcagctcaccgcaatctccacctcctaggttcaagtgattcttatgcctcagcatcctgagtagttaggactacaggcatgtgccaccatgcctggctaatttttgcatttttagtagagatggggtttcaccatgttggccaggctggtctcaaactcctggcctcaaacaatcctcctgccttggccttccaaagtgctgggattacaaatgtgagccaccacattcagctcagacattaatttagcttgatatatatatatggattaattaaaggaggattagtcagaatagaaagcactgaaaaaggaaaattacagaagaaaatctgagtggtgctcattcagttgccatccagaggaaaaggaatcttagttgtcaggcctgaactactcagatcacattgagcatcttatgtctgttttgagaacagtatatcaggatgacttagcttgtagtcattaaacttgaaatttaattggtcccttgttctgattcaacactcaggttccaactgaggtacgaggggagtcggtgggcaagtggttggtagctgaaaaaacactcaaagaattgtagacagtttcaacatggctttactctctctctgggcacaagcgagccatatgtgcagcatcagcaaggtataccttttacagacaatagtggctctgagccaaacacgagctcatgtgagttgttacctaatgtgcctcatgtggtgtggttacataacgagcaaggttgtgtgcttgcactccaaacccactgagtcatgctgcaccagaaggctgcctcagcctactcctgactaaagcacagccatttcccttacactacaccccctaggctgagggcgtcctccaggcagggacacatgcctatatggcggagccctgagtccataacccacaacaacaatacagagagcaacagctcactactaggatctcagctatgatacttatgactattagggcccaatgtacgccagaacctagggatgctcaccatctctgcagggggttgacagtgaggctctcagtcaccttaatctcctggaagacccctttgcagggctgctgttatgttctgctgattgtcagggataaggtacaacattgtgttcctaaaagggcacaggtggctccttgggcagcagttatgtctaaggccacttggttttgcaacaccactttttgatctgatcaacctcattcattaacaggaggagggacactcaggtgtaattcagagcctgagcggtgtgctccgcaagagcagtaaattgtgcttctacagttttgacacctgctccagggatagtcattgccaaagggtagaaacaccagggggctcatcacattcgcaaaaactgagagcacagtgcctcccagttatacaggcatctgggcaatgtggggagaacagtagcaggtacataaggccacccccagatacaacatccactccagtttgctgataggaaaggctactgtgtcctcatagacccataagctcccaagaggcaaaaagtccattggggtccgaccttggtgaggccacttgttccaccataccttcagtgtggtgacacatgttatgtttgcacaggccgtgacaggtacccatcctgttaccccaatgttgctctgtgcactgcaatgcctgggcttgggctactacatgttcccctactagccagccccactcatcacgaatgctacggtccagccatgggtcttgctgtgtcctttgtccaaagcttgccacattgtgttccaggcatcagccatgggatctcaagtctccaggcatgtccagttctctgcagacacgggatgtatgtgtcagggaaagctgtctgcagctgctgctggaaaggcagtgcaggtccaacagttggaaacattggtcacctcagcataggtgtggggtcagtccacaatgcaattggagcatgttaacctacggttgaaatgacagagcaggcacaggtactaacagaggtaaatcacatccctcaggcaaaatataggctaactttccatccctggataacaatgcagccaccaagggcttttgccctgggtgatggtaccacaccttctcaaatctccatggttcctttgaatcctgtatccatgccaaagtcacagcgtagctcataataggcccatcagatagtacatatgtccctcagaggagggctccttccctggctgttcctctacaaacagtcaaccttggaagccatgtattgaacactcaaaaagtgacatgcaagtcatactgtaggccctccccacagggagctatgatggccaaccaccagcagtggagagcttggagggtccatggccacagccaggttttctgttcccctgccttcagggttgttggggcaggcaacaacaggttaccatttgtccccatacctgatcggaggaggtcatccttggtatgtatctccaattgaatgggggtggtggcctagtgaaacaaagcctccactggggccgggccacctttctgtggccattcatttaaggtttggagcaccaggtccagcctggaactccagctccgcaaagacaggggtttgacatgcaagcgtaatccattcttcaagatcccattatatcattcaataatacctcagcttgtgggctgtatggcacatggaatccccactttatgtccatttgctgtgcccatcattgtacctgttgtccagtgaaatgtgttcccctatcactctcaatggccagaggacaaccatacagggaacataagtgttgcagggcctggatggtgttctgttggttggccaccctgcaagggtaggtgaacaacaggcctgtggccatgtctacagccgttagtgcatgcgtataccctcgcgactttggcagcggcccgatgtagtctacttcccacctggtcaagggcactcaccctattgttacttgttgtataacaccgggcagctgcctctttttaggatatgtctgaacacatgccaggcatttctgacaagcctcacaaatgtcttgcttgggaagggacagaccccaacacttattgaattgttgcatcagtttaccccctgcatgtcccagtttccggtgtagccacaaggtcacatcttgtgttggtgctgactctgaccatctgaccttagccaaggcatctgcctcatcattactaggggtggccaaaggcatatggcctgacacatgataaatagttacctctttttgatgacctatttcccaaaggtcttgccatatggcttggcctcaaatgggtctgtggctcactagccaattctgtattttccaagtagttaaccacaaggttaagcctcagtagactgcccagctatcagtacagattaccacaggtgtcacctccttggtgatcaccatccacactgctctgagttcagcccattggctactttgtccgcacccagtttcaaaccatatggtgtcagtactaggttggactgcaacagtggtccaggcagcagtagcacctcatctactgtgtaccatgccccctcaggaatcctgggatgcccttccttaaatggtgaagactcaggatctaggggtgcctcaggccgcatggccttatcttgcattaggactacacgtcccaagacctcttgcaactctgctgctatgggacttgtactcagcttactccactgctgcaaggagttgccccattttgccaaagtggacatctgtgctatcccactccaggtggtcattacacatagacgcatccatcctgttattgggtaagttgtccatatgatgactgcagcctgtcctgtcatgctctcatgagcccgaaggccagcatatacagctgctagctgtttctctatcaatgaataccggagttcagctcctttccatagttgggaccaaaagcctactggcattcttaggcgctctgtgcattgccacaagcctcaaccaaaaccgtctgtggccacatgcacctccagctcaaacaggtgcccctggttaattacttgtagggcttgtggctgctgaatagcgcacctggctgccagtaaggcagtctcagccacaccatcccagtcccaggcaagagaggcattactgcttctaaatctgcaagagaatcagaggttaacataatatcatcaatgagattatgacatatggtgcagctgtgcatatagccctgtggcaacactgtgaaaatccattgtcgctgtcccataaaggtaaagtattcctggctctctggaaaagaatgcattagccaagtctaccacatagtggtattgttccaattccatcatcgagcagtctatcaaatccatgatagatgagacagctgccaaaccttgtgaaacactcacccccagaatgtattcaggagagacatacacagcgcataagcagggagccaaacggtgatgccaaggtatagagatacaggtttcactttcactgaccagctgccataactgtcaatgtaagcaggtttgccaagaaacttatccgggttcccataaacaaggctgcaatctgtgccagtatccaccagcacccgctgtacatcggtgggggactggtggatcactaattccacatgtggcctccagtcatttagtgtccccgcaagctgggcaccttggccagttccctaatcaagcaaaaaaggctctacatttccacttggctgcagcaagtcatctttgaactgaagcgcctgggtgggaccaggttacacagcaatgtccttctcccccttgggcattttctggaattgctcctccagagacaactgtctccacaaagttaaaagcacttcattgggttgcttatcaattttctctcagtcaacccggccaaaataaaatctatacatgtctgtgagtgtgtcactcgttggcgccccctttttaccatggggggaccccctgtgggtggggcatcttccccttctttacagcatggacccctcggtcctgccgatggccttctgcttccctgagagtcaccatagcagtggtcacttcatgtatgtggtaccctatgtacaggttgaggacagtagctagggagtcaaaggcactcaggggtgcagaacccaacacaagattctcccatgtggtagctgaagcattcatctcctggtccctgggtattcaggtcaaacatagcctgccgcatacccgtctcccgaatgacttgcaccaaatcacatagactggtatttactcacggtttgggtatttcaccagcgttgttccacacagtctgtatggctgtccatagccactcaatcaggatgtgatcactttgcccttgtgccaactgcttgttcacctgcaaccactgacagagggaggggtgagtcgtgatagaggccagcttttccatctcagaggcagaacaggagatactatctgctctcttgtctcacaaatgaagcatccaggcaggtagacattcccctggatgctggcggcactgcttgcctaattcccacaactcagttggggtataggcagtatatgaagtatgttgcattacggtgggtgggggggggtccctgagccttctcttggggccccaacagctgttcatgatctaccttctggtggaccactgggtgagcccacaacaagagttcttctttctctgtatcagaccaagtggggatctctggctgagacaatggacccatgcctacattcacagcagcctctaattccttttccaagctctgtagctgggtttccaggtgccccacctctgcctgaagggcgcttacctgcactgcatccctcagggactgggtgtgtgcttctcatagcacagtcaaaatgcccatccaactctaccagcaaaagctcactccttctcagtgctctgtgcttccagcagcttcagagccttctccatgcttgcaggggacccatctatcgccacccaggtttccaccaaagcccatccaaacagcacagctgctaccaggtaccacaacccacgctgcagcctcatggccgacccggaatcaggggggaccaaagggtcactcacctcaggatcctgttcatgagcccaattgtcatgttctaactgagatctgaggggagtgggtgggcaagtggcaggtagctggaaaaacactcaaggaatcgtagatagtttcgacatggctttattctctctctgggcacaagtgagccatatgtacagcatcagcaaggtagttgtaccttttacagacaatagtggctctgagccaagcatgaactcatgtgagtacttacctaatacacctcacatgacgtggttacgtaatgtgtgggggttgtacacctgcgctccaaatgtgctaagtcatgctgtgctggaagtcccagcctactcttgactaaagcacagccattccccttatgaatatgtatcaagataacttctattattaatatttgaatttccatgcagtgctgcctgcaacaagaaaataaacattactccaaacaaagaataaaattctaaattggagtcttacctagaacttaaatgtaggggagagcaacctccagaaattcttttggctctgggtggtgcatgggaaacagctgataccagtcccactccctaactgtaactgatggttccaaagctccccacctggctgggggcatgtgcaaatgtgcctcagggaaccaaacactaaactactcagccattaagtctctttcagtcattactctctttcagggagtacacctctgaggtgcccctagagtgggtgagtgcccagagttggtgaatcctacagatgaggaaacacagttctagcaattactgagaacagatgtgcctctcagtcttagaaggattgagtcctcccaatgattgagattctctacctataaagtcaccagacaggatctgcaaagggaggggtccatattaatttcagatacgtgtgacggtatgtctgaaagagacctagaatctatttttttcatccttaagattttatacctttatttttttattttttatttatttttattttttgagacagtttcactcttgttgcccaggctgaagttcaatggcatgatcttggctcacttcaacctctgcctcccgggttcaagcaattctcctgcctcagcctcctgagtagctgggattacaggtgcccgccaccacacccagctagtttttgtatttttagtagagatggggttttaccacattgaccaggctggtcttgaactcctgacctcaggtgatccagccacctcggcctcccaaagtgctaggattacaggtgtgagccaccatgcctggtctttatacctttattaattttaaaattttaaacttttttaatttaaaattttatacttttaaaattagatttttaattttaaatctcttattatgggcaggggaggggggttgtttgttgggagagtatttgccattaataaaggtggattagctgggaacttctgaatggatctgtttcaattccctgacaaacaggtgttgatttacttctacacttaccgtcctcctaccaagatgcatgctttctgtttaaacatatggtcacactttgatgtttttttggctttcacttatttattttcatttatatcctgtcagagttaactatctccagggaatattggtagtgtgttcaatggagagctagagaatggctctggagaaagatgtgtttaattaaattaaaaattcgctaacacatgcctgtgtaaaaggggaccaggtaatgcagactgcttcttgctgaaacaaatttgggacaatttaaatctgtttctacttagggccagtatattatagttatttattctgcttactgttctggggttgatatcagtaaagagggagaaggaaagccaagaaagagaaaggaaaagaagactgcacatgcccatgtcagaatgtatgatatattcatttaaactgcactatataaaactatagaggtatcagaagtgtctgatgaattaacaaatgcatcgataccttttcagcatctaattattatgtggtcttaatatttttttttaaagtttgacacaaaaaattattataatgctcaatttcttgatagcaaaccacactggtaaccacactggtaatcaggtataaattgaaactcttgtcattcaagtctgatggatgctacggtgtgctgcccagataccaccttcagcaggagactcttagtaccacagctgtcccaagtgttgaggattgctgatggcacggctgagtttcttctcagggaacagcctatgactggttcacagctctccatggaataggatagatactagccactattgtagcagtaccacagtttaactctccccaaactagtcctccacctcttactttcttacaggtgttgttcctgagagcactccccaataaaccttggccacgcataatatctctaccttgcagtctatctagagaacctaagctgagacggaagcataggtacatttgataacatttaaattttttgtatgtgcatttttaagtgagatgggtctagcatagcctgtgaggctttggaaacaaaattaatctggcttctaaattgaggggatttttccctttttcttccaatggcctggaaatgtttgaataacattggaatcatctgttctttaaaaattaaacccatctggtctttgtgccttttttcatgatagattcttaatcaccagcccaacatcttctacagtgattgtcaatttaaggtaatttatattttgttaggaaatcattcacttcctctgtgttttcaaatttgtagccatggaattgcaagcagcaacctcttataattctttgaatcatgtctgtatctatgtttttgtttccttctcgtttgtaaccttgcatatgtttgcaagtgacctcttgtgcttgccatgtgcattctctctttaatcaggttcacagagagtttatctactttattggtctcaaaaaaataaaaataaaaacagctttcggatttatttatcccttctgctttattttggcttgttttggttttctactttattaatttcagcttctattcatattaagccaatcctttttagtttctttcatcattcgtttcccaatttctggtgattcgttttttctcttttacctttaataacaaagacatttaaagcaataagttcattttgagtgtagattttgctgttccacttcattgctttctcagtagttggtaatttcacattttattttttatttttttgattaatcgattaactttccaaaagttaaaacttttataatttacacttcattttattgaagtgtgattaggaaaataaccctaaaaacacacatttttctttattttatttttggcaactttaatttgtcaaggtttcctttttggccaaatacaggattaattttgtaaatgtttcttgaatcaatgggagaaatacagtaaattgaatttactgatttgtatactagatgtatttaactctgggagacatatgtttaattctctaattgtatcaagttctccttgcatttttcatatttttgctttacatgcatactttggaaataagcattatgtctaaaaacagcaaggtatgtaccttaatttaaaaatactttattgctaaaaaattctaaccatcatctgttccttcagtgagttgtaatctttttgctggtggagggtcttgcctccatgttgatggctgctgactgatcaggatggtggttgctaaaggctggggtggctgtggcaatttcttgaaataggacaacagtgaagtttgctgcatcatttgactcttcttttcatgaaagatttctctagcatgtaatgctgtttgatagcagtttacccacaatagcacttctttcaaaattggaatcaatcctctcaaaccctgccattgctttatcaactaagttcatgtaatattctaagtcctttgttgttatttcaacaatgttcacagcatcttcaccaggagatcttgtctcaagaaactactttctttggttatctataaaaagcaactcctcattcattcaagttttatcacaagattacagcaattcagtcaaatcttcaggcctcacttctaattttagttcttttgctatttccatcacatctctagctgctacctccactgagtctggaacccctcaaaatcatccatgaggggtgttggaatcaacttcttccaaactcctgttaatttgatattttgacttctacctatgaatcacgaatattctctttttttttttttttgagacagggtctcactctgtccctcaggctagagtccagtgatgtgatctcagctcactgcaaattttgcctcccaggctcaagtgatcccaccacctcagcccctcaagtatctgggattacaggtatgcacaaccacacctgcctaatttttaatagacatggggttttgccatgttgcccaggctggttttgaactcctgagctcaagcaatctgcccacctcagccttccaaagtggaattacaagcatgagccactgcaccctgccacgaatgttctcaatggcatttagaatggtgaatcctttccaggaggttttcaatgtgctttgcccatattcatcagaggaatcactatgtatggcagctatagccttataaaatgtatttcttaaagaataagacttgagaattagaactaccctttgatctgtggggtacagaatgaatgttgtgttagcaggcatgaaaacaacattaatctccatgtacatctccatcagaacttttgggtgatcaagtgtcttgccaacgagcagtaatattttgaaaagaatcttattttctgagcaataggtctcaacagtgagcttaaaatattcagtaaaccttgctgtaaacagatgtgctgccatccaggctctgttgctccattgatacaacccaggccaagtagatttatcataattgttaagggctataggatttttggaatagcaaataagaattggctcccacttatagtcaccagctatattagctcttaacaagagtcagcctatccttcaaagctttgaagccaggcactgacttttctcctctagctatgaaagtcctagatggtgtcttcttccaagaggaggctgttttatctacattgaaagttgttgttgtttagtggagccaccttcatcaatgatcttagccagatcttctggataacttgctgcagcttctccatcagcactctctgcttcaccttgcacttttatgttatggaaatatcttctttccttgaacctcatgaaccaacctgcgctagcttacaacttttcttctgcagccttttcacctctcttaaccatcacagaattgaagaaagttagggacttgttctggattaggttttggtttaaaggaaagttgtagcggtttgatcttctgtccagaccacttgaattgtctctattacggcaataaagtggtttcactttatcactcatgtattcactgcaatagcacttttaatttccttcactaacttttcctttgcattcacaacttggctgactgttacaagaggcctagcttttgggctatctgggctgtcaacatgccctcctcactaagcttaatcatttctaacttttgatttaaggtgagagaagtgagatgcttccttttgcataaacacttagaggctattgtagggttattaattaacctattttcaaattattgtttatttcagggaataggagggcctgaggagaggcaaagagacagggaaagtgctgttcagcgtcacatgggcatggtttgtggtgccccaaaacaattaaaataacctcaaagatctctgatcacagatcacaacagatataaagttagcaagattgtgagaattaccaaatgtgacacagacatgaaatgagcacatgctgttggaagaatggtgtggacagactagcttgcttcagggttacaacaaaacttaaagagaagtacaataaaacagatatgcctgtatatttttgctgccatattatgtgaggcagatctccactgaagttttgggactgattgtgaagtttgggactgattgtgaagaatgcttaaatattaagcattcttgttcctataaaccacttgtcacatttgtcattccacacttgaaaatttctcactgtacattctctgaagcttctgtcaggctgttctggcccttcttttattgtctgcactttctttacctcttcttgtgcagtgttggcctgcaccctcaaaatcttattctctttgactggttaataacttttgcttcatttgctccttcccaaccatgcttgggacatcttcatttttctcattttgtcttctctccaggtaatttttctgcagaccaaaacctaatgtcaccatcatactgaaactcttttttttaaattttattattattatactttaagttttagggtacctgagcacaacatgcaggtttgttacatatgtatacatgtgccatgttggtgtgctgcacctattaactcgtcatttagcatcaggtatatctcctgattctatacctcccccctccccccaccccacaacagtccccggtgtgtgatgttccccttcctgtgtccacgtgttctcattgttcaattcccacctatgagtgagaatatgcggtgtttggttttgtgtccttgcgatagtttgctgagaatgacggtttccagattcatccatgtccctacaaaggacatgaactcatccttttttatggctgcataggattccatggtgtatatgtgccacattttcttaatccactctatcactgttggacatttgggttggttccaagtctttgctattgtgaatagtgccgcaataaacatatgtgtgcatatgtttttatagcagcatgatttataatcctttgggtatatacccagtaatgggatggctgggtcaaatggtatttctggttctagatccctgaggaatcaccacactgtcttccacatggttgaactagtttacagtcccaccaacagtgtaaaagtgtgcctatttctccacatcctctccagcacctgttatttcctgactttttaatgatcgccattctaactggtgtgagatggtatttcattgtggttttgatttgcatttctctgatggccagtgatgatgagcattttttcatgtgtcttttggctgcataaatgtcttcttttgagaagtgtctgttcacatcgtctgcccactttttgatggggttgtttgtttgtttcttgtaaatttgtttgagttctttgtagattctggatattagccctttgtcagatgaatagattgcaaaaattttctcccattctgtaggttgccttttcactctgatgctagtttcttttgctgtgcagaagctctttcatttaattagatcccatttgtcaattttggcttttgttgccattgcttttggtgttttagacatgacgtgcttgcccatgccgatgtcctgaatggtaatgcctaggttttcttctagggtttttacggttttaggtctaacatgtaagtctttaatccatcttgaattaatttttgtataaggtg

SEQ ID NO: 1393 - DNA, 20001 bp, Homo sapiens
tggtgtatatgtgccaattttcttaatccagtctatcattgttggacatttgggttggttccaagtctttgctattgtgaataatgccccaataaacatacatgtgcatgtgtctttatagcagcatgatttatagtcctttgggtatatacccagtaatgggatggctgggtcaaatggtatttctagttctagatccctgaggaatcaccacactgacttccacaatggttgaactagtttacagtcccaccaacagtgtaaaagtgttcctatttctccacatcctctccagcacctgttgtttcctgactttttaatgattgccattctaactggtgtgagatggtaactcattgtggttttgatttgcatttctctgatggccagtgatggtgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtagattgcaaaaattttctcccattctgtaggttgcctgttcactatgatggtagtttcttttgctgtgcagaagctctttagtttaattcaatcccattggtcaattttggcttttgttgccattgcttttggtgttttagacatgaagtccttgcccatgcctatgtcctgaatggtaatgcctaggttttcttctagggttttcatggttttaggtctaacgtttaagtctttaatccatcttgaattgatttttgtataatttgttaaggaagggatccagtttcagctttctacttatggctagccagttttcccagcaccatttattaaatagagaatcctttccccgttgcttgtttttctcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccctgggcagtatggccatttccacgatattgattcttcctacccatgagcatggaatgttcttccatttgtttgtgtcctcttttatttccttgaagagtggtttgtagttctccttgaagaggtccttcacgtcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatccacttaaagagattttgggctgagacaatggggtcttctagatatacaatcatgtcatctgcaaacagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattatgttgaaatacatcccatcaatacctaatttattgagagtttttagcatgaaggttgttgaattttgtcaacagtctcttctgcatctattgagataatcatgtggtttttgtctttggctctgtttatatgctggattacatttattgatttgcgtatattgaaccagccttgcatcccagggatgaagcccacttgatcatggcggataagctttttgatgtgctgctggattcggtttgccagtattttattgaggatttttgcatcaatgttcatcaaggatattggtctaaaattctcttttttcattgtgtctctgcccggctttggtatcaggatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagatcctgttattggtctattcagagattcaacttcttcctggtttagtcttgggagagtgtatgtgtcgaggaatttatccatttcttctagattttctagtttatttgcgtagaggtgtttgtagtattctctgatggtagtttgtatttctgtgggattggtggtgatatcccctttatgattttttattgcgtctattagattcttctctctttttttctttattagtcttgctagtggtctatctattttgttgatcctttcaaaaaaccagctcctggattcattaattttttgaagggttttttgtgtctctatttccttcagttttgctctgattttagttatttcttgccttctgctagcttttgaatgtgtttgctcttgcttttctagttcttttaattgtgatgttaggatgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcattttgttatgtacccagtagtcattcaggagcaggttgttcagtttccatgtagttgagcggttttgagtgagattcttaatcctgagttctagtttgattgtactgtggtctgagagatagtttgttataatttctgttcttttacatttgctgaggagagctttacttccaagtatgtggtcaattttggaataggtgtggtgtggtgctgaaaaaaatgtatattgtgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttataaatctgggtgcttctgtattgggtgcatatatatttaggatagttagctcttcttgttgaattgattcctttaccattatgtaatggccttctttgtctcttttgatctttgttggtttaaagtctgttttatcagagactagtattgcaacctcttcctttttgtgttttccatttgcttggtagatcttcctccatccttttattttgagcctatgtgtgtctctgcacatgagatgggtttcctgaatacagcacactgatgggtcttgactctttatccaatttgccagtctgtgtcttttaattggagcatttagtccatttaaatttaaagttaatattgttatgtgtgaatttgatcctgtcattatgatgttagttggttattttgctcgttagttgatgtagtttcttcctagtctcaatggtctttacattttgtcatgattttgcagcagctggtaccggttgttcctttccatgtttagcgcttccttcaggagctcttttagggcaggcctggtggtgacaaaatctctcaacaattgcttgtctgtaaagtattttatttctccttcacttatgaagcttagtttggctggatatgaaattctgggttgaaaattcttttctttaagaatgttgaatattggcccccactcttttctggcttgtagagtttctgccgagagatccactgttagtctgatgggcttccctttgaaggtaacccgacctttgtctctggctgcccttaaccttttttccttcatttcaactttggtgaatctgacaattatgtgtcttggagttgctcttctcgaggagtatgtttgtggcgttctctgtatttcctgaatctgaatgttggcctgccttgctagattggggaagttctcctggatgatatcctgcagagtgttttccaacttggttccattctccccgtcactttcaggtacaccaatcagacgtagatttggtcttttcacatagtcccatatttcttggaggctttgctcgtttctttttattcttttttctctaaacttcccttctcgcttcatttcattcatttcatcttccatcactgaaaccctttcttccagttgatcgcatcggctcctgaggcttctgcattcttcacgtagttctcgagccttggttttcagctccatcagctcctttaagcacttctctgtattggttattctagttagacattcttctaaatttttttcaaagttttcaacttctttgcctttggtttgaatgtcctcccgtagctcagagtaatttgattgtctgaagccttcttctctcagctcgtcaaagtcattctccgtccagctttgttctgttgctggtgaggaactgcattcctttggaggaggagaggcgctctgctttttagagtttccagtttttctgctctgttttttccccatctttgtggttttatctacttttggtctttgatgatggcgatgtacagatgggtttttggtgtggatgtcctttctgtttgttagttttccttctaacagacaggaccctcagctgcagatctgttggaatacccagccgtgtgaggtgtcagtctgcccctgctgggggatgcctcccagttaggctgctcaggggtcaggggtcagggacccacttgaggaggcagtctgcccgttctcagatctccagctgcgtgctgggagaaccactgctctcttcaaagctgtcagacagggacatttaagtctgcagaggttactgctgtctttttgtttgtctgtgccctgcctgcagaggtggagcctacagaggcaggcaggcctccttgagctgtggtgggctccacccagttcgagcttccgggctgctttgtttacctaagcaagcctgggcaatggcgggcgcccctcccccagcctcgctgccgccttgcagtttgatctcagactgctgtgctagcaatcagcaagactccgtgggcgtaggaccctccgagccaggtgcgggatataaactcccggtgcaccgttttttaagcccgtcggaaaagcgcagtattcgggtgggagtgacccgattttccaggtgccgtctgtcacccctttctttgactaagaaagggaactccctgaccccttgcacttcccgagtgaggcaatgcctcgccctgcttcggctggcgcacagtgcgcgcacccactgacctgcgcccgctgtctggcactccctagtgagatgaaccgggtacctcagacggaaatgcagaaatcacccttcttctgcgtcgctcacgctgggagctgtagaccggagctgttcctattcagccatcttggctcctccctcccaactggaacatttcaaaggcaaggctgagataaatgctgtttacaaattccagaaaagaaaaaaaaaacaatgctgctcttctgctcagcaataggttttcccagccaagccagcacttctgtgggttgtatttaagtcttaagtgtgtcagagctgttccctgcaggcgctggtattgtccaaggggggaagtttgaggacagtgtctctgaaaactccaagcttttggatgaagcaacctttccacattaagtatgtaacataagacctggtagatatctcctatgatttacccatcatgcaaaaggactgagtctctgcaaaacagggctttcaaagaacctttttcaggagaagaaaatgttggaagagctgattcattgcctatttgcttttgacttggcatctaaactgatccctgtaaaagtatttatgggtatggacaacaaataatgaaagggatcaaaatcggaatgtttcattcagtttaacctggcccatgcagtgcacttcaggccatagactctggtttgaactctgtgacttctacgatcccttggctttgtttgtttcattgcttggaccttcagactgatcagagttctgtgagtacagtaggtgctcgataaatgcttattctgggtactaccattgatgcctgtggcagtgactgcagatgagcaggctccggcagcagtgaggtgtggggctggaggtcctggctctggcatccaaccctgctccatccgccacactagctgtgtgactttggggaagctatgaacctctgctgaactctatattagtaagacgagagtggtagtaatagcacctccctcatagggtcagagtgaggagtaaatgaaatagcctgtgtaaaggacctagtgtggtgcctcatatatgtgaaaactactcatggaacaggggagtagtatccagaatatgcaaggaactcaaacatctccacagcaaaaaaaccaacccaattaaaatatgggcaaatgactggagtagacatttctcaaagaaaacatatgaatgtccaacgaatgaatgaaaatgtgctcaacatcactaatcctcagagaaatgcaaacctaaaccacaatgagctattttctcaccccagtaaggatggctattatcaaaaagacaaaaatagcatgctggtgaggatgcagaaaaaaagggaacttttgtacatagttagtaggaatttaaactgcgcaatcactctggagaacagtatgcaggttccttaaaaaactacaaatagaagtaccatatgatccagctatctcactactgggctttatctaacagaatggaaatcattatatcaaagagtcatctgcagccccaggtttattgcagctctcttcacaataaccaagacatggaatcaacctagttgtctgaccacacatgaatggataaagaaaatgtggtatatacatatcatggaatactattcagccataaaaagaatggaatcctatcattcacagtaacatgagtgacgttagaggacattatgttaaataagccaggaacagaaaggttagcactgcatgttctcactcatatgtgtcagctaaaagagttgaacacaggaagtaaaaagtaggacagaaggtactagaggctgagaagaatccagggcagggagggataggaagaaagttgttaaaggctataaaattacagcttgataggaggaatatgttctagtgttctataccactgcaggatgtcgacaataatgaatagtttcaaatatctaaaagggggatgttgaatattcccaacataaatatataaaaaatgataaacgtttgagatgatgtatatgttaattaccctgatttgatcactatacattatatgtattgaaaatctctatgtacaccatgaatatgtacaattattatttgttgattaaaactttttttagaaaaacttgatcttatagaattagaaagtagaataatggttatcagaggctgagaagcagagttggggagaggacagtcaagagaggttggtcaatgggttcaaagttccagttagaaataataagttctggttgttctattacacactaaggtgactatagctaataataatgtattgtatatttcaaaataaaacttttaaaaaaaaacttgatctcatagaataagaaagtagaataatggttatcagaggctgagaagggtagttggggagaagacaatcgagagaggttggtcaatgggttcaaagttccagttagaaataatacgttctggttgttctattacacattagggtgactatagctaataacaatgtattgtatatttcaaaataactagaagagaggattttaaatcttctcaccacaaagaaaggataaatgtttaaggtgataaatatgctgattaccctaattgaccattatacaaggtatccatgcattgaaacatcacactgtaccccataaatatgtacgattgctatgtgtcaattgtaaatgaaatgaaacatttaaaaaagagcttagtatggtgcctagacactttaggcattaatcaatcaaataatatcaagatattattattattattcctcctcccagtagtaaattgcagtgtagtggttaaaagtaatcacttaagactcagatatttgggttagaaactggctctgccaatttctgttggcataactttgggcaaatcagtttcaatgtcctgatctataaaatggtaataataacagagaaaaactctggtgattgtagcatggtataggtaattcatagtgctgtttgtgcctggcacagatggacaagcctacaataaatcatagctagtagtaaaataaaaatcatgaaaagggtatgtttagattagccaccaatgcttaattgtcctctaaggtaataacgttatttgtctaatttcacctttccacttacttgcttatcggaaggttgatagctagggattgccagagtgtctgaactcagaggtaacttcccctgaagatcaagggctgtctgcagcccctgctggaagccggcttgccaacatcagtccttccacttggagcaattcttgtgcagtcactgatgcaaagtaatattgaaagaattgcctcaaggatgttcaatggtgattactattgatcgtggcctggtaggtggaaagactgctcagaggaactaaatgcagcgacctcagctctcacagttatttatatattggaacttggttttgcaaagtaagtcaaatgaaactgaacaacatttgcaataatccttcactgctggccagacagagaagggttttgggctaagaactgggctaaggaaccctgcaggtttgaggttagttatgagttggtgctcccttgcctacagattatttcaaaacaatgtccctacaaattactgaactggaatgtcaactcagtggattcttttttttttttttgagacggagtctcgctctgtctcccaggctggagtgcagtggcgcgatctctgctcactgcaagctccacctcctgggttcatgccattctcttgcctcagcctcccaagtagctgggactacaggtgcccgccaccacgcctggctaattttttgtatttttagtagagacagggtttcactgtgttagccaggatggtcttgatctcctgacctcaagatccacctgcctgggcctcccaaagtgctgggattacaggcgtgagccaccgcgcccggccagtggattctttcttctctggccactcttaagggactcatgtactgttggattcagaagagggcgtttaaaaattcagggaaccaccttcccctactgagctctaacactaagaaccagaggacctattcttttatgaaggtcaaatgacctttgaaaagggggacttccttttctccataaatgatattcttttcttttccaaggggcttagggccccccaagtttgaggcacaccctgccttcagtggcgtgccatggcctttgggttaaaatgcacaatatttagcaaaacagtctccccagtcatctggcccggtctggtttcctctcttacccctcccgcagtgctcctcacctgcttattctggtttaaccaggtgccttagtcagctggggctgacatcacaaaataccacacacgggaggtggggtggtagggttgggggttagatacagacatttatttctcacgtttggagactggatgtccaagatcaaggtgttggccaatgcagtgtctgatgaaatctcttttcttgcttttagacagcgccactcctcactacaccctgacatggcatctcctctgcttgttcgaggagggaaaggaacggggtgtgtgtgtgtgtgtgtgcgtttgtgtgtagattgctgtcttcctcttcctatacgggcactaatcccatcatgggaaccacacccttatcacctgatctaaccctcatcacctccaaaggccctgcctccaaatactagcacatcatgagtcagggcttcagcatatgaattttggggggacacaaacgttcagcccataacatcagggattgcaaactgtcaccttcaggggccaggcaggtacaatgaattcttgatgagagaaggaaatttaatatttcaaacacagtcatttttcattgtcactccagccagccacacaaaaccaagttcactgtccctctcttttctaagtcccctctcttccccacacccaggttcagcccaggacagctcacacactccatccccagccaggtggggccagggcctctccaacatccccaagctggggatgcttctggcaggatgacgggcctggaagccaagtaactggctgaccccggggacaaggtgaccacgacgaacgacgacacgagcaaaccaggccgcagctgatcctcctgaggctgcaggggccctgtgtccccatccgttccctctgtgcaaaaccttgactccctgaggtctcctgccccaccctgcacccttcttgctctgaatatggaggcaccttgtacttccaggaggcaaaagagccctgagggaacctccttccatttcctgctgtgaggacagcggacccctgtcgctgcccaactcctttgtcctttccccacagggactacctttcctcgagtgacagccccgctctcctcaggaactcacccctggtaaccccttctctcttctcgccacctatggccgctctcctgtgagcactcccggggcctccagctccttctctcttggcttcatcccagacacatttcttcagagttatcctaatatgctgtttccattttgtttcccactgactcttcagccgtgatgctgtggtctgaatgtgttcctcaatatcacatcttacaaaccttttttttttttttttttttttttttgaggccgggtctcactctatcgcccaggctggagtgcagtggtgcgatctcgactcactgcagcctcgacctcctggtctcaggtgatcctcccacctcagcctcccaaatagctgggactacaggtgtgtgctaccatacttggctaatttttgatttttggcggagacagggtttccccatgttgcctgctctggtctcaaattcctgagatcaagggatccactgctttggcctcccaaagtgctgggattacaggcatgagccgctgcctcggcccaacatgttgcaaacttaatccctcacgaaacagtgttgggagatggggacttttgggaatttaggccgattaatgctgttttaaagggaacttgtgggagtgggttcaggctctttcactgtcctgctgtgtgaagacacaatgttcatcctctcctaccctctgccttctgccatgtgaggacactgtaataattggcaccttgatcgggggctttgaagccttcagaactgtgagatgatatatttctgtcctgtatgggttacccaggctgtcatctgggtaatccatcaaagactgtgacactttgttaccgcagcacaagtgggctgagacatatggcgtgatttctcttcccacccctctactgactgtcatcgccaaactcagtgagcattttttagtccttatctttctaaaaggacatcttgatagagcggggactggagctcagacagtgctggtgattagggttggggtgtctccccagttgatttacagttgaggcttggacactgttttaaacttgggaggagtctcctaaccatctaaacacaaccctgattcacctggtgggccagagcagtctgcctggaagaaaaatactgagaagccagcactctcatgactattgaggtgcagggatataaaatcttgtacaaattgcgatggctctgggccaagatcaatttgttagaaacagccaggcttcctgagagaatgttccattaaggggaaaaggagtttggctgggcttgaccaggcagttctctcccttggggtctctcgtgaggttactgtcagatggtggtacagccacagaagtggctccataccacatggctggctgtgccaagcacttagcggtctcccccaacaccgtgatgtcgggttggagggactactggtttgagatagaaagtgggacgaatgctaaaactccattttaaccctgccaccacagcaccaaaaagcacatctttcagcatgctttgtggaagaaggattgcatgtttatggcaattaaagattgcaacacttttgattcccataaaactgtgtctggttacacctctgactgaacacaagggggggctatcctctgaaatagcagaaacctaactttctgtgtgcaatgacagccagagcttattcctcaggtaccacctgccataaatatacaagtccctttacctaacaaagacacagtgatattgggggttcaggccaccactagtggagggggaggagactaacctttggctcaaccttcagtggaagcagatgtgcttgaagctatttgggcaacagagttcaaggatttgacctgtgtcaacatgggagagggaaagattatagcgggacacttttggcaagctctggaaggagacgaattatggaacatgcgcaaatagagaccgatgcacagaaaagctaataacattcaggctcagggctccttccttgcatgagtcccatggcagattgtattttccaagatggcagccacaagactccagccacatgtactcttcttacaggatgaggccaatagtcctcccatggaaaggtggggtctatatgtccttccctagaatctggggagacttgtgactctcatgcagatgatgctggagtatttccaggctagactgtaaaggagaaataacttctgcctgattctgttggaagccagttgcaggcttctaggaagcccagacacatggagaagttctgagtgttttggccgatagtcacagatgagattccagcaacagctgggatcacccatgagatgtgcgtgaggaaggctttgagatggtttcagccctagccaccactgacctaagagaccacaagaaagagaatcacctggccaaacccagcagaccttcagaattcagaaataaaataattcgtcttattttaagccactgtgttttggtttgattcatcccatagcaaaagacaacttcaacaggccctttctgaggctctggaggggccctggcaatgtatccatttggtcatttgcttttgtcaaaagcagacattttagctgtaattggctaaaattctgatctctttctgccctcatgttgggtggtggtggagtggatgtgggcattttgaggatccagcaaaagaagaattgagttgagtcattgagtttgggttccatgggatttatttatgtggtatggagtcatttctgtgtatgttattgctagctgtccctgtgtaaaacagatttcagaatagtcttcacctcccttgtgctgacttacctagaggtgtaatgtaaatatgcaagaccatagattacatcacgattgtgtcacaagacatgtgcgtttgcaggaacatggatggagctggaggccattattcttagcaaactaacacaggaacagaaaaccaaatatcgcatgttctcacttataagtaggagctaaatgatgagaacacatggacacgtcgaggggaacaacacacactggggcctatcagaggttggaggatgggaagagagagagcgtcaggaaaaataactaatgagtactaggtttaatacctgggtgatgaaataatctgcacaacaaacccccatgacacatgtttacctatgtaacaaccctgcacttttatccctgaacttaaaataaaagttgaataagaaaaatagaaatgtacaaagctagaaaagagtgtagctcatcccatctgggaattaaaccaaatcttacagctcatacataaaaatagtttgataaagattttcctaagtgtgccaagaatcctgaaaactaatcttccattatcgatcatgagctatgaagccagaagaaaaatttaaatctatcaataataaaatactagagccaaaatagtttattattctcttctctcatagaatatgatattacaacattattgaagaggcaatcaaagcatacacaggcaaaaatgttggtaaaggagtattacagcaataggtcaggaatttgtttaattaaaattgctattttactgagttttatatatatttagtggtagcagtagccagagtagactttgctggagtctgggccattgagattggtattattaaggttatgttggcctcatttgctcttaccttctggcatacacaggatacatctcacttgatttctcacaagtctttggtacccatgaccactcccacctttttacaattttcacttttgctggcttctctggactcacgctgtcaattttcccctctggctaactgttctcagtcatctctacagaattctctccttctgggtctttatgttgttgaggactttatcctagggcttctttttctctctctgagcaagcttgtccacccccattgcttcaatcccacctatctgctgacaactgctgattccacatctccagctcagacctctttcctaggctctacaccaggaattggcaaactttttctgtaaagcgatgataacaaatattttatcagcttgctgctcattgtactgtctctgtcacatctgctcaactctgctaaggtagtgcaaatatagccacagaaaatggtaaaagaatgggtgtggccatgttccaataaacttgatttataaaaataagcctgcttcatgggctataatttgccaactcctgttctaaaccagaatattcaactcccttctggaaatttccacttgggttttctcaagttcctaaacataacattgtccccaggcaatttcatcttattccctcctatgtgttccttcttaatgaatgatccactatccaccagatgtccaagacagaaattcaggcagcatacttgatttcattccccacattcagtcagtcacaaaatcatgtcaattctactttctcaacatccccctaatccattcttttttctctttctccactgccttctttcaccccctctcatctctcacctcctatgacctcctcactacactgcaatcagagagatcaagccacccttggattttaaaagccttcagtaacagtagtccctgcctttctttggctgaagtctaaacttcttgaaacagagtgagaagcctgcacaattggaccatttccccatgttagccaaattcctctcatctgcctgctcctcccgcctctgggaccctgcacatatatttcttctgcttaaagaatgtgtagcaggtgaagcaactatctgaggccagtatcccatgggcagtaagaagaatttaccaagacagttgtagataaagaaaggcagatttattaaagaaagcatgaaaatatgttgcaaggcagcaaggggcaggccagcaagagaggagctgaatgccaagagacaaaggcttgctgggggttttataggatgttgcttgtgctgcgtgctgaagagggcttagtgcagtactgataacaccaaggttgcagtgggataacctgcatttttctatcagctgagggcctggtgatagctgggcacaggaagattgtgagttatttgtgcaggagggctatggtcctggaccatgaagaaaggcaaacttatagcttatctgctttctctttcttttttcctcagtgtcaccagcctgattccttttgcctaattaggacttcacagaattattctcctttctcatccttccagctgtcttctaagtctcaacttggatgtcacttcctctgggaaatgtctcctcacctctcaagactgtctctctgtgcaccactacagcaaatgggacctgggccacttcacttttacaattccagtttacagacctgcattgccccaaccccgttagaccaaagactccctgagggcaaagatggcctcttatttactcttgattccctagcacccagcacagcactaagcattgtacccactgaaagaacatctgaaggatgagcgtttatagcaaaagtggtttccactgacgttcccttctctcttccccaactttggattgaggagcccaggagctggtcaggtggcaagataagatgagaacggagaagtcattacttggggcctctgttttgctggtgttttgctggtgtgtggagatggtgggtttcccttgaatacctgggaggcaggagcaggcatgaactactccagcctctgggttctggatccacatggggtgctgctgctctctggcacccatcagtccttaaccatctggtctccagccagggaaggagcgtggtggtggagaagcctctctgtcccacccactcatcccaggagctcacgagaatcagccaaagtccgagttctgcaccctgagttaggaactctataactttagactttccctgagctttgggagttctcttaactagtgtgaaagcagttacatcatcctgggtcctcctaaaatagacacatgtatccaaatataggcacatgtattgcaaacataacatgtatgtatatatgtaaatatatacatataatttttgttttgaattaagtataaacacaacaagttacaaatatagtactgagaggtccttgtatggccccgcctccctcaggcagtatcttacataactatagttcatgattacaactggaaagttgccattggcaccacatcagaaactagtctgcagaccttgctcagatttcaccaggttttttgtgcactcatttgctttcctgaaaatattttaatgtttttctacatgacttatctccccgacatactgtgagataaggtttttttttctccgaataagcttagagaacaatgaatgtgagaggtgggaaggatgatttggtgcatctctgttttatccatggtgagtctggacctcagagcagaaggaccctcgtctctcctctggggagtcctggtgccaactcagtgcaggctgctaagttatccgggtctgactgtcttcttctctgctaaaatttgtcttaagcatgtaacacagccatgcttattaatgatgaggagacagccaatgaaaattaattttttcaaagatgaatagatatctagattttttcaagcacaactcatttaagaaaatatcacctcactgagccccaaatgagttaggtctcacttagaaagtgtcccctagtgccaggtaaagtgcctcatatttgcaatcccagcacttctggagacggagataggaggatctcatgagcccaggagttcaagaccagcctgggtaacatggcaaaaccctgtctctacagaaaatacaaaaaaaaaaaaaatagctgggcgtggtggcgtgcacctgtggtcccagctactctggagtctgaggtgggagaatcgcttgaatccaggaggttaaggctacagtgagctgtgtttgcaccaccgcactccagcctgggtgacagagccagcctctgtttccaaaaaaaaaaaagaaagaaaggaaaagaaaatgcccccgagttgattacattttaaccactgtgctaacttgagagatagtctgctatctctttacaggacatgagggctgataatcacctcattgcatggtcctggggactgatgaacaaaggctaacatgtggaaaagggcaactaaagaaagaagagccacctccaggttaattagtacaagtctcctcgctggtatgccctaatacactaaaacagcagtaaaaacaatctgcacattggcatcgaaggcacagataaacttgccgaggacccttaccacggcagagggatgctttatatgagtccttagtagattaattaagttcttgctagttccatttggaaatgatgctgtcctcttggggctatgcagagaagttcatgttgatgaaatgagctgtcctagaatggcagttcccgggcagcagagcctgggctcaaggaaggttgaaagaaggggtggcgtggagctgccaggtgcaaatgtcaggccagcaatgcagtccagcttgcatggacgtgcttcgcctaggaagttgtgacttggctgcattttccacttcaggtgagatggaaggttgaactctacctcacctcctggtgaggttgatgtttcctggtgtttataactttctttgtaaatacttgaaaggaatttaccattttaatgctggaagagacgtctattccttcttaagaggacctgagtggatcttgattgcaggccttatgctgggcagagctaaggagaattcaatttgtctccaatcttatttgaatgttctttttttttttttttttttttttttttttgagacagagtcttgctctctcacccaggctggagtgcaatggcacgatctcggctcactgcaacctctgcctgctgggttcaagcaattctcccacctcagcctccccagtatctgggacgacaggagcatgccaccatgccctgctaatttttggtatttttagtagagatggggtttcaccatgctggccaggctggtctcaaactcctgacctcgtgatccacctgccttggcctcccaaagtactgggattacaggcatgagccaccgcgcccagcctatttgaacgttcctatgcctgctacaagtgcagcagcagaatctccacacatcttgcgtgcgaaagtttcctgtagttcctttagcatagagaggctggggaaggttagagactgacttgtactctttagacatatagttgatcattgaacaacacacgtctgaactgttacacacagatttttttcaataaatgtgttagaaaatgttttggagttttgcaacaatttgaaaaaactcaaagacaaaccatccagctagaaatatcaacaaaaatagaaaaagttaagtatgtcatgaatgcataaaatatatgtagatacctagtctattttattctttactaccataaaatataacaaaactattgcaaaagttaaaatttagtaaaaattgtgtacacactcacagatcgtatatggtgctattctcagttgagagaagtgtatacaaacatcaagatgcagtattaaattgtaactgcataaatttaaccgtagtgcataccacactatggtaataatttcatatcctcctcctgttgctgttgcaatgagcaaaggtgttgcgagtatccacttaaaacgttctgtgatactcaacattccatcatgagcagttcatccccagtgaattgcgcatcacagtaaaaagtgctctctccctgttcgcatgtatttttcgtcctgtttcgtgctgtactgtaaaccttgaataacaccatgggatccaatatgaagtggcactagtgatgctggaagtgctcccaagaagcagagaaaagtcatgacatttgacattacaagaaaaactggatttgcttgatatgtaacagagactgaggtctgtagctggggttgcttccatttcagacagatgattcatcttgtaaacaggtggtgtaaacttactgtatggaaaaatacataacagtaccacagatgtattttctccttacgaacatttccttttctctagcttactttattgtaagaatacagtatatcatacatataacatacaaaatacatgttattaactgttgctggtca

SEQ ID NO: 1394 - DNA, 106499 bp, Homo sapiens
taacatcttatgaatacacctcgcatatatgtgaatacgttcatctcctaggatataaaccagagggctggattgcatggagtagcttgggtgtggggttaagtcccgacatgattataacatttgaagatgcagaatctttcattttaaccctccctttccatccttttccaccattcagggtatctcctgagagagattgaagaaacttagattttatctcttaccctttactgtagacatttcagttattttaagtttgtttccttctttgcttctgtatcatccaagtttttattgtctttttttttgttttagttgccttcctttctcttaggggctttttctgaaccgtgtagtgatcctcagctgtgatcttacgtggtaggcgtagcatgaaaaactgatcaagaagcagaggctgcacatgggtgcacgtcagtgggggctctgactggcctggttcatgggggaccccaagtgtaacatctgcagactctttctcttggaatacacaatttctccatagaattgttttccaaactattcccaagacaattattttctgaaaaaaactgccccctcccgatgagggaaaaggcctgaggggagttttctcctctttgcctctgctactgacctgtgaaaaccaaaaggaaagatggtcccacaaacaaatggatctcacccaattaagttccagataagagtttctggaccttattttggtccccagaaatggtaaaaaaaaaaataaaaataaaaataaaaaaatgagttgaggcttcataaccagatcagtctgactccagtacatacttgcttaaccacctattgcgtctcacatctaattcatctctcctaatcacactatccctccagttcttttttttttttttttttttttttttttgctctgacacccaggctggagtgcagtggccccatctcagctcactgcaacctccacctcctgggttcacgccattctcctgcctcagcctactgagtagctgggactacaggcacccgccaccacgcccggctaattttttgtatttttagtagagatgggatttcaccgtgttagccaggttggtctcgatcgcttgacctcttgatccgcccacctcggcctcccaaagtgctgggattacaggcatgagccactgcacccggcccctccagttcttgaacccatattacctctctttcatttcccccttgatgtgtttattttccatgtgttttgttcctcaatgcaatttgaaggacatgatccccagaccagtggttctcaaacttcagtgagcatgagcatcacttggagggtgcagaagcatagagcgttgcgccctgccatcagagattctgattcagtaggtctgagatggagtctgaaaatggcatttctaataagctctcctcggatgatgtacatgctgctgatacagagaccatactctgagaacaatagacagagagtctatattcatcgaaagagcatcaggcatagaagtagcaaatgacttcaagctatagtcctggtgggaagagagcttctaatatcgtttctccttggttgggttaacatttgttgaaagctttattcaattatgatttaaggcaatacttactttaatactgagtgctaattttcattttcttacatttaactttttattcattcaacatgccttttagtgaatgataagattagagataggagtatgctgtttagtaaaagaaaatagcatgggaaaggcagaatatgggaaacaatgaggggttttcaggatgcgtaagttcccaatttgttgaataatacacaccacacacacacacacgttcacatacacatcctgctggttctatttctctggggaacactaatatagtaatagaaaaaaattgtgtatatgtgtgtatgatagcacatgtatgaagagctagcatatgtgtggacatacatacatatgcattaactcttacatatatgctaattattcacatatatgttaggtaacatatatgtatatacgtatatttacatatattaatatgtataatgtgtataaagcacaatggtttgaattagcattttaataacagcagacgtttgaataaagagttacaggaaaagaattcaagcttaagtgacatggaggaaatggcatgatgagcaaaaatagcaaaatcaaaagaagtacttatttgggaataggagacaaggtagtacaacgaattcaggtttattttggaacatgttacatttgatttactaaatggatccccaggaaggaaatttaggtagtcagaagtgaaagattagtaatgcataataaaataattggggaggaaagcaacatctaaattccaaaataactggagtaaaactgccaagatttttaaggcataaatatgtatatttctattaacacaatattaaagaaagactaaaattttaatggaatgggtagagcaaattctgcattttaacagtaatttagtaatttctgccagtgcttctattaaagcataggcaatatgtgttatgaatttataatatattacttatatttttcatttttctaatgcttaagatgaattgctacttcataaaagtgagctcatatgtcaggtgtcaagtattattaagtagaatagtattaatgctgaactaccaaagaagcaaaaaattatggtcatacatacctatatacagtttattacagtgatcatccattatatgtcagactctgtggtatttcctctagttcttcctcaggatatacctgctgggtaagtatttcttccctaatctatagatgaagctctaactaattccctcgagcacaaacagctagtaaggatccagtttgatctgaacccaaactctatgtggttttgacaacacttaggtgtgtggaatagttaacagaaaagattgtttttcaccccgaagcttatcaaaattaagcatttctattggttagaaatgcctcaagagcattctgtggctaagggttttgtattctttttgggttctgctcagtcacagaggaagttgtaataaaagttctctcatggaaagacacttaattttacttcagctactgtctcctcccactcgccataaaaagtttatgtaccacagaccataaagaatacaaccgaagacacagactcacagaacagggttgatgtaatctgtgctttgcaaacactcttcctatacgccatttgtggaaaagcacaataacttttcagacatctgtttttgaggttacaaaatccgaaaacatctacagacttcaaataactttgtaaaatttaacggaatctgccatattggaaactaataccagtcaaaatatattatcttaaagcaaccttttcttcttccatatattatttggacaattattccattatccatttgtctagcactgagtatatttactgtacctggggatgctccttagagctaaaataacattacaaattgagcaagattgcatacttgtcctttcacatgttcaagctttgacaaaaaccaggacaaaagtctttgaagatagtccagaatcttgtaacagaaagggatgtgtcagaaattcagcttcccgaggtggtggagctccagaagctcctggagctctgtgctaagttacaaattggctaaggggtagggcaggcaagcgactgcttacaaaaagcactataaaaggtaactggaagctgacccccaaccaagaacctaatctgttcctgctcagtggtttctcataggtcagtctattttttcctctagatgaaatatcataaatttcacctactttcttgggaaaaccatcccatacctcataattaccaaaagaaaaaacttacaaaaacaaagcacaaatatatgctttaaaaatacttactaagtaagtaaatcaagtagaatataaaaccactttgtaaatgccctttatggtggatgatacaaaagcagaaatagcaaacctacttagaaggcaagcccagtgaaattaggagtgtatattctttcagtgtcaacctttaagaatacagacatttctctttgcaccaggatcgaaattaggtttattataaatttgctatgtattaaaaactttgaaagcttttgaattggtaaatgccagagacaggcttgctcttaaggtctgcagggcctgagacctgcatgttgcctgtgagactattttaaagctattaatcaagctggcgttgtggccctgcctggttctcactaggcctcttgaagcctatttctgtactaacccttgaagttgatgctcaagaggtattgctctcccctgggctgcaccactccctgaaaacttgattagcaacctggatctgctggcacaggccaaggcaaagaccagtccagtgcccagaatgcccagctctcactgcagttgccagaactcagaatgggactgacccactcaggctccctagagagccacaggggcagagtctcctcccactctcctcacctttccaactcaagatttctaggccattctaatcacatccaaagttaaaccaccccctgcacagggagaggtggaattcagttatgaaaaatctagtctgactaaacctcactttgggtgatgtgggggcagtcagcctaaaacaaaagcagatcctttcccttgtcctccagggcagagggtgtgattttctccccttctctgctcacccttctctctactccccctgtgcacgtgtgcgtacacacacaggcatacagatttctctcagctctacatcctctatctagaggtcgagatttggtttcaaacattcttcccaaataattctgtttacacaaccagttatcagactttcaaaaattttccttaaaaaatcaaaaagaaaaaagtcattgtattttcgtgtttgggatatgcattgctcctctgaaggctggacagattctaggagattccctttgcttatattttaatattatcttcattaattttctctagtggaagcaagtctggcaattcaatcacatctgcaagagagacatataattgactaactgtcatttcaaatgcagttgtattgtttctcatgcagtatttgttctaaagcctttcaaatctttttttttaagttttagagtatcttttttatgttttattttattgggataagaagacaacataagatctaccatcttagcaaatttttaagtgtacaatacagtcttgttgactataggtgcaatgctgtagagcagatctgagagaaaggcagagcatcttattacctctttatggttagattgagctttggaaagaacagaatgtgccactcagagttcccctttccagtagagattcacccctctccatttcatgcagttctcttgggacggtcagtcgtggagctttacctgggcactggcacctgggatgggaatgtgaccaaggattggacaacctgagtatttcatgccctggtagcatgattggttcatgacaaactaagttaatctgacagagatactgagaaaagttatgttctcttcctcaagaatcaaatgtatgtagaattagggctgtcagctgccatcttgttgacttgtggaaaaaacctttctgaaattgaagccaaagagaagcagggagagatgagagataaagttctaacgacaatgtttagatttctgaatccagctatgtccatttgcaaaggtcaataaattctttgatttggcttaaattagtgtgaattggatttgtgtcacttgcaaaaaaagtgactggaaaatagcatttcattctgaaagcaacagttccatctgacgcctggcaaatccacacagatgtctcataagtacaacatcttaaaaaataaacttgttttcctctcccatattccatgtcaccaacaaacaaacaaaaaacaaaaaacactcccactgacattttgcttacgtaagtactgccacacattcacttgaaaatgcctgaacccatcctctcctctgttcttccactcttgctgcttaatatataatctcaatatttttttggctaacctactgcaataatcttttcctaattgctctcccctacctccagtttttcccacttccaactgtatttcagttgttgccagagtgaaatttctaaagtgtacatttaaacgggtgacacccacataaacaatttcaatagcccgttactgcctaaaagataaagttctaattacatagtatatccatagctcctttatagctttgcttcagactccacacttctaacccagtctcctgccactactaccatgcatataatctgtgttccatccataacaaattatctctgttccttggacacgctagttgtttgcatataatgtttctgctttacctgtaatgaccttgtcaacattcggccctatcagaaaattatgtgccttctgagactcagctgagctttgtttccttcccgtagatttgtttaaggttctatattatctaaaaatcctcagtccttctactttagaagcttagcattctatttgtaccctttttcttaaattcacttggaaaatcagtgaggtatgtcacaagggaacaggaagtagtaatgtgtccaagaactttgctgtaaagaggcaatgtttattatctattgttctggaagccaaggcaaatgcaaaaatttaaatcttttgatcctgtactatttcattggctcaatatatccatggattacccactcgttctataatagaagccctaaatatgcactggcatttgctgaaatcgtagaggacactccatgttgtttaaggcctgcccccttctgtataacttctttcctagggcccaactggtaactttgttacaaaaaaaaattagggattttcctgtgttttcacaagcgtcttgttttgggcatttcctcaaggtctctggcatggataccttttgctggctgtctccatttcaagatactttgtagagtttatctattgtagccaacccactggaactctctccttgtacatttccccacttcttattactgaccagagcctccttttaagtctggttaacaagaaatatggatgttagcttagccatgagcacacttttaaagggccaacagtgatcatgaaatccagccccagatttttttttttttcagttacttagcacttcttcctaagtcttgtgttttagcctctaaatggaaggaaacaaaagttcctgtttatttctctaaagtgcctgcctgcaacactgatttgttcattttgaaccagagaatagctgaagcaagcaaaagtgagacttattcatttaaaatggttatttcggtccatctcagcagcctggctccttgaggctttccaaggcaacaatacccgggtaagggtggtttatcattcactccttgatcgtatgaagctaaatgctggatttttagtcataggtgtgctaagaaaccctcaatgcccaggcaagacatgctgaatatattctgtgcattctggtaaatacatcaaggtaataattacttccacatttccccttttaaacacacattttttactcagggccacagtttgcccttacatacacccaatgcatttcagatttctctgtaatttaaagaaaaagcattgctgaggtgagccaaatttatatatgagctctttgtgtaagctatttcagagctacaaaggctatgtccccacgcttatatacagttggtttcctcataatggctttctgccatcaattggaatacctttcttacagtaccccagatcccaatatgaaaagcatttacttttttttattatttttttttaaagaaagagttcttatgtatgtttctaaaacaggagggctggtttgcatttttgagatcctcgatctgaacacaataaaaaaggtgatatgttgggggggaaaatagtgacttgtaatgccagtggaaagaatgggctcattttcttgctttggaagcaagggggtgggggagcatatataatttttattttactgtatggaaactgaagacaaaaagtattattacatgtctctataaaacaaagcaaatgtaataaaacatatacatttgtaatattatttaaaaaagaattcacttctgttatatgcatttattccttatgtatactatatacatatattttttgttttataatactttgaaatcttcactatgattattaattaggttatcatttatacaactctgttcagtattgataacgtcttttcaaaacgacagttgttcatctccgagtatttttgttttattaacatttgagactgactttaataattttttcatcacaggttttcaacatagaagtatgtttcttagtttcaactgctccttctaattatatttgatttgagaacgtttgagacttgatttttggaagtgggtttctttgtgcattgtttttacatttttctaaaacagccaacagtttatagatgtattgggaagccaccaggttttactgtgtttcttacttttatccatactttctattaaaataccaatttaaaatagctcaaaattctgtctgtggttttggagacattaaacttaagtgcatcttgtgaatcaagtacatgtctctgcagagacaatcaaaaagaaaaagcaattgaaaactcaagtacaatgttgttatgttttattataaagagtatttaaaaagccagatattgtggtgccagatacattactttaatggttaacttcttggcatctcgtcaaaaggtagaacttgtatctggaaaaacttgatgagaaaaaaatgtcatagctataattttactgcctcatactacacaaaattgtctgttcaagttttacctgcgtaactctgtgagcagtcctgtgttcagcgccatccatggaggtttgtggaggaagttatccaggaacacaaaaaacagtcattttgatgtttccttagattgtttgtataagttcaaaattaaaaatgacttttgactaccttaacatcaattaaattcaaacctagacttaattgacctattctccaaatgagaagtccgaaattccgtgaattctcaggaaaatatctgtattatctttatttgcagcttttggctgagtaaatcaaaagactcaggaattatattttatagtatacattcctttaatcacatttattcctctctattttaattaagatattcatatctgacttcccagtaggcagagggacaatcagaagaacagggacagtacctttgtatctttagtatcaaaagcaatgcaacttgtaaatgtgaaaaattcaaatgacttatctgtaaaacaggccaatgccatatcgcagtagggatgtgtcataagtgaaaacatttatgcctgacactcaatgaatgccccttctctttctttccctgagtagttagtggtctattctctgtaaattactcaaaagtatttgtcttcctgtgtaatttgccttagttaatccttcatacagcaatgtaaaaaaggttttacccaaggaatgaggagaaagaggagaggaagctactaaatgttgagcatttactttctgtctttgagataggccacagtgcctcacttgggttgatgcttccagttgtttctagtcccatagcttttctctggaagagagtgtagtcaagtggctaaatgctttggccctagaaccatgttgaaagtgttcaaatgccagggttttaaagtcttgtgcacttgggaaaatgatgagccctctctgagctttaatttaccctggaaaacttgaataaatgttaacctacatcatcaggtagtagagaggatcaaataagattgatgcaagcaaaatgtttattttagactctggcacatggtaagatttgttacattattccccaggtgttaaagatgaggctgaaggtaaggagcagagggaaaatgcattgattaatggcatactaacaccatttgctaactttctcataatgggaaaatgttgataacatttaatatgggtccatccttatcttaccacttctccttgcaagccaactgtgtcagttgccagctctactaaactcagagcaaaatgggcattctgagctgccagagagggtggcaagctacagaatggtaaatgtctgttagtacaatggcttcttatgctgttaaaactgcagcataaggttgggcagatgagcatgtggcttacagtgtcccaagtgagaccatatctgttacaccagttgctcttcatcacaattaaggatggagaagggccaagtttcgtggctcatacctgtaatcccagcactttgggaggccgaggtgggaggatcacctgaggtcgggagttcaagaccaaccatgatcaacatggagaaccccgtctctactaaaaatacaaaaaaaaaaaaaaaagaaaaattagccgggcatggtggcacattcctgtaatccagctacttgggaggctgaggcaggagaatcgcttgaacctgggaggcggaggttgcagtgagctgagactgcaccattgcactccagcctgggtgacacagcgagactcagactcaaaaaaaaaaaaagttaaggatggagaaaattgaaatatggaaaatgtgagcagtttacatgaattcacaaaatgtttaagaggaggaggtgagtcttgtccatgctttctataaaagggaaatacaatagctgttaattccttgctcattattttagagacattgccaaagaaagataagtagctgcatatatatttactgagttgttttcttcaaaaaagaatgtataattcaaaagaccgatgccagtataatataaaagtgactgttaatgtaaaaaaaaaaaaatccacaatattttcttgagcgattggcataacatatcacttccatgcaagtgaagtgaagattgagagggaacttatcagtgtcatatccctggttcaaaatgacaagtctatgcacaggtttattctggcctgtgtctcttgtttttgtgtcaatctttgttctccacctacattttaagttctttaaatataggggccatgacttacccttctgctaagaacggttattaccaaataaagtatacatgaacaaataatgtgtagtaagccataactatgtctcatgaagaattagaagcttgggaaatcggtccaaatggaagcatgaattcatgaatacttagttgaagtcaggattcgagaatcttactggttcataggaagctagaggcagagtacaaaggctgatgacttcaaaatcaaagtcttgaggagatggtcaggtaatccaccctaggatgttgtcaacccaaagggactagatcgttgagagagagagagagagagagagaagtccaaagcagtgagtggcaaacaaattagtaagaaaaaaaacaatcaatcccatcaaaaagtgggctaaggacatgaatagaaaattctcaaaagaagatacacaaatggccaacaaacatatggaaaaatgctcaacatcactaatgatcatggaaatgcaaatcaaaactacaatgcaataccaccttactcctgcaaggatagccataatcaaagaatcaaaaaacagtagatgttgtcatggatgcggcaatcagggaacacttctacactgctggtgggaatgtaaactagtacagccactatggaaaacagtgtggagattccttaaagaactaaaagtagaactaccatttgatacagcaatctcactactgggtatctactcagaggaaaacaggtcattatttgaaaaagatacttgcacatgcacgtttatagcagcacaattcacaattgcaaaatagtggaacccaaatgtccatcaatgagtggataaagaaactccagtgtgtgtatatatgtgatgaaatactactcagccataaaaggaacgaattaacagcatttgcaatgacctagatgagattatagactattattctaagtgaagtaactcaggaatggaaaaccaaacatcatatgttctcaatgatatgtgagagctaagctatgaggacgcaaaggcataagaattatacagtggactttggggacttgaggggaagagtgggaggggagccagggacaaaagacaataaatgtggtccagtatatactgcttggttgatgtgtgcaccaggttctcacaaatctccactaaagagggtactcatgtaaccaaatactacctgtaccccaataacttatggaaaaataaaattttaaaaataaataagtaaataaagcagtgagtgggaaaataatctgaattaagtagatgaactaaagagagttaactgtagcaatctttttttccagggaaaggacaagacacggagtggtggtggtggttttaacctgggacaagcagaggaaagcagtcattaaagaggtcaagtctctgtgagtcactatggttatttattgtgaagacacagtctcttaacttctcagtctccaccaagcagtcacgctaagtgataaatgagtcaatcagataatatattataaatatttatttttattaatatggaaaaaagatcataaatataattaaagaaggacacagtatgatctatcagagacagatctgtgtgtatacatatatgtgcaatgtatacttgaaagaggaattgagagtttacacactgaattattgcagaatttactgatgggtgctggtaatatggttgtttactctttcctttttggtgtgtaacttttctacaatttttattttgtaaatgtgttttacttttgtaatgagaaaatatacatttatacttgaagaataactctacaaagtaaatagctactctgtcatattataaccaccataagaataggttataatggagcaaaaatatgcatgagaatcatatagtccttcattggacagtacaccaaggcatactacacttttctgatttcttacacagatatatcactgattgtccaaagtcccttagaatattttatctcttgtctccccatcacatttcctagctttggctgtttctttgcctttttcccagccagtgtttctaaaactaatgcagaatgagaacataatgacattggttctataaagaaattgttctccagcctggtcaacatggtgaaaccccgtgtctactaaaaatacaaaaaattagctgggcatggtggtgggtgcctgtaatcccagctattcgggagacagaggcaggagaattacttgaacccaggaggcagaggttgcagtgagccgagattgcgccattgcactccggcctgggcgacagagcaagactccgtctcgagaaaaaaaaaaaaaaatgttcttcacctgcagagatgctactgaggcattgtcagcaacacatgcacttaaagttatgtgtttgcaaatgtagatggtagtgttgagtcacccatactctgtctcttgatccccttttgatcagcagcaaacatttgcaaggcagctggctggaatcatggctgcaagctgcatgagcataacactagctttggtcatacgtaggaaactaaagggataaatatcatacccttggcattattaacactgtattctccacaattgctaaactgcacgccactatgtatatttgaaccgagagcaaatttactgtgacatcttagactaattttagattcactgttgttgagaaacacaaatcagaatttttatgagtatcatgtgcctagtgggtgggtggactagaacagtggtttagaagaaagagacctgacttctagacttaaataaatcatcctttagataagtaattttcactggccttaatcttggtatctgcaaaacaagggatttgagtagttcattgtttccaaacttgttcaatgttaataagttcaccaagtactgcctgatatgacagttccctgttcctgtacattgctatttagcaggaatggagcctatgaactacaattttagcaaatactccaagtaactgatatgataagaaaaattggataacactggatgaagtgttgtttgacctccccaccctaaccgtaaaaagtcagtagtataggagggggtcatcattacattattgttaacacattcctacatgaatggctacggtgagagatttgcctgttgcaacaacaacaaacaaatctaagagatcatttcctttaaggacacattgttttgcttttatggtataactaaatggccaaatatagattcactcacacatactgtgcattgaaaccaacggagcgaacatgagtccttagaataaaggcctgtgacatcaagcattcagctgttaaccagagggaaatcacttgtacttttctagcctgtagtcttatctgtagttacagaatttctttgcaacatttactattgtaagatgtagaacatggtgaaatgttgtagaaatcacggaaatgtaggcttgagatgatgccagctttgaagattataagtgtgggccctgttaaagagatgaatcacataaagtagaatatagcacacagacacacactcacacacacatagacacacacctttgctcatactcaaacattcacacacagaaacatacttacgctccccaaaataagaacacatgcaccccttttccgaacacttgctgtgccaaactttcaactctggattgagtttttcgttgattaaacacatgaaactgaaactatccaaataaactcttttggcagttattgaaagtcttttgaagtaaaccagaatgcttctacagtcaatgtttccatactgaatcagtccctgtcacagtgatattatgtttatttttatgctggaatgtagattttttctttctttgcaccagctctgcaaagataaaaataagaggtaatgaagcagaatgctatgggtttgaggacctcttccctggagaatgtgtaggctctaattctttttacaatctctttataataagattggcctgctacttcatagcagtaattgcagccttcttctattcgtcagaaagagaaactattttctcgcctctgtgaatcagtaatccttcttaatacttagtgattccctcagtcctcttatgtttccaaagccatgttgtctgttggagcttgtcatgtgtgacaggaattgactgggagggacccatgtgggaaattctaaaggtacttttgaaaatttccccaaaagcttgcctgtttttttcagagccctttactgatcggaagcaaaaaaaaaaaaaaaaaaaattgataaaccaaacttaaaacttgagtacaagtatgacaaaattaaacatatccaaaagtgaactcataattttctacactccccataaagccacttccttcctctaaaaatccctgttttggataatggcatcgagctaagtgttaaagccataaaccagagtcacccttctctgctagacaaatccagttattcatcacacgctggcaattctaaattcaaaatatctcttatttctcatctgtctgttcactccccactcgtgaggcctcatagtaggatttcattgattctagcctgttcatctccctgccattagtctttgcttacctaaagtcctgattccgctgccaactaaagtaggaatctgattttgtctttaataaattcttgaataagatgaaaaacaaatgcttttttcttatgattgtcagctcgtttataacccagcctcagtctgacatctcagactcatatgttattatttcctttagcctttatcgactttcttttagccgcactgactttcttaccattccctaatcatgtctccttgttatttgtctatctttgcatggaatatctcccaagagatggaattccattacctctcacaccacaacactcctgctctagtctaaaaaactccactcaacctttaatcttctcatgtcaccttccctatgaggcatcctcaatttcctcacagagcactgcattcctaatctattaataaagtgcaaatcatattatggatggtgcagtgggttgaatggtggcctccctaaaaggtacatctcatcataatccctgaacctctgaatgtgaccttactaggcaaaacactcttcgcagatataattaagaatctgaggatgagatcatcctggattatatgtgtgggctttaaatccaatacaagtgaaccaataagagacacacagagcagagccacacagggaaaacaggagaccatgtaaagatggagggagagattggattgaccaaaacccaagaaactctggagccacatggaagaggcaaggcaggattgccccattagagcctttgggaagagtaagccctgtagacaccttgacttcagactgctggcctccaaaccgtgaaaggttaaccttccattacttaaatccaccgagtttgtgggaagttgttatggcaaccctaggaaactaatgtaggtagctatttatacattcactcctaactatatcttaaaattctgcagggcagatgtcccacattgtttttaaattaatagactttatttcttgagcagttttcactttacagaaaaattgagctccaagtacagagcattctcatataccccttcccatttcccttattattaacagcttgcattagtgatgtacagttgctacagttaatgagccaacagtgatacgttattcttgactgaagtccatagtttacattaaggttcactctttgtattgtatattctgtgggtctaggcaaatgttaatgacatggaaccaccattacagtatcatacagaatagtttcactgccctaaaaatcctgtgttccacctatttattcttcccttctcccaaaccttggaaactgctgatcttttttactgtctccacctgccttttccagaaagccatatagttggaatcatacagtatgtagcatgttcagattgacttgttaccgtatcagcgtttacgttttcttcatgtcccttgtttgtttgatagctcattttttaaaaatcactgaataatcttccattgtataagaggccatagatttgtatttcacctttgtagccttaccacatcgctcagagtattacataaatgttcattaaattaatagatacacaagtagatacatatacatggatgaatgactgaataaacagtgaacgagttttaatgacttattgaatataaagtgaaagtatgcaatcctataaaacgactaaagtgactatattattttcttgctgtcactgaaagcacgcaatggatgtcactcaggatttctaggttcattctgggttctggcttgcattgaactggtttgtgttagatcccaaggccaaaggaataaactgaactgaaaaagtcggtatacctaaatgactcctggccacatcagaaatcgccttaaactgctaggaagtgtataattcatcttcacagattcacagtactttgagtttcattactgttgagttttgttgtcaattttaaaaacagttaaaaggtaaaaaacatgtaatacttatgaagcttcttcagggcacaatttcaggctgagtaatatcatttctctgtcctatagctgaatggctgagatcagaggatttgcttcagttacccttttatctcaccctcttttttgttgaaaagattaactttcagtagcacttaatatttatgaatgaaattataccaaatagagaattcaaaataattttgagaggtcttatgggaaaaggaaaaagattggtcccaagatgataactgttgaagctgagtaacagagataagaaagtttattatattctctacatttgtatatgtttgaatttttccatagttaagaaaactcattttataaaatactgataaaaagaatgtcaacataatttgttgttattgttattgtcattgttgttgagacagagtctcgctcagtcactcaggctggagtgcagtggtccgatctcagctcatcgcaacttctgcctcccaggttcaagcgattctagtgcctcagccccccaaatagctggaattacaggtggcacactaccatgcccggctaatttttgtatttttagtagagacgaggtttcaccatgttggccaggctggtctcgaactcctggccgcaagtgatccacccatctcggcctcccaaagtgctgggattgcaggtgtgagccactgcacccggccaacatattttttaaataactacgttataaatgtaaactgaaagtcgttttaatctcatgtcaaatcagaatttttgatacccctaaaatacctaataccctaaaaatctgtgtgaattaagcagcttcagacctttacattgcctaagttgcttctctctctctcgctctgcctccatatatatatatattattatgtaattatattatattatacatatctctcttcacatatatatatctccatatatattactacaaacagttaatatattactattaaaaagttagtataaaatatatactataagaaagttgcaagacgaaatatttgaatagtctcataaagctgtcagcatataatatgatttcggctgcattttttcgtggtgacttcagagaagatacatgaaacattatctgatatgcaacctcacggtaaataatttcgtttattctcaaattattggtataccacaaataggaaggattccccttcccccacttttggcaatccttaaataaactgcaaattcatgtcaccatctggctggcaatggacacaggcagattaatcatttcctttttgaataataaaaaaagttcccttcaaaatgcccccaaaatattggataggaaagaaaaacatgaaagttttatttacaatttcaaatggtttgcaacacacgaaaccctgcaacggaaacttgctttgctcaagctggcattacacagtttgatttcttattgataaacatatatattatgcctacaagaaatgtcatttattaaaagaatgatacaaaaaattgaacttttggttttcagaaagcacagattgctcaaacacagcatcttagttccccaggaggctccactcagtgcctcccaacacctctcacttcagtctcccgctttttcattcttctcttcctcactgtttataataataatttgtaacacatttatcatcgttggtaaagtaaatcattgaaacctgaattgccgccaccttgctgttgaacatggaaaagagctgaaatccctttgaaataacctgtatcacttggttgatatttttttcctgcccgtagcaatgttactttggttttgttgttttgaagctttttgatttttttttgctacacattttgatgtttgactaatagaaaaatatttccttattttcttagtcattactatgccaagtgattcatttcttctctgccttttttttgtagcctcaggcattcttagtggtgtcactaaatttatcttgcagatgttaaaaaagaatccccactagaatcctagtatgtagacttttatagtgttatgaaacatgcctatttttaaatatttaattaatattttaatgtggtataaataacagcatctctgaagccattgccattcccaggagtcaggggaggctatacagaacactgtcctgttacaataattttctaatgatttggattatagtcattgcttcctttttctgctgttataataatttgacccctgacccataccaacttcctagtcatctattcagtttttatttatttattcaataaatatctcttgaccactacttttttgccatgcactgagttaaacattgttaactattagtttaatacattgttaatacattcaagtagctcacacatcctgagggctgtctttgttcaaagagtgtttatagacaagaaaaatgggagtaacaatgtccttctgtgacataagcataattggaaaaaaaagtaaaagtataaacaagagagctttggaaagaaaagaaggttctgaaacattttagattgggagcaaatatttggatttgaacaccaggctttctagcttttgacaaaattcaaaatccttttacatgaaaatccctcaacaaagtaggtagagaaggactttacctcaacattaaaaaggtcatgtattaaatatatatgtgtgtatatatatatacatatacacacatacatacatatatctcacagctgatatcatactcaatggtgaaaaactgaaagattttcctatgagaaataaggcatgattgccccattctccaccacttctattcaacagagtactggaagtcctcgatataacaatcaggcaaaaaagaaataaaagtcatccaaattgaaaaggaaaaagcaaaattatctctgtttgcagatgacatgaccttacacattgaaaatgtcaaagactccaccaaaaaaaaaaaacctgttagaattaagaaatgcagcaaagttgttgattcaaaatcaacatacaagtatcagttgcatttccgcacactatcaaagaactgttcaaaaaagagattaagaaagcaatcctggtcaggcacggtggctcacacctgtaatcccagcactttgggagaccgaggtgggtggatcacgaggtcaggagatggagaccatcctggctaacatggtgaaaccctgtctctactaaaaaaatacaaaaaattagctgggcgtggtggcgggcacctgtagtcccagctacttgggaggctgaggcaggagaatggcatgaacatgggaggcggagcttgcagtgagccgagattgcaccactgcactccagcctgggtgacaaagcgagactccgtctcaaaaaaaacaacaacaacaaaataagaaagcaatcctatttacaataccctcaaaaagaatgcaaatttatgaacaaacttaacgaaggaagtggaagtccttgtacacatgaaactagaaaatattgatgaaaaaaattaaaacacaaataaatggaaagacggctgggcgtggtgactcacatctgtaatcccagcactttgggaggctgaggtgggtagatcacctgaggtcaggagtttgagaccagtctggccaacatggtcaaaccctgtctctatttaaaaaaaaaaaaaaattagctggacttggtggtgggcacatataatcccagctacttgggaggctgagtcaggagaatcacttgaacttgggaggcggaggttgcattgagctgagatcacgccattgcactccagcctgggaaacagagggagactctgtctcaaaataaataaataaataaaataaaataaaaataaatggaaagacatcccatgttcatgaattggaagaataaatattgttaaaagtgttcataccatccaaagcaatctacacatttaatgcaacctccatcaaaatcccattgacattttttacagaaaaagaaaaaacaatcctaaaatccaaatgaaactacaaaagactccaaacagccaaagcaatcttgagaaagaacaaagctgggggcatcacatgtcctgatctcaacatatgttacaaagcaactgtaatcaaaatagtgtggtactagtataaggaaaaacatatagaccaatggaacagaataaagagtttgaaaataaacacacaatatggccaactgatcttcaacaagggtgtcaagaatacacaatgagaaaagggtagtttcttcaacaaatgttgttgggagtggtgatggagcacgatagcagaatagaaatctccactcatcatcctttctgcagggataccaatttaacaactctctataccaaaaaagcaccttcataaaaaccaaaaaccagatgagcactctacctggttttaacttcatatccctgaaagagtcactaaaaagataggaaaagcagtcttgaattgccaacaccacccctcctctatcccttagcagtggtggcatggtgtggaaaggaaatctgagtgcttaaaagaggaagagtacagcaattgtgagacttgcattgaactcggagcttccctgttaatagcagaaagcaaaatcagaatgaactcagttgatacccacccacggaggaagcatttaaaccaaccctagccagaggggaattgcccatcccagcagttggatcttaagtaactgcaagcctcactaccatgggctaaagggcaccatggccctaaatgagtttgaagggtagtctaggccacaggactgcaactcctaggcaagtcctagcgctgaactgggctcagagacagggaactgaacgggtgcaccacttactaagacaaaagtgctggcaccacacctcccctagccccagcctgcaaagctcatggctccaaaagagaacccttcattcacttgaggagaggagtcagaagagtgaaaaggactgtgtcttgcatcttgggtatcatctctgctacaggaggataggacaccagagtagcgaggtctcctttctaggccctagctctcagatgacatttctagacacacctggggcaagaaggaaacccactgccttaaagggaaggatccagtcctggcaggattcatcacctgctacctgatgagcccttgagccctgaataacaagcagcaatatccaggaagtatgctgtgggcccttaggtgaggctctgagacttgttggcttcagatgagactcagcacattggcatctgtgatggatagtgggcaagactcattttgcttcagaaaagcagagacaaaagtaaagggaaatttatcttgtaccttagacaccagcttgaccacagtggggtagaacactaagtgggcccttggggtccccaattctagcccttggctcttggatgacatttctggaccggctctgggccataaaggagcccactgctttgaagggtgagtccaagaccagatagcatttaccataagccaactgaaaagcccatgagccaaaagggaacatcagcagtagcctccccatgggcctgtggagccagtggccacagagtgaggttcgtctgcctttggagaggggagggaaaatgggaaggactgcatttcatagtttgaaggccagctcagccacagtacaagagaacaccaggtagacttctaaggtttttgactctagactcctagatgacacctgtggacccacccagggcctggaggaactcactgctctgaagaaaaggacacagacttggctggattttccacctgatgattgtagaaccccagggccttaactgaacataggcagtagccagggagtggttagagcagaccttgggaaagacccagcactgtgctggtttcaggtctgacccagcacagtaatagtggtagtggctacatggggtgtttgtgtcattccactcccatctccatgtgactcagaacagagagacagataataagagagagagagagagagagagagacagagagagagagagagagagagctatttatttgggaaaagtaagggaagagaacaagagcctctgcatggtaacccagcgaattcttccaggtcttgtctaagatccccaaggtggtacctctgcaagtctgcaagaaccagaaccacagcattactgggcttggggtacccccagtgcagatacagctagatcacaacacccaagtcctttcaattatctggaaagcctaccaaaagctcaggtacaaacaagttcagactgcaaagactacaataaatatctagctccttaaggcccagtcacagacaaatatccacaagcatcaagataatccaggaaaacatgacttcaccaaatgaactaaataagggaccagggactaatcttacagaaagagatttgtgtcctttcagatagtgaattcaaaataactgtttagagaaacctcaaagaaattcaagataacaccgagaaggaattcaaaattctcttagataaatttaatgaagagattgaaataattaaaatgaatcaagcagaaattctggagctgaaaaatgcaactgatatactgaaaaattcatcagtcttagtagcagaatgaatcaagcagaagaaagaattagtgagcttgaagacaggctatttgaaaatatacagaggagacaaaagaaaaaagaataaaaaacaatgaagcacatctataggatctaaaaaatagtctccaaaggacaaatctaagagtgattggctttgaagaggagctagagagaaagatggagatagaacatttttttcaaagggataattacagagaacttcccaaacctagagaaagatctcaatatccatgtataagaaggttataaaataccaagcagatttaatccaaagaagactacatcaaggcatctaataatcaaactcccaaaggtcaaggataaataaaggttcctaaaaccatcaagagaaaagaaaaagtaacatacaatagagctccaatatgtctggcagcagactttttcagtgtaaatgttataggtcaggagatagtggcatgacatattgaagtgctgaaggcaaaaaaagaaaacttttaccatagaatagcatttctggcaaaaataactttcacacataaaggaaaaataaagacttttccagacatacaaaagctgagagatttcatcaacaccagacctgtcctacaagaaatgttatagggagacctcaacagtaaagaaaaggacattaatgagcaataagaaatcatttgaaggtacgaaattcactgataatagtaagtacacagaaaaacacagaatattatagtattgtaactatggtttgtaaactacttttatcttaaatataaaggataaatgttgatccaattaaaaacaagcaataactacaacaactttttaatacatagagaatacaataagatatgaatagaaaaaagcaaaaagtttaaaagtggaggtaaaaagttaaggtgtagactttttattagtgtgtgtgtttatgcaaacactgttaagttgttgtcagcttaaaataatgggttataagacaatatttgcaagcctcatggtaatctcaaatcaaaaaaacatacaatggatttataataaataaaaaggaagaagctaaatcgtatttccagagaaaatcaccttaactaaaaggaagacaggaaggaaagaaagaaggaaaagaccaccaaacaacaagaagacatataacaaaatcacaggagtaagtccttacttgtcaatagtaacattaaatataaatggactaaactctccaatcaaaagacatagagtgaatgaatggatcaaaaaacaagacccaaggatctgttgtctaaaatatacaaatcaatcaatgtgatgcatcatatcaacagaatgaagaacaaaaaccttctgattatttcaattcatgatgaaaaaagcatttgataaaattcaccatcctttcaaaacaaaaaccctaaaaaaactgggtatagaatgaacataacacaataaaagttatatacaacagacccacagctagtatcatactaaatggagaaaaacagttttttctctaagactggaaacatgacaaggatacccattttcaccgttattcaacaaagcactggaagtcatagctagagcaatcagacaagacaaagaaatagggcatccaaattggaaaggaagaagtaaaagttattatttgaagatgatatgaacttatatttggaaaaaacctaaagattccacacacacaaaaaaatcctagtagaactgataaacaatttcagtaaagttacagaacacaaaatcaacatacaaaaatcaggagctttttttttttttttgagacagagttttgctctgttgcccaggctggagtgcagtggcatgatctcagctcactgcaagctctgcctcccgggttcacgccattctcctgccttagcctcccgagtagctggaactgcaggcacccgccactacgcctggctaattttttttttttttgtatttttagcagagatggggtttcaccttgttagccaggatggtctcaatctccttacctcgtgatctgcccacctcggcctcccaaagttttgggattacaaacatgagccaccgtgcctggccaggagcatttttatatacctacagcaacaatctgaaaaatgaatcaagaaagtaaatcccatttacaatagctacaaataaaagacctaggaattaaccaaagcagtggaagatctctacaataaaaactataaaacactgatgcaagaaattgaagagaacaccaaaaaatgggaagatattccatgttcattgattggaagaatcagtattgttaaaatattataatactcaaagcattctatagatttaatgcaatccctatcaaactaccaattatattcttcacagaaatagaaaaaagtctaaaatgtatgtgaaaccacaaaagatttcaatagccaaagtcacctggagtagaaagaagaaaactgcaggaatcacattacctgacttcaaactatactacagagctaaagtaaccaaaatatcgtggtactggcataaaaacagaccaggcacggtggctcatgcctgtaatcccagaactttgggaggccgaggcaggtggatcatcaggtcaggagttcaagaccagcctgaccaacatggtgaaaccccgtctctattaaaatacaaaaaaaaaaaaattagccaggtgtggtggcacgtgcctgtaatcccagctactcaggaggctgaggcaggagaattgcttgaacccaggaggcagaggttgcagtgagctgagaatgcgccactatactccagcctgggtgacagagcaagagactgtctcaaaaaaaaaaaaaaaaaaaaaaagacacatatttcagtggaacagaatagagaaccgagaaataaatccatacatctacagtgaacttgtgttagacaaaggtgccaagaacataaattggagaaaggacagtcttttcaataaatggtggtaggaaaactggatatccacatgcaaaagaatgaaactagacccctatctcttctatatataaaactatcaaggatatggattaaaggacttaatggattaaagacttaagcggattaaagacttaaatctaagacctcaaactataaaactcctacaagaaaatattaggaaaactctccaggacattggagtgggcaaagatttattgagcaatacccacaggcacaggcaaccaaagcaaaaatggataaatgagatcacatcaagttcaaagcttctgcatagcaaaggaaataatcaacaaagtgaagagacaacccacagaatgggagaaaatacttgcaaaatgcccatctgtcaaggaatgaataatcaaaatatataaggagctcaaacaaatatatatgtccataaataatctactatcaagtctctgtaatcactaacaggggtcacaggttgtattctggttgctttctaagcccaagtcattctcagttttgctcccagaaaaacattttttttaaataggagttgatgatgttactttgactttttaaactttttaactcaggattcttctaaggcttctcattatgttacattaaaattcaaaatccctaacaggagctgaaggaactacctgatctcactcttcctctctctccaaacacatcttgagcccctctttcccttgtttggtccacttcacagtggacatctttatgttcatttgaaggacatgcttatttctaaattcagaaccttcacacatggtcttccttctgcctgaaatgctattctccaactcttttctattgcatttttatggtttaatctatatatttcatccacaaaataaaaagcctcatcttgagtcctctcataacaaatactccatcctctatcctcatcctttttcagttgtaacataaactgctagaaatattcgctattgactacccacagtttcatctttcactggaaatggtcatttgctagaggctatactgtctctgagatagggacaaaaatgcctggcactattcacaatagcaaagtcatggaaccaagttaagtgtccatgaatgtttgactgggcaaagaaaatgtggtacatatacaccatgaaatactatgtagtatgtggtacatatacaccatgaaatactaagtagctgtaaaaagaatgaaatcatgtcctttgtagcagcatggaagtagctggaggccattatcttaagtgaaaatcgatttcattatccttaagtgaaatgtttcctaactcagaaacagaaaaccaaatagtgcaggttgtcagttatgagtgagagctaaataatgggtacacaaggtcataaagaagaaaataaaagacaccagggactccaaaggaaggaggctgggggtaagggaaagggttgaaaaaggtcttcttccagtgtttctatagtttcaggtcttacatctaacttgttaatccagcttgacttaatttttctatatggtaagagataggggtctcatatcctttgcaattgagcttcttaaagtgttgttacatttactatttcggcttcttttcttcccagttctctcctcagttagcttcaaccagctttgttgaatccattatccttctaaaattatccatacctagattccaacgtctgattgcaaagcctatcttaaggttatataacagttgtcctgtctcctgaaatgacctttcttggcttttacacacctgctagctttgtattcctcccatcattgttcaaaattgttctcagccaactttgtcaacagtgttctgcaacttccaaaattgttggagtttttctggagttcttggctctttcttcaaggttttataataatcagaaggtaataccattcagttttttggtcttatttactccatccataactctaatgcaaatctctattttcagtgtcagatcctgctccaccccttactctactcagtgcaatcccacagttctaactgtgagttcattatcttcctccatcctctctattgttccattcatccagcaaaacaaaccaggaacttgagactaatatttgactttttctcatctctcctgtctctaactcaccacacaactatgagatgaaactttctaaaattgtacccagttatgtaggccccttgcttaagtcccctcaatgatctttattgtcctcaagataaggccccattttgtttgcaaagctcactaaaactttcatgaactaaacttctctctcaccagagatactctattgtagttatgccttctctgtcttgtctagaaaggcagtataattcagcagagtcttgctgcctaaatttgagtcacgtggtttgctatccatgtgatgtttatttgtatggagctagagactgaattttcccaggtctcagtttcccttaatgttaaaataataatagtattcatctgggtatgtatgagacttgacatcagacctgcaaaatcctgtgatggtgtctggcaaatagaaatcactcaacaaattgtagctgtattcattattattaatagtagtatttcattttatacattaaatttctccagggcaggtgctatgctaagtattcagtacatattaattaaataattgttacttggatataaaatagtagagctctaccttatcaagcaaactaattcacttctttaaactctgaaataattgtgcaaattaagccacttgaaagaattgaggtaagtatactctgggaggttacagtagaaataacatattgtaatatatataaaatgagaagagacagtaagactaacccaggaaactcaatcacttcacatgtagaggcttgagaaatattttctgaaatatctaaaaaacaaaggttttctgttaatctattgtgcctatgccattggagaaagtaaacttcgtaaaataaagctcaaccaaaggatgtctttcaagctttcttattcaaaccttctggcagagactgaaaactcaaccactttacttatcaaagactgcaatcaacatagcaaagcttaagaaagattagaaatgaataagctgctccacagactctgaaggttattagagtttgatagagtcagaggcagccacaccatatggttgctgaaaaattcactcatcaaggagagtcataaaattgcagtacatttctaaagacataaaccccctacctgttaaggatcaaaaataaccagggacagagaatttgccaggaaggaaagtaaagcaggagtagaaatcttcaaaaacaccattccaggatttgtactatatacaactgcatagcggacagagagacctgtgaattgtctttagacaatactgcctcaatacttacccactactgacacatgcccatacatggggtgtttcaccagtatgtgtcctgattcaattactgccatgaattttctcctcttccacaaacttttcagaatgaggcaagcactatttttttaaataaatccacaacatttaggtataaaagcatatatatttccaaatcaaaggaagtccaactctgagtcactagtgagaaattctatctcttatactgcaaaaccccaggtcccaaggattgtatataattcagaacaattgaaaaggaccaccagtttggggttttttttaaattttgttttccattattcgtggatcaagtgggaatggtcttctgagggtaggagtcaccacttgtctctcaccaggcttaagaggggaaattttgcccagactggcagcctcagtgtgctggatctagcctttctaggatcaccctaaagttattaccctccaaagttcttccacttcctcagaggtttgcaaagaagctggaagtgagtcttccgaaatagcataaatcatgaattgtaactaatcaaaatgtgactttatttttgtttcccacagactttttaggctttattcaatgggtaatttttcttcattcttggacgaaaacttaggccctgtgattttctgcacattcttatgggattggttgccgtaagtcacaatcattgtgttatttcaataattagcatgtccagaacaagattttaattagaactttgaatttgtttaagtataaatctctcttctagtttggaccagctttattctggagcctgcaaaaggcatcaggacagtgggaatcagatattttaagtcagctgttctcactgctcttagcacatgattaaacttgactcttgtgaggcacttgcataggcttttcagagacgctcacctctagaaacttctatcctgaagtcccacggccatctgctgttctaagcagatactctgaatttttctttcagaatctagtgataaactctaactagcctctctctgatgggatattcacagtcctctagtcaccctcttcgtcatgatcttagattacctcaagccaactctctattccacgtgaccagccactgacctaccaatcacactctcacatcgtttgctctgacaaactctgagggtgcaggatgtttgcaatgctgcaatgctctgtgggctctgtcaccaggcaattggcttgtctgtcttctgcccactactgctgtcaatgtgaccccaaactgcagagacacacatggctttctgacttatcttgtgaaagccttccttaccaggcttaaggaagtgccacagacccaggtacattgtgtggagggtgccaaattggtcacagagctcacaataccattttcccaaagacattgtcctcagaaatctgctgtctccacatttcaaacttttgtatattcttcatctgctgagagttcttggagtggtgaagatggaactcaagatattttatataaatatatactgcatataaagatatgcctcatatccactctggtatcccagtctctcttatggtagcatatttgaaatggagtcaacctgagtctcctaacaccctgtcatagcagtatcatctgccaaaaccgcagcatttccagtttggggcaggctcccagactttcctataatattgctacttctttctctttcattgatctctagaaaaacacacaatttctcctcaatttaaattggcttttaaatcctccattcttggattggagtggataaataagatgctcagaccaattttatttttttcttatgaattgatcccactatatgaataatgaaagaactgcaagggtttctcatgatctacaaagatcagttaccgctggaaaattatatatgttttatatattgatatacattatatgtaatttcctcagagtaaagaatacatgtataaatatacacatgtatatatgtggttttaaattttactatccaaatattgaatgcatttgaaagctctgacagcatttgtgatgaatgagaaatctctaattgctactgaaacactccttagacatgccaagtacgttcaaaagaaacttttaaaactttcactgagggtgaaaatatcaaaatcaataatcctaataaacaacttcttagtattcccagagatattctgacagatgagagagaagattgttcacctctagatttttccctcttttttcttttgatatcgagtgagcatgtatgtcttatttgtgtgcagaaatataaataatgcaatgaaggatcacaaaagaggagcctcctcacaactgatgagccatttttttttaattaacagaagaaaaagataaggaccatactgaaacaattgtctgaggtcccagaggtaaaccttaatacctgcattttaacaagtgtttgaaattgaaccaagtattggaatagaggaggatataaaaaatgactatgttgtcaattatttcacacttcagaaaaataatacacatttgaaatctggcaagcatgaaaaaggtcacgtggaaaagaactctgctacagatgaaggtattgctttgctgtcttacacataaattattgaataagattacagtatttacaaggaaagaaatttttcaactgtctaatgactaataatgccgtctatctccctccaaatatgatgaaccttgaacatttttctgggtctattcaaaattattttctcattcctcgttgtattagattgtgataagaatttttctctgtgtatatatgtgtatgtgtacacacacatacacacctatacacacatacacatatatacacatacacatatggagacagatagtttattcagttgatgagtcaagagtggcaacacaggagaaagaatggttcattgtaattgttgcaggacatacggtattttctggccacaggtaacataaataaggaggtgataatgttcctatatttacaataattaaaatctgtgtgggacatgcttagtgacacatttaaaagtgtatcttaagcacacggaataaacaatgattcattaaagttgtggaacaaacatgaccccaattatgtttcaaatgacaggaagaaccaggaatgttttctctggagaatacagcattcaattgaacagctacactgagaaacataagaactatcttcacatgtttaaaacagctatgtggaacaggagataaatgtttctttaggtgccagagaggaatgagaaaaaggtagagggagatcatgtttggatcatagatagaatgggatatctcagaaggaagcgagttgtctacaatctgaggtggtcagataggtgatttgaatcatgtctaggatggaatttgacttggctcattcataaagagtattcatactgtttcatcacctaatatcacattaaactcatatgggacatattcaaatgggttagaggtaaagtagagagataccagttgactccctgccccgagtagggccccatattgactcctacttttgggccttgggcagaacagagcaagtaattcagagtcacaaaatacttttgtgttttagccctttcaaaatggtcagcttcctctaacaagctctaaatctactctttaaaatcctgtattttgttgttcaattaatttataccctccattttttgttttcaaccataaaactattctttatggatttcataacttaaaaattcatatgctacattgacagcccaaaaaaagaaaagcactttcctttttcaacatctgtactattgtgatttatgacctctttttatttggttctctgtcttacattttttagtaggtggagggataggaatccattctttgaaatgaatcgtatataaatatctgagctgaaatacaataacgagtctgtcgtgcatcacacagtagaaccagaaagataaataatgtagccgcataaaaataccttattatgcttattataaacacctttgattttacctaaacacagccaagtacacagtgttcatactaccctagtgttttgcatagaaaccatgcaacatataaacttgtatgtgtgtttattttcagtaatctctaatcactcagtggagtttagtgttagttcatctttaaatttaaaccattattctatacacagggagctataacatttttttccacatggtgtcatatttatttccacaaaggaaaagtgatgacagaaacatttttttaaaaaaaggggttccaaaaaatatgtattaaaacaacagtagatttcccattaagcaaagaattcagtacctcatttttcagccagttgaaggagcgccgagaatgtactggctttggaaaagatacctctttccagccaaaactcttcagagaggttcaataagaataatttccattcaggaattccaattttcatatgccaggtgtcaggactgtcatacctttggactgtttagtcttagcaaacctaataaaacaatcgtacataaccacaaggaaacattttgttgctcttttcctcacagcatcacttttaagttcaactaaatttacgaaaaaccagttttgcatttttgaacatcttgttcagatttctaaggaagatttttcttgaaagcacgtcaatataatgagttattaaaatatacacataaaacaagagtgatattcaagtggttatatactgaatataaaccctgagacatgaagtttaaatggtattctttctggagaaaaaaatctgtggttgaaatattttagccttatcttactggcagttcacagggagtcagataatgctgatggctgctgctttgtgccaaacatttgaaattcagtatagaaaaggggcttgcaaattgtcttcttgacccatgactcagttttgtgagatgatggtttcccatgcagagtttcaagttgaagatgcccttgttttatttctcacagtttatagttctacaaaaggaatgcagtgggaagaatttctcaaactaaatattttaagggtcacctacaattgatattgtttaaagcaattccttaacaacatttcattaaaatctgttttagtttctccatcaatatattagtgttaagaaagcaattcattttcatagagggctgatgtgactgctctattgctctagcataggagaaagcataatatagattgcatttaaaaaatcctccctagattacatttctcctgatttagaagataataatataaattatttatttactgacctatcctgaaatggttgtgaaggatctcagtgattcctggacttaagaattcctggcatttaggaaggaggtaagtatttattttgcccaagtgccagactataagctgggtgcatattgtctcatctaagggtctcaagtgtcccctgaggtcctcaatcagtcttgcccttagttaaggggagttctaagccatgactcattttcaaatcactgggtccatgaggccctttctgaccataaattgtagttctaaattcagagattcagtatcaggtttaagaccaagtccttgagctgtattatcagttttagtaggtgggttcatagtttattctgccatgcctgagtacttctctcaataactgatgtaatacctcagttcctcccagaatgtttagtcttgtttgctttagctacatttctgcagtgactggagtctagttctagtacttgctactggtttggtatcttttattgctggcttccagcatatccagtcataaatctattctggactcctatgattaaaaaccatccctttggaattacaactaataactagtggaatggaaatatttataaacctgtttattctcatagcagtgcgatgctttgtaacataagccgttatatttgccatgttaaaaaatggagaaaatcattaattttaaagattattgaagtaatgtggaagatgaatttttttatcttgtccccaagtgtgaaaaatcctcaaagccaaagagccatgttcatcattgtatcccttgtcaccaaaatgggacctggcccaaagcagcaggtcccaccagcaggtctaatttccaggttctaattcttgccagtctcatgccagagcttgattctggcatctgatagcttcattttagagctttcatggtgttgaaaaaaaaatgtcaaagatgtcacgataagatttgcagctgcaaaagtttctgacagagcagagcaaacagtaataaattgaggcaaaagggataaagagagagtaggcctccttttacctctaaaagcatcaaatatataaggtgaatcaaggtgacttagtgcttgttccacagagtcacacttgacaaaggaaagctttagcttaaaaaaatcaatgtgttagggtaaaagtatgtaacctgcatcttcttcaagattatcctaatttacttaaattacagatattttttctgtattagtttccctagcaattgatgttcccatgcatggacatatccagggtcaggcatcaaaaatctagaattttgtttcctatagtcagtaaagcatggaaatgtgaacaacataatacatattaccttgattcttctttagtcactattaaaagtaaaatttatacatttgtaaatttataaaaatgcacaaatatactctatttcatacatctagtcacattattaataatcatgagataaaatatgtagtattaattgaatgtgaacattaatctctgttctgctaaccaattaaaatttaaacacaaaaatatggcttaccaatgagaacaaatcatttaagtattacaatagataataattttttggacaagggaaaccttttcatatttttcaatgacagtatttagtcctttttagtaacaaaaagtatatcctctcagccatccaacaaagtgaccatatagcaggtacaacaggaaatgcttttggaaaatgccaagcattcagaaattgacatctacaaggtccataaaagaatgtctaaatgacaagttttatatggttgtgtacaaaaatgcatgtagcctatagaactcaacagtatattagccttcttaaagaaatattcgtgaatcctatacacacacacacacacacacacacacacacacacagagagagaaaggcaagaaagacaaaagtgtttttaaaaaatgcacattaggctgggcgcggtggctcaagcctgtagttccagcactttgggaggctgaggtgggcagataatgaggtcaagagatcaacaccatcctggccaacatggtgaaaccccatctctattaaaaataaaaaaattgggggaggagccaagatggccgaatagaaagagctccggtctacagctcccaacgtgagcgacgcagaagaccgtgatttctgcatttccatctgaggtaccgggttcatctcactagggagtgccagatagtgggcgcaggtcagtgggtgcacgcaccatgcgcgagccgaagcagggcgaggcattgcctcacttgggaagcgcaagggtcagggagttccctttctgagtcaaagaaaggggtgacggatggcacctggaaaatcgggtcactcccacccgaatactgcgcttttccgaggggcttaaaaaacggcgcaccacgagattatatcctgcacctgtcttggagggtcctacgcccacggagtctcgctgattgctagcacagcagtctgagatcaaactgcaaggcggcagccaggctgggggaggggcgcccaccattgcccaggcttgattaggtaaacagagcagcctggaagctcgaactgggtggagcccaccacagctcaaggaggcctgcctgcctctgtaggctccacctctgggggcagggcacagacaaacaaaaagacagcagtaacctctgcagacttaaatgtccctgtctgacagctttgaagagagcagtggttctcccagcacgcagctggagatctgagaaggggcagactgcctcctcaagtgggtccctgacccctgacccccgagcagcctaactgggaggcacctcccagcaggggcacactgacacctcacacggcagggtattccaacagacctgcagctgagggtcctgtctgttagaaggaaaactaacaaacagaaaggacatccacaccaaaaacccatctgtacatcaccatcatcaaacaccaaaagtagataaaaccacaaagatggggaaaagacagaacagaaaaactggaaactctaaaacgcagagcgcctctcctcttccaaaggaacgcagttcctcaccagcaacggaacaaagctggatggagaatgactttgacgagctgagagaagaaggcttcagacgatcaaattactctgagctatgggaggacattcaaaccaaaggcaaagaagttgaaaactttgaaaaaaatttagaagaatgtataactagaataaccaatacagagaagtgcttaaaggagctgatggagctgaaaaccaaggcttgagaactacatgaagaatgcagaagcctcaggagccaatgcgatcaactggaagaaagggtatcagcaatggaagatgaaatgaatgaaatgaagcgagaagggaagttgagagaaaaaagaataaaaagaaatgagcaaagcctccaagaaatatgggactatgtgaaaagaccaaatctacgtctgattggtgtgcctgaaagtgatggggagaatggaaccaagttggaaaacactctgcaggatattatccaggagaatttccccaatctagcaaggcaggccaacgttcagattcaggaaatacagagaacgccacaaagatactcctcgagaagagcaactccaagacacataattgtgagattcaccaaagttgaaatgaaggaaaaaatgttaagggcagccagagagaaaggtcgggttaccctcaaagggaagcccatcagactaacagcggatctctcggcagaaaccctacaagccagaagagagtgggggccaatattcaacattcttaaagacaagaattttcaacccagaatttcatatccagccaaactaagcttcataagcgaaggagaaataaaatactttacgaacaagcaaatgctgagagattttgtcaccaccaggcctgccctacaagagctcctgaaggaagcgctaaacatggaaaggaacaactggtaccagcctctgcaaaatcatgccaaaaagtaaagaccatcaagactaggaagaaactgcatcaactaacgagcaaaatcaccagctaatatcatcatgacaggatcaaattcacacataacaatattaactttaaatgtaaatggactaaatgctccaattaaaagacacagactggcaaattggataaagagtcaagacccatcagtgtgctgtattcaggaaacccatctcacgtgcagagacacacatgggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcccaaatatatatgcacccaatacaggagcacccagattcataaagcaagtcctgagtgacctacaaagagacttagactcccacacattaataatgggagactttaacaccccactgtcaacattagacagatcaatgagacagaaagtaaacaaggatacctaggaattgaactcagctctgcaccaagcggacctaatagacatctacagaactctccaccccaaatcaacagagtatacatttttttcagcaccgcaccacacctattccaaaattgaccacatagttggaagtaaagctctcctcagcaaatgtaaaagaacagaaattataacaaactatctctcagaccacagtgcaatcaaactagaactcaggattaagaatctcactcaaaactgctcaactatatggaaactgaacaacctgctcctgaatgactactgggtacataacgaaatgaaggcagaaataaagatgttctttgaaatcaacgagaacaaagacacaacataccagaatctctgggatgcattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaaacccttcaaaaaattaatgaatccaggagctggttttttgaaaggatcaacaaaattgatagaccactagcaagactaataaagaaaaaaagagagaagactctaacagacgcaataaaaaatgataaaggggatatcaccacccatcccacagaaatacaaactatcagagaatactacaaacacctctacgcaaataaactagaaaatctagaagaaatggataaattcctcgacacatacactctcccaagactaaaaccaggaagaagttgaatctctgaatagaccaataacaggagctgaaattgtggcaataatcaatagcttaccaaccaaaaagagtccaggaccagatggattcacagctgaattctaccagaggtacaaggaggaactggtaccattccttctgaaactattccaatcaatagaaaaagagggaatcctccctaactcattttatgaggccagcatcattctgataccaaagccaggcagagacacaacaaaaaaacagaattttagaccaatatccttgatgaacattgatgcaaaaatcctcaataaaatactggcaaaatgaatccagcagcacatcaaaaagcttgtccaccatgatcaagtgggcttcatccctgggatgcaaggctggttcaatatacgctaatcaataaatgtaaaccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccgcagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagatgacatgattgtatatttagaaaaccccattgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacacgggatgtgaaggacctcttcaaggagaactacaaaccactgctcaaggaaataaaagaggatacaaacaaatggaagaacattccatgctcatgggtaggaagaatcaatattgtgaaaatggccatactgcccaaggtaatttacagattcaatgccatccccatcaagctaccaatgcctttcttcacagaattggaaaaaactactttaaagttcatatggaaccaaaaaagagccctcatcgccaagtcaatcctaagccaaaagaacaaagctggaggcatcacactacctgacttcaaactatactacaagtctacagtaaccaaaacagcacggtactggtaccaaaacagagatatagatcaatggaacagaacagagccctcagaaataacgccacatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacatagacatgggcaaggacttcatgtctaaaacaccaaaagcaatggcaacaaaagacaaaattgacaaatgggatctaattaaactaaagagcttctgcacagcaaaagaaactaccatcagagtgaagaggcaacctacaaaatgggagaaaatttttgcaacctacttatctgacaaagggctaatatccagaatctacaatgaactcaaacaaatttacaagaaaaaaacaaacaaccccatcaaaaagtgggcgaaggacatgaacagacacttctctaaagaagacatttatgcagccaaaacacacatgaaaaaatgctcatcatcactggccatcagagagatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccatggtggaagtcagtgtggcgattcctcagggatatagaactggaaataccatttgacccagccatcccattactggatatatacccaaaggactataaatcatgctgctataaagacacatgcacacgtatgtttattgcggcattattcacaatagcaaagacttggaaccaacccaaatgtccaacaatgatagagtggattaagaaaatgtggcacatatacaccatggaatactatgcagccataaaaaatgatgagttcatgtcctttgtagggacatggatgaaattggaaaacatcattctcagtaaactatcgcaagaacaaaaaaccaaacaccgcatattctcactcataggtgggaattgaacaatgagatcacacggacacaggaaggggaatatcacactctggggactgttgtggggtggggggaggggggagggatagcattgggagatatacctaatgctagatgacgagttagtgggtgcagtgcaccagcatggcacatgtatacatatgtaactaacctgcacaatgcgcacatgtaccctaaaacttaaagtttaattaaaaaaaataataaataaaaaaaattagctggatgtggtggcatgcgcctgtaatcccagctactcaagaggctgaggcaggagaaacgcttgaacccgggaggcgcggaggttgcagacagccaagatcgcaccactgcattccagcctgggcagcaatagcaaaactccgtgaaagaaggaaagaaagaaagagagaagagggtggtggggaggggcggagagagagaaagagaaagaaaaagttacattattaattaacatgttttgaatggcttcatccagaacataataggaagacacgtgtacatttctcagaaacaattgttttcttgaaatctcagtcacagcataccctcatttttgcctaaaatcatcagctttttactaaatgattttagttgatgtttccatagagatcaaaaagtgaccatgtgagaatatatacgtgaagttccttctaaactgcataccattaaaatgactcctatttctatggtttttttttttttttttaactcacacctctactcatctatcttattttttatattatggtccttcaaactatgacccaaatgtcccctgctagttctatttcctgagacttccaaatataaaaccctctcactcattacatagaatagggatcatagtttcttgtcatgagaaggtgtgctatgagattcaatatattgccactagaacagcatatttctaaaccctgatgatggtcagagatcaagatggcatacaatagtcatgcatattatagtaaaacacaaaagataactatcagaatttaaatgtatataaaaataatggttttgcctaaaatagatttggattaaaaaaatagtaatgactgatgtctttgaacgtacatgaacacacagttgttagtggtgtatatgagaattatcaagtcctctatctttttaatctaatatttctccagtctattttacatgtgcaattttaaaatatctttatgctttaaaatataatcttaaagcaaatcttataaatgcaattcatgaaaacttacaaaagtaacgaggaaatattttcaccaagttggaaactacattttattaataatttaaaaagttagcagttggtaattttctcaaaattaatattgaattattttacagtgtttgaaattatttttctctcttatttctgatttctcatgtcatctatatagaatatggaatcatgtttaaagattttaaaacatttaaaaaacatacatacattacataaatatatgtgtaatatgtacacatatgtatatgtgtgtattcacacacacacactttggagaatatttatctgtgtatttccgttttaccttgagttttgattcaaaacctatgtttttcaataagattataagtttcatgagattgaaatctaattcaatactgtacatctttagcatgtattatcattccttaaggataatgctcattttttttgtagctagctttttgtagcttctataaattgtcattccagatggcactccattgtttcaaactcgatgccactcaccttcttttaggaaaagatttgtatttaataggaagcctgggcagtgtttttctacaagaagagagggtgtagcttgaggaacgatattaggttttgcaattgaattgttcttctatgaattactcctaaaaactgatgtaagcaaataactcttccaagtctccaagaactgctttaccacaggaaatatctcaacaatttgctgaaaatatttgcatctgttcacccagaaagtgaaaatcaaaagtgattattatctttttctccttaaagaaaccatcataggtgccctgtgtcatccaacacacaccctagctatgggtgtgtgctgtgttgagaaatgctaataatacactcttgaaaagaaacatacctctatatttcccttgtagcatatattttttaatgaattaaacgtaaaggtcactggcagcaagaaaacacttttattattatactcaactcagtgcccaggttagagtctgacacagactagatgcttgataaatatttaccagatgaatgaatacaagttgtttataatctcagctgctgaataggctaatatactgccccctctccctgtacattttatcatctccagagattaaaaagacctaaaagatgtatcgatatcattttaccattccaagcgataaggcttaagaatggcttatattgtgtcgggtaaagaccaaatatggaaacaaatggtatatgaaaaattggcaggaaaaaaaatcacataagactgagagccaggcaagagatattttcttgtagtccagattatccctagcttgttgtatgttcctacgcaaatgactttatatttctgggcatcttgacacatctgttacatgaagaagatgctctagctgccaaagtctctttcaggttctatattctgaaatgcaaacaactagcaatactgaataatggttagcttgctgagcaatgaggcaccccatacattgctggtggaattttagaaaatgccgcagccgctctggaaaacagtttggcagtttcttataaagttcaatctatatctacccataaaatccaggaagtccactcctaggtatctactcagaagaaatgaaacattatatttacacaaaaacctattcacaagtatttacatcagctttgtttataattcttaacaattagaaacaacctagatgtccttcaaccagtaaagatataaacaaactgtggcacatagctcaaatgtagtattagcaataaacagagcaaactaatggttcaaacgacaacatgcatgaatcttaaatacattttgctgagtgaaagaatatgctctagtttgtgactttgtttctttcagggatatggatcaggaatcctaaaagaattacatttttatattaggattaaataaataaataaatgtattgtacataataaaagccaggtttcctgctaccagagaaagaagttgtaaaaggtgaggagggaagattagaatggctcctatggtgctggattgtagtaaatggcatcaatattaccttatttttaagtatgtatatgtgtacacacacacatatatatggacatgtaaacatatacaaaaatagctatgaaaatgagtgtaagcatgaattagtatgctacatatatttcctacttttatccctgaatggggccagagtcagtaagacccctgtaacaaaatagcacacctagaacccacacatttgtttctaaataccactctccaataaatggaaccaggactcctgtgagaaatgattgattccaggattgagacaggaaagtttaaagtgagcctgaagtatcttcataatgccagaaaataagaaactggggtaaaataataaataaagaaaacaaaggatggaggaatactgaataatcacaggagccaaactgaaaagtctcccaatggctaaagctggaatagcatgaacaaaaaataagtaactgatatttgagataaactcctaacaataaaaatttcagttcatactaacataaataaatggggtgatatggtttggctgtgtccccacccaaatctcatcttgaattataactcccataaatcccaggtgttgtgggaaagacacagtgggaatgaatcatgggggtggtttcccccatactgttctcatggtagtgagtaagtctcacaacatctgatggttttacacgaggtttcccttttcacttggctctcattctgtcttgtctgctgccgtgtctgatgtgcctttcgccttctgccataattgtgaggcctcctcagctatgtggaagtgtgagtccattaaacctctttttctttataaattacctggtctcaggtatgtctttattggcagcatgaaaatggacttactcagtggggcatgcgtgatggttcttctttatatatttatcaatggaaaatcacaattagaataccacagtaaaaattgccacaggcatgatccagagatagatgctaaaatgaatgggctaaagtttaagctgaaaccagatatttgcaacaagaagattacaacaaggaaaatagaaatttagagtggaaactcttcacagacactaccatagtcaagtgattaaggttaacataacctgtcattcaaattgtatcatcttcaatactctgacgtgatgcctggagacaagcacattatccgtgacattcatctcataaatgcataacctcaatctaataatcaaaaaacattagacaagcttaggttgaaagtatatataaatatgtgatgcttccactgacccgttctctgatccattctcttcaaatgtcaaggtcaagactgatgattgtcacagactgaagaagaccacagaggcttgacaattaagagcaatgtgggatttgagattagatgtggaatagaaaaagtacattaataggagaattggggaaattgaataaatcttgtgctttggttaatactattgaatgaagggtaatttcttttgataaatgttttatagttatataatatacaaacataagggtaagatggattaagggtagatggaactctctgtactatttttggaattattttatcactgtaaaattatttcaatattgaagagttaaattccttgatcattcaaccagtaggttgtcaatgtattcattacaggatgccaatttgagatttttttaaatttaggataatttctaatttcctcctgtgtgttttctgtaatcatagggaaacatcaaaatatctaggtactgcctggtcttaagaaatttccctatatatagcacacatcactttagcccacataaactgagatatttggccacatctaactgtaaggaagtctggaaatggtatcagttacaattctagtgctgtagaagaagggaagaaagattttggtggttggctatcagcctgtgatgcaagaataaggagcactataggagattctcaacctaacatttatttacaatgttgatgcacttcatacatagaaaaggctcttaaagaaatatgagtactgtcataaatattaattgcaatcactaacattttagtatgttttattttacaaggatctttctgtgaaatattgcttttaaatctatgaaataaatataacaatcccaatttatatatgaagaaattaaagcagagagaaattacatatatagtgacatagctgggatagagagatattacatatctagtaacatagctgagatataattctagattttctgacccaacatggacatttttctgtaaaaattgtttaaagattctatcagtttaattgttaagaatgttttcaaaattgaaaaaaatctcaccccagtattaaaatcacattgtcagaaaattgtataactcttgtcttcagagaattaggagcttaagaatgagtcaaattctccttttgaacttgacttaccatatttgtgaagttcataatgactgaatgtttcatttaggccaaagatccaccaattccaggctctgggtaaaagccagacctcgaagtctcctattattccaagagtacatttccaaatattttattctctttatttgtctcatgctctggttttgtcccaggcaggtctcattcaagtccaagttcaaacaagagcctttcagtcttacagtctctcatctctcccccaatttgttttggctaattgcctccctctgcggccacactatttctctcactcaaacagttgatcccatatgtcaatgctgtttgcaaaggagcacttgaaagggtagggttattcataggtagcattgttgaaggacagaaagccaggagaaactcctcagtccataacattccattatctacccccttactgtggagtgataaaataaacccctatgtatcacaagattcaaagtcagtattctagtccttctttcctattcatataaaattggtatatcaacattgcaacaagactgtcaagaatgctaatctgatttccatcaatgagtgggtaaatgttctgaatggcagagctgatatatatgtccttgctctatgatagtcaaagtatactggaggctttgggcaaaagtcatagcctcattctttaaaagacctccagaacttctgcctgtagaactgtatgaagggtaaagggactccaagacattccacagaagaataacaagggaatatacaaagactgcataagagaaaactgcaattggaagagttttctccaactatcttaagggcagccctgaaatagtctttagtgaggcatcattttgattaactaaaagggaaagccagactttctaaatggtaattcttaggaataacatattagctcaacataaagaaagataagtgtaagtattagaagtatcccccccccgccaaaaaaaaaaagaatgggtatctcagcagagagctagtttctcatctcttggaaggcttcaggcaggagagcaaaagtaacagagtctgactatatagctacatcacaactgacaaagtttatttaactattttaaaagtcaatttagatttattattggatttactttttaactgtccataaatctgttaaggtaggcgtaatggaactagtgcaagtcaaaaaagtggacaaaaaacagtcaatatcaaaaaaggaaggcatgcaaatgaattcctctctcgacagatagacatatctatatatatgaatatctatacatatgatgtcaaaattaccaatgatttgaagataaataaacaggcttcttgtaaagaattaatgttgccagggatcccatttgtctccaaagctgtggtggtggatgccatgttgagatgttaacttattttctcctctccccttcaaggaggtatttagctctatattcaatcatttcaagaaagacatggcaggacaaaaaagcggaactggccacaagtcttttaagatcttaggaaaagctggaagattttatgatgaagccaagattctttggtttcttgggcataagcttctgaatgcagagggagaagaattatctccagactagaaaaatatgcctgcagtatgtaaacagggacatatagaaggagggtatagattagagacagggagaactatatctgattttctagccattcctctggggagctaacaagatggcagacaaaaaaatggcttgactgtgttgtgcagctcagtacccgggatccttgcatcctacactggtcagggttctccagagaaacaaaatcaataggatctgtctctctctctctctctctctctctctctctctctctctctgtgtgtgtgtgtgtgtgtgtgtgtgtgtgtgtgtgtgtgtgattatagaggctgagaagtcccatgatctgcaagctggagaaccagggaagctgcttgttcaaatcactctgagtctgatagcctaagaaacagagagccaaaagtatatctctccgtctgaggttaaaagcctgagaaatggggagactactggtgtaagtctggaagtctaaaggcctaagacctagagttcttatatacaagggaaagagaagaatgatgagaatgatgtcccaccttcggaagaaagagcgaatttgccttttttcagcctttttattctatctggactctcagtcaattggatgttgccctctcacactgggtaagggcagatcttccttattcaagttcacttattcaaatgccaatctcttccagaaacaccctaacagatacacccagaaataatgctttctcatctatctgggtgtctcttaactcagtcaagttcacaactaaaattaacaagccctctagaccaagcatgtcagggaagcagcagggagcaactgaacctgaagagcctagaagggctccacaatggacatcatgaaggcaaatcacaggaacaaatcacaatggtctacatcttgagtgaccaatgatcttggtagcccaggactttccaggtgttagcactgagagacgcatatctaggaaaaatccttcagttccgtgcaaaccaacatttgtcatttccccatcccattctttgtctgcggcactagtccaagaaggatggatatttcaagaaatgaagttaaaccttctaactttttcctaagcactagagattcagagtcagaatttaaaaaggaatgaccaagaataaagttttattttctgacacgacagaatttgtgaatcaagagtaatacctaccataactgaataccataaaaaaggaaagaatgaaagtttttcagaggaaaattgatagcctccaattctatactgagccaaaatactctatagaaccaccaaatagccccatcattgcaaaagttagaaaacattgtaaaacatcgtaaatatattttaatgaaagaaaatgaaaggacaaactaaaaaaatacaaagaaaaggcaaatagcagaatgcattaaacagttactcaagtaggattagtcatattgcatgtgataatattaatgagttaaactccctcttaagtaacaaaactctccatttgcatttaaaaaaataattcattcacaggctgtaataagagtaatgcctaaaatcgaacatggctctgagccatccaatattcaggctctctcctgaaaccccattgtaacatcaataaagatgttattttaaaagacacaaactgaaaaatggaagaaaatgaaagtagagacacaccaacagaatcctgaagcctggaaagcatgtgaataagtggctttgttctgatttgcactgccaaatcttccaaaggctcagaaatggatgtccacagagactctgtagtggggctggtgttgagaaaggaggttggttgagagctgcttgaggagtgttatttgcctagctctctcccactctgtgcccttagtggctgcccctccctgacctagcataatagatgtctaaaattttattctctggaaacttgaaagagagggtctctggacagagggacaccaggaaaagttgaaagcacatgtgctgtaacaaaataaacaaacaaaaatgaaaggaatattaagagaacatctgcaaactgagtgatgagactttctacttaattatccctgccttttaccagaatgctgcagccaggacttaacttctagacaagaggctagagggatttttcctaggaaatactaccagcccaagaaggagaggacttaagagactcacaccgaggaagccccaacaaatgtctcagataatcttactgtgccttactgtgaatcccaagatcagtgggtcccattctcatgcacagagtttaaaattagattttcagacctttcactcttttttttcttcacttagtcctttatttaaggaagtctagagatggatattaatattaacagaatctcaaaagttgaattactgaggatatattcagcaaataatttaagagtgccagatttaatgatttgaaacacgtctccatattggatgaactcatattccctatgtaattctttttttttttttaatactttaagttctacggtacatgtgcacaatgcgcaggtttgttacatatgcatacatgtgccatgttggtgtgctgcacccattaactcatcctttacattagctatatctcctaatgctatccctcccctttccccccaaccccatgacaggccccggtgtgtgatgttccccttcctgtgtccaggtgttctcattgttcagttcccacctatgactgagaacatgcagtgtttggttttttgtccttgcaatagtttgctgagaatgatggtttccagcttcatccatgtccctacaaaggacatgaactcatccttttttatggctgcatagtattccatggtgtatatgtgccacattttcttaatccagtctgtcattgacggacaattgggttggttccaaatctttgctattgtgaatagtgccacaataaaatactggcaaactgaatccagcagcacatcaaaaaacttatccaccatgatcaagtgggcttcatccctgggatgcaaggctggttcaacatacacaaatcaacaaatgtaatccagaatataaacagaaaagacaaaaaccacatgattatctcaatagatgcagaaaaggcctttgacaaaattcaacagcccttcatgctaaaaactctcaataaattaggtattgatgggatgtatctcaaaataataagagctatctatgacaaacccacagccaatatcatactgaatgggcaaaaactggaagcattccctttgaaaactggcacaagacagggatgccctctctcaccactcctattcaacagtgttggaagttctggccagggcaatcaggcaaatgaaagaaataaaggatattcagttaggaaaagagaaagtcaaattgtccctgtttgcagatgacatgattgtatatttagaaaaccccatagtctcagccccaaatctccttcagctgataaacaactttagccaagtctcaggatacaaatcaatgtgcaaaaatcacaagcattcttatacaccaataacagacaaacagagagccaaatcatgagtgaactcccattcacaattgcttcaaagagaataaaatacctaggaatacaacttacaagggatgtgaaggacctcttcaaggagaactacaaaccactgctcaatgaaataaaagaggacacaaacaaatggaagaactttccatgctcatggataggaagaatcaatatcatgaaaatggctatactgcccaaggtcatttatagattcaatgccatccccatcaagctacaaatgactttcttcatagaaatagaaaaaactactttaaagtaaatatggaaccaaaaaagagcctgcattgccaagacaatcctaagacaaaagaacaaagctggaggcatcacgctacctgacttcaaactatactacaaggctacaataacaaaaacagcatggtactggtaccaaaacagagatatagaccaatggaacagaacagagccctcagaaataataccacacatctacaaccatctgatctttgacaaacctgacaaaaaacaagaaatgaggaaaggattccctatttaataaatggtgctgggaaaactggatagccatatgtagaaagctgaactggatccgttccttacacctcagatctttcactcctaaacacactaaaggacccaaagttaccaggtgttttaggaaagtgtctcatataaaagctaacaggccaaaacaaacagaaaaagaagacaatctggaggaagagaaaataattttaaaagaagggaaaaaaccatatcattaataacctaagagagatactgaatctgtgattaaagtatatacagaatctttttaaaaagaaataactatttagagaatttttttaagccttggaattaataatgccatgaaagctaagaaaaaatgatataagctttgattacaaaaaaagttaatacaaagacgaaaaacaactggtaagagtaagaaaattagaaatctatgcaagagatttaatgtctgagtaaatggatttaagaaaagaggccgggcacggttgctcacgcttataatcccagcactttgggaggccgaggcgggtggatcacggggtcaggagatcgagaccagcctggctaacacagtgaaaccccgtctctactaaaactacaaaaaattagccaggcatggtggtgggcatctgtagtcccagctactcgggaggctgaggcaggagaatggcgtgaacccaggaggcagaacttgcagtaagccgagatcgcaccagtgcactccagcctgggcgatagagccagactctgtctcaaaataaaataaaataaagaaagaaagaattgagaaaataataaataatgaatgatgtaatttaagaacgttttccagaattaaaggacttaggtttctatctagtgcccaagacaatggagttaaaaaagttgtactctaaggtacatcactatgacatttccaaataatagagaaaagaaattctatagacttacagaaaggggagtacaggaaggctcatataaaatcaaaaataagaatgtcttccttctaaatagcaacacaaagaaccaagctatgaagtcatgccttcaaaattctgaaaagaaataatgatcaaccgagcagaattttactgcagccgaaatatcaacgaagtgtcaagataaatttgagctatcttctgaccaccaatgtctcaaaatattcacctgtcatttatagaaatatgttgtagaatatgacacaccaaaatcaatgagagaaaaaaagaagatatgagaatatagaaaacacaaaaatctaacaatggagtaaaggaatctctatgaggatgatgacaggaaatttcatggtaacagttgaattccagatggacaaaatatctagtgaagctggcccagattcttattcattattgtgttgatttaaccatgtgctgagaaaagttttattctctccttcatgccataaaaaaatttcttctttgctgtacttgtaggagctagaggtaaactatagtaattttagaggcagaacatgcaaagcagccccaaactctcttccatgtccctatgggatgcctggtacctgtcccaggccacagctctgccagacaactggacagcagtgatctttgtgatccttgtgttttgacacctactctaggccacaggctctggctttctcaaaagataaccttgaaatcactctgtaaaatcttggttcaacttaccttcttcagaaaacgtttgtctaataatacaactattgcccttttcttaggcttgtggagtgctaatcatcatactaatatttcatattcatttggattcacagtggttgatataattttgtaaaaatccttgaaaaaaatgaaataagaggaagggcaaaagcttaccaaaatatgccaaaccaatgataaaaacaagaaatctaaaaaaaaaaatcagacgaggaatattacagataaagtatattgtgaggccatgaaaaggagaatcattctgtcttgataaagtgtacagcccacgatgaaaatataatagtctttaatatgctacatgtgttgtgatatgttaatgcatactgataactcacatcagaattcatgaagcaaatgctatctggaaattgatggacataaaattgtcatgggaaacttgaccttgacaaaataaatacacagagaatatgacaaaaaaattaatactaagaactatttatgacaaacccataagcaatatcatgctgaatgggcaaaagatggaagcattccctttgaaaactggcacaagacaaggatgccctctctcaccactcctattcaacatagtattggaagttctggctaagacaatcagacaagagaaacaaataaagggtattcatcaaataggaaaagaggaagtcaaattgtctctgtttgaagatgacatgattctatattagaaaaccccatcgtctcagcccaaaaactccttaagctgataagcaacttcagcaaagtctcaagatacaaaaaccaatgtgcaaaaatcacaagcattcctatgcaccaacaatagacaagcagagagccaaatcatgagtgaactcccattcacaattactacaaagagaataaaatacctaggaatacaacttacaaggcatgtgaaggaactcttcaaggagaactgcaaaccactgctcaaggaaataagagaagacacaaacaaatgaaaacacattccatgctcatggataggaggaatcagtatcatgaaaatggccatactgcccaaggtaatttatagattcaatgctatttccatcaagttaccagtgactttctttgcagaattagaaaaaactactttaaatttcatatggaaccaagaaagagcctgtatagccaagacaatcctaagcaaaaagaacaaagctggaggcatcatgctacctgactttaaactatactacaaggctacagttaccaaaacagcctggtaatggtaccaaaacagacatatagaccaatggaacagaacagagacctcagaaataacaccagacatctatagccatctgatcttcgacaaacctgacaaaaacaagcaatggagaaaggattccttatttaataaatagcgctggggaaactgtctggctatatgcagaaaacagaaactggaccccctctttataccttatacaaaaattaactcaagatgaatcaaagacttaaatgtaaaacccaaaaccataaaaactctaggagaaaacctaggcaataccattcaggacatatgcatgggcaaagacttcatgactaaaacaccaaaagtatttgcaacaagagccacgattgacaaatgagatctaatcaaactaaagagcttctgcacagcaaaagaaactatcgtcagagtgaacaggcaatgtacagaatgggagaaaatttttgcaagctacccatctgacaaaggtataatatccagaatctacaaggaacttagacaaatttacaagaaaaaaacaaacaaccccatcaaaaactgggcaaaggatataaacagacacttctcaaaagaagacatttatgtggccaacaagcatatgaaaaaaaagctcattgtcactggtcattagagaaatgtaaatcaaaaccacaatgagaatggcgatcattaaaaagtcaggagacaacagatgctgtggaggatgtggagaaataggaatgcttttacactgttggtgggagtgtaattagatcaaccattatggaagatagtgtggccattcctcaaggatctagaaccctaaataccatttgacccagcaatcccattactgagtatgtatccaaaggactataaatcattcagctataaagacacatgcacatgtatgtttattatagcactattaacaatagcaaagacttggaaccaacccaaatgaccatcaatgatagactggataaagaaaatgtgtcacatatacatgatggaatactatgcagccataaaaagaatgagttcctgtcctttgcagggacatggatgaagctggaaatccatcattctcagcaaactaacacaggaacagaaaaccaaacaccacatgttctcactcataagtgggagttgaacaatgagaacttatgggcgcagggaggggaacatcacacaccaaagcctgttgaggaatggcgggcaaggggaaggagagcattaggagaaatatcgagtgcatgcagggcttaaaacctagatgatgggttgataggcgcagcaaaccaccatggcatatatatatacctatgtaacaaacctacatgttctgcacatgtatcccagaacttaaagtaaaataaaaataatgaatttgtgtgctatatttaactatctagataaaattcatgttttaaggaaaacgtattactagaattgaaccaacaggaagaaaaatctcagtaaactgtggaagaaattggagccaaatcgttatggtggtaaattttctcaattttcaaggaagaatatgagaatatttatatagtctcattttgaggattatgcttctacatgtgcaggtgaaggcagactcaaaaagcagaatgtaaatagtacctaaatgctttatgtaaaaaataaataaaatttaaaaagaaatgacaaacttagaagaggaggggaacattgtgaatatatatgacagaaatttaatatccttaatatgcagaagttcttagaagcaaattaaaattacatggggcataatagggggcaaagggcaaaatattgaggtttgctcaggtttatgtgatgggcacacagactggttgctcagaaagaattacaaatgaccaaaaagctatgaaaaaattatttgatgactattaaagaaatgcaaattacatccacaatgacacctaattttaatctgtttaataaaggttaaatacaataattattataatgtattgctataaaaggggggaaatgggaattgccaaaaccatctaggaaagaaatctgaaacagtaaaggaagagacattaaagctgacattcataatatttttgcccagaaaacccagttctagaaaatgatcttaagaaaataattatacatgcacaaaccaatatataagaacaatctggatgttttcataataaagtgaaaataaagtgagtttcattaaaaagtgagaaacattccatatgtgtatcaaaactgaatggtttgcatataaggtgatttatctacttaagaagttgttttagccatgagaaatcatactaacaataatttaaaattttggaaatttctataataatgtgtaaattaaataactcaatagaaaattacatatgtggtacaatcccaatataaacatgtttgagcatggatgcgtgtgttttatgtgtatacaattatacacaaatgttaagaagaaaaggctaaaaattatacaaaaaatttaactgtgcttatttctgggtgatggaattaagagtgagatttctattttttctactcatgttctactaatacgtttattcagaagtagtaatcattctaaacagcaagctgcaaccctcttcaatggaattggaaagtgacaaatatgaaatgaatggttctccaaggcatttgattgctattagaataggcttagtcttcctactggcagaaaaaaatccaaaataaccaataaaacttgttcacacaactgtgctgacaatgatattaatgcctagaacaacacagcagttaactaagggaaaaccatgctgggtttgactcaatgagaaccagaggagggtaaaagcaaatggaaaaagatgaaattgacaggaaaagcaaatggtaatttcaagctcccggcctgggtgggcagtttgggtaggaagctaacctctccagagtttgggttcactgaccacaagtgaaacaaggatttgcagagcaggccagatcgaggtaaatagctataaaagtgttctgccctgtaagtaccaccctgaaatataattaaccaccagaacaaaagaaaacagtgcccagggtttctccattcaggaaacaaatctaaagagcaggaactggagccatgtgccaacacttccccaagatcagaggccaagaaaatagcataatatctgaaaaataaatttggttagattctcgcagaactttctaactcacctctttggaactgtactgtttagttctaaggaccacttatgaaagaagtctgggtattaattctatcctaaaaccataacaattatgaagttatatttacatggttatatttactttggtaaattatatgagctatttctaacatattggaagaaagagctaatctacctggattatgaaaatgcttattctactttaaagataaacacacacacacacacatactcatatacttataagtatgtatatgtagatttagtagcttcaattcttttttttcctgttaatccatttaagcattcaaccattcaacaaatgttctgtaaatacaggacatttactatgccctaggcattaagaagtatataaagttatacaagtcacatgcatacttctttaaatctagtgggagggaataaaatattaatatataaatataaaaaaaggctcttacttgcaagaataggctaggctacactatagtaaataacaaaaacaacctgatacatcagtggcttcccataataaaggtttatttatcattcaccaaagtcttaaggaggtaaattggttctccagaatgatgttgcatcacatcatgacccaagaccacaggatgcttctaaaacatggcttccaaagttgctgtcaaaggagaaaagagatggaagaggcacattggctcttaaatatctcagagcaaaaatgacctgtcatttcatttactatttgtcagaattcagtaataccggcctttagttggttactctgtgaagcagactcagccaacgatttacatccaagtggtttatttcacaagtaatactgggagaaatcaatagtgaatgagaaacacaagatatgaaacctaagcaaggaggcaatttcagtcattatctatggatatgccactggatgtggtgaaatgaacacacagatataaaactcaggcatttccacatcttaaagatgaggcagcatcagcacctggaggaaacatctaaaggtgaaggttccaaccattagcagcaatctggcacacagactggttacagggagatctgagggactgggcagggcaacaatagtgtctgctccaaattgtaacaaaattcaaggaagctaaaaagaaagaattgtcctcatgaagagtaaattttgtagtaaacatgtggtgttgagtctgccatgtacgaggctatgtgatgtaagcagagaacactgcaatagcttagttataagactgaaggttgacagttagctccgttcatctttctagtgattgcaaaaatgaacagaacaatgaacaatatcaatattgatataaattctttattgatcaaaggatgagtgtgtgttttatatatcagataagtattatactattatgtctaataaaagaatatggactaaaatgcagatttcaacagtagtttcaaaaagcataggaaatcaacttaaagaaggctaattattttcttcttttagtagaaaaggcttttgatgtattagccttagagaaaaatgttgaccactgatttaaaattatacatttattaatgtaaatgaaggaagttgctcagcacaatgcctgcacaaaacaagttcttgatagatatttattttgacatttatattacctaaaaccaaaataagaaagtgattccttagcaagcacaaaataattttcatgtatgacaatgttaagctcttaagaatttctttttttataataacaaaatttgttttaaaagaaccttaagacataaatgatccagttgtgattcagacatgtaagagaaacctaaactcagccttcaagcccaaatcaaccacatttctaattcaagtgaagaacacaaagcattttttaaaattcaacatcattacagacatagtctgatccttttcagagattgttctacctataactttgtagaaatttcttaacagattttctttcaatcttgattgtgttttattccacgttttcctctcttttttgttaattggctccattttcatgtaattatgctactcatatggtgattttcacattaatgcatacagaactactatgctatgtgattataataaagatggttcaggcccggcgcggtggctcaagcctgtaatcgcagcactttgggaagccgaggtgggcggatcacgaggtcaggagatggagaccattctggctaacacggtgaaactccgtctccactaaaaatacaaaaaattagctgggagtggtggcgggcacctgtagtcccagctactcgggaggctgaggcaggagaatggtgtgaacccaggaggcggagcttgcagtgagccgagatggcgccactgcactccagtctgggcgaaagagtgagactcatgaaggaaggaaggaaggaaggaaggaaggaaggaaggaaggaaggaaggaaggaaggaaggagggaaggaaggagggagggagggagggagggagggagggagggagggagggaaggaaggaaggaaggaaggaaggaaggaaggaaggaaggaaggaaggtcggtcggtcatggcccagtttttccattgcattgtcattaaccagaaacacaagaatagtatcaaccttaaaatataccgtacctgggtttaaacaatcatctcagttacagaattatcattattgaaggtaaaaccaaaatactgcactaatgctatgcagccataaaaaaagatgagttcctgtcctttgcagggacatggatgaagctggaaaccatcattcttagcaaactaacacaggaacagaaaagcaaacactgcaagttctcagtcataagtgggtgttgaacaatgagaacacacggacgcagggaagggaacatcacataccagggcctgtcagggggtagggggtctaggggagggatagcattaggagaaatacctaatgtggatgacgggttgatgggtgcagcaaaccaccatggcacatgtatacctatgtaacaaaccttcaagttctgcacatgtatcccagaactttatatatatataaacttgactgccaaaaaaaaaaaaaaactgaacacgctgaaaacatttcatccataacactatgtcctgaaggttgttcctcactgtatctattgacttgacccatccaaacaaagaaaaattcccaaaaagagcaagtactgctaaagacagatagcagtacttcgaaagtcctaaaaaaaaaatcctaaaacattgttcttatgcaatcattcttagagcagcaagaacacagctctcagttggctttagctgccaaaataaaacccaaagagttgtaaaaatcccacaaatttagttcaactgtttaaaacatatttttgaaccccctgctatgtgctgagccctattgtcttctgtaagtataaaaatgtgtaagacattttcttgctgatactggaataaacacatttaatcaaagcctgatatcaagtctagataaatgatggctatctaaagaatattcccaaagagatccattagcattatgattcggtcaaaactggtgcttaaataataattaacaatcatttgttaagctcccatagcactctagactctgaaatcaacctaaatatatgaaactttcactcattcccatggtgattttgggaataatggccctattgtttgaagatctctcatctctaattacttatctgcaaaaaaaaaaaaaaaaccatgcacattgagatgctttgtttcattacatttaatagaaagtttacacatggagactgcccagtactttgtacatatgctacactatttgtccttaagtctacggatttcctttacttggcatgaattataggagaagtgcctaacacccagactgagtgagttattctagcttatggtggtgttggagagaaaagtgcataaaccagaggatgtcattagaccagtgacaatggaggagaaaatatccagtgctgacagccctgctcacttgcaagctgatgggtgtcaacgtgcagagcagtacagacagaatggcttaggaaggggtttgccgcatctggcaagaaaggaagtgtaacaacaaaaagagaacaaaatattgtatgtctgtgtttgctccacctaggaaaagcagacacaatgaatctacagtatatatagagaaggaactaaccacatgtattaataccgtctttgtgcctcagctgtaaaacagattctgggcttgtagttaaagtggctgcacagatggggccttttcccctttctttgcaatattctatattctaattatgatttgcactgcttctggcatgaaagcaaggccactgatgtggccccaagagtaggcatgataaaaagccaggcccatgaactcatgcggccgctcttttccacttcccttctcctccttctgctaattcactatgaaaattttctttttttggacagcttttggaattcttcagtctgtctctggttccttttcactccctgaaagaaagaagattcaaccttctaaaggaactcaagacttactggcaggagagggagcatagactgattaataatgtggtacaaaactctgcaagtatataaagtgctaatagccgattatagtaaaataacttttaaggactaactaaattatcttggagtctacataaaatccaagcgcaaaatctgtatcatagggcacaaatctcccacctcatatggtacttcattttggctctaaatgtgaagttagttaattgtaatacttaaaggaataacaccaacaagttaatgaaaatctctatatacgatgttccaagtcatcttattttatttctgttattgccagaagagccttacaaatcttctgtcctgtaaaattgatgtttaatgaacttcaccttaatagtctgtcaaactcttatgaagaacaaatgttcttcataatttatcatgtaagctatatagctgtaaatataggaaagaatcttacataatttgtacatatgttttagctctttaatatactaacacaattaccaggtacacccttctatttcagtgtcatctttttaaacactcaaagagaatttttcttcttttttgtctgttgcagtcatttttcccccagaatctcaatactggcttttgccattaggtaatcagaagcattgctatacttactcatcaattcattcagttatccattcagcaaatatttactgaatgccaactatgttccaggaattattctaggaagtacagtagttcataaaacagaatggagcaaaaattctacccaatagaggtagataataggtaaaataaacaagtaaagtgtataataagctagatatatgaatagatgtcatggaaaaaaattaagaaatgaatatataaacaaacagaatggaatatcaaatattgtgaccaagaaatgtttcacagagaaggatagttaaatgcatctataaagaaagacagaaatacagttagatggacttgtgatagagaattgttctgtaaaggaaacaagtacaacagttttgaagatagattatgagtgaagcatgcgaggaagagcaaggtggtgaatgtggccgaaatagattaacaagtagatgatgatcacagagccctgaacagaccatattatgtagaacactgtaaactcattcctactctgtttaagatgagaagacattggagagtttgtgtaaaagagtgacatgtatgaatttatgctttataaatctcttatatcgatgataaactgttgggataacaaaggcagaaacaaggatacgagttaggaggttattgcaattccttagaccaaaattgataatgatctggaatgaactaagagccatgaagagagtacagactggttggattatagatgtattttaaaggtacagtgagcagcacttggtgacagactggatacaggttatgaaagaaggagaaaggtcacatatgaatcccaggatttaggtctgagaaaatgaaaatgtggagttgccatttatggaaatggggaagactcattgagaagcaggtttgaagagaaagatggagtgtaactttggacttgctaaattgcagatgcttattgaatatctaagaaaagagagctgaagttgagaagagaggcataagccatttaaaaatcaaatgatttttaaaattatgaaaaagatgaggttgtcaaaatagtgagtatagggagaaaagagcagagtctaaggactgagccttgtggtactttgacaatttgtgttctgagagattaagagaaatcctcaaaggagaccaagaaggagcagccagtgaaatagaaaaaaattggagagtgtagtatcctggaagccacataaggcaacttctagagaggagggagtgatcaactgtatcaaaatctggtaaaagtttaagtaagatggtgaaaaaataagaacctaccattggatttagtgatatggaggctgctggtacttttggtaagaaaattatattagagtagtgagttcaaaagcttatttggagaaggtttaaaaaagaaggtaggagtagaattggggatgaatttagacaatattttgaaaggtttttctgtaaaaggaaatgaggaaaatcaatggtagctgagtgggaggatggaagcaataatatcctcttttcagacgggaggaataagagcatgtttataggttgacataaacaattcagtagaaagtaggtggaaatgatacaggaaggagaagaatgtcttgaagtaggagagaaagcaagcagtctcctgccacatggagagattgtcattggataggaacacccttaagtcatccactgtccaagaaacacatgcaagtatgtggtttgttatgatggcaggagcttgtggaaactctcttttgagtgtttctattttctctggaagcaaggtcatcagctaggagttagggtttaggagaaagtattagaagttagaagagagaataaaaagtatgaaatatttttcagggggagtgggagaatgaatgatgtgaagaaataagattgtcaggtggcattaaggacccacttgaaattagaggtcataaagttgaaagaagacaatcattatggttgtgtttttctacagccatgtctaccagtacaaaagcagatgtggagtaggtagagagatggatttcatcacaggttagccagggatgaaaatgtcaagacagatacaagacaataaggagagaagattattataatgatagaacatggaatgtaaggtgagtaaataagaggaccaaaagttacagtaatggacaaggaaaaagtggtatgagcaattgatttcagccccagtgggatacagtgggagtgaactggaaagacaagtggtggtcatagagagaaatgcctgaaatcgacatctttaaagaagttaacaatcattggtaaaaacaagaaactatactgtgcagccatagtacgaattgtcttatgtagatggaaggtgataatttaagagaagaggatgtcaaagaactgagaaactgattgaaaataggttttgaaatcacaaagaattaaatcaggaatagtttggagaagagcaactttcacctaaaaactaaactcctgaaggaaaaagagagagtgacctggaggccagtaaatgagcgaaaaaaggaaggaagggtaatgtatagtctcccagcatgagctttaaagctgcaaatatgtacaagtgaaagagaacagattacctagaagtgtcaatgagcaacaagtgcatctgcttcatcaccaggccgagtatttaaaaatacttttaaaaagcattttcatttttatagtttaaagttctcgtacgaggcctgccatataatttaacctaatttttcagacaattaaattatatgattagtattattgacatcctctattatatagctaaaaaactgcccatagtcatgcacataaagtttacattattccagatgaattaatcaaatgtcaatggacagaaaacaaactcacttaaatattcttttggtttttaagttggaactctcaaacaataataaagataaatcctcctgggaccaggcacgatggctgacgcctgtaatcccagcactttgggaggccgaggcgggcagatcacaaggtcaggagaccaagaccatcttggctacatggtgaaaccccgtctctactaaaaatacaaaaaaattagccagctgtggtggtgcacacctgtagtcccagctactcgggaggctgaggcaggagaattgcttgaacccgggaggcagaggttgcagtgagctgagatcacgccactgcactccagcctgggcaaaagagcgagactccgtctcaaaaaaaaaaaaaaaaaaaagataaatcctcttttacgtgttgctttgaagcctgggagtcgagtgtggcaccagtgggagattactgttggcacaattacagacaagccagcctgccatgtggcactaaacgcctgtgctgcagccatgatctcaatcttccaggcactctacccaagattatctagaaatttggtgttagtctaccatattaataagaaatattacatttgtttctttcctgtaaggtgtgtggtatatagttaattgtacgaacagggccagagaaaaagtcaagtgcttaattataaaagatgaaagacccaattcaaaactgctttttgaggctgaatattttgtcatcttttattttttcatttattccctcaaagaacatgttttgagtgcctcacataggcaaggcactttgctggccagtagagtagcaaatggaaacttagcttgtgacagtttacaatcttcttgctcttatgaagaataagatttattcaccaccaaaaaaggcacataaatataggggggtgagaataattttcatttgaatatgttctcctatgtatttcctgaaaactcttgagaaaattgaatatatgtaggaggtcttacaacacttgaaatgaagaatcaaataaactcagagaaaatcagcttctaggtaaatctcctgtgattttgaaagtcagaaataaatgtttgtgtcacccctgacatggggactaggtgattaaaatcaactcatatatcttttttaaaaagaaaaagtatgaatactaagaacacagataagattaaataaaaacaagagagacctgagggtttaaaaaaatgcatttggccatgattcctcttaggagcagctaagacaaaatgagtagtgttgcagaaagaaatgaaaatccccaaggcaacccagcaaaggaagaagaggttctcttaaagtataaatgggtctttgttgaattttaacaagccatcaatgcacagattcctggagatgtctgaagttcttcatttaatgtgaaaatactttacacttttccttaaacaacaacaaaaaaaattcaccccactggcaaggagccaaagcttgcacattttttgagtcaccacaggaaaagagaaagatgagagaggccaagcacttccacattcacactggaggaagaatgtgccccacttccccgagttctaatcagtggcagttctggatcctgattaatgagcccttccgcgctcttggcctttctacccccaactactgctctatagtttcaattttcactccaaatctggaaatgcctcctcagcgaagaaagcgctgagatgatgtggagggaataaatgggaaacgcagatattagtgctacctggccagcaggaaatttgaactgtatcaactgagatggcccaaagagctgttgaaatgtaagatgaagttcagaatgggactactatgtcaagaatatgaatttgaatttctttttggaggagagagaagggagtcaaagtttgaattaaacgtttatgagtcaatgggacacaccatcactttttttgttgtgtcctgctctggactgagacttctctgagtcagctgcagggaggctttttagtatttacccttctgaaaaggactttctgcaccatttgggtggctgagctggactagcttatcaatgggctatgatttatttaaatatgtaaatatgatattgacagacatatgtaataatcataaaacacctattttgcatatggtttactgggcactgtttgggttttataaatactaactcatttaacctcaacagcatggctatatggcctgaaaactgaacacaggaaatgcatgtaactaatccgtggtcccacagctaggaaatggtagtcctgggatttgatgatggttccagagctggtgttcacaagtaataaaccatgatggttccagagctggtgttcacaagtaataaaccatctgcttcacttttccaataaaatctctgatatgaacgctagtgataattttcaaaactgtgtacatacacaagaggaactaacacttcagtaaagtagaaaaggaagcagtatttaagaaggtaacacagaacagtgcttaagaattgaaactgaatttgaattctgtcttctgcctgtttccaagcagacttgaacaagaaggaacctccttaagactcagttttcctatctgtagtatgggagcaataagaagattactgtaaagttaaatgagatgatacatattagataacatacaactaatgtaataacattatagtaaattttagcaattactttaatgtcttttatatacactgcccccaagcaacctattagtgaactcaccccaataaaatctaaattttccacttattttactctcaaaatataccttaaaagattgttttctgtagactgccaagaatttgagaatggcagggatgttcttggttttaagggatatgaaaattatttttagtacatccaaatttttgacaacaatctgatgatatgaatgaagcaaatagttaaattaagaagacagtgagaagtggctatcttagacacatcagaacaaataatgcctccttaaggggaaactaagagtttgcaccccaatatgtccttcactcttaggtttcttctagaccttgtagtgtatagttgctgtgtccctggagcagcagttacttatagtcagcattgcagcttatggtaccaaaagcagctttgtgaccatatcaccctaagtcactctgatgtttcaaactgccaaagaatttgtggtaagaagaatggtagaaggcttctataatttaagaccagaggggtttttttccactggagtgattcaatgtgcctggtgtgtgcacatgtgttccaatacagatggagactcaaatgactatcagaccctttggtgtgagttcaaatttcctgaaggtgttggaatgtctgtaaaacatcagatgccctttgcctgcattaaaaatatatatatatattttaattatctgctgatttgacattttgctttatcttgggtaagacttgacactgtctttgaaaaattattcacaaaaaaatgtttttgagtttctggcaggtagctgactttagttaaggagttatatctgatctgtctataacaaaacaccagtctttgttcgtgtgtgttccctcccaaaaaatctaaaatctttattcttgttccaatactattagtcatatttttacagaattattggtgagccgctgtcatcacccttacaatgcatttttcctacttaagcttcagaaatttttttcaaggagccttaggcaatgttatcaatacaagtgccggggttttttttccctaagcattttggtaattgcaaagtaggtttctctgatttcttaattttacataaatcacagttgttaaagtgagaggaaagaagccttctgataatgttgtgctttaaagtaagtgaattctgtagtcaatgtcttccatcagctactcatgtattttaggtaatatctgagaatcaaaatgctaagaaactgtgtgagaaggagactggagacagatatgaccttaaataggtaccctgtattttcatttctaaccagaaactcaaaacataaaagtattgattagttaaactaccatcagcaattaaccttgtaagtagactgaagtgtagctgcttatattacatactttaaggagcacataaaaattctatttgccccaattattcttcagcatggcaattcttgctccctttatcatggcagaaattttaccatcagagtcattcttatagattccataccaaagattaaatcaatgcccttagaatgccactgtgactatctaatgcatgctattacagcagtcagcataggctagcttatgctattctaacaaacaaccttcaagtcacaataacaatacaaccaaggtttttctttttgctggttcagattacatctctattagtgcaacagagggcttctgttcagcacagtcactcagggactttccttatcatcattctaaaggaaaaaaggattcctgagagagtcttgcagtaacaactgggtgttcaaccctccagagtgacacctatcacttcttcctacaactcatttgccagtcctaatccctacaactgcaaatgggccaccaagtgcatttaatatgtgtctgaatttggggaatataaaagcttttgccaagagctctaatgactaccaacagttacctcaaagaaggacttctgattttgaaaacagcattttcctttttaccagcaaattgtaaagtgctgagtgaacagagggaaagtagaacaagccccattggattgagaggcttcatgggatggaagtcagaaggagaggaccctgtttatttggaagcaaaaacaggtgttagaaatggaaaaatgaaagagggagaccaatttactatgcaactttgttcatatcaattttgcttaaaattacattgttttaattagagtccattattttaatgcagatatactttaaaatcacataaaataatcaagattgttcatgagaagactgtcaccaaaaatactgcatacatttatgtttgtggggtattacaatgaacaaaaccaggttaattaacctgaattaaaaatagttgaaatttgaaatgtacatacactaaggtttatgtatacaagtttctatgcatgtttaggtaagtgtattgtaagtattctctggattcactaatatggatagctcaattttactttgaggactctatgccagcagctacagttcagtttgtctatttcattctgagacgtcaatggcattataattaattgcacttttatttgtagtcattctctctaagcattaagttacccatgaatgccagattactcactgattcttaattgtgtctcaataactaattcctttttatttctgcatggcatcatattgtatggatatactgcagttcctctgttgatggacatttggattgtttacagtttggggctactataaatagagatgctttgaacatataggggcaaatctttgtatggacatgttttcatttctcttggatatatacctagaagtggaatgattaagtcataggaaagtgtattttttttactttttaagaaattgctaagctgttttccaaattgctaagctgttttccaaagtatttctaccattttacattcctttgagcattgtatgagagttccagttgctccatattttccaaacataatacaatctctttaattttagccattctaataggtgtgcagtggtatcacattgtggatttaattttaacttctctaatattgagcatattttcatatgcttattcaccatttgtaatcttttgcgaggtgactgttcaaatactttgtttattatttgggttgtctcttttgaaagagacttgtaagaactctatatgttactgatataaatcttttgtctaataaatacactgtgaagtttccactaggctatgacttgccttttcatatcctaactgtggttttagaagtgtaaagtaattttttaaaaaagacaatttaatcttagagtagatattagtttttctaaatcaaggaactgtcctcaaagttgcatcctattccttccgactctgagatattgggcatcattaagatgagaacagttcaaacctagacatcctcataacggccaccaccactacaacatacatttcctgagtacctagattctgtcaagcaatgtggttggttactcagataggaagtgactaagacagaggcattctgaaaattatacttttatctctgccaaacccagcacatttctggtaatattttgtgattactctgacaacttaaaaagcagtaaattaaaacacacacgcacacacacacacacacacacacaatttgtaaacatccacttctggctcttttgtaaacatctagctcttttaaatactgcaatactgagacagaaaagaaaaatcatgcaggtgatctcaatatgcaggatcaaatctctttccattcaccccagcttttaggaattgattgagccaacgatatagcattacgtaaaataactaataagaggacttgtttattttttattagtgggcactttacatatactttttaaatattaaagcaaatagtgtattaaagtacactgtgaggaaaaatgtgtaaatttgtaaggtaaaagatgaagtttctagaaaattttattgttatagtgacttctgtcaattctactctcatggcctagggttctttactcattggcatgtgccatttgcctcaataataactgagttttaagccagagagagtttgatgtttaaatcttgaatggcagtaaaaagttacacgtgcaaagagtaagctctggcttcgatataatcggatttttcaagttaatgggctcatagtaaataaaaaattcaaactaaaagaaggtataaagtagagcaaagatatggacgtaaaatgtgaataatattgtaagcacatagtaaaatgtagggttaaacacaaacgttagtaatttcagtaaaattcaatccaataatatttaatggattaaataccctattaaagtcaaagattgtcagactgaatttaacaagaacagcaataaatttatgcttgttacaagagaacatctaaaaataaagctaagaaaatagttaaaagtaacaaataagagaatataaatagctgaaaccaaactaaaaagaaaaagctactataatgatgttgatatcaaagagttttataaagcagagctatgagtctagataaaaagtaacattttatagtgataaaaggtgcaaatgactgcaaaaattcgacacttctaaatgcttaattacatagccttcattttatgatacaaaattaacagaaaaacaaggaaaatagaaaaataaatatggaatattttacaaatttttaccccacactgggctagaaagcaaggattaaaaatcataaaaaccacaatgtgaaaattctaaagaaaagatgtacaaacagaatctaacaaaatataacaacagtaaagtgttccagtcaggatgagatcattccagtaatggtaggtttgttcaacatttcaaaaccaatcagtgtgtttagttaccttaatagaattttaaaattcaagcgattttgtttttacgtgcagaaaaagaattagccaaacatcaacatgtattacttacaaacactttaataaaactgaattttaaaaatcttccttctgtaataaagtatatctataaaaatccgtggcagaatacagaattataaaatattaaaagcttcccacctgaatattttattatcaattctgcaattcaacattctactagattcccaagccatttatttatttatttatttaagacggagtctcactctgtcgcccaggctggagtgcagtgtcatgatctcggctcactgcaacctctgcctcctgagttcaagcgattcttctgcctcagcctcccaagtagctgggactacaggcaagcaccaccatgcccggctaatttttgtatttttagtagagacagggtttcaccatattggccaggatggtctcgaactcctgacctcatgattcgcctgccttggccttccaaagcgctgggattacaggtgtgagccacagcgtccggccccaaaccattattttgtaagcaagtttatttaatatgcatcataaactgctgtctttcagtgaatggaagagtttgacagagaaacatctttgtaagcaaacatttaaaatatgttgttagaacatatttctttccaatggtttgtattatgagtttacatacgcagctataaaatgtaagcatgcttttttttctctctctctcctttttctaatatatgtttatttgtgtaggttttccctagccatttaaaaagacaagaaaggaaataaaatatataacgaatggaaataaataaaatgcttattcttcacagttagaaaacccaaaataagctacatatgaattattataattaataagtgggtacaagatgcttgctggatacaagattgtactagtcagcgttcttcagagaaagagagtcaagagagattgatttaaataaaatggctcacacagttttgggggctggcaagtctgaaatatgtaaggtcggccagtaggctggaaattcaggtaagagttgatattgcatttctgagtttgaaacctgcagggcaagccaacaggcagggtttctatgctgcaatcttaaggcatctgtgattgaatgcagctcacattgtgtaaggtaacctgctttactcaaagtctaataattcaacggttaatcactttttaaaacaccttcacaacaacatcttgactagtgtttggtcaaacaactgggcgctatagcttagccaacttgaaacataaaattaaccatcacagttcaccccatgtcaacttggaacccatagacatctccttaaacagtatttaatgtctaaagacaatcacagagtcatacttctgcctaacatgatacaatgtaacctgtgtacaaccaaaaacacagtaacctttttaccagaagaggatgcaaagtccttgggtgataaacactcatctccttgatatcctgtaacttaaatacaatgatgtaacgttaacaaaacttaaatactatgatgtgaagttaatacatcttatgtttcatgacaaggagcagagaggaaagaaatcaaaatattacacacacacataaatatattcatgacaaaataaggaataaacactcctagcaattacagtcctcatttctgcagctggtcacatgctcatagctaatatttatttattttttatttatttatttatttatttattttgagacagagtcttgctctgttgcccaggctggagtacagtggcatgatctcggctcactgcaacctctgcctcccgggttcaagcaattctcctgcctcagcctcctgagtagctgggattacaggcatctgccaccatgcccagctaattttttgtatttttagtagagacggggtttcaccatgttggtcaggctggtctcgaacccctgacctcgtgatccaccagccttgacctcccaaagtgttgggactacaggcgtgagccaccgtgcccggccatagctaatatttataactaccttttctttttgttctgtgacctcagaaagcaccccgctggtcagtttgtggtgttgaggtcagtcagcatctcagttgctggggtgacccaaaccttcattccttaaggatctgggtcattagtagttctgcctagattgagttgttgtagttttccagtggctttaatcacaagcatcatagtactaacggatgccctaagggatctcctgtactcttccttatctccattatatataggaactcaatttcttctgggtactcaggattaatcatcccaaccagtatagtaactcctttccttcccaattgattcagagacatgaggatcccaaagtggcccagatggcagttttaacttccatttccatggaatcatggatgtctctcggtgaaaacatccttttctttgcaactataacctctatatcagcatagataaggtcatgagaacaggaagtaaaaatgttgctagtgaatcactacgggtaatagtgagtggtgccacttcatttctatcccttgaataaatccatgaatcctggctatgagagaaagagcagcatatgctgggcactgatatataggacatacatagcctgccggaaaactttgtttcagccctgcaaggtatcactacctatccggcaatgtaattgaatcttcaaaaggccattcccccattctgtcaagccagtttcttagggtggtggagaacatgataagaccagttaattccaagagcatgggcccattgccatacttcatatgctgttaagtgagttcttttatcagaagtaatgctgcctgggataccgtgatggtggagaaggcattctgtaagtccatgatgataatttgggcaaaagcatcttgtgcagggaaggcaaatccctatctagagtgtctactccagtaaaaaccaaaacactgcccctttagaaatggaagtggtccaatctactcaacctgccaccaggtaactagctggtcacccctgggaaatgatggcatagcaggtgctcactgttgatctctgctgatgacagactgggcactcagcagggtctgtagccaggtcagctttggtgagtggaagtccatgtttctgagcccatgcatgacctccatccctgccactatgggctactatgttcgtgacccattggacaatgacagaagtcatcataatgttttcaataaatttcattcagtcagttatatattaatattaaaaacaataacaagaaaacaagaaaggaaagtagtttctcttttttaccatactcaaaaattaattaaattccatgtaaatttcagtctaaacgtaaaagatacaacattaacgtttttaagaattatatagggaaatactgtcacggccttagtttaggagctttcaagagaacacacacacacacacaccattaatgtcaaaagtaaaagactgaaaatgtgggctgcattaaaattaagaactttgatcatcaaaatactattcagagaagaaaaatggcaaataatttaagaacatatgccactcctaaatgtgacaaagagctacatagaatacataaagaatacctgcaattcaatgaaaaagacaggccaccacaccaaataggcaaatggttagaaaacaggaacaagatttttcacaatattttagaaaacaaactactagaaatatgtcaaatgcccatcacagtagaatgaataaataaaatgtagtatatgaatataatggaatcaaacagcagcaaaacaaactatggctacatagaacaacataagtcaattgcacaaaacaatattaactgcaacatttttattcagttagtaaacattttaaaaatagacaaaatgattacttaatattaacataaggatattttggggaaggggtgtgaaatgtacttttgggagaaaatattcacagttcacatacttggcaaagtagtattacctagaatatagagataacttctaaaattaaatttttcacacatgaaaaataatccaatagaaaatgaacaaagaatacaaacaataaattctttaaaaatgtaaataactaaaaatcatatgaaaatgtgtttactacatgtctaattggggaaatacaaattctaaaatgaaataccatgttacgcctacctcttagaatagcaaagtttttcatttttttagtactatgtgtggcaaagtacttagaagaagggtaatttgatactttaaacatttagtaaagttgatgatgcataaaaccctttggaccaagatttctattcctaacttagggaagaataccttaggaaaattcttatctatgtgcgtaaagaggaggaaacaacctaaatgtctttcagataggagaaagaatagataatggtatgttcttacaatagattattaagagttttaaaatgcatgtatattattcacatagtcatagctcattctttaacttgtgctttactcttactattttttagattctctgatatttatgtatcagagagatttagagaattttgttcatcaaaatactattcagagaagtaaaatggcaaataatttaagaacatatgccactcctaaatgtgacaaagagctacatagaattcataaagagtacctgcaattcaatggaaaaggccaccaactagggaaatgggtagaaaataggaacaacatttttcacaatattttagaaaacaaactactagaaatgtatcaaatgcactacaaatacataaaacaaatactacaaatatataaaacaaaccactccaaatgtgtatctacacacacatatttttctatctccgggtatcttgagtatagtagtaaaacacaaattaaagaatgaactatacatttattgtaccattttacgtaacatataaaagcacacattgcaatattaaatattgttatggatatatagataagtagtaaggtattaaacgacactgaaaggctacacaaaaatgcaaggaaattgttatttttagataggcaaggtaatagaaatataaaggagccttcaattttaaactttttatttttaaaaaaataaaaaatctgaagcaaatatgacaaaaaactatacttgtcaaatgaagcactgagtcaaagctatgaactgaattgtgtccccccaaaaaattcatatgttgaagccctaacacccaatgtgatggtaattggagctggacctttggaaggtaattatgttaccatgaagtccagtagcgtggggctctcataaccaaaggttgctgtctctctgactgtctctctaccatatgaggacaagtgagaaggtgaccatctccgtctgcaaaccaagaagggagccctcaccagaatctgacctggctggcaccctgatctcagaattccaccatctagaactctgttgttgaaggcacctagcctatgatattttgttatggcagccgaagcagactaaggcagtcatcattatattattaatataattccttatatttgaaaaatcactcacacttttcaaaatgtataaccataaatacctaggttatactggcctaagattataccaagaaacagaatattattacaattaaaagtaaataaaggcattcttcaaacaaattaatgtactgtaaaatctttgcaagctggaactgcaagagtatcctgagagccttgtgcagtatctgctacacactggtgcttaatgtgtgttgcatgtggagcatacataggttaaacaaaaattataatgctacctgggaaataaactccagaaaccaaagtttttctgagatcctctaataaagaaacaaagctacaacaacaaaatacttgttttcaaacatttactgtctagaaacaattttttcaacttttagtattagtttaagtaccacagacttcatagtctgataaagccagtttcctagtatcctctttacacgacttcctaattctggcctcaaaaactgtaatgaagccctttccccagtctgccttccccagtcatccttttgtagtccaaatctcggatccttgcagactaaactggggcatataatagcttccttctttgcctccttttgagttaatagtctggagtcagtattattttggatcagtttcaagaggtgtacttcaactttgtcaagaaaagtgatcatattttgtttgtaatccttcatcacataaagctaagatgttttaaattgatatactgatgaactgtcattgtagggaactgcatccgattatgggcctaagtagaatttctagagatatcaggaaaaatctgaaatgtgtggctccaagaaagaattattatgtatggtcctctccattttcttaacctcatatgtgtttatactttcactaacttttcaagtgttaattcaaattggtctcctaagtattccctcctgttggtagcatttggctgtacagtcaaatgagcagctgcctctaagcatttgctaatgcttccttcctcaaaggaaaactaatacaaatttaaatttgtgttaatttccacctgaggcatgatggcctctgttggtttttggcaagttcagataattgctacaaaatagtttttttcttatttcaataatatagggctgtaggaacaatatttgcactgtattattaaccagttttatggtaaatgttgtttatttatggtattgtacatgtggtatctattaagtaacatctcaaagaataaaaaccacttacttgttaaatggaaagcaaaatgtggaaaacaatttggaggaaaatgaaagtagatggcaaatgctgacagtcacggggcttactgaagttatcaaaaatgcagattacttagccacaaatgaaaagaaataataatagtttttcaagcttgacagggaccacttacggcaagatttcaacatcacttcacacaacttgacatatgcaaatttttccagtgcagtttcaattataatgccatacaaattttattagtcacttggtaatactgtagataattggaaaagtcagtgaatgatttataaaacagagagattgattccacaaggccttcttgatttcaagaagacagaaaattaacattttttatataaaggaaaaatatcatatactgtttttgttactgaatttgtagcttatatatcaattgccgttacaaaggatttgagatggctggcctaagcacaatgcaaaacatgttaatttttaatgtaaataatcaagactcatttagaagaggagaatctcgagtactttggccttagtataaaagtgatatttcttcaactgttttttgctcaaaaagagaactgccattgcctgaaaactcatgtgatatcagatccaataccaaaatattcaactattcttccctaagaccgtgctacacagaacctgagcaagaaatgcctgtgggcaattgttctgcgtaatttaaccacctcgttcatagtgtgggagaatgatggagcctgacagaacatccaaagtgttggaaccactgattagtaaatacttgcaagctatgtccgtacttggcccttgatgtagcagagtattgtaacacaaattccaagactgaaagaaattgggagatgcctactatatccgactatggagaggtagaaaaaaagaactaaaaataaaaatactacaattttggatcattaattcagcttgccaattttcactgataaatgataataaatcacaatacaaaaaatactgcatttatctttttatttaatcaaactagttttaaaactgagttccatcctgtaagactgatggaagattcaaccttatccttggggctcccctgatatagtggtacaaagctgctagtgttaagaaatgggaattatctctggtcgaatatctacagttgatactggctactgcagggaggcctgatatttcatcgctctcagaaactctggtgctgctcccttttaggcatcgctgaaaaagctgggattctggagccttctccacgaatttccagaggcttgtgtgacttatggatttccctccctcggatcacagaaaaacctccaaatgttctgcttctccaaagcacacctctttgtcctgccctcacccgactctaacataatactgtcactgattttaggaggtgtctaccttatacagcttctattttctgctgcaaaatacccctaaggaaagaaatgacaaagattaactaccagcttagagcaaagggatagggaaatatgtagggagcataaaagctatttaatacgaaaataaaatgctgccacaagagtaaataaagaatagtgaaaagcttgtcagtagactttaattttaatataacctaagcctaaatccacaagatattttgtcttgtcccatcaacgcaaccattctaagaaatcttcaaacacatgatacaatttttttcctgtcacttttgttcattttcctttgaactcaaattagaattggcttcattattcactagatttccctcttcaacctccttccatccaatcatttctcctctctcatcttctgtgaattggcaattgcactgccaaggtaattcctcagaagtggtacatcttgtacttcctgactctcaatgtttccggaacatttattgatgtaagctgggttctgtcatagatgcattccttcacaagtcaaccggtgatactttgctcactagaaactcagttaccaggtcctcttgattctactattgttcactaatttctttgaagaggcatttatggtgttttggttgtctcataccactttatccagaaccttctcttgaaaaatctgcctgcctacatgcagatttccacacattccatctgcacatcacatgagtctctcgacaacactagttttgcttgctgtggtcctgcccaaaagtattaactctttctccgttgccaataggattaagttcatgcaattcagcttggtaatttccaatctgctagcatctaaatccaacattgtttttccatctcttttaaaacaaaaaacaaaaccccaatgaatctaggcaaaccctcaggttgccctccatgcaacctatagatctccccatctccctatttttatgaaagttagttctctaggatatagtagattctctttctaaatctggggaaatccccaatattctctaagttcaggtcagtgcctgccttctcccaaatgtgctttacaactttctttttagaggcagtggcttctttcgtccaaaaactcccagctttgcttgtctgtaaccattcattgtttctttaaaatatatacttgctttagacttcttggtattgtctgacattttaaaatcattcatattattaagttttacctctgtgtctatagcctccccaactagactgtaaactttgagtatgaggctatgattctttgtatgcccccactcagagctctgcatagcctgtgaaactctcctcttttcctcccattaagagatatgaaatgaatgaacagccacacattacaccatagtctggtgactatagcagagagtttagagatgaaaatgtctccggtgttaacataaaataagttgcactcttatgtctaaatacagccatttgattcatttataattttcacataatgctatttttaaatgtgttctattaatatatacataggtgttttttatacataaagctattaaagtgcctattataagtacaatggctaagcacatgtcctaatctttcacagagttagagaaaaggatcccacattaccctgaaacaaagaaagtagtaatttacctggtagaggcaatgtctttcctccaacagaagggaaaaacaatccctccaacaactgacattcaatttaatttttaaaaatagttcatacgcatgtaaaacatatttgaattatccatttgtcaaagcgtaaaactcaaaaaacttatttcttctctccagaatggcaccattgcacatttctcctccagagcaattctggtggatgtatctggcagccaaacatgaaagtgtgggtgctgtggtgctggcagccagcccagcatttaaccctgctgttttagaatgtcataaaataagcacaatttaatcttttcaaatcatttggtcagtggctgtgatttccgcagaaaataacttcaaagaagacaggcacctttgttgatgcgtgtttaagtgccttgagtgccaatgcatttaagaataggtagcgaaaacctcaaagcctggaacacattcttgggattagataccaagaggatgtgtaggctggcctattaaatttctctggtagtaaggatgtgctcaagttgatataattaagagaaagagtcatccaaaaaaaatagtaatcacaagtgactagacactgcttgttgtaatgtatcaaagcagagatgttgatatagggcagagaaatcagcatataaaatattaatgtttacttctgatatgggctgggggagtgcttttctttatgacatgggtctgaaatgcatatagcatcatttttttttttaagttcagggatgcacatgcagaatgtgcaggtttgttacacaggtatacatgtgccatgatggtttgctgaacctgtcgatctgtcatctgggttttaaactccacatgcattcagtatttctcctaatgctctccctctcctggacccccaacccccaacaggccctggtgtgtgaggttcccttccctgtgttcgtgtgttctcattgttcgactcccacttatgagtgagaacatgtggtgtttggtttattgtttgtgtattaatttgctgagaatcatggcttccagcttcatccatgtccctgcaaaggacatagtattctttttatggctgcaaagtattccatggtatatatgcgactcattttctttatccagtctgtcattgatgggcatttgggttggttgcaagtctttgctattgcaaatagtgctgcaataaacatacatatgcatgtgtctttatagtagaatgatttataaccctttgggtatatacccagtaacgggattgctgggtcaatggtatttctggttctagatccttgagaaatcgccacactgtcttccacaatgggtgaactaacttatgcttttaccaacagtgtataagtgttcctatttctcaacagcctcaccaacatctattgtttcctgactttttaataatcaccattctgactgacatgagattgcatctgattgtggctttgatttgcatttctctaatactcagtgatgttgagctttttttcatatgcccactttttgatggggttttgttttttcttataaatttgtttaagttccttgtagattctggatattaaacttttgtcagatgggtagattgcaaaaattttctcccattctgtaggttgcctattcactctgatgatagtttgttttctgagcagaagctctttagtttaattaaatcccatttgtcaattttggcttttgttgccattgcttttggtgttttagtaggaagtccttgtccacgcctatgtcctgaatggtattgcctaggttttcctctagggtttttatggtttggggttttatatttaagtctttaatccatcttgagttaatttttgtataaagtgtaaggaaggggtccagtttcagttttctacatatggctagccagttttcccagcacctttaattaaacagggaatcatttctccattgcttgtttctgtcaggtttgccaaagatcagatggttgtagatgtgtggtgctatttctgagttctctgttctgttccattggtctatatgtctgttttggtaccagtataatgctgttttggttactgttgccttgtaaacttgtactatagtttgaagtcaggtagcatgatatctgcagctttgttcttttttcttaggattttcttggttatacaggctctcttttggtttcatatgaaattttaagtagttttttctaatcccgcgattagaaaaaaaaactactattactacaaaaaaaaaagctactattgtagcttgatggagatagcattgaatctataaattactttgggtagtatggccattttcatgatattgatttttcctattcatgagcatggaatgtttttccatttgtgtcctcttatttctttgagatgtggtttgcagttcttcttgaagaggtccttcacatcccttggaagatgtattactaggtattttattctcttcgcagcaattgtgaatgggagttcattcatgattggggtctctgcttgtctattgttggtgtataggaatgcttgtgatttctgcacattgattttgtatcctgagactttgctgaagttgcttatcagcttaaggagtatttgggctgagacgatggggttttctaaatataaatcatgtaatctgcaaacagagataatttgactttctctcttcctatatgaatattctttatttctttctcttgtctgattgccctggccagaacttccaatactatgttaaataggagtagtgagagagggcatccttgtcttgtgctagttttcaaagggaatgcttccagcttttgcccattcagtatgacattggctatgggtttgttacaaatagctctcattattttcagatatgctccatcaatgcctagtttattgagagtttttaatatgaagagatgttgaattttatcaaaggccttttctccatctattgagatgatcctgtggtttttgccattgattctgcttatgtgatggattacgtttattgatttgtgtatgttgaaccagccttgcatcccaggaaagaagccgacttgactgtggtagataggctttttgatatgctgctggatttggttcaccagtattttattgaggattttcgcatcgatgtgtcatcagggatattgacctgacgttttctttttttgttgtgtctcttccaggttttgatatcaggatgatgctggcctcataaaatgagttagggaggagtctttctttctcaattgtttggaaaagtttcagaaggaatggcaccagctcctctttgtacttgtggtagaatttggctgctaattcatctggtcctgggctttttttggttggtaggctattaatcactgccttaatttcagaacttgttattggtctattcagggatttgacttcttcctggtttagtcctgggagggtgtatgtgtccaggaacttatccatttcttctagattttctagtttatttgtgtataggtgtttatagtattatctgatggtagtatatatttctgtgggatcagtggtgatatcccctttatcactttttattgtgtctatttgattcttctctcttttcttattagtctagctagcagtctatctattttattaattttttcaataaccacctcctggattgatttttcgaagggtttgttgtgtctctatctccttcagttctgctctgatctcagttatttcttgtcttctgctagcttttgaatttgtttgtgcttgcttctctagttctttcaattgtgatgttagggagtcgattttaggtgttcctcactttctgatgttggcatttagtgctataaatttccctcttaacactgctttagctgtgtcccagagattctggcacactgtctctttggtctcattgatttcaaagaaattcttgatttctgcttaaatttcatatttactcaggagttattcatgagcaggttgttcaatttccatgtagttgtgtggttttgagtgaatttcttaatcttgagttctaatttaattgcactgtggtctgagagactgttatggtttccatacttttgcatttgctgaggagtgttttatttacaattatgtggtcaattttagaataagtgccatgtggcactgagaagaatgtatattctgtagatttggggtggagagttctgcagatgtctattaagtccactttatccatagctgagttcaagtcctgaatatccttgttaattttctgtctcattgatctattattgacggtggggtgttaaagtctcccactattattgtgtgggagtctaagtctcttcgtaggtctctaaaaacttgctttattaatctgggtgctcctgtattgagtgcatatatatttaggatagttagctcttcctgttgcattgatacctttaccattatgtaatgcccttctttgtctttttttatctttgttggtttaaagtcttttttatcagagactagcattgcaacccatgctattttttgctttccatttgtttggcaaatattcttcaatctcttcattttgagcttatgtatgtctttgcacgtgagatgggtctcctgaatacagcacactgctggatcttgactctttattcaatttgccagtctatcttttaattgggacatttagcccatttacattttaatattgttatatatgaatttgatcctgtcatcatgatgctagctggttattttgcacattagttgacgcagtttcttcctaatgtcattggtctttatattttggtgtgttttgcagtgactgataacagtttttcctttccatatttagtgcttcccttaggagctcttgtaagacaggcctggtggcaacaaaatccctcagcatttcttgtctggaaaggattttactcctcatttgcttatgaagcttagtttgactggatttgaaattctggattgaaaattctttaagaacattgaatactggcccccactctcttgtggcttgtaggatttctgcagagtgatctgctgttagtctgactggcttccctttgtaggtgacctgattcttctgacagtgcttaacattttttccttcatttcaaccttggaaaatctgaagattaggtgtcttggggttgatcttctcatggagtatcttagagttctccatatttcctgaatttgaatgttggcctgtcttgctaggttggggaagttctcctggataatatcctgaagtgtgttttccaacttggttccattctccccgtcactttcaggtataccaatcaatcataggcataatcatttggtcttttcacatagtcccatatttcttgtaggctttgttcattccttttcattctttttttctctaatcttgtctgcatgcctttttttcagctaggtggttttcaatctgtgatattctttcttccgcttgatctgtttggctactgacatttgtgtatgcttcacgaagttctcgtgttgtgtttttcctctccatcaggtcatttatgttactctctaaactgattattctagtcagcagttcctatagccttttatcaaggttcttagcttccttgcattgggttagaacacgctcctttagctcagaggagtttgttattacccaccttctgaagcctacttctgtcaattcatcagcctcattctccgtccagttttgtttccttgctggagaggagttgtgatcatttggtggagaagaagcattctggcttttggaattttcagcacttttgtgctgctttttcctcatcttcatggatttatctacctttgatctttgaggatgatgacctttggatggggtttttgttgagggggggtcttttttgttgatgcggctgctgctgttgttgctttctgtttgtcagtttttcttcttacagccaggcccctcttctgcaggtctgctgcagttcattggaggtccactccagactccattcacctgggtgtcaccagtggaggctgcagatcagcaaagattgctgcctgctccttcctctgtaagcttcatcccagaggggcactggcctgatgccagctggagctctcctgtgtgaggcagttctcctgtcttgctggggttccaggtgccactggggtatgaagaatgtcattggcattttaatagggattgaatttaatctgtagattgctttgggtagtatggacattttaacaatattgattcttcccatccatgaacatggaatggctttccattttttgtgtccccttcaatttacttcgtcagcgttttatagatttcattgtagagatctttcacttttttagttaaatttattctaggtgctttattttatctgtaactatagtaaatgagattactttcttgatttctttttcagattgttgactgctggcataaagaaatgccagtaatttatgtatgaccatttcaattgatggtggaaaagtattcaatgaaatttagcacctcttcatgattaaaaactcaaaaaactgggcatagaaggaacatgcctcaacatgataaaagccatatatatgacagacccacatataatatactgagtgagaaaaaactgaaagacttttccctaaaatctggaacaaaatcatgactttcactactgtaattaacacagtactagaattcctagctaaagcacttcaacaagaggaagaaatagagcacccaattggaatgaaagaagtcaaattatcctcatttgctgactatatggtcttagatgtagaaaaacctaaagattccacttaaaagaaactattagaattggtaaattcactacagttgtataggatacaaaatatatgtgcttttatatatcttgtcaccttatagtcattatagaaaatttgttctataaaataagtattttaagtttagcaacaattgctgcaaagaaatgttatgtaaataaagattattagattattaaatgttaccctttctaagccttttctatttgcatggcaatagaaaattcttttctaagaacaaatctattgaaattttctcttgcaggcaatagaactaatacctctatatttctgtttcagaggagaaatagtcttttagctgagcaacaatatatcgaccgaaatttagctttgtttgcaggatataagaataaatttgaatggacctttgaaataaaactaagggaaaatgaagtgaagatgtaataaaacaaaagccgagttaattattcagaaataagaaaaacaatagaattgaatacacaaaaaaactctggttcttttgtgggggcataataaaatggattaaatattaactagaaatatcaagaaaaataagaacacatattgagaaggaataaaattatttctaaatagaatatttaaaattctaacagaaaattcagtgtaacataaaaattattttgaaaccatggatcaattgattattttatgaaaagtataaattaccaaattgattaaagatataaagaattgaatgagacaatatctatgaaagaacttaaaaagtttattaaaggtggctcacacctgtaatcccagcactttgggaggctgaggcgggcagatcactaagtcaggagattgagaccatcctggctaacagggtgaaaccccatctctactaaaaatacaaaaaattagccaggcgtggtggcgggcgcctgtagtcccagctacttgggaggctgaggcaggagaatggcgtgaacccgggaggcggagcttgcagtaagccgaggttgcaccactgcactccagcctgggcgaaagagcgagactccatctcaaaaaactaacaaacaaacaaacaaaaaagtttattaaagaactagctcacatcaggacaaatagctaattcatgtggggcttaaaacctagatggccggtagataggtgcagcaaaccaccctggtacatatataactatgtaacaaacctgcacgttttgcacatgtatcccagaacttaaagtttaaaaaaaaaaaaaaaaaaagaactagctcacaaggaacctaagtacagtttgtagaaacccttaggaacaacaggaaaaatcacttgtcatgtgagtatctcaaagcataaaagaagcctatatcataccaaaaggaaattaaattccaatatgacttagtttatccaatctaataaaatagcatataataaaaatattataatctaactgtgatatacaaaatccaacaatatatttcaataacttaagaatttctttcataaagagtaaggatatttggtattaggaaatttattaataagcttcgctacattaatatgttaaataataaaaacggcacatgcaccttaatataaatggataatcatctgataagattcaatacccattactaaatcagaaatatgtaaaaagtctttaacaagtcaaaataattttcctatcacaaaccaataagaatatactttagggtaaaagtttaattttaaggagtactagagttagaattagcataagggtatcagttatcatcactattattttatttttccataagaagtcaacaaatcagtaaatgcataaaaaaccaacaaagaaaggatgaaacagaattttaattatttatagattgtataatagtatctatacaaaagtataattactatgcaggttaaaaattataacacatttcaatacagtagccactagcaaaataaattattcttctctaccaacagtaaccaaatgtaaaatatatatttcatctataaaattggtaaaaatacagcatacttataagtaaacattttagaaaatagctaatacccatatgaatgtgattataaaaaatctactgaagaacagtaaagagatcttgaatggagatacatattgtatctcaaatagtaatagtatattttttacaagatttcaaaatatcagttattcctaagttaatgtaaaaactcaatgcattcctaatgaaagcagacatttgtctctggtctcaaatcaaacatgagtaaagctaagaaaattatttgaaataaaagcaatgagtgtgacaaatcctatgtaacattaaattttactttaaagttaaagtgattggaaacatttgatattgatacagaaacaaacatatcaatggcatacaatagagaatctaaaaatagatgcaagcacacatgggaaattcatatacataaaagttgacatttctaagtagtctagatcattcatcaaatgacagtgggccaactggcttgcatttggaaaaaaataaaataaacttggaaaataaatctgaacacctacttttactttcactaaaataaatctcaaattgacttcaaagtgttacacatgtaaaaaacaacaaacatactaaaaaaatcatttgtaaatatctttcatctttgaggtagggaagcttttttaagcatgttacaaaattcaaaaacacaagaaaaaaacaattttaaaatataaattatgcaagcaaaacaaaattgtaaagacttaaaaagtttgaaagaaaaaaatatgatagccaaatggtcaataattacaatcgagaaaaaacatcccatgactcataaagtaagcaaagaacaacacaaaagaaaatttagcaaatttcctgacatggcattttagagtcaaagacttttgatgacctaaaaacatatgatcagattacttatttcaacaatacaacaatattatgagtacaaacaataaaatattgtggcactatggctggaaaatgtttttaaataataagaaaacttggcagaatttatcaaaacttcaattgtgcatattttgaccccctaattccaattctaaatattctttacaaatacacaggtgcaaagatttctatatgtacttaatatgtacagattttataataggtagtgattttatattgttggtagagaagaataaaatatttataaaacctaaaaataacctaaacattgttcaataaggaaagaactaaataaattagcatatgtactacataatacacagatattaaaagtaacatgaagatatatatgatacattttcaagtgaagaaaacaatgttgaagaataaaatatagaataagattgtatttatgactaattagtagtatttatattaaggaaacatgctcaaacagaaatgcttggaaatccacagcatgcatagtagagaggagagtgagatcagtgtgtgagtgtggggcatggcggagcaaagagaaggatgatgaaaatggccttgtaatctttttcgatatagttctgggttgctagaagtttttttgtatgaatatgtactatttgcattattttaaaaagaaaagaagaaaaatgagaggggttgctataatacctatgtttgtataagagtaaaaaaccaggcatcctctgacaattttataacaatgtaagttgttagaattttttggaaagcgtttggtagcatccatgaattgagtaatgttcatacacattgagccaatcatgatatattcaaaaattacacaatagctatataggcccaagtgaacaaaactgtttgaaagaatgctcattaaataatggtttttaatatttaaaatttagaaacaatctaaatatttgaccagtaaagaattggttaaacaaattatagtaagtttatttattaaaaggatatactgcaatatttaaagtattaaagcatatttctgtgtattagcagaagtggcccatgaattattaagcaaaagcaagaaattggaggacctgacttaaaatttgatcatttctgtaaattgataatagtaacattatttacataacaatgagaactatcagtctctactttgttaatgtataataaaaaatcagcattagtatacactaatctgtttacatatatataaacctctgttatatttgaagggtaacattaaaggggtgccctgaatttctgctctcatattgataaattctaatgagcatttattactcttataatcagaaaaatgaagctgtattataaatgataatttaaaaacacctctttttagtttggatgtctatacaaacacattactaacaggaagggtaacttgactggtgaaattaagtatggtgtctttgccataaagcaaatcaaagttattctaatatatgtgaatacctatgaatacgacataatttctgttcaaatataaatatccacgagcttaaatattgtctatttacacacaccacagcaataactcaggtgacattcataagtagatatgcctgaaattattttcaaggaaattactttatttctctgtagctctgtgcaatatcactgtaaacaatttcattgatgcccaggtcctaaagttggtattgttttctcattcagtaacataaaaatagaatgacaaggtttttcacccttacctcccttggctatggttgagaattttcttttcacagaacttcaaatgtgaaaataaatgagctacaatagtgttaaccaacccatatttttcaccgtatgcattattggcacactcttaaacattaattgctcagattttctgggaagaaacggttctgaatttcaaatcttctatgctagttatctgaaatgtttccaacacaaacaaataatacatatttgaggtgatgaatatcttaattatcctgatttgatttttacacattgtatgcacacatcaaaatatcacatgtaacccataaatatgtacaattatgtaccaattaaaaatgttaaaaaagaaaccttgttctcatatgattttatgacatttaatctgaaatacttgagcataatattaaaaaagaaaattttatattatcttatctcaaactttggccataatgaaaatatctaatcatttttactttgagttaaagaaaaaataatataaaaatttttagtttggtaaggtacactttaaatataagaaattaaagtaaaactatgaactaaatctaattgaggttgagacatacatcatttaaatcaaagtgttaaatagctaatgttaaatatttaatttagaattaatttaaaatgggctataaatgcctatttaacatgatctctttgaatatatgtttagtgaaaagactaccttaataatatttatgttttattgtttaatttggagttagttctcgagattttaggtatcctagacatgtaataattacgcaccttaaaagccgaactaatttttattttacacaaagtcacacaggaaggcaaaaactctaaaacttcaaaaactctaaaatccatgctgataatacaaataacaccaggaatctgggcacagtagctaatcccagcactttgggaggccaaggtggttggatcacccaagatcaggatttcgagaacaacctgaccaacatgataaaaacctgtctctactaaacatacaaaaattagctgggcgtggtggcgcatcgcctgaacccaggaggtggaagttgcagcaagtcaagaccgcaccattgcactccagcctgagcaacaagagagaaactctgtctcaaaaaaaaaaaaaggtggtaatgggtattacatacatcacagcaataactcaggtgatgttcataagtagggatgcctcaaattattttcctgggcaacaagagggaaactttttggaggttttatgttacaaaagtcaaaggttgcaaagtaagatatatggattaccattccttttgtaccaattatttaatcatatacataatttcacatgtgcatgtatacaaacatatacacacacatactgcattttatgtgtttacatatatataatgtgtatgtctacatatatatagcatgcacgcacatacacatacatgcctaatcatgcacctcctggactctagaatcaaattgccatctctccagcacaatcacactcacttaacagtttaaagagtagggtatgccattctttaataaggctgtttttaaattttgaatcatttcctctagatttgcatggcaaaatatattttttaatatttatatttttaaaatactgaatggccttattagctgcaagctataaatgccacaaaacagatttggaaattggaacgcacccaacataaatggttaccaacagcgaatgggaaggcataagaaacagggcagtaaagccaccacacaatatgaggaaaatcattaaacgatctggaaaagtatcaagatggctggcctctttgtagttccagcacaaagactgagccttatttctaaatattttccctggtggggaataacagcttgaaaataatcccagatgtattcatttgcgtaactatttgcttcttgcagcatataggcatggaaaaattatttaaggtttcaattctggacttgtattttttaaatgtcaggcttttgaaaaatagcaccatttttctttaaaaccgttcatttacctggaatgttggccagcaggcctataatatggacttggttttgttaagattgaaaaaatgcccaatggcaagagaggaataggcaattttagtggataaaactaaatttgaacccaaactcatctgagcaactgtccaagcagagtataaaacagtgtttttacaattctctgagccggccaaggaattctagatcccgttaaagaaacataaatttagagaaagaaagtaatctagaaaggtttctttaaagatactgaaaacagcatatttaaaataaagtttaaggcagaagtcaactttatactcaggcacttttttccttaaaagtattctctcatttgagatgattctagatagtgagacaagagctcccaaaactaaaattcactttcataaaactattttaacacaaagatagattaaatggattcacagttctctatcaactgttgagaaatttatttaaactcaacattttgaagtcctaaacacatataattttaaaacaattttgcttaaatatatgtgtaacatggcctcacttctgcaaatgatctgttaagtatcagttctgttttctacatttgagaatacattattttcttaaagcagggtctcttgtaagtgtgaggagtgtgtgtgtgagagagagtgtgtgtatagagagaaagattattatcagcgtcttttttctttcacttatttttttttaattttaaaggataccaggaatttaaataattgagtgaaattagcaaaatttttagtaagcattccagtgctaaaataaatgttggtggtttttgttttaaaattacactgttatttagaatgtgaaggtgtgtgtttgaatccaccatccattttacaaatatttaatgagcactatggtatgcagtgtcaggcagtctaacaactaggattttaaccgtggtaatgtaaatacggtgcattggtcctccaaaatgcttctacagaaaaacagctagaatcgtattcctgattatcttaggaagacaatctgaaacaagagataaattgaagagtactgtttcatttacagatttctgaatattttctaagcattacatcaatcccacataatttatgtagatgatttatcacctgagcatgtggaactgccatcctctgctttagaagaaaaagatctctttgactcaagtcatctcttgctttgagacatactattagccatatgacgatgacaccaggaggaatggattggattaatttcaaacaaaaataaggaactcaatctaaactatgtaaaactcacctcattctgatttattgcttttttcagaccatagaagctgcaaataaaatttatgagggaagaacaataaattaggattggataaaggcataattttaggcctcaagttgcttgtacagttagattttaacacataaaattgggagcataatactaacaagttaataaaatcagctgagtgctgacatgtaaaaacatttctttaaacaattggtgggttcaatcagccttgttgacaacttgaaattttaaaaacctacattacttatactaaatgaaattaaaaacgtagaaaagttcataaacgcatgcatcggaaattcactggttttggaatatattggaggcggggggaagttacctttaaagttaaaactgtaaaattaccacataataaaagcctatgctttgaacactaattgcccatgcattaagtaagaaaaagctctcttcctactattgtgaaggtttgatggatgaactttctttggttttactgagctgtgttttatgtatttttggttctactgctctttttagtttattcttgattttaattttactaatatgtattagtatcaataaagcattaggtctatgaagattcctacagcgttttaattgagagtaaattgcctacgataaaaggggcctcctaccggcctagaaggctggcccaccctagtggctgggcaccactacttgtttgaagagttaaaccaaggcacgatagcccactttgtcagctgcctagagggaagttgtcaagtctgggaccctgctgctttattcctataactgtgttttagaaacacctcacaagtggaattgtggttgcctcatccagaaaatgtggaaaggattaatgtggcatgtaaaacaaatcactcctgagctcagctgagaaagtgggtattaaaagcactccagtcaaaagagctttagtgagagggtcacggtgatatacattcagcatatgttgggctggtaatgctgcagggtgtttggaaatggtaatggtccatgagtgtaaagtctttcaagacctcttaaaggcacatgtgtttcttgagcatgttctccaaacaaggacctgttatgggttagattcactgaagcttttaaactttattgattggtttgtaagattccaggttcacttactgcttaaaaaaaaaaaaaacaaactgttgataaacataggcaagaatcccactttaatcttaaccttatgaatcaataaacaatgtgggatgttgcctcctcatcgattacagtacacgctatttatttttattatggaagtgtttgctagttttcagagttaatgggcaatatatccatgttgttcttctaaatccaggtgctttgtagatttattttgagggggaagaaaagggagagacctgaagatttcttgctttttgaaatatgaaccatagccttaataaaaacttgtgggtttcaagttgagagagaacaaataaacctgctaagtgtaatttcataaactgaaatgattttccttggtatttccacttttggaaagaattcattcagaccccacattataatgcaaatatataactgtagccaaagatgcatgagcttgtaaagaaaagaaatataatacaacagttttgtacacacacacacacacacaaagaaactctgttgtctcttctttgtttggtttacatttgcacttcttttatgagacacttatgctttttcctacaaagttatacctcatcaattcattcatttttctaaataacctataccaagggatcacacaaagtctttgaaagatgaaagtacaggcaaaggttgcaataaataagcagtgctgcatctaagtagttgtcagcacgtgtacacaaaacaaggctgggtttttaggtaggacttggtaaaatatcaagataggctaggaggaagtactagttaactaacctaaaaatctcatcagtaaaactaaacaaataaaaatatgacgtgaaactgaaaaaagtcagggtgcttttgggtttgggttcagtgcttccaagtttcgtcccaacttacaaccatgactgcaaatattttttcactaacttcaagcatgacattatttgttacctttgctttactgcaggcctggtaaaagtcaagatcaataatttctcaggaacagctccactctacactgaaattacaaccggcctgagggacacagcagatataaaatttcttgccatcactgtaaaactcataaagcatcactgttgtcttgtttttaaaccgaacttcctgtcttagtctcattcatatcattgctctctgccccacacatttgacacagggaaagaagatggtaaatgctcatggtattgaatatgaaatgggtaggtatagaaaggagataaaaatgttacaataaaataacaagatggtaaggacaagtgaagctaccattatcatatcttccgatttagcttctatttccagctactcttccagaactcctatgccaagaaagtatttctgcattatatgtaaatgggtgcaacttttatgctgtctattcgaagtcatcactttcaaacataaactcattcaaaattgtctattctaggtttagaatttttcaaatgatttcctgattatgttaaatatccagaagataaaagtacaatgttttgtctgacctgtattattgacaaaggtatttttttttgtcagtaacactgtaatgatgacaggaaatggatgatcccaaaaacagtcttgattttgttaagtatgtgtgagtctgtaacatttttgctattttaaattaaaaatgattctgagcctgaatgatggattctgcagcatctaacagtaaccaggtttggatgctggtaacaaggaaatcactgaaagcttgttccctgtgctcagtggtaccaacttagagtgcttcctcaaacactaattggggacctggattatgttgaattttgcaggtttccacatcttccagacaaattgcacatgagggcagactaactcacgccaagatgtgctgcacacctgtacaacagatgaccaattttactgtgcaaagacaaacctccacaaaataatatgatgttacttcacatggtgtacatacaactcagacagctaaggggctgaatcatgccatttagctgtaagttttcattgctaaagacattttatagggcttaaattttatatagtccggtatcaagtagtacccctaattgcatgacttcaaagtagacatatgagccctactttcatattattttagtggcaagcaatcactgcccttcccattgttcctatgagatcctatattaatattattattgggaattttatttaagttcaattttagtgaaaactgtgccaccttccttgaatgagaatttgaacactgagattaaattgataaagaaaatcaagtctgaatcattttatagtcaagaggtacattgtgaatcccataaagcattgtttcaggaacctggttagtgttctgtacacctgcttaatgtttttttcatcatcacaaatgtcaaagtactcagtaagtcaccggggtttgaatgacagccatgcgctaagcaagcagttatgttttttcactaccaaattggaccataaatgatgaaaaagaggtcaaaaaggaagtatggaaccatacaaatttgaaagaggaaactgctaatagccataaaccctgtgcaatcaaaggcttggcaagtcattgcaaattacctgctctgtgaattactgatcgcactgtgttatgatatagaactttctaactcctttcatctgtagtaacagtgcttctaataggtcacagatcaaaagcaaaactctgctagtggaattctgatacaaacatgccaaggttgcataggcataatgcatctgaacaaaatgttaatatacaaccaacgttgcttttgatcaactgattatttaatatagtgtatgtgttttacagatcaaacttaccaatataattgttatagaaagggaagattggtaaggcatgcatgactaatttaaaaggaagagtgaaatcttgcatgatactttcattagggattaatgtaggttggtatgctttaagcaagatcttggcgatctttcagatgcaagatgccaaattcctaaatcctttacttctaactcaagactaagacatgtgggaatcaagcacactcaaaaatactcatccaaatatttatcctattagggaaaatatctgtatcaataagtttcttttttaaatgtgacatgcccatgaagggtgaggtttaatcagtttgctttcctccttcccctttgctgtaaattatgggtactgattaaatggatatttttattaagtggagaagaaaagaaaagaaatattgggccatgagatattttatagcaaagatttggctgaagtgttaccaagctagatttgccctaacacaaaaatagctccagtgcctgggaggtagagaagaggaagaattagatgaggtagacagttgccaaacacagattttcagttatcttggtacttttacttgataacaactcatatgcttaaaatggaaaatcattttctcgttggtttttagatatatattagaaccattatttgttttttgtaagaattattaatcaattagtgctacttattgctgtaatgctgcaaatataatactgaaataagagatagcattcctgtctttatgggaaaatgcacataaatgcacacatgtatataaacaaatatagaatattatagtgctataaagaatagaaata

SEQ ID NO: 1395 - DNA, 20001 bp, Homo sapiens
taataaccctaaagattaatttgctccttctgcataataatgaaaggacaaggtaccttgcggatcctagggcatatctgttcaagcaccaaatactttttaaaattaagaaaataaataatacttggaaaatggccccattccaacaaaacccttaatgtttaatccgtaagaagtcatctgaactctcatttaactagctttcctgatggactgattgtatgggggacatggaaaatgtgaataccaagtaatgagactgattttggcaagacatcagagaaatcagcctaaattactccttagtcacacttacataggaaaatcattttaagagactttatatcaaaaggattaataaataccagtcaagtcatgttttccagggacttccaggtcacatggtgatttacaaacaggtgtctaaatcccccttcccccaccccagattccaggtgaaatatcaagtagaatattaaaacgtgaaaataaagtttcatgttgacttctctagttttgtcgggctatttatagggatcaaatagtgatcttattatagatcactcccacagcaacttggtccttgcccatttctctttgccatccttcccacaatgggtgcttcaactttcattccactcattgtatctgatacatatgtacaaattctgtcagttaaaaataaatttttaaaaattttaaatgtactatctattctttaaaattagtttatcctctattactattttaatgtagatatagagagaaaaacatacctacacatgcttacaccatttaattttatatgtagttttctttatggaacatgggatcagtcattcaaaacaaataattttgtcatcttcaaaaattccagagtctagatattgttatgactacctggacgggggaaaatcttaactaatcattaagttaaaaattagctaataattattagagctcagaatgaacaaaactagttaagccgcataccttacagaattctaccttgtcaagtcaggccttttagattcagcaaccctaattatccatttcagacctgttgaattacttaaagtactcaatgtggccagttctatcccctccggacctatgcactttcacctccctctcctgtcaacttagaagggccttccccaccattttcccaggaacacttcctactcttccttccagacttaactcaggtgattcctctgggcctcctttatgagcctatccagaaaaatgaggtgctcttccctctgctcccaccaaaccctgagcatctctcttcacagcattcctgccactgttttggggctacttgtgtacttgcctatccacccccttccgcaaaatgcctggtttttatctttaaaggtaggtatttgtttttccttatacatctttgtcttccccgacacccaaatacagcctggtgtaaactaccagcatttaataaatattgaataaataaatgaatggatggaaaataaacaaaaagcttaagtctctctctacattattataacctcttagtgaaggatatatgaaatgacatcacctacaagtattaatggcaaaataaaaacatagataatgagcactttaatgtgctttcattaatttatttatgaagaaataatgtgacattcaagtttggggggattcctataccctaatatctaccattattaaataatagttttcagtctctgtctacatagtcattatataacaagaacacatgcccagctgggcacagtggctcatgcctataatcccagtacttggggaggttgaggcagggcagattacttgaggtcaggagttcaagaccagtctggccaacatggtgaaacttcatctctactaaaaatataaaaattagccaggtgtggtttgcatgcctgtagtcccagctacttggaggctaaggtgggagaatcacttgaacccaggaggcagaggttgcagtgagccaagatcacaccactgcactccagcctgggcaacagagcaagactccatctcaaaaacaaacaaacaaacaaaaaaaaaaacaagcaaaaaaccacacatgcccctaccagccaagtatcctttagataacatattattctgcacatgcttccacattgttacacttccctcataattatctctagtcttgccaaataacctgttaatttattcataatttaaaggcaataaagcagagccttgagcaaggctgcctgagtttaaatctggactctctcactttgcaagtgtttgatcttggataagtcacttaacttctctgtgcctcagtttcctcatcctgtaacatagagatgataataagagtgctatcatatggttttggtgaagactaaatgagctaatacatttaaagtgatgataagaggtggttttgttttgagactgggtctcactatgttgcccaggctggtctcaaacctgttggtctcaaacttcgggctcaagcaatcatcccatctcagcctctcaagcagctgggattacagggaggccatcttgaagagttcttgatacatggtacaaacgctctaactattagctatatatttttattgtaattctgaattcactaatattggtctaggttgtttctatattatttgcatcacactagcacatttaagcatatggatttgaggatggtttcttgggtagttggttttgtttcaaattctcaagatttctaactaatttccaaaagggcttctaatctactttttaaatgctcatgtaaaaattacttaattttatatgtgtaaactactttttaagaagatacttcacaaaatctcgacaacctacacagatagacaattgtcaaagaagttggaaggggccaacattttagtttgtacttgaagcttttcatctcagaggagttgctaagttactatctctatgcacatcctagcaagagggagagggttgtgaccaaagaaacaatacttttttcctactgtgcttcacaactcaaaattcattgattcgtatgtatattttgttttgttttgttgtgactaaacaatcctagtttctttcatctctttcaatgaaaggaaacatgtctgtcaaaaaaaaaaagggggaacagcaaagggaaaacatccctcagagaaaggagtgaacaatataaaggtaaacaaaccagggatttctttgatattgcccatttgtttgtgagaacaaagtaacaaacactgaaggagaaccaagtatagattaggcataaggtaaaagggagaacattattcttcattgttcttatctcagaggcatctactactaaatgatgtggggcacagaaagtgggcaaaggaaacactcatactctataaacttacctcctctgggtgataatacatgtacacccagtgccgtttctttagcaaaacgtatttgaaatgcaaaccccaaatcatgttcatactctatgtcttttgctttctagatgtggaatcaaaaaaaaaaggaccttttggtttatctaggcctaatgaggttgtctttgattcttgattatcaaatagttcatttgtttaaccaatattcatacttttgtatttttgatataattgtacaaatttggggaatacatgtgatattttgatacatgtatataatgtataatgatcaaatcatggtaattgggatatccatcacctcatttatctgtgttgggaacattataaattttctcttttagctatttttaaattacattattgtaaactaatttccttactgtgctattgaatactaggcacagatcacaataagatgcacataaactggacaaaagtctttgtcaccacgaacacagatatgtactgaatttgattcccaaatctgctctgtggccttagtcaagttactgaactcacctgagcgagtttcctatgaaatgaaaatgacagtaattgtggtgcatctccttgtacagctgctgggaaggccaaatgggctaattcttataaagcaccctgtgcatagtaagccctcaataaatgctagctactgttgctattgttcctttcattgagagatgttttgtggtgggtttttgttgttttgtttgtccattagccaagtcagaatatgacctctggcttgtattgtccagtgctatttttcatagaaatgaattttttttttttttaaagagacagggttttgctctgtcacccaggatagagtctggagtgcagtgatatgatcatagctcactgtaacctcaaactccagggctcagtgaccctcctgcctcagcttcccaagtagctgagattacaggcaagcaccaccgtgcctaattttttttttttttttttttgagacagagttttgcccttgttgcccaggctggagtgcaatggcgcaatctcggctcactgcaaccttcgcctcccaagttcaagcaattctcctgcctcagccttcctgagtagctgggattacatgcatatgccaccatgcctggctaattttgtatttttagtagagatggggtttctccatattggtcaggctggtcttgaactactgacctcaggtgatccatctgcctcagcctcccaaagtgctgggattacaggcgtgagccaccgcacccggcttttttttttctttaagagagaggggtctcactatgttgcccccaggctgacctcaagtgatcctcctgcctcagcctcccaaagtgcaggtgttacaggcatgggccactggcacctttcctagaatggattttcaactctgtttaaagacgattgctaatgcacagccaattgaatgcttattaagtagaaattaaacttgctttcaaataatgagaacatatgtcacagatgaagagttggtcctagtgcaagtttacaaataaaagacaaagaacctttcagctattgtgactagttagtcccttcttttacagatgtgcccatctgtgtgacaaaagaagcaaggccttttcaaatctttgcagagatggcacatgataaaagtcaggttccactggcttggatgctgattgccccttcaggattacaaccaccccagttccctgcattgtttgtgctatatcatgagagaacaggggcacatgaggacaagatttcttttcatttcacctttcagcagccttgtctgaaaccacactgactgttgttaaaaatgatgcaaattgtgcctcctttcagaaaagcacaaaccattctcccgttttcccccagtccaagaactgtacaggaccttcattagctagaggaacacgatgatggcagtgcctattttaagcagaaagatgctctaaagggaaaaacctaaaaggcttcagacaaaatactattcagtttattatactattgatttttagaatactcttcagctttgctttttttgcggatatatgtcaaataaccagcagtgctttaagttacttgtagaagtatttatcatatatattttttcttagagaagagaaataaagctttggtatggactaacccaaaattgtttgggaggtaaaacaaaactttcagatcagttatgtggcaataatcaagacacccaacatgattttaattttaaaagggagaattccattataaaaatctaccaagtttcctcaggctcatccccacacataccttttctggtctatgtaagttcacctgtttagcaaagggatgggattgactaattggacactcaaagctttcccccagctctgagttcatcccagcttctttagattttttttaagaacaaagaaaaaccaatattttgggaactcttacatgtagataatgtcagaattaatttccacttgtggcaggatttcagtaaagttataagacctcatatactttttgtctaagttaaagcaacatctttacatcactttaaattatacaaacttctaaccaataaaaacaggagaagtatggtgtgtatttgtttccatgggcttccataatgaaggaccttcttgggtggcctaaagcaacagcaatttgttatctcacagtcctggaggctggaagtctgccatcaaggcatcagcaggcccatgttctctgcaggctctagagaggacccttccttgcctcctccagtgtctggtggtcactggcaatccttgcctcctggatgtatcactccaatctctgcttccatcttcacatggctttcgcccctgtgtgtgtgttttctcttcttataaagacatgagtcattggattagggcccatcttaatgtggtatgatctcaccttaacttatttaattaaatatgtaaagaccctatttcaaaataaagtcacattctcagattccaggtggacacaaattttggggaacattatttaaccctgtacatatggagtgcaaaactactcacctttcctttaccaaggaatttctaagggagtcaaattaatttaaaatcttcaccaacttctcaacaagtgcacagctttattatatccaagatcataaaatctgtcatttttcttgcttatgttgatattgtgctttatatttacaaagttttttcatattgcttcatttgatactcacaagcacaaatactcattctcacacaagtaggcagggtgactggtctctttttacagataaagtgagggagaagggaaggaagcttaccttttatcaaataactactctgtgctagatactgttactagtgcttcatgagttgtcttatttgatctatataaaaaactcaaaggttactgtaagtagtattattcccattctgaagtagagtatagcataaaatagcactaaataacttacccaaggtcacacacagctagtaagtaacagatctggggctgccgctcaaatgcacctgtgttctaagtccatcatgtttccattcttccttctcaattaagccttcttcctaacaagtctttaactttgttcatggttagaatttgctaaaatatgtttggtggttgaaagtcatgacaaactcagtgatctcattaaaggatcaaccggagagatctaggccacttaacatgacacatacaggggactatgctttttgtagttatccttcatgttgcaataaaatgcaaaattttcctaactttgaaaatagaggaagaattgtggtggtaagaatcgtcaaaaatttacccacttttggaatagcctcaactagagtaaccctctaggactttcatttattcttctctgtgagtaccaatagggtgaagtcaaaaaatgactccaccattctgtggatggcccaaatcatgagaatgaaggaaaagaagttatcataaccttaagaaagaataagtgggaaaaaccattgttccaaatgtgggcttgaatatgctgtaatgtttcaaagcagcaagtaaagtatacttgttaaggatactctacccacctatgaaccattggagaaaatgaactattttgatgctgcctttaaagagttgtatcttcagagaagccaaaattcactgctgaaagattccttcttgaatctgtctcagaaacaatcttggatttagaatgtacatgtatatacttgtgtatgtgattatacttaacaccatcagttctaccttatattataaatataccatgataacagaactttcttttcagattgtgtcaaaaaagaaaaaaaaaaagggtctcactctgtcacccaggctgcagtatagtgatgccatctctgctcactatgatctgcctctcaggctcaagcaattctcatgcctcaacctcccaagtagctgggattacctgcgtgtgccaccacacctggctaatttctgtatttttagtagaaacagggttttgccatgttggccagggtggtctcgaactcctggactcaagtgatctgcctgcctcggcctcccaaaatgctgggattacaggcatgagccacctcacccagactcttttcagattcttaatgcattctacgtatttacaaataaatattgctaatagctaccatctattgaatacctactgggtgccaggcagctaagcacttactgtacatattcctagttgtcacaataatcctacatggtactttttactgatcctcattttactggtaaaggctctgagactgagaagtttaatgtcattcaaaacctactagatgggtgagccagaatttggactcaagttcacataattccaaagcctgccaccacacaaggaaaatatccatttattcacttatataagattgttgacctctttaaatatgccggtttcatcctaatcctctaaaaaaattagtcattctcatcttttgaagtccctctgacctaagggtgattcacagaggatcaagtaggtaggatcaagaatcctcatcttccgaatacattcatctttttagcttgataaagccagaatgttggggcctaactacgtagacaatttcctcacatttaattagaagacagacctaagacttgtctttgaggccaaatgctacataccaagttttcaccatgaattatgtttcatgagaacatggttgaatccatattaatactggatatctaatagagatcatgttataaatgaaacaaccatttatggataggtaaatattatcaagtacatgtttacattttcatattacatagcaaatcgttaggaaaccaagtgattaaatttggggttttgatggggtacacatggatgtaaaaatggaaacagagactgggggttataaggggtgcaggcatagggctgaaaaactacctattggctgctatgctcactacctggataacagattcaatcacactcaaaactcagcatcacacaatatactcttgtaacaagcttgcacatacaccccctgaatctaaaagttgaggccaggcgtagtggctcaggcctgtaatcccagcaccttgggaggccaaggcgggtgaatcacctgaggtgaagagtttgagactcacctggccaacatggtgaaaccctgtctacactaaaaatacaaaaattagccagggatggtggtacgaccctgtaatcccagctacttgggaggctgagccaggagaatcgcttgaaccagggaagtggaggttgcagtgatccaagattgtgccactgtactccagtctgggcgacacagcaagactccatctcaaaataaaataaaataaaataaaataaattgaaaaaaataagaaccaactgttgaaacctcaaaaaaaaggggggtgaggcggtgggggtgagttttgaaaggtttaactttgcatgcattggtttaccaaaggaagaaaaagggagtgggagagacagaagaaagagaaaaaaaaactccataactagaaaataaatgcctgcattgtagaacttcttaaatgttattttcataaagttatataaacgtatgtcatgcaaataaggacaggtcaaattgaaatgtttataaaatatgctaaatttaagagttgtagtcaaaatgtattatagaatctaactgtggagtttattaatttacattttcatggcataaaaatagcaggactcaagccatgcagttaatgtacacaacattcactgaattgtagacacaaagaggctaaacactagaaagcagcttttaatattctgtaatgttctttatcaagctgtttgtacaagactttatgaaacacagcacacggcttaacaatctccagtgcattattatacatatctaacttttgccttcggatactcccagcaaaggacaacagattctcaactttactgtaccaaagcaatgtggtcaggaaagcagcttccccgttctgcagcagctaaatgtcagagagccaagggttccaccaagatttcccaaagcacagcagttgccattagaaacttcctaaccctccaatgttcactttacagagtgttcagagggtgataaacagatcttttacttgatttgccatctgtgaattttaaagctgttaaggcacttttctgtctttatttccatgatgctcctgatcccatttgctagttagatgcactcactaatatattattcagttctattgagaaaaccatactgaggcatctccgatttgacattactgtccaaatttttttttttttataacatatcaagtaaaataaaccagcttgaaaccctggccttttttagtgcttcaaataattcttttcatttctttgttactgagagctcacattagaaagctattaatacatttgagtacaatttatgttttcaatgcaacccagacaagaaatgaaaaggcatggagaagaaacatggccttcctggacagcctgaatcagtaagtcgttactcttcaccaaatgtagcttatgtacaaatggcttcatttccattccccttcgctgtgggagcctcaagaaccacagttacaggagctagaggatgacgctgacagcggtcacacaggcagtacccactcgtttcaatagccttcgccttttccatttgttggtttgcggaaagacaaaactgtgctgatcctgattgtatgagacaagaaaatccagccaattctattttacgtggtactcttgccttagtttctttttcagtgagaacagacgcgccactgctacagctggccctgtatgttatttttttccagcattagtaatggagtcattgattcaatctatatgaatggagtccctactaagtgccaagcatataacagtgaacaaaacaacctctggcctcatagaactttcattcaaggcggtgagatgggaggagccaccaacatacgaaaacaaatgtagtcacatttacattaatgcctgaattaccaagactcgggctttctttgaagccttccccagccaatttgagggcactatcagatgtcctgtaatatgcacaaaaccaaccactcattttcctccactttggccttcttgctagttgtctccttgtggggcaggtaagagacctgacacactgccacatctacagggctaccaccaggtcactgacataagagtcagcatctccaccactgttcgccactctctaccgctctgcagaggccactggaagggtccagggtaagaaacctcacctggggtctatggcagggtagagagagaaagctggaggctcccccacctgctaatattacagttggttacctcggccctatggttctgtttgtgcccaaactttcacatggtctttcacaaacacgactttttccccttctgaccttcacctttctcttcacccaggctccatgtattcccttgtattctcatctctttccctcatctctctccaggcacctatccacaaaataggttcctcttttttcaccagaagcagaaatgtatatgaccattatctcttacaaccacatccccatagggatgactaacctgatgctcaaagagccacagtccaccttggactccgttaggaagccctgccaggtatagatgggagaactgagctaccagcatcaaggacaccagcaccagaaccagtctttgaactattcaattttatttcctaatgaatgtatttctccacccaaatgctgtgcatcccaggctcttcctcaacctctacctacagagaggatgatcagctcttgtgggtgaggtacagtcacaccagtccagcaatgtgctttgcgattccttgccaggctggattccctaaccattctggtaagcctatcaataagcttgcccaaatgcggtgaagacctctctcagaacagccggagtatattaatccatttaacctgggttttcctaatcaatatggaaatgtttagcctctgaattctgaaggattgattccatactcctgtatggcattccctggctatcaactgccctgagtaggttagcctcaagatatgtgtgggctttgctaaataaactttgataaaataagtaacatttttctgatatatatgaaaatggttttctcatctgtgttggacttttccacagctacatctcctgttctcatgagaagttttacttcctcagaattagtgtgcctccgtaacacaaaacttcagaaaactcccaggcacatgcatgtcaaatgcatgtccaataggcttccacagcaatcttctcatctgtaattcacccagggaagaagcaagcacctccagtgttctgcagactcacagtaatccaagctgcttaaatccttcataaatcctctgtgcaaaaacactaaagagattgtcagcaggaaattcaaccactggttacctcggacattcctagaagacttttccttaattatcagccagagcactatgtcattaatgcagacaagagttgacagcagctggtctaaggcagtaatagcagagacagacacacaaggcaggttcagaagctaaccaggagatgaaatgggacatggcttgtgtgaccacaaacatgaatgcgtgtgaggaatgaaggaaaaataagacccagcaatgattccccaggtttctggcttagatatttgagaggatgcagccactttttattaaacacaggaggaagagcagacttggggagatatatggttaactgcacactaatttatatttgcaaaatgatgaagcacatggagagcaattttttatttttattaaattgctgattatgttcttaagagaaaatatttgtatttactatctatgcatttgaaccatcagaacccttattttcaggacccttattcccaagttttctatgtgtctcggtaattcatcaaataatattaaccagcaagggagggaagtaattaagtgaagatgaaatttttattaaaacactaatcataaatgctcatttacttattcgacaaatgcttactgaatgttggcaatgagccaagtaccaatgtgaacgacagaaacatagataacaatgatactgaacacataaggagtaccagccaccacaataagcacgtcatctgccattgacaatccccatcataatcctgctaggaaggtgttattacaatgactattccatagatgatgagaactaaaactaaaatcctaaacccccaactggctgaacaaatcccctcttggttaaggggaccccagagaaaccttagaaactgagttcctggccacggtgcgatgggaagccagacccgtctcattacatcccctcctttttgtggtttagacgcaacaactgaccagcatcaatgttaacatagagatcctaagactaacaaaatggactctgtggcaataagataccaaattataaagattgcctaaggccatgccaggcaagggttaagtcatgcaccctccacacttaaagagtaaattctgttccaactgccacaagtttttctttttctctagcagttaaaccagcaccggcctcaagataagcactattgaaacaactgcagcactctcaccaccagatgctgacccccggccgattccacaagccatacccacattttttgattggaaaagagacagctgtggttcagtaactttctcctaataagagaccatggaccatggactgatctggctggtttacagaggctgtaaacttgagggccttcgtgtccctgccttacgttttgccatataaggcctaattgtaagacacttaaatgttaagtctccaccccaaagtgaacatgggatgcaggtaatacgcatgtttgcttatcacacgtgtacctctcccacttcatgattattcatagctcctcctgtaacctattgaatatgtatacttggccaacctcagcataaatccctgttccaccccttcctccctcaaagtgtctgttaatagcctctgcaagaggctacacttcccagccttcaaaaatggccagaccacaggctataaccctttataagaaataaagtctccttcacagatttaaagatcttgtgatttttccatgatgaaactgacatagcaacgtgttgagtaacttggctaatgagtaggaaaccaaagtttataccaaaccctgggactctagagccggtctctgccatgcctcttccctcaaggaagtcaggatcctcttgggaggcagaccatacatgtcattagaaagcttttacaatgatcaccttgcttgttcatctcaactctcgcagatctgccactttcttcagtcctctaaccacttgattcggtacacttgatgtgatctagcattaccagtctctcctccaccacatgctgcctgtaattgtagcagtcacttgttttcagtcatatcattacagagcagcattgagttttccagtttataagcagcccaaatttgttttcctgttgagcttttgccttgaatgtctggcttttccttggggatacatagttcccagttccatttcccacaggagctttactctggaatgtctaatagtgtgtgtttgtttcaacatcggggatataaataggtaaaatgaagttctgcttggtgctgctgcacggctgcaagaaccaagggccagccaatcatgagctgagggacttactgtgtttgtttaaatatagttcaggtttctcccttctctctacctcaacaagatttagcacctagaacaagacactacacctttagtttgcactccgaaattgctaggaagtaaatccatctggaaactgcactggataaggagcagggatacacagcagtggctggaaagaaattactcaagtacgaaatcaggaaggaacctcattaacaccccaccaccttttgtaaagtcaataatacactgtccagtatgaaacccagccaagatctcagctgttgactgttcagtgaaagaggaacatgaaagtgacagaaggacattcattccagaaaccctgagaatccagcagcccctacctggtctccagctccatgacttgccaccgccctcactgctccagtctaaattccacaccttcagagctagagtcagagtttccagggtggcaggagtggagtgaaccagggggatcccagcatcctcctcaaatgtagggactaagactggcggggaaaaggggcagggtcctttggggattgtaatgcacccaaggggaaatcccagagatccaggttcagtcctctggccctccccagctagcctgatgtagctccatcttcactgaagttcctctggtgataacacatcatgttgaagaggatatttagggcttcctgagacaaagctgtgctaaacacatgaactctcagcaaatactagcaagtgaattaaaaatgaatgaatatcctataaaacaaagcaacaaatcagacaacccctacccccgaccccatggctcaatgagagcttctggacctgcagcatccccacaacatataattcacccactaccccatactagagaaacctaggaggctctcgtgtcctggggagcaagctgttaagtagaagtgggagaattcctaaccctgttaagagttggaatgttaaactctaaagataagcctgaaaaccagctttaaaaaatgtgagcattcctagttaacctagataggcagaattcttttccctcctatcaagacaaacccacagtagctcaatgcctggattatgaggccacatcacaaagatgttagttttttcagtttgggttgttgctgaaaagaaagtaagaatttaggcattacaattcagactagatccattcattaggtccacaccacaccagtaaacagtgatacagatttgcatagtgtttttttaaattaacatttaataatgttttacttcccaagccccttatgagctgggcattggctaaaaaggttttggctcagtacaaagaagaatgttccacgcctgtgaaacaccaaacaatggagcagtggtgttgtaagggagtagcctctggcccattcaagtcaaaactggataattatttgttgcagatgctttaaagagttctaataatttaggtgttaggtgagaataaataatctctaagatgtcttccaatcctagcatacatgataaattttttctgtggaaaaagcacccaaacagaaagtgaccagtgactttccctagtcacacaaccagaccctccagcttctagcctaacactctttccactggatggtcttcaccaccaccagtactcagccccaagacaccaggggaacactggcactgtccctttggtttcatagaaaataagcacaaataaaagattcaacatctgaccgacatgctttcccatattttataagaagatcaatttagtaccatataggtaccaaggtactataggtaccacataggtaccaagttactataggtaccacataggtacattagacagactgttttgtaaacttctgaaagccaatacaaagaacatctcagagttagtatggtagaaccttctagaacacttgtcatggcctgaatcttcatgtccctccagaatgcatatattggaacttgtattagggttctctggagggacaggactaataggatagatgtatatatgaagggaggtttattaaggagtattgactcattcaaccacaaggcgaggtcctacaacaggccatttgcaagttgaggagcaaggaagcgagtctgagtcccaaaacctcaaaagtagggaagctgacagtgcagccttcagtatgtggtcaaaagcctgagagcccctggcaaaccactagggtaagtccaagagtccaaaagctgaagaagttggagtctgatgtttgagggcaggaagcatccagcatgggagaaagatgaaggcgggaacactcagccagtctagtcattccgcattcttctgcctgctttattctagctgtgctggcagctgattagattatgcccacacagatggagggtgggtctgcctctcccagtccactgactcaaatgttaatctcctttggcaacaccctcacagatacaccaaggaacaatactttacatccttcaatcaagttgacactcagtattaaccatcacagaacttaacccccagggtgatgttattaagaggtgaggactctgggaggccccaccttcatggctgggattactgcccttttaaatgggttgagggaacaagtttacccccgctttggctccttccaccctgtgaagatgcagcaaccagacaccatctgtggagcagagggcaagtctttaccacacaccaaatctgttggcaccttgatcctggacttaccaatctcaaaaactgagaaataattttctatcatttacaaattactcggtctaaggtgttttgttatagcaacgggaacagactaacacaaccctatacttcagtatttgggataattggattaaactaataatttcactattaccccataatcaaacataatggcagcatttatttggctgagtttcatgcttagagtatgggaataagaattgttccattataaaggtcacaaccttacataatgatctcccttacataatagtcacacccctatttttggaccggcagagccagcataaaaagtgttatcattacacaaatacagcactttagaggtgtttttaaggacagaaatatattttcaattctattactatttttcaaacagctgaggctagacagagattccaagtgccctgcttcgctgtttttgagctgtcaaagaaaatgaatcaactgactacagtcacgtatctaagacagacatagaatttcgcaggaagtctgaggttatttgggtcaagttcatacggtatttgatctacagcctgataatacagcttttgtgctatatgagcacactaggacatggtgttatttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgtccggctaattttttgtatttttagtagagacggggtttcaccgttttagccgggatggtctcgatctcctgacctcgtgatccgcccgcctcggcctcccaaagtgctgggattacaggcgtgagccaccgcgcccggccgacatggtgttattttttaactgagacataaaaaccaaagtaacaatctacttgtattcattgttaagttttcatatccttatagccaaagaaaggaaaaccacttccaaccagcctgcttctattaatacacacagtgatctttgacgtaaatgtcacacatgttcactttaggcttctggtcaaatttgcatgaggccaattaaattctgaggtcctgaatctcctctgtaaattcaacagatagatttctcttcttgtactaagctattgtttggtattgttctgaactactcaacagctgtaattctgcaactcactggatgttgaagggtataataattgtaccgagggatatgaatgtgtgtaaacccaaagcccagtgctgtctctacggtgatacacttatccacattcctcccactgtcatgacacagtcctcttacttcaactggctcacttctccgaatgcctggaacttcactcaatttaccttcccttatacaccttagatgtcaccttagatagtgcaccttaaatgtgcactattatggtagccactagccatatgtggcttctgagcacttgacatgtggctagcctaaactactgagatgtgctgtaagtacaaaattatatactagattttgaagacttagtatgacatatgtaaaatacctcaataattttcataccagcctgctgaaatattttgcatatatcaggttaaataaaaacatacatattatacactagaaaattttaaattatgtgtgtagctcacattattggataatattgagttggctaattttaggctctctttccctgactccattctactgagctctcttcaattacacataaattgggtcttctaattttatcctttatctcttaatctccttttctatccttttgtttttcctgtgctgcattctgggtaatatctcatatttatcttccaaatcactgattctttcttcactaggtctaatctgttgttaatccatccatccattacattaggttttatgtttactttgttttgatgttttgaatatggttttgtttactgaacttccagacaagatttcatctggtttagaaaaatattggaaaccattaggcaatttctactaatgctgaatacatgcatactctgtcaccagcaattctactcctaggaataaacccaacaggaaaaaacgatagcccaaaactgaaaattacccaaatgcccaacagctgtagaatgtggcatattcacacaatagaatactaaattaaataagaaaagtataactatatggaaaaatatgaagttcttttatcctttttcatatgttgagagacaaaggtcatatacaaaagattatatagtatataaatccatgaataaaatctttttaataggcaaaattaaaatggtataagaattcaggatacttgcataatagtcacacccctatttttggatactggttgaccttggagtaatactagttgaccttggagtaaaagattacatgaagggaacagaaagggggtttatgagatgctggtaatgttctgttccttgatctgaatactggttacatagtacattaatttatggaaattcatcatggtatatccttatgatttttaaactttgtatataatttaacagtataacaaactcaaactctaatcagtgattttcagaaaaatatttggatgttgtattagtctgttttcacactgctataaagaacgacctga

SEQ ID NO: 1396 - DNA, 20001 bp, Homo sapiens
aaatatgcttgctccagatgctaaggcacaagatggccaaggatggcggagttcatggagaaagcatcatgagtgttttggccttctgatttgatctccctagcacccctcaaagatggctacttcctaatgctgcttggcaattcagacacatttgggtttttcctatgcatataaccacacttttctgaaagggagtagaattcaaggtctgcattttctaggtatgaacactgtgcatgatgaagtctttccaagccacaccagtggttccatgtgtgtgcacttccggtttgagtgctagtgagatacttctgtggttctgaattgcctgactatttggggttgtgatattttcataaagattgatcaacatgttcgaatttcctccccaacagtcttccattaccaagtaaagattcatttttctgggactgagagtgaaacccataccaatcaggcctttgagatttctctgtatggcaccgtggccgagagtgagaacatcccattcactctgtgagtagcacaggggggcggtcatcatggcaccagtccctctcctgccataacccttggtctgagcagcagaagcagagagcgatgcctagaaaacaagtctttagttaaaaaaatcagaatttcaaaattgaggtctttcctctatttgatattgagaaaaaaatgcttcaaattggccattttattttcacttactagttatatttttttatttatcatcttatatctgtttatttcttttataaagctgctgttaaacaatataattaaactatctcaaaaggtttgacattaaagaaaatgagcaatggtaacaggaaaccactctatagatgtacatataatatgtacagaaaatataagtagtaagaagtccatgacaaagtgttagctctttttttttttttttttttttttttttttgagatggagtctctctctattgcccaggctggagtgcagtgattcgatctcagctcactgcaacctctacctcccgagttcaaacaattcttctgtctcagcctcccgagtagctggggctgcaggtgcccaccaccatgcccagctaatttttgtatttttagtagcgacagggtctcaccatgttggccaagctggtcttgaattcctgatctcaggtgatccacccgcctcggcctcccaaagtgctgggattacaggtgtgagccaccatgcccagcctaccctttactactaatcaaagaaataaaagtaaggcaacttgatacttttacaattactagatgaacaaatctttaaaaatagccagtgcagacaaggtggtgaagcagaacatgcgaacctaccatgcatcattcacggctagaaccctccaggtgcggaaggtagtattttaataactttccatagctacaaaatattattacatagaagggagtgatttttttctaatatttatcctaaagaaatagtcaacaaacatttttaaaaacatcaattacagtcgtacctatactagcataaattagaaacccagtatccaacattgaggcagtgggtaaatgaatcgtggtttatcaagtcattaaaatcaatctagcctttaaaaactataattgtaggaaacccaggaaaacatagtaaaaaatggaatataaaatctgaagagaataaagaatagagaatcgtatgtgtgctatgattgtagctaaataatgttcaagtatcaacacaaattgaaaaggaatacatgaaaatgaaaattatatttctgaatgattgacttcaggattttcttttagaattgtattaaatagttcatgtcattaggataaatgctggaatgtggatataatttaaaatatactaaatgccatcgaccttcattttgagttctttgttggacatttttgtgcatttttaaaatatcccctaaataataaagctatttatatttggagaggagaaaaaaaagtggggggcagggagagctgatctctataactaaccaaatttattgcttttttgtttaggcctgaagtttccacaaataagacctactccttcctaatttacacagaggtagatattggagaactactcatgttgaagctcaaatggaagagtgattcatactttagctggtcagactggtggagcagtcccggcttcgccattcagaagatcagagtaaaagcaggagagactcagaaaaagtaattaaatgtatttttcttccttcactttagacccccacctgatgtcaggacctaggggctgtatttcaggggccttcacaattcagggagagctttaggaaaccttgtatttattactgtatgatgtagattttctttaggagtcttcttttattttcttatttttggggggcagggggggggaagtgacagtatttttgtatttcatgtaaggaaaacataagccctgaatcgctcacagttattcagtgagagctgggattagaagtcaggaatctcagcttctcatttggcactgtttcttgtaagtacaaaatagttagggaacaaacctccgagatgctacctggataatcaaagattcaaaccaacctcttcaagaagggtgagattccaagataatctcaacctgtctccgcagccccacccatgtgtacccataaaatgaattacacagagatcgctataggatttaaagcttttatactaaatgtgctgggattttgcaaactatagtgtgctgttattgttaatttaaaaaaactctaagttaggattgacaaattatttctctttagtcatttgcttgtatcaccaaagaagcaaacaaacaaacaaaaaaaaaaagaaaaagatcttggggatggaaatgttataaagaatcttttttacactagcaatgtctagctgaaggcagatgccctaattccttaatgcagatgctaagagatggcagagttgatcttttatcatctcttggtgaaagcccagtaacataagactgctctaggctgtctgcatgcctgtctatctaaattaactagcttggttgctgaacaccaggttaggctctcaaattaccctctgattctgatgtggcctgagtgtgacagttaattattgggaatatcaaaacaattacccagcatgatcatgtattatttaaacagtcctgacagaactgtacctttgtgaacagtgcttttgattgttctacatggcatattcacatccattttcttccacagggtgatcttctgttctagggagaaagtgtctcatttgcagaaaggaaaggcacctgcggtatttgtgaaatgccatgacaagtctctgaataagaagtcaggctggtgagcattctgggctaaagctgactgggcatcctgagcttgcaccctaagggaggcagcttcatgcattcctcttcaccccatcaccagcagcttgccctgactcatgtgatcaaagcattcaatcagtctttcttagtccttctgcatatgtatcaaatgggtctgttgctttatgcaatacttcctctttttttctttctcctcttgtttctcccagcccggaccttcaacccaggcacacattttaggttttattttactccttgaactacccctgaatcttcacttctccttttttctctactgcgtctctgctgactttgcagatgccatctgcagagcatgtaacacaagtttagtagttgccgttctggctgtgggtgcagctcttcccaggatgtattcagggaagtaaaaagatctcactgcatcacctgcagccacatagttcttgattctccaagtgccagcatactccgggacacacagccaacagggctgccccaagcacccatctcaaaaccctcaaagctgccaagcaaacagaatgagagttataggaaactgttctctcttctatctccaaacaactctgtgcctctttcctacctgacctttagggctaatccatgtggcagctgttagctgcatctttccagagcgtcagtactgagaggacactaagcatgtgaccttcactactcctgttctgaattccaggaatatgcccttttcaaccctccacacatcccctgccagacagcaagtgctaatgggttacaggaacaaaggggagaaatattagatcatgtcatacaagccagtgacacaagaaatgaagggaaaggctagacacagtgtcatctggaaacaggaaaagcaattgcttttggtttgttcttttcctagtttgcatttgggacaaatgtatagaataagaattgccttcatgcctgcaatcccagcactttgggaggctgaggcaggtggatcacctgaggtcaggagtttgagaccagcctggccaacgtggcgaaaccacctctctactaaaaatataaaaattagctgggtgtggcggcacatgcctgtaatcccagctactcggcaggctgaggcgggagaattgcttgaaccggggaggcagaggttgcagtgagatgagatcgcgccattatattccagcctgggcaacagagaaagactccatctcaaaaaaaaaaaaaacatgcctattaggaaaagtatattaaagaccctatgtgtaacatctttaatgtttttaaattctactttataatagattttatacatgtttactataaatagattaggaaaaataagcaaaaataaaataaaatcactgtgaccatatcactcagagacaaccccaattaacgtttttatttatattctttcggactttatatatacataatatttatatgtttttcgtcctttacaaaaatagaattatggtgtatatactctgaatgactagatgagaacatctggatcaaaagcattaatgtaagagcattcaggataaactcaaaatggagaatagttagtggtattgagccaggcaaaataacgcaattcttatctaactggagacttttcttctaagaggttattacgttgtttttcctcatcacaaatctgaggcaatatcatactttcttcagttcttagaaagagacttttagatgaagttttttttgtttgttttggttttttttttcttgagatggagttttgctcttgctgcccaggctggagtgtagtggctcgatctcagctcactgcaacctccacctcctgggttcaagcaattctcctgcctcagcctcccaagtagctgggattacacgtgtccgccaccacacctggctaatttcgtatttttagtagagaaagggtttcaccatgttggtcaggctggtcttgaactcctaacctcaggttatccacctgcctcggcctcccaaagtgctgggattataggtgtgagtcaccacacccggccctagatgcagttttatacatgcatttgtattacacataaatagcatgcatattctgccagagcatctacaactttaaatctacatgtgaatgtgaaaataaaacctcattaaattagtaaataactctagctgcttgtaaagcacgtccagtcgtattttttatatgttacaagactttatctgagaaagcctaatgaagcattccttgtctgattataggattactgacagaacagttatttagacagagaatgttcagatgcgttttatttttattttttacttttatttatttttgagacagtctcgttctgttgcccaggctagaatgtggtggcgtgatctcggctcaatgcaactctgcctcccgggttcaagtgattcttgtgcctcagcctgacaagtagctgggattataggtgcccgttaccatgcccagctaatttttctgtttttagtagagacggagtttcaccatattggccaggctggtcattgaactcctaacctcaggtgatgtgcctgtctcagcctcccaatgtgctgggattacaggcatgagccacagcacccagccagatgcatttttaaaaacgtacctgaactttatctaggaggtaattataaattagactaataatcttctacagtttctttcttctgtgattaaaatcaatcaaatcaaagattctctttctcacaccttctgctaactcctcagaaacctcatatcacaagaaatgaaatggaacaggcctttcgtttgatacattttagaataagaaatcctctaaatttagaagtcatttggcccagtcctccaaaaatgatgcaccttattgggacggggctaaatagttgctccagtgtcttccattcctacaaacctgccattctctgatccattatacacatctcccctgggtttattctcacaacctttgttctgaaattccatttgaaggctttttccatcctaaaaccagtgggggacaggcgggaattgtaaaacactcagaagataataaattgccctttttcctgtgctttttctcagaaactgggcgaatctacagaacaaagaacggcatgtgaattctgtgaagaatgaagtggaggaagtaacttttacaaaacatacccagtgtttggggtgtttcaaaagtggattttcctgaatattaatcccagccctacccttgttagttattttaggagacagtctcaagcactaaaaagtggctaattcaatttatggggtatagtggccaaatagcacatcctccaacgttaaaagacagtggatcatgaaaagtgctgttttgtcctttgagaaagaaataattgtttgagcgcagagtaaaataaggctccttcatgtggcgtattgggccatagcctataattggttagaacctcctattttaattggaattctggatctttcggactgaggccttctcaaactttactctaagtctccaagaatacagaaaatgcttttccgcggcacgaatcagactcatctacacagcagtatgaatgatgttttagaatgattccctcttgctattggaatgtggtccagacgtcaaccaggaacatgtaacttggagagggacgaagaaagggtctgataaacacagaggttttaaacagtccctaccattggcctgcatcatgacaaagttacaaattcaaggagatataaaatctagatcaattaattcttaataggctttatcgtttattgcttaatccctctctcccccttcttttttgtctcaagattatattataataatgttctctgggtaggtgttgaaaatgagcctgtaatcctcagctgacacataatttgaatggtgcagaaaaaaaaaaagaaaccgtaattttattattagattctccaaatgattttcatcaatttaaaatcattcaatatctgacagttactcttcagttttaggcttaccttggtcatgcttcagttgtacttccagtgcgtctcttttgttcctggctttgacatgaaaagataggtttgagttcaaattttgcattgtgtgagcttctacagattttagacaaggaccgtttttactaagtaaaagggtggagaggttcctggggtggattcctaagcagtgcttgtaaaccatcgcgtgcaatgagccagatggagtaccatgagggttgctatttgttgtttttaacaactaatcaagagtgagtgaacaactatttataaactagatctcctatttttcagaatgctcttctacgtataaatatgaaatgataaagatgtcaaatatctcagaggctatagctgggaacccgactgtgaaagtatgtgatatctgaacacatactagaaagctctgcatgtgtgttgtccttcagcataattcggaagggaaaacagtcgatcaagggatgtattggaacatgtcggagtagaaattgttcctgatgtgccagaacttcgaccctttctctgagagagatgatcgtgcctataaatagtaggaccaatgttgtgattaacatcatcaggcttggaatgaattctctctaaaaataaaatgatgtatgatttgttgttggcatcccctttattaattcattaaatttctggatttgggttgtgacccagggtgcattaacttaaaagattcactaaagcagcacatagcactgggaactctggctccgaaaaactttgttatatatatcaaggatgttctggctttacattttatttattagctgtaaatacatgtgtggatgtgtaaatggagcttgtacatattggaaaggtcattgtggctatctgcatttataaatgtgtggtgctaactgtatgtgtctttatcagtgatggtctcacagagccaactcactcttatgaaatgggctttaacaaaacaagaaagaaacgtacttaactgtgtgaagaaatggaatcagcttttaataaaattgacaacattttattaccacactaagtcattattttgtatcatttttaaagtaaatttattcttaggtcagattcactcagcatattttgactaagtaaccactgtacttagtaaaccgaagagcttctgagaattatagtgtaccttatagatatttttaacatttatatttgtataaagctaaagaaagccttacatatcctttaaactgactatagaagaaaatgatacagaattttgcctgcataaagtacacaggactattcttgcctacaatatgctttttcacaagcaaaatgttagactaatataaggcatctttggccattttatagtgtacatcatctctatttctgaggcctcattgttagctgtaacgcaagtagcatttgtgcaataaaatgaactatttgggatgggagggtacattttttagaactttgctttgggttgccttgataattaatagcatatagtccatttatgcagctaagtagggattgcttcttagtacagtcaggaagaatttagcccagaaaacaattatttcaatggccactgacccaaacttccaggctgaagagcaatggcgtgatcatggctcactgcacctccacctcccaggctcaagtgattctcctgcctcagcctcccaagtagatggtactacaagcacacgccactgcacccagctaatttttgtattttttgtagagatgggggtttcaccatgttgcccaggctggtcttaaattcctggcctcaagtgtctgccccccttggcctcccaaagtgctggaattacaggcatgagccaccatgtccagccttgacccaaacttttattgtcagttagctattggggcttctggagtttgggtctcccctgacaggagggggctccccagttcacacttggccactgcccatcaattcctgttgatatgatcaacaagatagacaattgcaaatgttgctgaggatgtggagaagtgtgaacctgtgtaagtggctgatgggaatgtaaaatggcacagccactatggagaacaatttggtagtatttccaaagttaagcatagagtttaacccatatgacccagcaattccactcctagatatatacccaagagaaatgaaaacacagatccacaaagatttgcacacacaggttcatagcagcattaatcagattagtcccaaagtggacaacccaaatgtccatgaacttgtgaaagagataagcaaaatgtgacaaattcacataataaaatattattcagaagtaaaaagaacaagcagcagatatatgatacaacacgatgagccttgaaaacgtttagccatatgaaagaaaccagatgcaaaatggaaccatgggcttaggggaggagaacggcacaatggtgtaaaagttgcagagaggaacaaaaaggctacctgcctcgctcccaggccaagtaacacaggaggaaagaaaatatccacatatgcgagggctaaaggaaagaggtgttctcaagctgaagcaggaggtgggactcaactctggaggtgggcctcacacactgtaccaaattgaggactagctaaaacagggatgggggtgaaagcaccttttcgtaagacatgcccaccattgtcccgttctcctcccttaagcccttgtcttgctcatgtcagcaagcttattgccatctattcttcctagttacagacatctgtggagctctgagttttttgcctaatcattattttagaacctggttcactctctctcccttctacactagttctgtcattattattactgatttcagtacctctgaggtgatagattttattttccaatggcagccacaacactacctcccattctatatgttcccctgcaatgttgccttgacatccctattaagagttggaatctagtcaccccgcttttctagtctccccactcctttgaacttgtgtgggccctaagattgcttctactagtagaatagaactaaaatgaccctggaccagtgtggggtgcagcccttaactggcctggcagcttctgcttttggttccttggggcactcactcttgggaaacttccctttggaactcagcattcatgatgcgggaagttgaagccacatgaaaagagcatatggtggttctctcagctcccagccaacaaccagtctcgactgtcagccatgtgagtgaggcatcttggacctccggccagttgagtgttcagaagactgcagctcgagctggcatctggatgcaaccacatgagagacgctctgcccagccaagcccagccaactcacagtactatgagagatactaataacttgttgttgttgttgttgttgttgtttttattattaaactttaagttttagcatacacgtgcacaacgtgcaggttagttacatatgtatacctgggccatgttggtgtgctgcacccagtaactcgtcatttaacattaggtatatctccaaatgctatccctcccccctccctaagtttttaggagtttgctttgcaacgatagatagttgaaacatctggatgatgcatccagtattctggcttctcactgcctttacctcctctctcccatggccttgtcttctaaatctacctttacatagaaacattcagtcacgtgctatactatatcatgccattactaataactcataaactcaatttcaacttctcccttctttgactaccacatgctatctttttactttaatcagtctagtgctctcagttcaacagctcctcaactgccccaggacctccaatacattgatctattcatccctcatttcctttcttagcctcactttgatccgtactcagcttagatttcaaggcccaaggttattattactccagtgccaaaactctaaagagctgtgcttctctcaccctcaactgagctcttcagggcaaaacataaaccctgaatatatccaaattgccactcaactccataactgcatctgagcagcagaatgtgataggtaacacacccatgcacacacagccctgctgcccctcactttaccgcctcactccatggctcccttacagctgcccagcagtcctcctacatttccctggtccaaacaggcctcactctccaagatgatgatttaatctcagacctctaataacttctcacctctctctacactcacctgattgccttatttactgagaatacaggggcaatcataaagctctatgtgcttcactcttaaatctatccatctccctgctcctgtgtccatacactctgttttcccttctgatataagagacgttttccctctttctacctctgaccaattcttgcataaaaagatcttgaaggagaaggaagtccttttctcctactcaaagacattgctctggagttgttcctgttctctcctgctcctcagttttcacctcctactggatcattctaacagcaaacaaaaatgtatacttcccacttaaaaacaaattaaaacttgcttgaacccacttccatctccaccttcctttttttttttttgtgatagagtcttactcttttgcccaggctggagtgcagtagcacgatctcagctcactgcaacctctacctccctgattcaagcaattctcctgcctcagcctcctgagaaggtgggattgcaggcatgttgccaccacacccggctaatttttttcgtattttaagtagagatggggttttgccatgttggccaggccgggctcgaactcctgacctcaagtgatccatccatcttggcttcccaaagtgctgcgattataggtgtgagccaccacacccggccttatgctcctctttatagcaattgcttaatctctactaatggtttctacttcccctcgcaatcctcgaacaaagtctgatcaagccactttcaatctaccagacttattgtttctaagcttactgatgaataccatggcagtaaacccaatggtcgattctcctttgtcttcttacttgacttccctgtgtaatttgagccaggttgcttttcccttgaaacgatttttcactggtctcttaggactccactgtttgctaccctctttctcccattagctattccttctcactctttgttgattcctgctcatcttcctaacccttaacgtgttgagtgctccagtgctgaatcttcagtgtctcaacttcatttatatctattcacaaggtgatactcagttggctttaaacaccacacagctgctgatgaatccaaaatttacatctccatcttgtacctcgcttctaaatttcagactttttaatatatccacttgtctatcaaatatctccacttggctttctaataggttttgggaacctatcatgttataaaacattgttatccaccagttttctcctcccagttaaaagaatttcttccttccagttgctcaggaggaaatcttggaatccatacttgagttctttcttccgcaatacataatcaatcagtcaaaaaaactggcttggtgtcatggctcatgcctgtaatcccagcactttgggaggcctgggcaggagggtcacttgagcccaggaatttgagaccagcccaggcaacatggcaagacgccatctctactaaaaaaaaaaaaaaaaaaaaaaacacttagctgggcatagtgatgcatacttgtattttcaggagactgaggtttgagcatagcttgagcccaggaggttgaggctgcagcgagcttttattagcgaaaaagcactctagcctgggtgacagagaaagaccctgtctcaaaaaaaaaaaaaaaaaaaaattctatcagcttcacttaaaaatatatccagaatctgactgcattttaccatttttaatgttatgccatcaggtttcactggattatttcaatagtctctcctggtttctctgctactgctcttgcttctcattagtctattaataatgaatcaggtgaactttctagagtagatcgtagcatcccattcctctacccagtacttcaactctctgtatttttcatcctgcctaacaacaaaaaaactataaattattgtttgcatatgcatgtgtgtgtttgtacgcatactgttgttattcaccctgttttacatttagcccatttctagctaatttttgtatatggtactatctgtggttagaggtgttttttgtttttgttgtggtagttgtggcaataatttcttttttacatagtcaaattattccagcaatttgttgaaaaaaatatcctctctccatcgaattacattggcaactctgttctctggtcctcacagatcagttcctcatgatgactgatttttcaggaaatgtgggctttgaacagacttcactcagaaagcctgtgctagagttccagcatagggacctcattcctttatcagggctcagatccttcatcctcttgtaacaggctctggacctacaatggaaatctgctgacatgagattaagagaaggtatctggaatgaaggcacttctccgactccacccattccgctgacagggctccaacaactccagggtcttttaatcaagagattgctaagtcaaagacaatgcctcctcagccaaatgtgaaacacaaaggtttcataatcaaaatgaaattccttcttagcacacaactggagaaagctctaaaggagataagaatcaataataagatttataaaatttggcagcataagctgaggatgatgatatttcccttaatctttatgtttccagatggcactggtgtggcagcagaaatcacatcatggatgagacgctaagaattggcacaagatctgcaccttagatccaaagactatgtgatccaggccctcaaatacatcttttctaatcctcataataattctatgaggttggcaccattgccccattacaaatggggagaggttatgtgcaaagtccaagctcacatcaccacaatgggatagcctgaggatgcaatcccaacaccatttcctgagtcatgctgtgctaggccaaaatttggattcctaaagtcccttaatggtgatcaaatggtccaagttgcaagttaaggagagtaggtcggtaaagacaataaatcactgtactccccagacttctccaactaatcccagttattcttcatgcatttaacataaagctcttcgccggacaacctggcctcttactctttccctaaacaaagtttttttctgtagtctctatatttttgctcaaatgtccctctctgcctataatgaccaccctattttctaagtacctttaatgactactttcactcttctgagctcccttctgaaatctttttttcttccattgctatgttaccactacgatctacctgtcagcacaagtgttgcatgtacttgctccgatgttgtgttactaaaaataattactaccagtttttctgcatcaactatgtgccaggcactgtgtgaagtgcttggttaacatttgtttcattctcacaatagcctcctgaaataggtatttttatcttctctttattgatgaatataacgagatgcagggaaatgaattaatttagaaatcaaagctagtaagtgggtgagttggcttttaaaccaatgtgtgacttcaaagttggagttgttgatttttcccccctttgagttttaagcctgtttgaacatatctggggcacttggagatggtgcaccagaaatacattggcagaaaaaatttttcccaagagaaaagagaagcaaaacacataaaagtgactcaaggatggaggcccaagacagagaggagaggcaactttgacttccaccatgtgtctgtttctattgtctggcagcccagcctatgggagttgcctgaggtttagggagaagcaactatgataatctgtgaattgctagatttggcatccatggtgtggggcatggtggtccaacattttcccagcaagcttctaatgtgctggggtctatggtggcttttgtgagctgcactgacttcagtgcggactccacaggtcagggaaccttgacaccccctgtgcttcggcaactcgtttgtggtgggttgtgacaagtgatattagtaacagccggatggaaaaaggaaggaaaatgtaaggtcaatgcaaatttttatcaagtacctacgatgtgcgggcaattttgcaaggtgctagtgtcatgcagcctgtggcatatttgagcagacttatgggagtatatagaaaagctaggagtgggccgggcgcggtggctcacgcctgtaatcccagcactttgggaggccgagacgggcggatcacgaggtcaggagatcgagaccatcctggctaacacggtgaaaccccgtctctactaaaaatacaaaaattagccgggcatggtggcgcgcgcctgtagtcccagctacacgggaggctgaggcaggagaatggcgtgaacccgggaggcggagcttgcagtgagtcgagatcgcgccactgcactccagcctgggcgacagagcgaaactccgtctcaaaaaaaaaaaaaaaaaaaaaaaaaaaaaaaagctaggagtgacaaaggtcttcatacacttgtctttttgtaattcatctgcccagagtgggcaaattttggtaattcatgcacaggcactatactgtacatgctaaccctgactttactcactgctctgtttctcacccaagtttgttatgaatgatttaaagatgctgaagatacctggatataaagaagggggacgaagaagctagaaaaatgctgttgcaatattattttggccctacatttcccccagcattctgttgcccagaaattgatttgcatcactgtttgtcttgccttctcagttcctttggcaataacgattatattatccatctacttttcttttaaaaattcaaagtataaaaataagtgtatttaataatttgttgaacaaatgcatacataaatgaataaagactgtcatgaataagtacttttaaactccaacaagcagcataaatgaatgaaacttctcatttttctctccatgtctccacttctgtaggtttctacaagcagagggtgtaatcaaaattgaccagtacactcattcttcctgggaacagaacatgtaggatgctctaaaaataccttctttgattcattaaactgagtttctcaaggatgtaacgaaaaggaacacaatttgttctagaaagagattttcctatatgtcctaagaaggagaaaacaaccaggagacaaaaaggaactgagatattgaccaaaatagatcattaggaaagagcgggtgattttgagtcaggtttttttaaaaaaagcaacagaaaacagaagttagaaagaaggtaggaagatactcatgtcttgatatgctatcattttaataacttaatattgattttaaagtaaaaaccaaccttatttttccattgtatgggccaaaatcatgtgagtttgtgtcacacattgagggcaatgacagtgctagttaaataaagagctcgttgatgtgcctgagtaacactgtgaactcagcattttgataacgatgtaagggctagaaaattaggcttttagatgtccccaggtcagaggtgagcctgggttgttaaatgaggccgtaagattcctctgccgccacatgtgatttgactaagatgacaatgataagtgtcccttcagaggtatggagccttctgagaccaggtcactcattatttcaaggtgacctcaagtccaagggcacattttaacttcatgtacaacaaacagcatcacgctgctccttgatgtttactggttcattaaagggtaggatgtagggtgtgaggaagtgagggtggtacattttattcacaccagtaaaagaagaaatgctcaagttatattgtataatttctatgaaaaaaagtaacagaaatcagcacaccatttttagaaggctcaccacgtgtgaatatctttccaaaaagtgatttgtcaaaataattgacgtaactatagtgtttctcacattttctcctaagtcacatgcctaaaagctcagcagaaaaattaatggaagaaaatgtaacccatttaagataagctgaaatataagcaaagtcaaaagataacaaattgatccccccaaaattgatatataaaaagtaaaaagtaagttttggctgaacgcggtagctcacgcctgtaatcccagcactttgggaggccgaggcgggcagatcacctgaagtcgagagttcgagaccagcctgaccaatgtgaagaaaccccatctctactaaaaatacaaaattagctgggcgtggtggtgaatgcctgtaatcctagctactcgggaggctgagggaagagaatcccttgaacccaggaggcggaggttgtggtgagtcaagatcacgccattgcactccagcctacgcaacaggagcaaaaactctgtctcaaaaaatagtaattgtgagtttctaaaaatcaataaaatcacacacacacacacacacacacacacaaaggaaaaaagagcaaaagatggaacacaaatctaaacataaagtggtccttaaacatatgaaaggtagtcattgtcatgcataataagagatagaatttaataatacatgaaaatgccactttttaccaatttagattcagaaaatctcaaagtttaaaaatacaccttgtttgcaactctaaaggaaaataagtcttacattgcagatagtaatgtatattggtgcaatccttgtagaagacaattggtaatacctttcaaaattataaatacatatccttttctaatggttctgctcttgggaatttaccttgaagatacacatctgcaaaaggatattaccatagtctcagtcattacaattttgcttgtaatagcaaattagtgaacaacacatatatgtcagttatgattattttgcaaccataaaaaatgaagataaagatggatttgtcaaaatttgatatttattcatgataaaaaaaactctcagaaaattaggaatagaaggatatgtcctcaacctgatgaaggccatccacaaaaaacctacatataaaactatatttaatggtaaaagattaaattattttcctaagatcaggaaaaaagctaagatagttgccttaccagacctattcaatactatactggaggttccattcggtgcaacaagacaagataaaaaaataaaaggcatccatattggaaaggaagaggtataactgtctttgtttccatacatgatcatctatgtaaacaatctgatgaaataaataaaaatgatctacaaagttgcccatgggatgtaatgaacaattgatagccttttcaacaaatggtgctagaataactggatatctctatgtaaaaacaaacaaaaacaacaacaaaacccaaccacctctatttatagcttgcaccatatatacaaaattactagagctgagcctaaatataaaacctaaaactataaaacctctaaaagaaaacagaagaaaatctttgtgacattgggttaatcatagccttcttgagatatcaaaggcacaaaccataaaagaaaatactgataacaaagacttaatcaaaatttaaaacatttgctcttccaaagatagtgttaagaagataaaaggtcaagtcagactgagtaaaatatttgcaaaaaaaaaaaaaaatctgatcaaggtcttatattcaaaactattaaagaacccttaaaactcaatattaaacaacccaatccttaaaagatttcaaaatttaaactaaaattaaaatggacaagtaagcatacaaatagattgcaaataatagaaaaacacatatcatgcaaacaaataccacaagaaagctgatgtattattctaatatcagacaaaatagactttaaagcaaaagaaaatgttactggagacaaagagaaacattttctaataagattgtcaatctgccacgaaaatataataattataaatttatatgcaactaataacaaagcaccaaatacatgaagcaaaaatggacagaaatgaaaacaattcaacaataattgtaagagatctcaatatcgcattttgaacaatgtatggaaaaactagacaagacagcaacaaggtaacagaagccgtgaagaataaaccaagtatatctaacagatatctatagtacacttcacccagtaacaacacaatacacaattttctcgagttcacatggaccattgtccagggtaggtcatatgctagactataaaatgcttcataaatttaaaggatagaaataatataaaatatgttctccaaccacaatggaatacaattaaaaatcaatagcagcaaaaaattagggaaactcataaatatgaagaaattaaacagcatattcctaaataaccaatggatcaaagaagaaatcaaaagggaaatcagaaaataatttgagatgaatgaaaatgaagacacaacatactcaaatttatgagatgcagctaaagcaattcttcaag

SEQ ID NO: 1397 - DNA, 53512 bp, Homo sapiens
caccacagatgacttgtgttatgcccagccataccataagagttcaacagggggccagccatggtggctcacgcctgtaatcccagtattttgggaggccaaggcaggaggatggcttgagcccaggagttggaggccagcccaggcaacacggtgagaccccatctctatacaaataaaaaataattagccaggcgtggtgttgtacaccagtagtctcagctacttgggaggctgaagcaagaggatggcttgagcccaaaaattccaggctgcagtgagctatgagtgcacccctgcactccagcctgggtcacagagtgagacctggtgtcaaaaaaaaaaaaaaaaaagaagtccagtgagggcatccacaagatttttcagaagacagataccatcccacttccctaaggagaacagggaaggagatttgtggaggagacctattgtgccaagaaaaacaatcagcccctgctggaatctgacaactcattaaaacaaatccctgctgcagaagggcctccacatcccatcagccctgaggaaggagaacatcccaaggtgctgcccacagtcctcgccaaactgtccacacctgatgctccatccatcacaccccttggatcagacccaggaatatgaatgggactcgtggtctcatttctcaatgagagtcacccctcaggcctcccaacacagtggctgcaggactgggaggcaggaggacagggctaatgttgtgcttgctaatgagccttctgggagcattgaaatgggctgcacaggagcaaccaatagccagccacacacaatgtcatctgctcagcagtcaacacagccctgctgctgttagcaaagggcctgagacaggcaccgttatgggcccagaaaattcatgcaggcagaagaggggcaggaagagaacccagcaggttcctcaccccacccaccccacccacccccttcataggcctggcccttttgagatcaagtgagagccttctttcctgcttccccttggttcaatggaacaaggcattagacacctattgtgctccaggcagagtgggtaaaggaagtgggtttttagagacttatcctgccaagaaaaaccatcagcccctgctggaatctgacaactcactaaaacaaatccctgctacagaagggcctccacatctcatcagccctgaggaaggcggcatcccttcacaaggtgctgcccgcagccctcgccaaactgtccacgcccagtgctccatccagcacgccccttggataggacccagaagcatgaatgggactcgggtgctggagaatgagaaaggcatcctttctgtcctgcagatgagggtgtggcaggcaaggcctcctcccccagggaacttccatcccgtccgctcctcagcacgctgccttgctctagtttggtccttccatttctgacaccaccatgtgggactcctgactggcagtttgcagattggaaatgcaaaaggaaccagaatgtctcacccttctcactcctcaccctgtacaaagtgccctcgcacattactcaggagacggggctcacccctgattctgccactttctagctgcctggctttgggaaagtccctaaatctggctgtgccttggttaaaacagggacaatgacacctgccctgcctatttcacatgactggtgactcactccaccagccttaaagcacctactatgttccaggcactgacatagacacattgcctctgtcttcttcttcttcctcttcttttgagaaagggtctcattctgttgtccaggctggagtgcagtggctaaatcatgggtcactatagccttgacctcccaggctcaagtgatcctcccacctcagcttcccaagtagctgggactacagatgtgcaccaccatgtccggctaattttttaattttttatagagatgaggtctctctgtgttgcccaggatggtctagaactcctgggctcaagcgatcctcccactttggcttcccaaagtgctgggattacaggtgtgagcccccacgcctggccttctgtcttcaataagacaggatcaaaaagcatacagcctagtagggggaggcagatgtacaaatgaaaaagtgcaataatgtttggaagctatggtggtagaattatggtatagtggggagaaggattgactgaataatgcatatacatagaaatggaggttttagagaaatcatttcataaggaaataacacttgctaagctcttcccaggaggtacttccatatacatagttgttctagatatccaaaaagatgatgggtgtgaacctactctataataggctgtggggatttgtacagtacaaagcattcatgtaaaatatcagacttcggtcaacaaaaataggttgtattagctaagctaggttaagctaagtttattgctgcagcaacaaactactgcaaagtctcagagggttaacaccgcaaaggtttatttattcctcatgcaacatgttcaatgtactttggcaggggcctctgctccacacggtcactcagggatccaggctgactcgtgcattatcatcctgcagctgctacacctagaacacaagtcctcttcagtcattgaggcaagaggagagacaactgaagggcagagagctggccagaatacatgtcactttcacccacatcccattggccagaaccaattacatgctcctgtctagcaacagtgggactagaagatatgaggaaacatggaatgtctggtgagcatcaagagctctgccacagagaacaaagaactgtctgcatttcacagaactggggtgtttggctaatcagagagtcctttagggaactctgagtctggtcccctcagagccaagcaattcctgggctacaggactggaaatgtattcttcctaactacaaagtgactggcaatggcagagaactgaggaacaacaagactcaagttatttctatgactcagatgagcacagagttaacacagtaatgatcatagctaactttttcttttgaagagacaggatctcactctgtcacccaggctggagtgcagtggcacaatcatagctcactgtaatctccaactcctatgtgcaaatgatcctcccacttcagcctcccaagtagctgggactacaggcacaaaccaccacacctgcttaatttattttacttttttagagatagggtcttgccatgttgccctggctagtctgaaactcccagcgacccaaagcactgggattacaggagtgagccactgtgcatggcccatagctaacattaagtgaacacttactgtgtgcaaagtccacatcacctgtattatattatttaagcctcacaataacccaggaagataaataatactaatagccccatttgatatatgaagataataaagaacaagtcaaaggttcttcatattcttcaactcataacatatcagagcaggaaattgaatgcagaagtcagtcccctgtctccaaaaatcattcgctttaccacaaacctatactgctgcctatagtggaatggagtcactaattttacatacatacatgcacacacacacacacacacacacacacacatgcatacacacaatttacagttccaagatctggattctcagcctggttctgacactagttacataaccttaggtaagtcccttcacctctctgaacttcaatttcctcatcggcaaaacgggaataatagaaatatctattatctatttaattatcttatagaaaagagttttgtcaactataaacttctctgctaaaaaaaaaaacaaaaaaaaaacaaactggtgcattagatatgccctagggatgatgcaaagttctgaagggaggtcacaactcctgggtggggaacaaaataggacagatgccttactctgaggagtcttcctcacacccctgaagcagcccctaacaacaaccagaggtgggcccaccctgcctcttcttctgtccccacgctctgtttggcagcttgagcacagcctcagatttgtctgcttttcctgcagaggtttttgcaggatttctgctaagtggggcagcgacatcaataagttccattgtgtcatgagtgttattgaagagcagagtgtctggcctgctggctggggcttctgggctcataagctctcccgaccctctttcaccccggcctcattggtgaatggcccctactgccctttctcccctgctccagcctccaattccattctgcaacaggaccactatttcagcatgcctggtccacacatccatccccaacagtgtccaccgaacattctccccaaacccagagccttcactcaaggcatgcctcccatctagaatatcctcccaccacctcgcctgtcaaagtcctccttagacacacaatgcaatgtcaacagcagttgtctccgggtgatgaaattacagattagctttatctttttctttccaatttcctctatttggagatctgggggaatgagcacataatatttttctcataaaaagaaatcacaatgaagtcatgttttaagttcctaccttcctgtgagcccctcccctccatcctagtctacaattctgtttcttctgtgaaattctacagctcttggccctatcataaattgctttatactctagttggtttgctgggcatgaacatctggtagccccaaccaaatggaaagctccatgagagcaggggacatattacacatattttccctatgctacacagccctctgcacagttcaggaagagctgaagcagcgactgagtacttaccaattacaggggttatgggatggccccagtatatgttacagtggcttggggaggtagagtcatgcagaataagaactaaggggccttggagtttatacaatctgatgctctgcattcacacagtttctgacatttcatttaccctcattaatagggtctggttacccccactacatgagcagtcaaactagggctgggagtcgtaaagcaatttggcccaagcttccagagcccacatctcctgtggtcctgtccagtgccttaaccactaaactgcagctgccactccaagaccttattaatagccatttctctccccagtcagtggctggacatgacttgccaggttaataatttgttcattaggcgcctaatgaattacttgttaattgctaacttgatgaacagccagcagttcccatctgcctggagaaacaacagcaaataaccacagaagggccggccaagccccagtggctgcagggcagaaggtttgagccccagagggtggcagttccctcagggagaagcctgtcttggccagtcacctgaagctgagtcccaagggatgggcgcctctggtaaacgacctcttgctggtcctataactgccctgcaaagggtcgaggcagcccagctcttcatctaccctaattattcaagcctcctctccacaaaacttcccctttttgctttcttttcttttcattttctctgaatttccaccacttgaagtcagaactacggagggtctcaaacttctgatggttcaactttcgatttttcaactttacaatggtgcaaaagagatacattttcagtagaaactacttccaatatgcatgcaaccattctgttgttcacttccagaagagtactcaataaattacattaaatattcaacactttgttataaaataggctttatgttagataactttgcccaattgtaggctaatataagtgttctcggcacatttaaggtaggctagactaagctatgatttttggtaggttaggtatattaagtgcatttttttgagatagtgtcttgctcttgtcacccagactggagtgcagaggcacgatcatagctcaccgcagcccaggaccccggactcaagcgatcctcctacctcagcctcctgagtagctgggactacaggcctaagccaacatacctagctaaatttcctttaacttttgtagagatggggtcttgccgtgttgcctagactgctcttgaactcctccgttcaagtgatgctcccacctctgcctcccaaagcactgggattacaggtacaagccaccattcctggcctaaatgtatttttgatttattatattttcaatttacaacagatttattgggaaataactccactgtaaatagaggggcacctgttctcaaagtaaactttttgtatccacacataatgatatgtcatcatattttctcagggtgttggttctatcttcctatctcaaaggcagctacaatgtcgctattggtcacttcaagcttcctaaaaacagaaaccatatctttctcattcatccttgtatctcttgtacctaacgtaatgccatagtaccttataagtatttattaaaggagcaaattactcatacttttctgtacaaatctgtattggtttgctcaggctgctgctatggtttgaatgtcctctccaaaactcatattgaaatgtaattgtcattatagtagtattcagcactgagatcattgacagcccacatgaatggattaatgtcattattgagacagtgggctcattactgcaacagtgggtttgttacataagtaagttcggccacctcttgctgtcttgctcactctcaccctctcttgccttccactttcctccatgggatgacacagcatgaaagccctcaccagacgccagcaccatgctcttgtattgcagcctccagaaccataagacaaataaacttctattctttgtaaattacccggtctgcggtattctgttatagcagcagaaaacaaaccaagacagcttccatgacaaagtactgtaaactgggtagcttaaatgcagaaatttacatatattctcacagttctggaggctggaattctgagatcaaggcttctctgaggcctctctccttggcttgcagatggccaccttcttgctgtgtcctcacatcgcctttcctctgtgcatgcacaccccttgtgtctcctcatgtgtccaaattcctcttcttataagaactccagagaaaacatagaagaagatgaccaagtcccatcctacaggggcttacaagaaaggatactgggagtgaaagccacataccgactagggaaagttgactaattcctttctatttcaattccgtctgtaacatggacatcataacgcctctttctccatcatgccaatgctagaagcataaaatgagactgtgctctgataagaaaaattactatgcagatgcagattggattagggcccaccctaatgacctcattttaatgtaatcatctctttaaatacccttcctacaaatacactcatatgaggtagtgtgtgtcagggcttccacatatgaattttgaagggaactagttcagctcataacaccttctcactccacaatgccaacttcagggctgggcacatattaaatatttaacacatcctccgaaattggtagacattccattttctctgggggaagggctcatctttgtggcctgagttcctagtcctgcacagacccctgaaaaactccatggtggaatatttaaggcaaaccctcttgtcatgtcggctcccaaatcctaatggctctgttatttttgaaatcactttagagcagcactgaatagagatggtgatttcttgcatttgcatagcaatttttcttatcagagcacagtctcattttatccttccagcattgctatgatggaggagggttgttatgatgtccatcttatggacagggaattgaaataaaaaggaattagtcaactttccaaagtcagagtaagcctagtatgtgcctttcacttccgttaaccctccttatgaacccctgtaggacgggacttggtcattttcttctccgcagctgagcctccagcgcaggtccaggcacaaaggggatgctcagggaggtttggcattaataataacagagctgctggaagagcctctatccagaggagctgaagtctcaggactgaccaccacccagccacccaaatcccctccagcaaaacaagcccttgggccctagggccacgtggatggcccgcttcagggtctgagcttcccacacccgagctgcgtttcagtgaaggccctgaagccaaggttgaattgaaaatgagtctggaaatatatctattatcacttccacactgctacgagtgacaataaggaaaatgagtttacagtacaattgcaaagtgatttcacatattatttatttctacctctttttatcacgggtatttttagaagctgcctcaaatgcattgtggaatgaagcagggtatgaattttaaaaatacactatctcatttcctccttggggccatgtttcagagtggataaggagggtagtgtgcccatttagcagatgggtaaagcaaggcagagagaggccaagtgtcagcccaacatcacgcaaggagtaagtgaataagctaggcctagacccgcactccatgctttttcctgtttgtcgctggctgctgtgggaggaacactgaggaactggaccaggagagagcccttctaagggcaggagagaaacaaatgcatgtccgctgcagatgtatctcctttggcagagtttttgaacaatttgtatctctgtttgtttttgttttgggaaacggagtctcgctcagtcgcccaggctggagtgcagtggcgcgatctcagctcacggcaagctccgcctcccaggttcacgccattctcctgcctcagcctcccgagtagctgggactacaggcgcccgccaccatgcccagctattttttttttgtatttttagtagaaaaggggtttcaccgtgttagccaggatggtcttgatctcctgacctcgtgatccgcccgcctcggcctcccaaagtgctaggattacaggcgtgagccaccgcgcccggccaacaatttgtatctgaatgattttagttgaggcctgtaccccccagttccctacctggcccctgcatcatcgcactgtgttgcccacacttttgtgttgctgtctggctgccaatggctcttgagtttgcagcctctgtttggtctttgaaaaacagccttgcagtaacttccttgggaagcccaatggcaccagggatgggagagttctttagctatagaacacggcccaggaagggaaataggggaacagcaaatgcaacatcacccacaccctcacccaacaacacaaatttgcagcagctgatgggatccagtaccttaagccaccagatgttgcttctcctacagtcctgggcagaactggaacacatattttaccctcctagatcatctcccaacgcatgatctgaaataggctacagaataaacaagccttggtctctcaccagctcagctcaagtagaacttgtgagcctcacaggctccataaaaagccaaatgcaaaagcacatggcagatgatccagcccctcccacacctgagccaccaccacatcacttccagctttcttctctgatgaacacaggagccccaaatccaaacctgcccccagataccatccacaacagtggactgtgggagtggaagtgacccacaacatgcaatccttccccactccctccttagcaaaccctccagcttgggggaggtcagcctcctccctctgcccacccccctcactgacctggagccatagccccacagtcccgtcaagtcctcccctcctggacagagtccttcctgggcttttgctgccaatagagatcaaaatctatgaccacttggtgccagctccttggcatgctcagaatacaaaagaactgggccacagggaagcagagaaatgacaggtcctggctggcactgagggtaatggaggcatcaaaggagctgtcactcagagaccccatctcagtggctgtgatggcagcaagggcctaggatatgccatcatgggaaggggctgcaggcactcagtggagccagtggtaacagtagagatgtcaggtacagagcctgaattctcagggactctatggaaaaaaaaggagttggtgcaggcttctgggaatggggcccctggaatgaagtgaggtgggcactgaggtgtaagtgaggctcctctcctgggaaccagacttggtgggctgcagaggagcccccagcaaccaagcaacccccacaaccaggccaccagcctatgggtataaaggaagtcacatttcccagcaactctagaagaagcacctggggagccacctgacctcccatcagggaaaggggctgcctcttgacagcctcgcagaagtgcttgacactcttgtcctctccagaaaaccgatttttaaatcacactgatctcaaaagcaggcctgtggctggcccctcctgggccccaggagagaaggggagcagcctgcagagaacaagggccaggacacagccggcatgggcagccacctcctcagaggcctttagggcccctgtggaggcccagccagcagcatccctctgtactttctgcctcgggcctcccctggaacagaagcaggaatcggcctcccggtgaggcatcctcacagcgggtctttgcatcggccagagctggactgagattgagaggcagtgtctcccctgggactctaacccctgctaagttcccaagcaggagatcctaacatgtgactttaccagctcttagggaactcgggatgggttttcccaggctggatcagaggccttttaaatgtccttcctagaattaaatccccaagcatttctccctggcaacaagaaatcaaactcataggcaggaacccaagggtctggtgcctcccgggtcctccatccacctagggcactcgggtcagaggaacagtctcggcttgagctttacattccccatgtcctgggccctttgttacaggctcttcaaagtccagggaccctggccttctcctgcatacaagtcctccccccgccttccccacaggctgtcctaacagatagcttcccctgcaagtgaatggagatctgccccggtgccccccaacccccaacctccagccccctcattgcagagaaaggcttggctcttgttttcttttaacttaaaacaacacttctggactcacaggaagttgtaaaaatagtacagagcaatctcacagacccttgcccattttccctgagttacaatttacataactatgctacatcaggaaactgacttggttacaatgtgtgtctatagttctgtgccctttgattacttcaccaacactgaaaatcaagattggcaactcttccctctccatatagatcccgccatcccgcactccccccagcccctggctatcacccatctgtgttctctgtcattttgtcatttccagtctctgcccctactgaagcgtgtggccatccgaaaccaccttggagaccgggtagatcccagctgaacaaagcaggcagtcctgggacagaaatggcccaggacaaagggaacccagtctcacttggatgcagacaactcacatacctggcacctgtgtgccgcaactcggccctcatctgccagcttctgccggcctgatggcgcattgtcccgttccaactccagatccatggttgcccttgccggggtctcagctgctggctccactcccctcctgcgggcccctcccgcaccctgctctctgctgcccccatcaggcagcctgctctcagagcatcccggccgcaggattttaattcaaaattctcccaagtcatgcttctcccatactgtacctacataattcacttttattacctaaatatagggcttaatatttggtcctgttaaatttcatcttgtttgtttcaggcatcctttcagcttctcaggatgctttcaaatcctcagctatctctctgaacttcaattatctcttctgtcatctagaaatttaatcatcctgctgtctgtatcttcgtccacgtcacagataaaatcgtcgaattgagcagggcttagaacagagtgttctggtacaatactaggtgccccttctagaggggaaagagtgagatttgggatcccagcaacccctttacaagccattattcagcagctctaaatgcacccaagtgagctgccaaccagactttatttttttcatttattcatgaggctgccaggaaagattttgcactgcttgctcacagacggaccagcccacttgagtccccacccacttagccaagggtctaattcccagaagttcccaagaacacctaggcttgtatacacttgtctaaaactcaggccttttgaggctatatggctgctacctgcaaagaaagcagaaactcagaaagactcactctgctgactggtctagccatggatgtctgcttgatttgggggtggccacgatgactctgtgaggtgagaagaaggacatttcatctgtctgggacctaagtattacatatttaatcagaagtatgcagctttaggttgtgtgtggtggctgacgctggtaatcccagcattttgggaggccaaggcagaaagattgcttgagaccaagagttcaagaccagcctgggcaaagagcaagaccccatatctacaaaaaaaaaattttttttaattagccaggcatggtggcctgcacctgtagtcctagctcctcaggaggttcaggtaagagggtggcttgagagcccaggaagtagaggctgcagtgagccaagattgtgtcactgcactctagcctgggcgacagagtgagaccctttctaaatatagatagatgatagatgacagacagatggataatatatagatatagataatggatagatagatagtagacagacagataatagagatagatcataagatagagagagagagagagagagagagagagatagatagatagatagatagatagatagatagatagatagatggatgcagctttttcccaaggcccacccagagttctacactggccctgggttctggcagcagccagctatccatgccagctgcccctgctgatggtcctggaggcctggccccggtcctgcttccctttctcttgtggtgagcgtgctcttggggaacatgctgttctttactgcctgctcacctcattgcagccgttctctccagccatgtgaggataggggtctcattgcctagtctctgtggggacccctctgttcctgtataggttcagaataaaaatagggacataagagaggcacagcccacaaggccactctgtgacacttaagtcccatgtgcacatggataatatgaggagaggagccacctctgacccaccaccccctgccgcccctgccgagcagaagtgccctgttacactgactttctaatcaaacagcgatcacaaggaggaaaaagttggagtgatcctctttgtcctaagtgaactcacactggcttccagcgatcacctttcttttccaagaactcacaaatcatcagtttcagtcatcagttttggaattttgccaagggtcaacattgaaattactgtataatcatttccaaaatcagggaaggtccgggctttctgggcctaatgcactttcttaagtgtggaagccaactgttccttccccctcactcaccatgagaatcacacacacacacacacacacgcaagaaggcacccaccagagactacactccactgacacggaagtgccgccaaacataaagacttccaaagccaacgtccctgattcttcccatcctgtcttcttttcacctctctcagaattgctccctcctctctctccaccacctcatccctccacccagaggtaagagacatcttcatagctctgtaattgtgactgtggctaagcagccgtgtgatcgcagggaaaggggagccaggcacgcgggaggggctcggacaggctctgacccatgctgccaacacacctccatctgtcagcgacagccctccctgcgtggggagttgatggagcggtgactgccagtttgctaacgtccttgtctgcggatgctgcaaagacatggttttccatggaggaattctgaggcttacacgcaagtcttctctgaattacagtaattaaagttgagaagagcaacacgccagaactcctcctttacctgtcatttctgggctgatgacggggctccaacttcaaggtcactctgtcctcctccctctttccttcctgcccctggctcctctccacaccaggcctgaaacagccaaggacccaaccttcccccatcacaaaaggcagccaaccagatccgggggaaaagcaggcaccttcgaactccagtgcttgggatttcaagttgagtcttactggcttggttcccagcaggaaaacatttcatccaggccctgctggggctggggatagggtcagagacaataatgagaactggaagagactcaactaccatccagacctgtctgctaattccacaaacgaagaaacagaggctccaaagagagaagtatcgtgctaaagttcagccagatagtctcagagtcagaacgagaactcgattctcctgacaccgggtttattccactaccccagggccatttgttgaagccagccgttgtgttaagcgctttacataaattatttctaatttttacagcaacttttcagggtatcattatccccatttcaggattgaggtaatggagtgatttgcccaaggtcgcatagatagaaagtggcaggcgaggaattcaagtctgttatcccattctttctcataaatatccatcaggggcagagagaggcgagtctgagtgggtttggggatgtgtgagggtgtcccaaaggaagaagtcctgaaaggtacctgctggaacatcccagctacaggcttccacggattacattcacctcaccaacggtaaggcccacatatggccagttgttaacaaacatcgtaccaagaaggaaaaaagccctgagtacaagtgcctggaggttgatcttcaacagggaagatgtagaaaggcagatgaaagctaaggaccctgaaactgacagaaggtcagggagaacctactaaaacccacaggtctcccttgggtttttgtggctaagctggtgggagtgagaagaaacccaaactcccaatttagtttccagatgtctgtctatctcattcgccaccacccacatactccaaccccactcctgaattaacaggaggactgatcagacctcacagaaaatgatgggattcttgtgctcccagagcccaaattctatactcctcactcctacccaaggcctggaaaggtaagaggctttagcagagacaaatcagagaaggagtggggtcgggggggcaaggagtaagaaagtggctttgtggggaagacccagtcctacacagctcaggaatgcgctagagggctgaccagtcctataatgccttgcctttgtggacacaggactcaaacatttgcaagaagatgttagacaccataacgttagctctcgccacaacacgaaataactagtatgtcattgtcagttgagttataccaactttctcatcatttttctttgcaaaatgaggacaataatagtatgcaccgcacaggatgtttgtgagaattaaatgagatgcaaagtacctagtatagttcctggcatataatcagcacacaataaatgttagatttttattgttgtttttacttctatcttgatgaaaaatgtattatttttacactgttataaacctaagagaaccatgagttaggttccacaaatttcattgctgaaatcatgtaccttggacagttctattattacatttgtgttatttaaacaaaatttcccttctcaggaaagttgcgaggaaagtactccctataccaccccgaggcaatgcttctgcttgtaaaacacttttccctttcaaggcaatttctcactgctcctcatcataagctcaccgtgtaattctgaggtcgacggagtagaagttgctgtacttcctttatcagatactgaaactcaaggtaaaggacgtttgtggggctggacctacagccaggtcctgatgcctctctcagcatccagtccagcaacatggagcacaggcaacttggcaggcgatctgcatgtctgtcctccggcgctcacagtgggtcccacgtgtgacccgcccctgccattggtggagtcctgcgtctctgccaggcttcagcccgacaggaccctcacccaagcatgagaggttcacaaccttgaggagtttggaagggcacgcaaaggggatcgactgctcttttttaaaaagcatactgcagagctgtttggccattttacaagacttctgatacccagccctcctccactgctgttcaggttctaacccctctccttgcctagcccctttccagcatgagggtcagccttacactagcaccattgcccgagtggggcggggtggagggagttcaccacgggtgcatgttctgattgatcagagcccacgctgttcaaggtgctacctacttcgaacatcatctctgcctgcatccctgtttcccattactccccagatatctattcccctacagagagtttgaccaccattcctcctagaatcttctgtcccagaatgacttacttttaccgatccagcccctacccatcctccacaaggctggtcaagcgtcttttcctcctggaagccctcctagatcagccccaggccagcgtttacctccattttctagctcccagaggctttttcgaactgcaggtggtgtatcattagcaggtcatggacatcaattcagggcattgcaatgagcattctttaaccaaatagaatacaaaatatcagaagataccgtctgtgataaagatcacagcatgtatatgaacatacgtatgtgtcgcatactgatgtgatataaaaaacgttccttactgcttcttgcagtcaaaacctttgaaaaacattggatattaatgccttccatcctaaatagtaccaagcatctaaaatctgcctaacttctccaaagacaccaggagtgaagtcagggagaagagaggagagtgagggggtcagccaggctggagccactctgacatgggagaggaaagtatatgaggacagggactaggtttctctacttacctctcccctggcacctggcataagtgtcaatgaatgggtagcacaccagttaggctagattactctgtgataacaaaagaaatcaaggccaggcgcggtggctcacacctgtaatcccagcactttgggaggccaaggtgggcggatcacgaggtcaggggatcgagaccatcctggccaacatggtgaaaccccgtctttactaaaaatacaaaaaatttggggtggggggaggggggagggatagcattaggagatatacctaatgtaaatgacgagttagtgggtgcagcacaccaacatggcacatgtatacatatgtaacaaacccgcacgttgtgcacatgtaccctagaacttaaagtataataaaaaatatatattaaaaaaaaattagccaggcatggtggcgggcgcctatagtcccagccacttgggaggctgaggcaggagaatggcatgaacccgggaggcggagtttgtggtgagccaagattgcaccactgcactccagcctgggcaaaagagcaagactccatctcaaaaaaaaagaaaaagaaaagaaaaagaaatcaaaaacagccgtgcatggaggcacactcctgtagtgcccccaactcagaaggctgaggtgggaggatctcgagttcaagcccagcctgggcaacatagggagacccccatctcaaaaaaaaaaaaaagtttccacagcttaacatggttgatttctcacttatgcaagtccactctaggtctggtaactccagtgtggctgtcccctaggtagtagctcagaaatctaggctgcttgcaccatgtcaccctacctgctggatcaatgcatggataactgtagcagggaaagagagagccaggggctgtccatggtgacctgtgtcccttttacgcccagctactggccagacctggcctcatagcccccacctaactgcaaagaggaagggaaatatagagaagcagtaagcgtctccctttctttctcttccttccttcctccctcccttacttcgtgtcttccctccccaccctcctcctcctcatctttctctctttctttctctctctctctttctctctccctctctctcttttctttcgagacagggtgttgctctgtctcaaacaaacaaacaaacaaacaaacaaagggctgggcgaggtggctcacacctgtaatcccagcactttgggaggccaaggtgggtggatcacctgaggtcaggagtttgtgacaagtctggccaacttggtgaaacccgtctctactaaaaatacaaacttagacaagcgtagtggcgggcacctatagtcccagctactcgggaagctgaggcaagagaattgcttgaagccaggaggcagaggttgcagtgagccaagattgcactactgcactacagcctgggcaacagagcaagactctgtctcaaaaaaaaaaaaggctggagtgcagtggcatgatcacagctcacttcagcctcaacctcctggactcaagtgatcctcacatctcagcttcccaagtggctgagaccacagatatgcaccaccacacctggctaattttttgatctttttgtagagatggggtttcactttgttgcccaggctggtcttaaactcctaggcttaagtgatcttcctgcctccctggcctcccaaagtgctgggataacaggtatgagcctctggtcccagccaaatgtctctacagtaacactgcccgaggtgttttgcctcaaaactctatgtatgtaacttgcctccccagctcctcaggtagtcattccacagaacttctggtggtcttctgtaaagcaagccctatgctaatatctgggaatagagaagtaactgagacactgtcccagtttggatggcaccagaagcaatcctgagctgaggatcacagtgtccctggttaacctgggaagtgcagagaacaccagcagggcaaagggaagtgatccaggagatgcattttattaagcctgttacctcagtggatgtctgaagcccaatcccatggagaaggtctggaaaatagtgtaaagcgcacctcaaaattatccccactttagggttgaggaagctgaagtctccctcaacccgctccccatcagcgctgattcaagctgctcctgagggatgttagtgccccagcccttccagcctgctccactcactcaggggagtggagtaaccttccagaaaaatccctcgttcaaaggcaggtgaagttcccagagcaaacttctcagtaagggtaaggtctgagggaaatgagcaggaaactgacagccccagcttccacacaggtgaacttaccaggcaggagaagaaagaggcagatatgcaaataaacattagcaaaggagaaaatgctacaattgaggaagcaacaaagcgtccaggcacagaggaggtagcagctgatcctcccaaggatggaaaaagacttcctagaagtgatcaaatctgggctgaatcctgaaggccaagtaggagttacctctgagaagaggaagaagagatgcaatggggactgcttgcctgcccatcacctccattgtccctttcttcccagctgacccagttctgcttagggtgcactgtgctcagccccaggtacctctctaggactggtctgcacctgttgcaaaatccttatgcccatttgccagagtcttggttttccagcctctcttgcacctggcagtgggcgtgtcaactggccctggccaataaaggtagtaagagggggttgggtgcaatggctcacacctgtgatctcatctcagcacttggggaggccaaggcaggaagattacgtgaggccaggaatttgagaccatcctagccaacacagcaagaccccagatttcttttttttaaggtaataagagggggtctgccagggaggattctgtggcagcatttgctttcctgagctaaagagcagatggatttgctgctgtcctttcctttcctcctgtcttgaatgcaaacgtgatgcctaaagtctctatagccatcttgtgaccatcaggtactgagcacgaggacaaaaagtcaacaagctaaagacagtagagtggaaagggacatggaatttggaattatggcagcattcctgaacagccaatgtttggccactgcctgctttcttatcatatgagacatataaaatcctatatgtttaagcccacttactccagtatcctctactcgcaacccaaggtaatgccaaccaacccaagtgggagaagtcaggtgcaataagccatgtgcaatcagccatgcctgggatctgggagaggtttggtttggctggaggatggactgtgcattacacagtggagggaaagaggccacccaggagcattaggaggagaatagaaaagacccactttgtcatgcaaagttcaaaggagaggttcacaaagcttcaaacaacgacgtcagatgatcatcatatgtgggtttcaggaaataattgtatccatcacataaaggaaggaccctgacccccttacagacatagatgatgtcggtacaattttgtagtgtctacagcctctaatacagtcaccatttaatatttattgaattgaattgaaatgatgttaccctaattatttccatgagacccacagtgcttcaatcaatcactatttagaaaggttgcagccatgttcccagctaagacatcagctgggtcccttccctcccctccccgggaatcagagtcctcactgcacaatgagagaacttagcctgtggctgactccctccaacaacaaggaggcctgtcctggcttccgtccacttcacactttcacaaaattggcaggggaaagctggtgggacgcttgatcgaggcccaagcactgagcagagggacgcttgatcagaccccaagcactgagcagagaaaatggatcaatagctacgccacccccagcctgatttaggaagaaaaattgcagatcaaatgtaatatttctgtaggtcccaaatgacccaggtcccaatctggctctttctctatatgtaacacatatgcaagtaagggtttttttgttttgttttgtattgagatggagtttcgctcttgtcgcccaggctggagtgcaatgggacgatctaggctcagtgcaacctctgcctcccaagttcaagcgactctcctgcctcagcctctcgagtagctggaattacaggcacccacaaccacacccagccaattttttgtttgtttgtttgtttgtttgttttttaaacagagccttgctctgttgcccaggctggagtgcagtggcacgatctcggctcactgcaagctctgcctcccaagttcatgtcattctcctgcctcagcctcccaagtagctgggactacaggcgcctgccaccaggcccggctaatttttttgtattttttagtagagacagggtttcaccgtgttagccaggatggtcttgatctcctaacctcgtgatccgccccaccctcagcctcccaaagtgctggcattacaggcgtgagccaccgtgcccagcctaatttttgtatttttagtagagacggggattcaccatgttggtcaggctggtctcaaagccctgacctcaggtgatccacccgcctcagcctcccaaagtgctgggattacaggcgtgagccacctttttttcatttttttctctcacccaactattatttcaaaaccaaagatgacgggagaggggaaatcaagtgttttctcattgggcattcaaagagtgaccaattaaccccccaaattaggcaagtaccagggagacccataaagatgagacattggacttcatgttcacacacccatcaacactccagccctaaattatatttgacatttaattaaaaccccaaggcagcgaagtcaagagttgaactgctacagtactggaaaaggagccgctctttaggatggattcatttacctcctgttaccaaagccatcaacactgacctcccccagcccagctttactcactggtagaaatacaacagaggcatgactggggaagtgtgttccccgtctcctgcactcccctcatcgcctccacagacatactcagacgccatcactgccagagtggaactggtccttctcaggttccatgccacccagcactaacttccctcctggccacccatacaggaagtcacccaaccccaattccccactcacttcccttcctagagactgcacttttctctgttccaagagcatgaagggtttcagcattgagccgcctttcttctctccttccttcctgccttctgttcttcctcccctttttcttccttccctccttccttctctcttctttcttccttccctccttccctccttcccttctctccttccctcctcctctccttccctccttcccttctcctctccttcacttcctttcttctctccttcctttccctccttccctccttccctccttctctccttctgtccttccctccttctttcttctctcctttcctccttcccactttctttcccttctctccttccctccttctctccttcccttcttccttcctgactgcccacatgatgcactgagcagcctccacattctagtgccatgctaaatgttacaggcacacaaagatccataaaacaactcttgcccttgtgatcttctggtggagacaaagcaatttatgaaatgcctaatatctatattagatataataagacaatgtgtgccaacgaagagtccaggcaacaggagcttccaggtcagaggaaggagagacctgagtagttagaaaggaccttgctgaggatcaggactcctgctggacctccaagaccgccatgacttagaaagatgagaggaagaggaaaggtgcagggacagagaacagtacatgtgaaggtctagaaacaggaggtgaacaggaaagagtaagaacccctttctgcctagaatggaggatcaggaaatggggtacagatgcctgttgatgagctagcaggagctggaggtggagtctggacttcctcctgcaagcaggaatcatctaggccccacaggaactctaggggtgttggtgactgtggagcatcacagcagatgagactgtgttgcttctctgacttgctgggtactggctgcctctctctctgagctggattttcatcccctatgaatcggtaggactaccctcattcttgcttctctgccacttgcctttcaggactagagcggtgctaaatggttccatgtaccaggtttcggattacagaaagtgtccttggaccccagacgccactctcttcctccgattttgaggcatcaaaacaaaatgatgctttcctgatacagatcacaaacccagcagagaatcaagacacattagcactgattcaaacacacatgaacctcactgtcttagaaacagagcatttcaaagcctctcaactcaccttgatcacaatttcatccccagaagatttaggaagtaacaaaggcaacagccttttcaggattaattctgatccaccaggaagaaattactgggaatctgaaatgacagaaaccacagacagaagagacaggatattagaagaaagtgaacatgtcatcttagacttcagagcagcccagaaagagaatagtagagagacatgtgtcaaagactttagaaagtctaatttccagacatttggagaaaaggtagctacaatccagtaaccagagtctctacaggggaagatatttcaagaacgaagcgtagcagtttctggagacaaggttctgtctacacaattgcaaaatatttcactgggggagaaaggagaaagaaatcttaaaaagataataacaatttcagctgcactagcacctctctggctccagcaagaaagcagacatcctagctcttaccatctcctacatcaacgaaaattagctttgccttgaaatcctgttttagtcacagcacttcccagctctaaaatgttcagtgactctcattcaccatgaaatttaaagctcaagaaaccctcaaggctctgcccatgtggacctggtctaccctccgagcctcagctcaccctgacctccacatctcacagctccaggccaggggatggcaggctgcagcctgcaggccggatgcagctcaccctacctgtttctgcacagtccacaagctaagaatgtttttttgaattttttttttttttgagacagagtcccgctgtgtcgcccaggctggagtgcagtggcgcaatctcggctcactgcaagctctgcttcccgggttcacaccattctcctgcctcagcctcctgagtagctgggactacaggtgcccgccaccatgcctggctaattttttgtatttttagtagagacgaggtttcaccatgttagccaggatggtcttgatctcctgacctcatgatcctcccgcctcggcctcccaaattgctgggattacaggcatgagccaccatgcctggcgtttttttgaatttttaagtggtggggtgggagagaaatcaaaaaaataatatgttatggcacgtgaaaataatatgaaatttgaatttcaatgttcataagtcatttttgttttgtttcgattttgagacagcatctcactctgtcatccaggctggagtgcagtggcattatcatggctcactgcagccacgacctcctgggctcaagcaatcctcttgcctcagcctcccaagtagctgggattaaaggcatgcggactgaggagccaagatggccgaataggaacagctccggtctacagctcccagtgtgagcaacgcagaagacgggtgatttctgcatttccatttgaggtaccgggttcatctcactagggagtgccagacagtgggcgcaggtcagtgggtgctcgcaccgtgcacgagccgaagcagggcgaggcattgcctcattggggaagcgcaaggggtcagggagttccctctcctagtcaaagaaaggggtgacagacggcacctggaaaatcgggtcactcccacccgaatactgcgcttttccgacaggctaaaaaaacggtgcaccaggagattatatcccacacctggctcagagggtcctacggccacggagtctcactgattgctagcacagcagtctgagatcaaactgcaaggcggcagcgaggctgggggaggggcgcccgccattgcccaggcttgcttaggtaaacaaagcagctgggaagctcgaactgggtggagcccatcacagctcaaggaggcctgcctgcccctgtaggctccacctctgggggcagggcacagacaaacaaaaagatagcagtaacctctgcagacttaaatgtccctgtctgacagctttgaagagagcagtggttctcccagcacgcagctggagatctgagaacgggtagattgcctcctcaagtgggtccctgacccctgacccctgagcagcctaactgggaggcaccccccagcaggggcagactgacacctcacactgccgagtactccaacagacctgcagctgagggtcctgtctgttagaaggaaaactaacaaacagaaaggacatccacaccaaaaacccatctgtacatcaccatcatcaaagaccaaaagtagataaaaccacaaagatgggaaaaaaacagagcagaaaaactggaaactcgaaaaagcagagcacctgtcctcctccaaaggaacgcagttcctcaccagcaacggaacaaagctggacggaaaatgactttgacgagctgcgagaaggcttcagacgatcaaattactccgagctacgggaggacattcaaaccaaaggcaaagaagttgaaaactttgaaaaacatttagaagaatgtataactagaataaccaatacagagaagtgcttaaaggagctgatggagctgaaaaccaaggctcgagaactacgtgaagaatgcagaagcctcaggagctgatgcaatcaactggaagaaagggtatcagtgatggaagatgaaatgaatgaaatgaagcgagaagggaagtttagagaaaaaagaataaaaagaaacgagcaaagcctccaagaaatatgggactatgtgaaaagaccaaatctacgtctgattggtgtacctgaaagtgatgaggagaatggaaccaagttggaaaacactctgcaggatattatccaggagaacttccccaatctagcgaggcaggccaacattcagattcacgaaatacagagaacgccacaaagatactcctcgagaagagcaactccaagacacataattgtcagattcaccaaagtggaaatgaaggaaaaaatgttaagggcagccagagagaaaggtcgggttacccacaaagggaagcccatcagactaacagcggatctctcggcagaaactctacaagccagaagagagtgagggccaatattcaacattcttaaagaaaagaattttcaacccagaatttcatatccagccaaactaagcttcataagtgaaggagaaataaaatcctttacagacaagcaaatgctgagagattttgtcaccaccaggcctgccctaaaagagctcctgaaggaagcgctaaatatggaaaggaacaaccagtaccagccactgcaaaatcatgccaaaatgtaaagaccatcgagactaggaagaaactgtatcaactaacgagcaaaataaccagctaacaccataatgacaggatcaaattcacacataacaatattaactttaaatgtaaatggactaaatgctccaattaaaagacagagactggcaattggataaagagtcaagacccatcagtgtgctgtattcaggaaacccatctcacgtgcagagatacatataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatatgcacacaatacaggagcacccagattcataaagcaagtcctgagtgacctacaaagagacttagactcccacacaataataatgggagactttaacaccccactgtcaacattagacagatcaacgagacagaaagtcaacaaggatacccaggaattgaactcagctctgcaccaagtggacctaatagacatctacagaactctccaccccaaatcaacagaatatacatttctttcagcaccacaccacacctattccaaaattgaccacatacttggaagtaaagctctcctcagcaaatgtaaaggaacagaaattataacaaactatctctcagaccacagtgcaatcaaactagaactcaggattaagaaactcactcaaaaccactcaactacatggaaactgaacaacctgctcctgaatgactactgggtacataacaaaatgaaggcagaaataaagatgttctttgaaaccaacaagaacaaagacacaacataccagaatctctgggacgcattcaaagcagtgtgtagagggaaatttatagcactaaatgcccacaagagaaagcaggaaagatccaaaattgacaccctaacatcacaattaaaagaacaagaaaagcaagagcaaacacattcaaaagctagcagaaggcaagaaataactaaagtcagagcagaactgaaggaaatagagacacaaaaaacccttcaaaaaattaatgaatccaggagctggttttttgaaaggatcaacaaaattgatagaccactagcaagactaataaagaaaaaaagagagaagaatcaaatagacgcaataaaaaatgataaaggggatatcaccaccgatcccacagaaatacaaactaccatcagagaatactacaaacacctctacgcaaataaactagaaaatctagaagaaatggataaattcctcgacacatacaccctcccaagactaaaccaggaagaagttgaatctctgaatagaccaataacaagatctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcatcctgataccaaagtcgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacacaaatcaataaatgtaatccagcatataaacagaaccaaagacaaaaacgacatgattatctcaatagatgcagaaaaggcctttgacaaaattcaacaaccttcatgctaaaaactctcaataaattaggtattgatgggacgtatttcaaaataataagagctacctatgacaaacccacagccaatatcatactgaatggacaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggatacaatatcaatgtaaaaaatcacaagcattcttatacaccaacaaaagacaaacagagagccaaatcatgagtgaactcccattcacagttgcttcaaagagtataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcatgaaaatggccatactgcccaaggtactttacagattcaatgccatccccatcaagctaccaatgactttcttcacagaattggaaaaaactactttaaagttcatatggaagcaaaaagagcccgcatcgccaagtcaatcctaagccaaaagaacaaagctggaggcatcatgctacctgacctcaaactatactagaaggctacagtaaccaaaacagcatggtactggtaccaaaacagagatatagatcaatggaacagaacagagccctcagaaacaatgccgcatgtctacaactatctgatctttgacaaacctgagaaaaacaagcaatggggaaaggattccctatttaatagatggtgctgggaaaactggctagccatatatagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactcaagagcttctgcacagcaaaagaaactaccatcagagtgaacaggcaacctacagaatgggagaaaatttttgcaacctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagccaaaaaacacatgaaaaaatgctcaccatcactggccatcagagaaatgcaaatcaaaactacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggagattcctcaggggtctagaactagaaatactatttaacccagccatcccattactgggtatatacccaaagaactataaatcatgctgctataaagacacatgcacacgtatgtttattgcggcattattcacaatagcaacgacttggaaccaacccaaatgtccaacaacgatagactggattaagaaaatgtggcacatatacaccatggaatactatgcagccataaaaaatgatgagttcatgtcctttgtagggacatggatgaaattggaaatcatcgttctcagtaaactatcgcaagaacaaaaaaccaaacaccgcatattctcactcataggtgggaattgaacaatgagaacacgtggacacaggaaggggaacatcacactctggggactgttgtgggttggggggagtggggagggatggcattgggagatatacctaatgctaggtgacgagttagtgggtgcagcacaccagcatggcacatgtatacatatgtaactaacgtgcacattgtgcacatgtaccctaaaacttaaagtataataataataaattaaaaaataaaaataaaaataaaggcatgtgtcattatgcccagataatttttttaataactttttgtagagacagggtctcaccatgttgcccaggctgttctgtaactcctgggttcaagtaatctgcccaccttagcctcccaaagttctgggattacaggtgcgagccaccacgcccagcccatagtaaagttttattggaacacgaccacactcatttgtttgataactgcctgtattactttgtgagggctgccttaacaaagtagcatagactgggtggcttagacaagagaaacttactgtctcatagttctggagtctggaagtcctcgatggagctgtcgccagggttggatccttctgaggcctctctccttggcttggagacggccatcttcctgtcttcacgtggtcttccctctgtgtgtgtcagtgtcttcagctcctcttcttatgaggacaccagtcaactagtcacattggatcaaggcccactctaatgacctcattttagcctaataacctccttcacggccctgtctccacttgcggtcacattctgaggctcggaattcaacatatgaacttgggggcacagctcactcatgacactgctgggtctgctcttctgccaccccagcagaactgcagagttgcaacagagaccatatgggcccacagagactattctagataggcttttactaccaatagcctctttactctggggtcctttacagaaaaggtttacccactcttgccctagacaatctgcacttgctatgcatccccccaaacaccattcctcattgtctgacagctggatatgagttcacactgaaacttagacgccccattttccccaaaaagcccctcctactctttaagacagcagaactgacaatagtgtcctatggggccactcccaggggcacctgcagtaagccaaagacctcagtctctgatgagacaccctcaggtggtcagagaggtcagagaaatcgagcagaaagacagtcgctcctctcacactcacacaaaggtaggtgccagggctggaggggacaggccagagagtccgcatgggcaacaggaaacacggctgggacttaggtggggatgaagctgtcacggctctgagaatgcatgtatctgaggaatgagctttagagagacctgtgggaaggaaaagtgccagatgagtctaggccagggagcttggagaagtgggaggtgtcaaagaggccatggagacaagagaattgggaaggaaggagccagaagaggaggaagtccagggaacagagaccaggaaggaggctcaaagggagcacagggtcttcgtgacatctcctggagaggggagcccccgtagcacacgacatccctgtacaatgagcaagatactggggcttgaaggaaagcaggctggagaggagaggcagggctcagagctccagaccagcaggctgcattaaggggcaggacacctgggcacacatcctgcgcacagatctgcaagggacacaaaaatgtcagtgcagccaggcacatgcctgtggcactcacgcctgtaatcccaacactttgggaggccaaggaaggtagatcccctgaggtcaggagttcaagaccagcctggccaacatggtgaaaccccatctctaccaaaaaatacaaaaattagccgtgcgtggtggcgcatgcctgtagtcccagctactcgggaggctgaggcaggagaaccacttaagtctgggaggcagaggttgcagtgagccaagttcacaccactgtactccagcctgagtgacagagcgagacactgtctcaaaaaaaaaaagtgcaacaaataagtcatatggtgcccaaaacttgggtctctacacttggcttcttcagtgtcttggtccccacttccactaaaatacacagggttggtaggaatcctcccatacactccccttaagcaccaactccaatcccatggacagagagtggaacatatttttagcaaagcctgtttgaaggggcatcagcacacacctcacctgaacatctacatgactggtccaggccctggccccagctctgcccagcactagctatgtgaccttggacagccatgtcctctctcaacctcagcatccttatctgaaactcaagggactgggctaggttcttccagacccttgcagcagtaatgttctgggagggatggctttaagacattaagcataatataggccttggggaagcctgagcaaatgtgggtggaggctgggggagcaagagtgttggttggacacagcccagaacccctcactgtggtttgtttgaaagcttggtaagggcgtgttgcaaggagaaaggacattgacctagcaaatggggcctgctggcagacctgtgctcagcacacagagctcagctgtgtgagagtacacaggagagcacacacacacacacacacactacacacatcacatacacacagagagtcagcttttggcatgctcctagctgaggaggaagaaactagagccacagagagggacagagggacagatagggataccgttttttttttgtttgttttttttttgagacagagtctcgctctgccacccaggctggagcacagtggcacaatcacagttcactgaagcctcaacttcctgggctcaagcaatcctcccacttcggtctcccaagtagctgggactacaggcatatgtcaccatgcccagctcatttttgtatttgttgtagagacagggtctcgccgtgttgcccaggctggcctcgaactcctgggctcaagcaatcctcccaccttggcctcccaaagtgctgggattacaggcatgagtgaccacacccagcccaggagatcctgttctgcttcagttctgcacacagcgaatcccagaataactgcccccattttaaaaagagaaactgaggcagtctcactaagagcattccagcagactggaagcaagtcggaggcttcggctgctgacaactatctgggtttcccttttagtgctggccaggagggagggagggaggcaggcagggaggggagtgtggtacgggacggctcaggtagagggtggtgctggaaaatacctcaccctcgatggaggaaaaaaccacagccaaacagctacgatcagcagggaggaaagaaaggaacattctgggctctgaggcctgtggtcagataagtggccccaacctgacttcctctccatcctcgatgtgcttttccatttatccttccccttgcccataagccagcctccaaacagaggagcatttgataacattcaagccccacagctctctattccgagcccctgttttttttttttttttaggctggagtgaagtggtgtgatctcggctcactgcaacctccgcctcctggattcaagtgattctggtgcctcagccccctgagtagctgggaccacagacacgtgccaccacgcccaactgacttttgtatttttagtagatacggggttttgccatgttggtctggctggtctcgaactcctgtggagttcacctcaagtgatccacctgcctcggcctcccaaagtgctgggattacaggcatgagccaccatgtgcagccctagcccttgctgtaagatgcttttcacttaacttccagccctgctgttgacctcactctctgttttcaatctccacggatatttctcaatgcgttgtaaatgtctctcaaaacgaaactcacacttgaccaaactcaggttatctccctgaattctgctctctttaagttcacgctgggaatggagtccaggagccactgaaggagaccaggcttcctcttcgtagacatgtaccccatgtgtcaccgagggccggtggggagagagggagttggtgcagttgtctttccgtatgcttatcctgaagcatccctcattccccttaataccctgtcacagagccatcgtctgccaagtcaacgaagcccctagggaacctgtttctatttctagcagatctctcaagggctggtgcgatcctatgtttactacccacagtgtgaggagggcctttctgtgtggcctaaaactgcttcccccggcctctctgagggcccccgttctgggattcagcatgtcctccccggccaatggcaaggggcagggggctgaatcccctgtccagtcctgttgccgtgagccatgtcggggggactccacaaggcctcaggggacatcggtggggagaagaccatcaccgtggattgagggtggaccccaaactgccctgacaaagcagctccctgcttgctgtctctgcctgtcactttccttctgtgggacaaatagactccttcttgcctgtattagtttcttgtgattgctgcaacaaattaccccacactgggtgacttagaacaacaaagatttattctctcacagtcctggaggccagatgtctgaagtcacagtgttagcaggaccagaggctctaggggaggatccctccttgcctctcccagctcctggcagctgccagcattggctagcttgtggctgcttcactccagtctctgcctctgtcttctcatggccttctcctctgtgtctcaaatctccctgtccttaattttagaaggacagcagtcattgaatgtagggcccaccctaaatccaggatgatcttacctagagatccttaatcacatcggcaaagacaacattttcaaataacttcacaatccctggtaccagaatgtgcacatgtctttttgggggacaaaccatcccactgcactggtctgctactcattcccttgcaagtgatcctctctgccgaatttcgagacccagactcttctgtgagccatgcaaggcccccactttccttagccagccgcatttctcatattccccacagcatatcccccaccctgccggcagccctctcactttacccccatcaatgtccttctttcttttgtaacttttttttattttactttaagttccgggatacatgtgcagaacgtgcaggtttgttacatagctgtaaatgtgccatggtggtttgctgcacctatcaacccatcatctaggttttaagccccgcatgcattaggtatttgttctaatgttctccctccccttgcccccaccccccgaacaggccccactgtgtaatgttcccctccctgtgtccatgtgttctccactgttcaactcctacttatgagtgagaacgtgcagtgtttgattttctgttcctgtgttagtttgctgagaatgatggtttccagcttcatctatgttcctgcaaaggacatgatctcattctttcttatggctgcatagtattccatggtgcatatgtgccacattttctttatccagtctatcattgatggacatttgggttggttccaagtctttgctattgtaaacagtgctgcaatacacacgtgtgcatgtgtctttctagtagaatgatttataatcctttgggtatatacccagtaatgggattgctgtgtcaaatgctatttctagttctagatccttgaggaatcgccacactgtcttccacaatggttgaactaatttacactcccaccaacagtgtaaaagcattactgtttctccatagacttgtcagcatctgttgttttctgaaatgtccttttttttttttttttttttttttgaggcagagtctcgctatgtcgccaggctggagtgcagtggcaagatctcagctcactgcaacctctgcctcccaggttcaagcgattctcccacctcagcctcccgagtagctgagattacaggcacacaccaccacgcccagctaatttttgtattttcagtagagacggggtttcaccatgttggccaggatggtctcgatttcctgacctcgtgatcctcctgcctcagcctcccaaagtgctggcattacaggcgtgagccaccacacccagctgaaatgtccttatttctaaactcgctccagctgtccccacctgaggtcctccctccttccctctgcccaccctatcctgcctcagagcctgccctaaacacagcagctcctacaggacgccgggaaagaaatgatttcactccaaggcgctgagcacaggctgtgtcacttaacagcggcttgagttcagacaagcctctcaatgactctgggcctgtttctacccccagacccttcaaacatggagacaatacctttctcccagattggtgaggattaaatgatatcaggcacatgaaagaatctgccacccagtaaactcccaataaatgtgtgtcctccagatatctgatcttctgttccctgaatccacttctatttatggccggcactgggcgtaattgtttcattctgttggcttcgtctccccagactgaacttcttgagcaatggaaagggtttggggtttctctggaatctcccacagcacctggcacagctttgagtcagtaaagaactgatgcctggaacgaacaccatggtgatgcccttaggtgtgtatttcaaatgggagaagcaggccctgtgtccctgtggtcacctccctggtctgcttacccacgggctggggccttaagggaggggtaaggccggcctggctcctgcaggccttggacacatggggagggggcagtaatggaatgagaggccccgagatccaattccataatgattacggtgagagggacaaactccagaggccaattgttgggtgtaattggagtgaacagcaaatcgcaattggccaagagccctgaggtcagacaggctgggcccatccaggtccaggaggaccctgtggtcggccaggcagaagaagatctctctccattaggtcctggcaggggagggtgagcaggctggtctgtatcatctgggtggagcggctgagtggatgtgacataattgaatgaggcctctgcgtcttccacccagagcgggggaattagcaggcccgaccctcgcctcgggagaccgcactccccctcatctgcctgcattgctccactccacaccgcctgctcagggtggggtgggagtgccaggaaacggctcaggccaggtctgttgtgggaaagagggggcacaggaagacgggcacaaggagccgggctcaggcgggaaagtcccgggggtctgtggggagggggtgatagtgatgggccgggggcgggggtccataggactagcgtttgccagacagatggcaaggagaaacccagagcaaggagggaggatgggatggaggcggggagagatggagccaggcacacagcagagatgggaacaagatagacagggagataacatgacagcggccagacacacaggacgagctgagcgatggcgaagaagaggggcagataaagagaggcttattaagaaagactgatcagcagcccgaggaataggcagacagggagacaggagcttcatggaacataggcctgaaccctccctgaccggggcagccacaccttctctgcacttacggggcactattctgaatatgccacattgtctcactgaatctgcccagcacccttacggaattggtaatgatttcttacagatggagaaactgaggctggagaggataagtcacctgcccagggccacccagctagaaaacaaaggagacagaaggtgagccccactggagctggtttcctggccccacccttgccctgcaccagcaaagtctttcttggtttagctgcagaggaatctctcagcctagccgcctccctaggatgaatggatacagaggacttcctggtggctgtgggagttcaagtggtcagaagactgtcttttttttttctttttgttttgtttggttggttttttgtttgtttgttttgttttgttttgttgagacagagtctcactctgttgctcaggttggaatgcaatggcaagatctcggctcactgcaacctctgcctccagggttcaagcgattctcctgcctcagcctcctgagtagctaggattacaggcgtgcaccacctaatttttgtatttttacaaaatacaaaaatacaaaaattagcgcccagctaatttttttagtagagacagagtttcaccatgtttgtcaggctggtctcgaacacctgaccttgtgatccacctgccttggcctcccaaaatgctgggattacaggcgtgcaccactttatttttgtatttttacaaaatacaaaaattagcgcccagctaatttttttagtagagacagagtttcaccatgtttgtcagactggtctcgaacacctgaccttgtgatccacctgccttggcctcccaaaatgctgggattacaggcgtgagccactgcacctggtctttgtttgtttgtttgtttgtttttaaccttttctggtctcagttccctacccctagggcccctggcactgccccttaccacctgcactggcctctccaacactcagtcagccactggggaatctaatgcatgcactaatgtcactttaaagtatggcctctgccatgggtaattacttttaattggggtctccaggtgtaataggggagacatttgagggggcaggaaggccttccctgtacctttctaatccaatgtgggaagattcctcctgtactgattcatcaagccagtcctggctgtgtgactggcttcatccaagcagggagaaaagatgtctgggtacccatcacctattgcctttgttttttgtttgtttgtttgagatcatgtctcactctgtcgcccaggctggagtgcagtggcacaatctcagctcactgcaacctccacctcccaggttcaagcaattctcctgcctcagcctcccaagtagatgggattacaggcacccaccaccacagcccgctaattttttttttttttgtatttttaatagagacggggtttctccatattggccaggctggtgtcgaactcctaacctcaagtgatcagcctgccttggccccccaaagtgctgggattacagacataagccaccgcacccagccacccattgcctttgtgaaccctatccaaactcccatggaatattcccagccacaggcaccaacttggaaagttctgccagccagaccaagctctccccaggaacagggaccttgccttgggtggggaccaccaagcaactgctcccattccccaaagaagctcccctgtcctccctggctgccagctgtcagggttcagaggggcttcaggctgggacatcacccatctaggtggctgctgtgcactctctgacccagccaggcctgctgccctgcccactgcctccccagcaccctggggaggtgagaggaagtgccagcgtcagcttatagacagctgtgcccaggagccctgaaggaaggtgagagctgtttcaccttcacgggcagtagctgcctaacagcaaagctgggaaactcagtgcccaggaaggaggtgccgatccaccccgccctggtacaacagagagcgaaagcaaatcggcttctccaccctgctcacaggacatggatagacaaagcaggaaggaggacaggcagaaagacgcaggcacaaacagactggagaagagacgctagtgatggagcccagtgctggaggaaggactgcatccaagttcctatttttacctgataatgaccctgagacccaaagaggcaaagtgattcaccaaggtcgcctagctagtcctgacattgagcgggtcctcccctaggaatctcatcatcagatcctgatttatggttccaagaggaagctcgtggcttaggcaccaagggactgagagactagctctgccctgggagccaaggagctgcatctcactgtcctactcaaaaaccctcctggtctcctgaaccaacttcttcctggcctggcagtcaatgccctccccacctggctccagcccccagcctctccattctgctcctcactagtgctcccacacatccctaaccaagctctactcctttctgtgggtgacaccctgcactctcccatattggctcactggaacccctcttgcctcagtgcctctctcaggtgtcagtattctgggaggccttccttgagggtcctggctcggagaggttaagtaattcacacacaatcacaccattaactatcaaatgagtagtggaggcataaatccaatctagaactaactcaaaatccctgttatgctttgtattatagttgctgtctattacccattcacaatttcttgtgcactgagtttcttgatgtaggggctatgccttcttatctctgtatgtccagcacctagcagagtgcttggttctggtaggcactcctaagaaccatttactggatgcatgcatggatggatgaatggatggagggacggatgagtggatggatgagtggagggatggatggatggatggacggacggatggatggatggatggatggatggatgagtggatggatggatggatgcatggatccatgatagaagaatacaacatctccaactgagaaggcagaggtgccttggaaaggccatggcaatctgcagagtagggtttgggcaccactccagtaacacaatcagccaccagctgatcggtcccagctgacctaaccctgcctgctctcttgagtcttggcaaaccccagaggcatagctggaaatgaatgaaaatcctcccctgagggacaatatttgcccttcctcctcttttattccgcatcctcctgtttacttctttttgtccctgagtaccacataaaggagcttcagaggggattctctacaagccctgaaagagaggaagcagccaggaagggctccaaaggtcctgaacgaggaagaagacatggaaagcacagagaggagaaaagagcagctcagtgggaccaggagagccagcagccatcagggctggaaatgtccagggcacctgctaagaacataatgacagaagccacaagacgggctggtcccacaggctgcagctgcaccaagagccccggtaaagtctgcagaggcacaggactaggcttacgctccctaaacattctcaattccctcccctccctcaatgagataaagcagcagcagtatcctccctgcctctccccacccctcatcctgaaccaaatgagacccccacgctaagcactgctgtccaaatcaaattccacttggaacaattctctctctttctctctgcccacctagctccttctaagcccaccccctctcccatgccaatccttccaaactcaatggtatcaaaaaggcctcaactgtcaagggctgatggagggaaatggagacccacttgtctggctgaccaccagaatttagaccaggacacctcgaagactcaggatccatgctgggcagagtccctcacaggacaattgagacccagtttctaattccgctcctgttatacggagctgtgtgactttcagcaaatcctatacctctctgagcctcagggtttttttaaatctgtgtaaccagtgagctggagagatcatggttttgaaaccatcctggtcagaagttgctgctgaggagtaagcaggggggactctgggcccctcatctcatcctgcacctgagcagcctgacttttgtctgttttatctgtcaggcttccagtaagattgcacttagaaaaaaggtttagcggttgtttaaaaaaaaaaaaaaaaaggccagacgccgtggctcatgcctgtaatcccagcactttgggaggctgaggcaggcagatcacgaggtcaagagatcaagatcatcctggccaacatgatgaaaccccatctctactaaaaatacaaaaattagctggacgtcgtggtgcgtgcctataatcccagctactcgggaggctgaggtaggagaatcacttgaatccaggaggcagaggttgcagtgagctgagatcgagccattgcactccagcctaggcaacaagagtgaaacttcatctaggaaaaaaaaaaaaaaaaaagctgaaatgcattggcctcaagataaactctgagattcctttcttctttcagtcttcgtctgcgattcagtccgtgcacacatattttttcctggctatcctaatctggacagtcctgattcacacattctttcctgtggttcctacaaaatggtcatagtcaccaggcctcatgtcctgatttgggattggaaagtaggtccccacacttctggctggatgtataagacatgggacccaccctccgcttcaggaaacaggtgcctcctataaagataaatgacccagccaggacatctctgccaagtgcagagtgttttagcctagaagagctgcagagtccaggaagcaaaggtggttgtggtgcagagggcaggcctcatggacgaggtggcttaggtccagatacacaaagactccacaatgggatttcactgggggtacagccgatggtcaaatctggtttcaggggtgaacagaaagctaaaatgtcaggactctgattcagatgcctgggttcaactccaattctgttgcctaattgctacatgactcaggcaagctaattcggctcttagcctcaattcccccacctattctaaaccatctccaccattccatccagctccctatgtgcctctctcaggctcttttttagaggtagccttggttgtggattttcacaggggaggagaaggacacagagaggaattcaagctccagaaaggtcagatgcaaaacctgcaaattggggaccaaatatagaccccaggccttgccttcctggttctacctccaccatactcctgaggtcagcgggggtaagaggagggtgagagggaggaaagataggatgaagaaggaacacagcccaccattagcaagcctggaggaattcccagctgctcagagaagagcctctaaggaatatgcatagtcaccagaggacgaggtcttgtttgcatcatcgaatttcccaagtgccataacaaacagcagtgactgtcgtctctggctccccatctcctgggacagaataacctgctgccctagtcactgtcactcctgcaacccgcccacctccctcacctatcttgtcctcaccatcaccgtgtgccctaacccaggccctccccaaagccccagcatgtgtcaagatcttccactgccaaattcccaagctgagcaaataaggatgtctgagccaggctggggctgccagatccctgcgagggaagacaagcaaaccaggctggcaatgccatacaggaagaaaggtggataggggtgtgcttgggacctgtggtgtcccctcacccctttgggaaaggagagcaggacacaagggagagctcaggcataggtcatgctgccatcttgtcaaaggcagcaccaaaagaaagatatgggcgaaagaaggaaagaaatgcttcttagtattatgcctgaaactctaccattaaggaacctttcttccagccaaccatcgcccttgccactcaggcctcctgcaaaatgcaatttccatttagcgcaattcagatgtccatcagtccaggactggtcacataagtgatgcctcccgcatagcacagaacattatatggccattaacaagagtgcaatatagatttttaaaataacaatgtccactctgtgttgccaggtgatagaaggaaatggcagagctttgcttagcagagtcctgcctttgtaaaataaataaataaattgatggatggattaagcaagtaagtaaattagtgaatgcaccaggagaaacatctgggaggacatagtctaaacaatgcctatctcacgggtcacagggatggataagaagggatcattttttatttatgtattttattttattttatttttgagatagggtctcactctgtcacccaggctggagtgcagtggcgcgatcttggctcactgcaacttctgcctcccaggttcaagcgattctcctgcctcagcctcccgagtagctgggctaacaggtgcacactaccacaccctggtaaattttgtattttttggtagagacggagtttcaccatgttggccgggctgctctctaatgcctgacctcaggtgatccgcccacttcagcctccaaagtgctaggattacaggcatgagccaccacgccccaccagagaagggattttttttttaaccttacgtgttgaatctttgctgtttgaaatttgagtgttttacaacgattgatgttataatcaggaagaaacaccatttcagtggggttgtggggagtaaatttcccatgaaaagatgacagcactgctgccacccggctgtgcgactgaggagccacgagaatctgggcccctgggctggtggaagggctgacgagaagaggctgtaggcagatgtgcacccccatccccaaaaccatccccacaggccttgctgcaatctggccttcaccttgaaatccagccctgtttatttcattaagtgtttgcccaaggctcagtctctagagaagcatattaactaacttttgtgaattcttgccaatttgcagagcacttacacattttcttgcattcattcattccttcagaaatgttctgagcctctcctacaagccaggcactaggtgctggggagacagaggctaaagaagctgcagtcggtggccctgggaggaggcccccatgcacgggggggaaaggcctctgcctgccatgttggtgcttcgtccccggggccagacagagcgcagagaggccccagtcccaggccggtggtgttgctgggctttaagaaagcaaagacttcaaccagatgaagaaggaaggtgctccatcaacagaagagcaatcagccaccagaatcctcagagggccaggccttatgctaatgttacaggatctttgaggtgtcgcttttctggctggaaacctctgtggccagtggcacctttgcccaacattttctcaggcctgctcagcttgttccacccactcatcctgtgctcggctcacactaccggcctggatcccacacctgccaagaacaacccagtcgtggagcggggactggtgtgtgagcgagcaagcgtggggtccggccactgtgcacggtcaggcatgccggctgctcagtggggcgagcagctccaggtgccggcacgggcgccggctctctgtgaggctgcagctagaccaggcacaccacaagcagcttccccggtgccagcctggaatgcagtggcacctggaagctcagagatgccaggaatcacagggcctcaaagagggagtcacagccctggctcagagagctgccaggtttgggccccctgaaggaccacagctcttctctccttctctttgtccacaatgtggtgaacaaggggcaagtttctgccctgtttgtgttacagcttttcttgcctcaccatttggtaggccccgagctcttgccctgcaactaggaagaacgaggcacacagacacgtggacggtgagcaagacgaagaggagctttattgagcagtagaacagctcagagactcattgcgggtagctcctttctacagccagagtgtcccaatgagtgttcagccctcagcagagaagaagaggccctggggtgggtgactcttctctgctggcaggtcatccagttttctctgtagctcttagcagagaggaggccctggagtggattgttcccatctccaggtaggtcatccctggagtgggaagctcctccctactgttggtcattctgacgttttctagctatcagcagagagggtagctcctctctgcagctggtcctccagtcatctcccctgctctggctgaactggccccagaggaggatagtgtatgccgatttgttcatgggcagccatgggcgggcacaggaaaaagcaccacgagttccccatccagtccacaggactggcagcctgaaggtagggtctcaccggggacccagccccttccacccaggaacctgtttgcctgctgccaccctccatggcacccaggctgcttgtatcaaggagcatctgcaggccagcattgagccgccctcactaagacgtgagatccctcctcatttaatctcaaaggtacaatatcagcttgccaaggtacaaccatcattatccctattccatgggaaaggatagattggcaagcatgggaagtggaacaggagctgggaagaggcattttggttcacagcaacggggaaagaggccctgctggttccactgaggcccctgcagtgccctggtctccctcctacacctgcttccacctctgggcttgagaagatcattcagaaccggctccaatgcctggactaaccaaggtgcattcccaacccagtgtcttccaggcttcctgactccactggcctccctttaccttccatgaccagacaccacacacatggaatgaagtattctagactccatgccatcccaggcagatggatctccctcagagtcccctgaacaaacgaggctcatgtgcacttccaccctctctgttcatgctgttcccctgcctggtgctgctcctgcacagctctatgtgcaaagtagaagatgcaaacaccacctccgccgtagaactgtattagtgtgttcccacctggactaatctcttttcagactgccttggatacacccacagaattcaagtgcttaattgttcttcaatgatttctgtgtgtgtgtgtgtatgtgtaaacaactaaactgccaatccctgagagcaggaacatgcccctgttcccatcaagcatcccatatttcccagtccacaccagtcacaaaacaggaattctctatgtgtatccctgtggctgcagcctccaactcccacgctgcccccaaagggctccctgctagacctagagctccctaagcctgcattctccaagtctggatatttaggaagtggtcaatatctacatgtgaaatgatccttaagtcctgtgttaatggctcttgtatcactgactggcaccatcacctccttgtccatctctcctttccccatcccctgccacctcctgaaggcacccagcggacggacagagaactcagggactgagtttccatctgtgtctcagaaaccaagcaagggctccagaccagagggctgtatggtggctccaggaacctagaacacttatttcctggccctgagaccctgggagggggaaatcctcaccccagaaggcaccctgtgcccccgtctgggccttcccaaacacagtgcagggagctaggactccttagggagcctgtccttcagaaaaatgactcagggaggtggccacagcgcctgggggcctccacaacaaaaaatgggtcactatgggggggaaaagtggttaaaaaaagaaaagatctgtttctggaacctggtctcagtgctggctgggagctgaatagggtcccctgagggagtttccagaatctcgtggttttctctcccagaatctcataaaccatcaggtctccagcccgggacccccacagccacagtgagccctgagtggaaacgggggacacctgagagcccttctccctgcctgctgcaacccaaccagtcacccagagcgagtgctgggcccctggagaggggctgtggggctgtgtgggctgcctctctcggctttctaggttgtttctaaactgctccattcctgttaagtaggacacaccagggaggagggcgctgagctccgggaggggcagggcaggactcacagagacggtgacaggaacctcaggactccaggctaggaaagggtctcttggggtcatctagaggcagaatccttcaggcaagacccagaaagggagagggcttgtcctgggccaccgcactcatgcgtggtgggagcggggctaacgaccactgcacacagctctggcgttcttggtgcacgtggaggagagagctggctgggaagccacaacacccaggccaccaccaggatcagccatgggcagaggcctcagtcttttcatctctaaaatggaaataagaatatctccttcgtggttgttgtgagaactgaatgaaacaccgtctgtaaaagatgttcgtgtgcaagactgaatattccatacaaatggaagatacttttattattccaagccatggtcttctgttgataccccaaactggccatgtgctgacaaatgctaaagtagggtggggttgcactaaagactcaatgtttttgtccccccaaaattcatatgttgaaatcctcacctctgaggcgatggtgttaggaagtggggcttgggggggtgatgaggtcatgagggatgaactctcaggaatgggattagtgtccttattaaataggcctcagagatatttctcactcttttaatcgtgaggacacagcaagaagacagttgtccatgaaccaggaagggtccccaccagacactggttctgctggagctgtgatcttggactttcagtttccagaactgtaagaaataaatgtgttgtttaagccgcccagtctacggtatttttattatagcagccctaacggaattagacagggtgggggtttgtgatactattctttctacttttgtctatgtgcgaaatcttccaaaacagaaagtcggcagggcgcggtggctcacgcctgtaatcctaacattttgggaggctgaggcaggcggatcacttgagctcaagagtttgagaccagcggccgggcacggtggctcacgcctgtaatcccagcactttgggaggccgaggcaggcggatcacaaggtcaggagatagagactatcttggctaacacggtgaaaccccgcctctaccgaaaatacaaaaaaaattagccaggtgaggtggcgggcgcctgtagttccagctacttcggaggctgaggcaggagaatggcgtgaacctgggaggcagagcttgcagtgagccgagatcacgccagtacactccagcctgggcgacagagtgagactccatttcaaaaaaaaaaaaaaaaaaagagtttgagaccagcccgggcaacacggcaaacatcatctccacaaaaaaatacaaaaaaatcggccaatcgtggtggtgcacaccagtggtcccagctaattggggggctgaggtgggaggatctcttgagcccaggaattcaaggctacagtgagctgagatcgcaccactgcactccagcctgagtgacagagtgagaccctgtccaaaaaaaaaaaaatgtcggccacgtgcggtggctcacgcctataatcccagcactttggaaggccgaggtgggcagatcacaaggtcaggagttcaagaccagcctgaccaatatggtgaaacgatgtctctactaaaaatacaaaaattagctgggtgtggtggcacgcgtctgtagtcccagctactcaggagactgaggtcggcaggagaattgcctgagcccgggaggcggaggttgcagtgagccgagaccacactaccgcactacagcctgggcaacagagtgagactctgtctcaaaaaaaaaatgtcaacacagacacaaggctatgtttctgaatttctactcacactgccactctggccccgatctgtggctgcacatgcacacgcatgcacacacacaggggcacacacacacacaaacacgcacacatgtttgaagggaactgatggcttccagagtgccaccctcgaggaaaggaagaaaacaagtcattggggtggcctgtcactgtgtcacgtgggacgtggctgtcagaactactgtgtggtcttcccatttcttttttttttttttttttttgagatggagtctcgctctgttgcccaggctggagtgcagtggcgcgatctcagctcactacaagctccacctcccgggttcacgccattctcccgcctcagcttccctagtagctgggactacaggtgcccgccaccatgcctggctaattttgtttttgtatttttagcagagacggggtttcaccatgttagctaggatggtctcagtctcctgacctcgtgatccgcccgcctcggcctcccaaagtgctgggattacaggcgtgagccaccgtgcccagcctggtcttcccatttcacaaagaccgaaggactagttttagagtcaaattctggccaaactccacactctgccctgtgtgcttagcccactcccagtgggcctggcttttctccagcctgaagccacctatagcgaaagaccagtttcctttcccttttttgtgtctgagcacagttccagtgagtcggggccatcaaactcttcagtgcacagcgtgttgttagattgtgtctggtccctgcaagacccctcgtgttttctgtcttttttccattcatcactgtccatgccctgaatctatctcctttctggacatacattgatgtttgtaaattgcctagaagggtgtctaaaacacaggaggactgggcatggtggttcacacctgtaatcccagaactttgaaaggctgaggcaagaggatcatttcagcccaacagtttgagaccagcctgggtaacatagcaagacccccatctctacaaaaaataaaaaaactggtcaggtatggtggcacatgcctgtagttccagctactcaggagaatgaggcagaagaattgctggagcccagggggtcgaggccgcaagtgggcaatgatcgcaccactgcactccagcctgggtgacacagcaagatcctgtctcaaaaataaataaataggctgggcatggtggctcacgcctgtaatcccagcactttgggaggccaaggtgagcagatcacaaggtcaggattgcgaaaccagcctggccaacatggtgaaaccccgtctgtactaaaaatacaaaaattaggcaggcatggtggcacatgcctgtaatctcagctactcaggaggctgaggcaggagaatcgcttgaacctggaagtcgcaggttgcagtgagctgagatcatgccattgcactccagtctggtgacagagtgagactctatctctaaataaataaataagtagccgggcacggtggctcacgcctgtaatccaaacactttgggaggctgaggcgggcagatcacctgaggtcaggagttcaagaccagcctgaccaacatggagaaaccccatctctgctaaaaacacaaaaattagccacgcatgatggcgggtgcctataatcccagctactcaggaggctgaggcagggcaatcacttgaacccggaaggcagaggttgcagtgagccgagatcgtgccattgcactccagcctgggcgacagggcaagactccatttcaaaagaataaataaataagtaaataagtaaaagaaagaaagaaaccatatgcactataggcgcctcttcttatgtgtttgctgcatgtcttcagtatgcacatatcctcatacatcatggagcattgttttcaatatgtgttttgaattttcataaatggtattgtattttgaatgctattctgcgttttacttttttcagctctgtccttgttgctgtcagtatctggttggatgactccaaagctgtgtaggatcccagagggcacccaccacagttcgcttttctgtcccctcattgatggacaccaaggggcctccagcaccctgtgccacaaacaacacactctacacacgtccctttagggagactttctgtgggatccattcctaggagtaggatcattgatttctaagccatgggtactcaaataagtaattgtttgacttggtatttgtaaattgcctagaacagtgtctaaaacacagtaagccctatacatggcatgttaaattaatttttaaaaatgaacagcactggatttgccagactgctttccaaaatcagtccaccagtttgcacttctccctgcaattcagtagagttcttggttaccctcagaaaggtaaccctgaggttaccctcagaaaggtgttttgtccacctttctgactttattctgatgatggcaaagtcatatctcaattgtttccattgacattctctgatattactatcagacgatgtattcatactaatagtatttgaacctctcttcaaacacttgttagtcatttagtctttttctgaagtggaagcagtgttagaaatatgtttctattctccgaggtgatgtagagaatctaagcagctttgggacc

SEQ ID NO: 1398 - DNA, 50775 bp, Homo sapiens
agcgcagtaataactgacatgccaggaatactatctaccccgtacagctgcggctgcgaggattccatgagtaatgcatagtccaaggtgccacatagtaggcttgaaattcagacaaattccttacaagtgggaggaagccagctgggaaatcagacagacctggatttgaatcccagactagctcctttgctctgtgaccttcagcaagtcgcggcatctctctggcccattattgtctcatccataaaatgagaacctaataatgggtgttttgcagggctctggggctgcgggcaggattggtgataaaacacgctgagggcctgctttggagggggctctcatctgggattgcagtcagggatcagtgtccttctcataattatgcattttcccctctctcctttgtctcccctgctctttccccgctgctgcgcaggtttgcggaggccagtgttgactgttccacaatggcttggaggggaggacagtggcagggagcagagcggtgcccaggagccaccaatccatggcagtcaggcagccttctagcctcctgctgcccgagagtcagctgaccttgatcttagttcaggggagcagagagcagtctggcttctctgaccttatccagccatcagcacctccggtgctcagaaactccccttctggggagaagtggttaagtgagagggctggagtcacagaggccctaagtttgaagtgtagctttagtacttacctgctgaggaaatgaactgcttcatcctcagttgccttacctgtaaaatgggtggtaagaattcctgcctcctgagatcatttcgcagtttaaatcagttcacgcctgtaaaatatttcccacactcctgacacatacaaagtgctcagtgaatgttggctatcaagaatttgggtcaaagaaggtcaaaatcaacgagtcgattcattacaaatgtgctaaactgtgcttcttgttaagtagggctgggggatcttgttaagatgagcattctgttcatcagggctgaagtggggcccaagactctgcatttccaaccagttcctgggtgaggccgatgctgctggcgttcagaccacaagtagaacagcccagggttgaaaccgctccctccctctctccctacctcccttcttcccttcttcccttcctccctcccttccttccttccttccttccttccagacagggtccagagtgcagtggcatgatcacagctcatctcagtctccacctcctggtctcaagcaatcttcccacctcaccctcccgagcagctgggaccacaggcgtgcatcactacactcagcaaatttttgtattttctgtaaagatggggtttcgccatgttgccaggctggtctctaactcctgggctcaagcgatcagactgcctcagcctcccaaagtgctgggattacaggcatgagtcacagagcccagcaaaacccattttcaaacagtgacctgttaaggcttggttctgatgagctaattcctgaaaatcggtatattcggggtaaatccaggagaaggggagtggagaggagctggtatgattgagtagctgctcggtgttggcattgttgaaagaattatctcctggaatgttgacagcctccctgagggatattaccatttccattgtacagatggggaaccaagactcagatgttaagtgacttgctcaagcgggactgggggagggcttggtctctctgcctccaatcccatcacggtcctctaccttggaagcaatggcaggagcctgagaacacagccgagaggatcctaggcaagccatctcctctctcgagaccacagcttccctgttagcaaaatgggtggcctgggtgtaaatgacctccaagctccctcccaccctcctgttggaagagtttgtgctatctgctcttactcagcattcatctggctgtgtccccactcgcttcctaatttggtgctgacgttctggttgcagacatatcagtttcaccctgtcatgtcagtaacaccagcagaactgctggacgcagtcatcttcccaacagcagacgaaacggtgtagcagtgaccagaataaactcagcacttgggccagacagaacattctcccatacccggagatgagcctttcagcatccgcaggtacaaaatgtcacttgcatcaactcaaagtcacatggaatccagtttcacctggagcccagtcttggagaggcaggaagaggggcctacattgctaagacaggctcatgtgcacctgctgagatcatacaccagaggctagacctaggcaggattcctaactgggttcagatccagctctgccactccctggtgtatgacctttggcaagttatttaatttccccaggcctcagtttccttgtctctaaaatgaagccaatggcagtagttgtcttgtggggttgtggtaagaattaaatgagtttatacacaaaaagctctcagaacagcgcctggcacgtgataagcactcgttgcatgcaagtcatcccataaaagtgaaatccatcacgtttatctgttttgcttattgttggatacccagtacctagaatgatgctttatagtggtaaatatgaatatttgtataatgattaaatcagggggttctagtgtatgtgctgccaaagtgagcactaaatcagcaaggttccagagtggtagttttcaaactgtgttccaaggaaccctaggttgcatcccactgtatggtgggatggagggagtgcaaagaaagacgaaaaagcatcattctgctctttactcctgcccagagcctcgctgatttatatgctttgtatgtttatttacatgctttacatgccaccgaaccatggcagtcaggcagccttctagcctcctgcttacatgcagagagcagtctggcttctctgaccttgtccagccgtcagcatctctagtactgagaggaacaggttggagacactattttagatagaatggcagcgagaaggcctcttctgaggagatgacatttgagtagcaacctgaggaaagtgagaggcagagtcttccaggtaaagggattagcaagtgcaaaggccctggaacaggaaagtgctttgtgtgtgttggggacagcaaaaccgaggcttaaatcagacaatgtgtgtacattttttgagactgtgcttgagacacattggctgtgactatcactggtgtcattttatcttcatgatgagaagggcaagtcccattagattcacattttattttattttgagacagagtctcgctctgtcgcccaggctggagtgcagtggggtgatctctggttcacagcagccttgacctcctgggcttaaggagggctcaagcgatcccccggcctcaggcttctgagtagctgcgactataggcatgggccaccgtgcctggctaatttttgtagagacaaggtctccccatgtttcacaggctgggattttatgttacattaaaaatcatatttattgatgtagaatttcactataataaaattaatccttgtctagtgtacaggtggatacttttttttttttttgatcactctgtcacccaggctggagtgcagtagtgtgattatgactcactgcagcctctgttccctgggatcaggcgatcctcccacttcaacctcccaagtatctgggactacaggtgtgcaccaccacacttggataatttttgtatttttagtagaggcagggttttgccatgttgcccaggctggtcttgaactcctgacctcaagtgatccacccaccttggcctcccaaaatgctgagattacaggcgtgagccaccgtgcccagccagtgatttaaattttaaaggactgatttgccattattttcgtgaaatcaaatttattttactttccaaaaataatcatagaaattattctccaacagataggaatatgaaatggagttgtttcctccttttgtgattgtgatacttccactctctcctgaaagaagtgtttctccccacaaaatgtttgtcatttagatggacattggagagttaggtaaataacagattacagttcctgtcatcgtagatcttataatctaataaactttttgtcagatatcttgaaatcttaatgcttataggaccatagagacagggtttcaccatattgcccacactgctcttgaactcctgggctcaagtgatctgcccaccttggcctccaacatgctaggattataggcgtgagctaccatgcctggcctgcaggtggataagatttgacaaaggcatccacttgtttaagtcccaccataattataatatagaccatttccatcaccacaaaaaaatctctcacgcctgcttatagccaaactcttaccaatagcctttggcaatcactgatataattcgtctcaagttttggaattatacagtgtgcaatattttgtgtctactttctttcacaaggcgtgatgcttttgagattcatctgtgctgctgtatgtacagtaatgtggccatttttacagctgaataatattccattgcatgaatgtaccacatattgtttattatttatttgtgtatttatttttgagacagagtctcgttctgtcacccaggctggagtgcagtggtgcgatctcggctcactgcgacctctgcctcctgggttcaagcgattctcctgccttagcctcccgagtagctgggattacaggcgtgtaccaccacgtccagctaatttttgtacttttaatagagacggggttttgccatgttgctcaggctgctctcgaacttctgacctcaagtgatatgcccatcttggcctcccaaaatgctgggattacaggcgtgagccacagcgcctggccgcacatattgtttatttctttaccagttgaacgacatctggatgtctccagttggaggttattataaagctgccacaaacgtgtgtacatgcctttgtgtggacatatgttttcatttctcttgggtaaatacctagaaataagactgctgggtcacttttttttgagacaaggtctttctctcttgcctaggctggggtgcagtggcatgatcatagctcactgcagccttgacctcctgggctccagtgatcctattgcctcaaattcccaagtagctgggactataggtgtgtgctaccacgtccagctaattttgtttattttgagacgaggtcttaccatgttgcccaggctggtctttgaacttttggcctcccaaagtgctgggattacaggtgtgagccatcgcacccagccatatgtttaacttgataagaaatcactgaattgttttccacagtggctgcaccatttttgcatccccatgagcaatatacgagaactctaattgctccacatcctcaccaacactcagtatgtcaggtttatttagttatttatttatagtttagccatcctagtagatgtgtatggtatctcattgtggtctaattttcatttccttaatgaataattaaggtttagcatcttttcaaatgcttattctcctgtcttctttttgttttttgaaacggagtcttgccctgtcctggagcgcagtggtgcagtctcagttcactacaacctctacctcccgggttcaagtgattctcctgcctcagcctcttgagtagcttggactacaggcatgtaccaccacgactggctaatttttgtatttttagtaaagacggggtttcaccatgttggccaggctggtcttgaattcctgacctcaagtgatccgcctgcctttggcctcccaaagtgctgggattacaagcgtgagccaccacgcccggccagggtgttggttttcttattgagttgtaggaattccttttatatcccagatgcgaattctttttccaatatatgttttgcaaatagttcctttcagtctatagctggtctttgtatggtcttttttttttttttttctcgagacggagtcttgctcagtcgcccaggctggagtgcaatggcgcgatctcggctcactgcaggctccgcctcccgggttcacgccattctcctgcctcagcctcccgagtagctgggactacaagcacccgccaccacgcccggctaattttttttgtatttttagtagagacggggtttcaccgtgttagccaggacgatctcgatctcctgacctcgtgatccgcccatcttagcctcccaaagtgctgggattacaggcgtgaaccaccgcgcccggcttatggtcttaaagagtgtcttttgaagaagtaaagttttatatttttagtaagtccaatttatccatgtttttcttttgtggttcacgtatttgtgtattttctattcttggaaattttacctaacccaaggttagttacaaaattataccccctatttattttcttccaaaggttttgtagttttaggttttacatttaggtcaatgattcatttgagttaatttgtacatatggcgtgaagtagagtcaatatttttttaatattaattgtgtaattgttccagcagcatttgttgaaagatctgcttcacagatagcaagacagaaaggtgcaagacttcgtcccccgcctctgtgtcaaatagaatatctagtgcagtgtgagtgttgtcagagaaggggtgaaggtgcaaactgggggagtcctcatgtgagaaatggggctctaaatggcctaccaaggtggccctcatggtagccaacagcgagcacctccgtgatgaaaccaccaacccgaaaacagcacgcaggtcggccagggaggtgcctggtggggtgtttctcttggtgttctcagagatttgtactcctcttgcgtaagctgcagattaggaaagcattaggtaacgacagggtggccggagcgtattacacaccggcctggcttggggccacggaatgtggcctgcggggatggccttgcctagcaagtcaaatatagcttgatccaggagagagatggcttcctctctccctgctgcagccagaatgatattccgctggtctctggcaccaggaaaacagggtctctggagcctccttggtgtcgcacagcctccggaggtagaagtggggagggaagccaggagtccttgggagccgcatcattcattccactttaaggagtcagactacagagcctttgcccaggggaaagttagcaacaaatagcaattcattgctaacctcctgcctcctccagttccaacatggcccgacccccactaaggaccacttagagttgatcttcaccaccccaaaccagggaccaaggagactgctcctttcacatagcactgccatggctcagatatttgtccagcatctacttattttattttatttatttattttttttgagacacagtctcattctgtcacccacactggagtgcagtcgcatgatctctgcacactgcaacctccgctgccctggttcaagcgattctcatgcctcagcctcctgagtagttgggactacagttgcgcgccaccacgcctggctaacttttttgtatttttagtggagatggggtttcgccatgttgtttttgcttaccacgagaccaggctggtctcaaactcctggcctcaagtgatccccctgccttggcctcccaaagtgctggaattacaggtatgagccaccacgcccagccaagcatctacttaaaagatcacaaattttctcattcacaggacttgggcttaatccctgccctcaacgtgcctacactcacacagtggaagatgtgacttcaacatgtattgaatgtggaaagaagctaaccttcaccgagggcctctgctgcctcagacactgtccacagtcttcagatattgtcggatttattctcacagcaactctgcaagagtgggatgggcatcctcattccttatgtggaaattggaactcagagaggttaagtaacttacccatagttgcacagctagtaagtgttgcagccactatgtgaacgcaagactgtcaggctccagagcctgtgaattttactaaccacattgccatactatgtgtcaagagctcttctggaggctgtgggaggctgtgctgggggctgcgacagaggggaatgagggacagtgtctaaccgcagtcctttgctgtctgatgaagggcaaacagaaacaaccatgatactgagatcatgggaacaacctgagcagaagctcagtggtgggaataataataataacagtaagcccagctattggcgtttacctagccttgttgtgttttgcacacgttaactcatttaatcctttcgacagccttaggacatacttttctgttggtgttgtagttgttgagatggagtcttgctccgttgcccaggctggaatgcagtggcacgatcttggctcactgcaacctccatctcctgggttcaggtgattcttctgcctcaccctcccaagtagttgggacaacaggtgtgcgccaccacgcccggctatttttttttgtatttttagtagagatgggatttcaccgtgttggccaggctggttttgaacttctgacctcaggtgatctgcccggctcagcctcccaaagtgctgggattataggcttggaccactgtgcccggccagacgtagatacttttatgatctttattctactgaggcctagaaatggaggcccagagaggttaaataacttgcccacggtcacacagctggtaagtgatagagccaggtgttaaactcaggctctagagggggaggcagagtcagccaggggcgttgtgtttttgggggcagcatagtggagtgtcaggttggaagggtaggttgggaagggctgaaagagagtttacatgccaggctgaggggtctggcccttgtcctgtggcctttgtgagcaccgggaggttttggagtaggggagtgatgttagcagacctgtgtttaggcagatgactctggtaggagggttggggatccaggaggggaggcaaggttgtagctgagagaagggctggaaggccactgtcctgatcccagagggcactggtggtggcagcctgcaccagggctgggcagtgggagagaagactcgctagccccaggctccggccttgcctgcagtgggtactgtcagtgctacatgagccgtgacacatgctcaaatcacaaagaaggccagtaccacgttaaaagctgtggtgtggggtgtcaaatggtgctggaatcctgaagattcaggactctttggtctgggcctagctgaaggcagctccagggcagaggacggagctgggccctgcctgggggtaagggcagatggaaggaggaagccaaccaagaagcctgtgtagaagggggaagagcatggccagaggctgggaagctgaatctgcaaggaccccatgtatgtggggtcttctctaggatttttctgggaaaggatgatagcagggatgctatggatgctaggttgaaaaggaaatttggggctgggcgcgttggctcacgcctgtaatcccagcacttggggaggctgaggcgggtggatcacgaggtcaggagatggagaccatcccagctaacacagtgaaaccctgtctctactaaaaaaaaaaaacaaacacacagaaaattagccgggtgtggtggcgggcgtctgtagtcccagctgctcaggagactgaggcaggagaatcacttgaacccaggaggtggaggttacagtgagctgagatggcgccactgcactccagctggggtgacagagcgagactctgtctcaaaaaaaaaaaaaaaaaaaagaaaagcaaatttggccaaaaagttgaggcccgctgtttccagaggaggagacttacctccctggagcactgcctgcttttgatagcttcaaacaccactctggactctcaaatgtctgtcttcagcccagatcttattctccaactccaggcctgtaaatccgatactacctgggtgagtatcagctccaactggatgacaactgtctcagctcagactcaaagagcctaaagctgaaagtatcatcatcaaactgaaagcttctcgggttaccagctgtcttagcttgatgagacatagccattggcccagttagttggtcaacacaaaaacctgggagtaattttaaactcttctttttccattatttctcacatgcaatgttcattaagtcctgtttctgctagttacctctgatgttgaccattcaacaagtatttattggtccctcaacaaatatttatgagaccccactatgtgccaggtaatgagcatatagcagtgaataaaactggcaaaaattcctgtcctaaggtgctgatattccagtggcatgttggaaaccactgatctgttcaatgaaacctttgtcattgcaagccactgggaactggaggctgtttgttactgcagcataacctagtccattctgacgaatacaccagtaagcagtgcaccacagcagtgaggaaagagctggaaaaggaatgtatagtgttctgtgggaacacacaggaggggaggagagaacagacattaaccctataggagaggtctctgaatgatttctacttttcatctgcatcccccttgcctttccctggctcaggctttcctaacgtcttgcctgggctttgtcaatattcttgtctttgaacttctccctatgagctattctctacccttctaaaatgtaaatctgattgtgccactcccttgctaaatctgataatgataccctgttgcccataagaagaaagttagactctttagcttggcatactttgttcctcatgatgtagtctctgcaaacttcccaacttcccgaatactgggcctaactctgataacttgggattctttgaccatctgtttgttcttctctccatgcctttgtacaccctgttccctctacatggaatatattctccttttcctcctggaaaactcctactcatgttccaaggttctgatcaaatgtcctctccaccttgaagccttccctgatatctccaggcagagttaaggccctcgtccactgtgtgcctgaagattcctgctcatctttatttcccagtgctttgcacactgaaattgctgctagcccgatagtccttggagagcagggactggcctctgtgcctgacacctagagtagagggggtgtctgacacataataggtgttccaatcatgtgtgttgaatgaatgaatgagtgattcagtgacaaagaacactatattctacccactgggcaggatgagggctggggaagggagacactccacactcaggtggtgaggtgactgtgggtgaggttaatacagagataaaggcagtcatggtgagaagccgtgcagtattagaggaaaagcactgcactcagattctcaggttatggctctttctcttcccagctgcatgcccttgggcaagtcactttccttgatccttttaaaaaaattgtggtaaaaaatgggcataacataaaatttaccatcttaaccttttttttttcttttttgagacggagtctcattctgttgcccaggctggagtgcagtggcacgatctcagctcactgcaacttctgcctccagggttcaagcaattctcctgcctcactctcctgagtagctggcattgcaggtgactgccactgtgacaggctaatttttgtatttttagtagagatggggtttcaccatgttggccagggtggcctcaaactcctgacctcaggtgatatgcccatcttggcctcccaaaatgctgggattacaggcatgagccaccatgcccagccccatcttaaccattttaaaatgtacaatttagtggtgttagatacattcccattattgtgcaatcatcaccaccatccatctccagaacttttctcatcttcccagatggaaactctatacctgttaaacataaacttcccatttcccctccctctttccctggacaactaccattttactttctgtctccatgaatttgactgctccagaagccgcatataactgaatcatacagtatctgtctttttgtgattggctttttcacttagcatcatgttctcaaggttcatgcatattgtagcatgtgtcagaatctccttcctttttaagcctgaataatattccatggtatgaatatactgccatattttggttacccatccctgggcacttgagtcgcttccacattttggctattgtgaacaatactgctatgaacatggatgtacaaatatctgttcgagtctctgctttcagttcttttacatatacccccagaagtggaattgctggatcatatagtcattttatgttcacttttctgagaaactgacgttactgatttccacagtggctgcaccatttaaattcccacaagcagtgcacagggttccagtttctacttcacagtcttttttttttttgagacagggtctcactctattgccaaggctggagtgcagtggcatgatcatggctcactgcagccttgacgtcctggactcaagggattctcccaccttagtctcctgaagagcagggactacaggtgcacaccaccacacctggctaatttttgtattttttttgtagagatggggtttcatcatgttgctcaggctcgtacttcactgtcttgatggccttatcttcctgctggggatgctgtgagctatgtgcctcctgaggtccacaggttttgaaggtcaaatgaaacaacacttgtaaagcacttgatgaattactgttattgtgccaacatacaaatgaggcttggtcccctgggcagcagctggcacctgtgggagtttcctcctgctagcagacacaccttcttctggtgacctggcatggagactgcttgcctcctggtgatgatgggttcactcccctttctatgggagaggtgaccagaggagagctttccatcttggggcagagtaaatctagatgctccaggccaagttaaagaaccctcaaccttgcttaattcaacaaaccttgggggcactgtgccaggcatggggtgtggctgtgactagtgcccagaccttgccttccagaggctctgtttagtggcagatgtagcccagttgtgatataatattactatccaccaaagttcactgttcctccctttaaacggatggcagatcatggccatgttcaacaaggtatagtcatttaacttgctttgaacaatgaaacatgaggaggataaacgtgtattacttctggacagaagccttaaggccagcaccaggtttaacacatttcttttctgtctctcataacagccagcaatgccctcagaaacaggctgcactgttcaattgggctccagagtgacgatgggtgaacagaacagcagtcaacctgtggtggacatgtagggtgagtgagaaagaaacctttgtcattgtaagccactgggaattgggggctgtttgttactgcagcataacctagcccatcctgactaatacaccagtaagcagtgcaccatagcagtgaggaaagagctggaatagtaatgtatgtgttctgtgggaacacagaggaggggaggagaaaaacagagattaaccccacaggagaggtctctgatggtttctacttttcttttttcttttttttttgagatggagtcttgctctgtcaccaaggatggagtgcagtggcacgatcttggctcactgcaacctccgcctcctgggtttaagcaattctcctgccacagcctcccatgtagctgggattacaggcgcctgccaacacacccagctaatttttgtatttttagtagagacagcatttcaccatgttggcatggtggtctatttcaccaggtggtctatttcaccaggctggtctcgaactcttgacctcaggtgatcccctgcttcgtcctcccaaagtgctgggattataggtgtgagccactgtgcccagtcagtttctacttttcatcttgtactcaattactcctccaacaaatgagagaggaattattattctcatttgtcaggtaaggaactttcagctcagagatgttaaatttcacagggtccttcagcttctcaagcatggggttggtattcaaatttaagtcttggtgatacctacaccccagatttttaaaagaaaaatgatatcaaaaatagctaacacttacgtagcacttcctgtgtgcaagtgcctgatagtgtgctaagagctacgcatgaatgaacgcatataacccttatatcaagccaatgaggtaggtatatttttatcctccattttacagatgaggaaattgagaccaaatgccagctcccacatcacacaactggcatttgaagcccagaagtctggctctggagtacatactcttaaccactgcacttagctggttctcccaggctcatgggggagaaaggtgagcactcagataactccaccctctgtgtgctttgcttgggtgatctcaccaacaccatggcttcaaccattacatatcagtttccacatattcagcatggatcttcttctacttcctattaaactctgtacctgggtatctggtggccattacaaacaagtgtcagtcctcagtaggtcactgtcagactgcaatgcacaaactacaagggatcctcttgctgcaaatcttcctgtgtcttcccatcatcttcccttagcacagtacccctgctgttgctatttctccagcctcaactggaaaccacccaaatgtccatcaactggtgattgtataaaccaactgtggtacatccatacaatggaatactactcagcaatgaaaaggaacacactgatacatgcaacagcatgggtgagtctcaagagcattggactaaatgaaagaaactagaaaaaaaagagtatctactgtatgattccagaaagttctaggaaaggcaaaaccataatgaaagagaacagatcagtggtttccaggggttggggggtgggtggcaggaattgagtgcaaagatgcacaaaggacattttgggggtgatggaaatattctatacatgattgtggtggtggtgaacaggtgtacacatttgtcaaactcataaaatttaaaatgtacacttaaaacagaggcattctatttatgtaaatgacacttcaataaagctgttttgtgtgtgtgtgtgtgtgtgtgtgtgtgtgtgtgtgatggagtcgctctctgttgcccaggttggggtgcagtggcgcattctcggctcactgcaacctccatctcctgggttcaagagattctcctgcctcagcctcctgagtagcagcgattacaagagcctgccatgatgcctggctaattttttgtatttttggtagggacgggggtttcttcatgttggccagggttgtcttgaactcttgacttcaggtgatccacccgcctcggcctcccaaagtgctgggattacaggcgtgagccactgcgcccggcccgatgaagttgatcttttgaaaaagcctctgtttgtgggttctagtcctggggtgccttgcaggccaccgcactccccacactgtatttccacagtctgttttctggtttgtgtctggcactagacctcaagcttctccagcctcttttcccgctgtaattgccatctcttccaccgtagcacagtggctgtactccctggatgctcagggagcgatgggctaagagttattagtgacttgtcaaagtcatgtggccactgtaaaaagtctttccttgcctttaagacaaatttcaagcccctaaatacttgggctggaatacttctgacccgaatgccataggctgtatccaaccgcagttcatcagctctctggtctgaagagagacgcagacagaggattcggagggctcccgaccaccggtcgctgttcctggcaaggactctgagcagaggttctcctggtcactgttacccccatagccctttactggttcagctgtgtatcatgcatcctagaaaggaacactaagccccaggagggaaggggctgtgtttgtctttcttgtcaatgtttctctagtgcctagcacagtgcttggcatgcaataaaattacgatatatatatatatattttaaaacaaatagattgtgaagtttggacatctggaataaacatgttgtttgtagctgaaaatattggagtcatttttatttatttttaaacatttctgtttattttttatttcctttttagagatgagtctctctgtgctgcccaggctggactcaaactcctggactcaagtgatcctcctgacagagcctcctgagtagctgggactgcaggtgcctgccacccggtgtttctattctttttttgtttgtttcttttgtttgagacggagtcttgctctgttgcttaggctggagtgcagtggtgtgatcttggcccattacaacctccacctcctggattcaagtgattctcctgtctcagccttccgagtagctgggattataggagcatgccaccacacctgggtaatttttgtattttttagtggagacagggttttgccatgttggccaggcttgtctcaaacccctgacttcaggtgatccgcccgcctaggcctcccaaattgctgggattacaggcgtgagccacggtgcctggtctgtttttattcttgaaatgctgaaatgtagggcagctcgggcatagatcattttcccacctgaactccaatagtttgggacttcaaatggggtctgacactttgtgggggaagaaacacaggagaggtgaaatcttttatgtgttaaactcttgatgactgggtacatttttgagggggcaagggggaagagtttttcaatatttcgtttgtttgttttttgagacagggtctggctctgttgcctaggctggagtgcagtggcatgatcacagctcactgcagcctcaacgacctgggccctagcgatcctcccgtctcagcctccctagtagctgggactacaggcatatgccaccatgccctgctaatgaattttttctttttctttttttttgttcgagatggggtctcactatcttgccccggctggtctcaagagctcctcctgcctcagcctcccaaagtgctgggattacaggcccgagccactgcacccagcctgttactaacattgaacgctctgcagtacttcatttagaaaaaaaaaacacaaaaatctgatttttttgaacagattttaatttacaaaaatttcaaagacagcacagagggttcccatatactctagtttctcccattattaacatcttacgttaggatggcacatttgtcacaattaatgaaccattactgatgcgttattattaagtaaagtgcatagtttatttagattttcttagtttttatctgaggtcctctttctgttccaggattccatctagaatcccacattacatttagtcaccgtgccccttagggtcccctgggctgtgacagtttctcagactttcttgtctttaatgaccttgacaatttggaggaatgctttgctgaaatattctgtacagtgtctctcaactgggatttgtctgatgtctttctcacgattagactggagggcataggttttcgggggggatgtccccagaggtcaagagctgcacctatttttcagatctaaatgcagcttattagtttagatgaaaatgtgttgtggttgacgttatatgcttgcgaaattgccatgctgataagggataggcggacttaatccccaaacagaaaacaaaatgaaacaaaattacacaaatcccccacttaccccacctcccaaatgctttccaccctcgacttcactttccccccacaaagcaacaatactgccatttctggatattggtagctctttctaaagggaattgaactgactcagaaggaaccaggaagtagttgcatattcagcccgctccggatcaacccctatctgtttctgtgctttctttccaaacaaatctttttagaatcagaagggagggaactgattctgttctcaaggatctacccggccgggcgcggtggctcacgcttgtaatcccagcactttgggaggccgaggcgggcggatcacgaggtcaggagatcgagaccatcctggctaacatagtgaaatcccatctctactaaaaatacaaaaaaattagccaggcgtggtggcgggcacctgtagtcccagctactcaggaggttgagtcaggagaatggcatgaacccaggaggcggagcttgcagtgagcagagatcgcgccactgcactccagcctgggcgatagagcaagtctccgtctcaaaaaaaaaaaaaaaagaaaaaagaaaaaagaaaggatctacccaactagggagcctctccctctgtccctttctcctttacacatttagtccctgctgtgttccaggagccacccttgagctgaaaagttgactgaaacagggctcttgtctgggatttggaaggagagatacccgatgtatgagcacggccccacatcataggtgttggagaggcggatatgtacctgggattgtgtggcccaatgaagggaagattattcttttgggtctgcatgaagcatgccagtcaaagggaattgggcaggaaaggatgccaatcaaatgagcagattaatgagcagggtagtcccccaccagtcaggggacaataaaagctagatttaacttggcccattctttctcagataccatcgacctttgcgtgaatgtgaggtgactgttctcttccaaagtctgcctttgtgatggcaactggtttactttgtacccagactcgcctgagggagggaagccagcttatccagaggctgtgctgcggtgtaccaagccctaatccttaaatccttggctctcttccacatagcacatgtcaaaccaatccctaggagtgggcaggacagcactttgcaaagcactctgaatcttgagccagaggtttgggtttgatttaatattagtgaaaattgcctctattggggcatatacaaaactcctgcctaagtgccttatgtgtatcatctcatccaaccttccagactgcatacgataatgatgacactaataagagttactaattttctttctttattattattatttttttgagacagagtcttgctctgtcacccagtttggagtgcagtggtgcgttcttggctcactgcaacctctgcctcccaggttcaagtgattcttctgcctcagcctcccgagtagctggaaccatgggcatgtgccaccacgcccggctaatttttgtatttttagtagaaatgggtttcaacatgttggccaggctggtcttgaactcctgacctcaggtgatccacccacctcagcctcccaaagtgctgggattacaggtgtgagccaccgtgcccagccagagttactaattattgagcatttgttatgtgtcagggttgtttaaagagctagacatggattacctcacttaatttcacaatagccctgcaagtgcaaaaatcttaagcacagagcttaatcagtttttacctatgtgtccccatgcccccaccacctgggttaagctatagaagttttccccaagccttcctcatggccgttctcggtcattaccaccaccctctcctcaagaaggtaaccactattttgatttccagcattgtcaatgagtttggctgactttcaaaattaataacttaattatttttaaaaattaaggtgaaattcacattatttacaaaattagccattttaaagaaaataatccagtgacattgaacacattcacgatattgggcaaccatcacctctctgtgtctccaaaacattttcatcaccccaaaaggaagccccattcccactaaacagttggcttgttttcgaacatcagataaatgaatcatgcaggatgtgcctttttgggtccgacttctttgtttttaacgtatgtctgtgagagtaacgcatgttgtgcgtgtggtgggtacaaatattatcctcattttatagatgagtaaaccagggcacagagtggttaagtaaccagcccatgatcactcagctgctaagtggttgacctaggatccctggcagggtggccctggagccttgttccggaagcatgtaccgtattgcagaggaggaaacaaactcagacagtaaggtaacaaactgaggggagccagtaaggatttcaatgcagattcttctgactgcaagaccaaactgttgactgctagcctgttttccccttgactaactgtgtgtcttggggcctctttctgggcatcagtttcccagtctcagtaaagcgttctgaattttccttgctggggtggtgaaaggcttggttgagagcctgtgtgaacctcacggtgccatattaacagtcgcgagaatgtaattgattctatgatgttgtggttcactggaaacttggcaggggtggagtaggaccctgaagaaagctggcactatgtcaagtggccaacgggagctcagcccttcctgttctctctgagtatttgtagctctttagtatttcctgtgctcagccccattcagagatcaccaagtcaaacacctaaaatccagggtccctgtgtttgaggaagtttgcattctaagatatttcttcccaggctggtaccctagaatgtcatcgttccataggctgcctttgtcatcatttatgaaatttgtcaactcttggtccagaggtctgattaggaggaaaagaagaaagtcatgtgaggccaggtgcagtggctcatgcctgtaatcctagcactttgggaggccaaggcgggcagatcacctgaggtcaggagttcaagaccaacctggccaacatagtgaaaccccatctctactaaaaatacaaaaattagtggagcgtggtggcaggtgcctgtaatcccagctacttgggagactgaggcaggagaatcgctgaagctgaggtgtggcagcttcagcatttggctccattattccctcaggcatgaaatcttcctctctagccttgtttaaatctcaacacttccctttccaaatgatttctaaggggaaacataaaaagaatgttccagaatactctgttggcccaggggtgatttgccagagcagtttcctggattacggcctcttcccccatcagcaaatcatgtgaaacaaactactgtcagctgtaaaccctgaatgtgggaaaaagagctgacacacagggcccactttcgtaaagctgacatttctcatgaatagcgaattcctgagtgtgggcagtagaccaaggccaggaattctcattagctggtgataatcaggcatgacttggactgtggaaggcagctgggcggagaggtcataggtatgggcaggggtgagccacagctgatagctgggcgcgatctgcctggattgttactgaaatactaacatgctctttatgggttagtaactcccttcacctccccaacggctcctacccgctgggaccttcacctccccatgatccaacagtgaaagatttaatacccacatgacaagggccttccagacatggtccagctggggtctgatgctgatttggatagatccatggcaaactggtgagtaaatatgttaaatgcctctcctggctgtgggacgacagttccctccttgggccccagcctccttcctgcttctgagaccacggcctctgatctcacctctttagagctgaaggacatctaggacatgagctcagctgattgtttcccattcagtggctcaatcccacccctttcacattcaacctccctgaagtcagcattcactgtttttttgtttgtttggccttttttttttttaaatccttatctctgtagcatttcctcactttcctaaacagagttagtcacttccttctgtgtgttctcataatacttacaagccatatctctatgatccaattttatgaacactgttattttctttttcatacgtatgaaagattgtgaatatttcttttccttttttttgctttggcttctgggaagctcagagcccaatttgtagtttccctcaattaagcaatcgatgtaggctttgtgaattcactttgtctctggcttcatgttaagttcagcctttctttcctccatttctttattaatatatatttgtattatattcatctctgtgattcatctcaaatgctaaaattattttttgcattgtcttattaattaattaatttatttatttatttgagacggagtcttgctctgtcgcccaggctggattgcagtggcgcgatctcggctcactgcaacctccgcctcctgggttcaagtgattcccctgcctcagccttccgagcagctgggactacaggcatgtgccaccacgcccagctaattttttgtattttttagtagagacggggtttcaccatgttggccaggatgatctccatctcctgacctcatgatccaccattctcggcctcccaaagtgttgggattacaggcgtgagccactgcacccggcccttgcatcgtcttctttaatgaagtataattttcaaaaataaaatgcatcaatttcacatatacagtttgatgtgtgtacccatgtaaccaccaccataatgccataggatacatttctatcacttcaaatttcccttgtatcctttctcagtcaattcaccaccctaccctgatctcaggtgccactaatctgttttcggctactacatattagatttacctgcttctacagtttcatagaaatggaagcctacgtatgtgatctttggagatgcatccaaagacatggatgcattatgccaagtgatatttttgagatgcacccatgtttttgtgtatactagcatcttttgagatgcactcatgtttttgtgtatattcgcatcttctgagatgcatccatgtgtttgtgtataccagcaaatggttcctttttatttctgagtaacattccactgtatggagacatcacaatttgcttctccattcacctgctgatggacatgtgaatgatttccagttctgggctgttttgagtaagtaaaatcaggagagtgtagcaggtgttgggcaaacaacaaacatgtctgctagtgtgaaattcaccggcaatgccttagcatggtgtctagcacacaggggtgcctaagaaatggatagtcgggttgattttaacagctccctgggtcggggagacagggttggaccttgaatcacagaaacatgaatttcagtcccagctgtgccatttccagctgtatgatcttgagtaagccactgaacttttctaaacctcagtttcccccaattctgtagaaggggactaattgttcccaaatgaacacaactgtcagtgaaagcactttgcaaaggattaagacaaatattaggcaaaactactgtgaccatggaatttcaaaagactagaatttctcttcagatcttgaattctctgctcttccttactgctaccctcaatggctgatgaggactcccacattttagggaagaattgagatcacgtccaagctcctacttggacttcatcctcacctccttctgagcctcccatggccaaatgcagtgattccccaactcccctgtaccccgccctgcccttagcacatttctagaccctggaactttgggtgaaatcccatttatcacaccgatctcccttggccacctcctagcactgtgtcacagtgtcagcagggctgttcacttctctgcccttgctctctatcactcatgagtcaaagttctccgagcacattccgtgttggtggccccctgtgaagggtttcaccaaacaccactgtgggctgggcgctggcttccatccactgacccagtgcagctcctggcttctgacttctttctgttcctctctggacttattttctcccactccttcctgtgactgtttaatataccaagatgttccctgtcttgatgctatcacttgactccactggctttggctttttactgtacttccttttttttcccttcatttgtaatgcattcatccacctgcatcaacgtggctttgttctccaccacttctcagcaataactgacctcccaaaggccaagcaccccagcatggctaggtcttctcttcctgatgctcctcatggcttccatattttccctgagactccttggggcccccaagtcacctcccctcccttctcttcctccagccatttcttttcatcttctttagctgtcacctcatcttcaatgctgggctctgtcacccaggctggagtgcagtggcatgatcatggctcactgcagccttgacttcccgggctcaagcgattctcctacttcagcctcctgagtagctgggaccccaagcacacatcaacacacctggctaattttttattttttgtagagatggggtttccctatgttgctcaggctgatctcaaattcctgggttcaagcgattctcctgcctcagtctcccgagtagctgggattataggagtgcaccaccacacctggctaatttttgtatttttagtagaaatggggtttcatcatgttggccaggctggtcttgaactcctgaccttaagtgatccacctgccttggccctccaaagtgctgggattacaggcatgagccactgtgcccagcccaatcactttctttttcattatactgtgtatctttctctttaaaaatccagattcaaacaaatagccttttaaattcaattagtccaaacctggtgaccttttatgccatcttttgggacagggccctgatgggaatacctgcagcatgggcccataacagcagccagcatgaacgctgtctcaaattagactgggtcagcagttgcaggcttggatgtaagcagccatataatgtcatgcaatgtcaaccctgaaataccttgggctgactccagggagatccagggccagcaggacactgagaaagccatggaaaatctgccatcgactgttgttccttcctggtgagctggggcatgcattagtctggaaagatctaattggttataactgcaggggaaggaaggaaggagttaattcctggctgggcctgtttgcaggaagccatatgctttagttattgaagtctgctcaacgtgggagggaataaattggcccttccaggagcctggttaagcagcagaaatagttttctcttggtcaagcacgggttggggggtggggttgaaggaccacccgcggatttaagatgtggccggtgccaggaccatgggtcttgtctgccacattctcctgctaacttggtaacactttttcctctgttagcactgtagctttgcttaagaaagacaccatactggacacttgacattcaaaaggaatttgtcctcaaatcttagttctctcaatttacaagcatgcctcctggtcttctcccgagtcactcttctgctgagtcttgtgttcacaaaacttctgaactgctttttcaaatcaccctaattttttctgtctcatatggtaaccactgtcataaacaaagattttttaaaagccacaacacaccaaatgaaaacctagccccttgcccccaaaataaattctgatgttaaatttaaccttctaagatcatccagtttcatcttgcaaagaattttctggatgaggtataaaactattttaaatcataaaaaacaagtgatagcacagaccacaaaataaaaaaatagtgcactctacttcattgaaatgaaaacttatactctttgaaaaacactattaagaaaatgagttgataagctacagactgggagaaaatatttgccagacaaacaatccaattaaaaatggtcaaaagatttttaataaatactttaccaaagaatatatatgaagggccaatgagtatgtggaaagaggctcaacatcattagtcatcagagaaatgtaaattaaaaccacaatgaaataccaatacatacctactaaaatgtctaaaatgaaagagactgggccaggcatggtggttcatgattgtaattacagtgcttttggaggctgaggtgggaggattgcttgaggtcaggaatttgagaccagcctgggcaacagagaaagaccctcgtctttacaaaacatttaaaaaaaaaaaaaaatgagccaagcgcagtgccacatgcctgtagccccagcttgagcccaggagttcaaggttgcagtgagccatgatcatgccactgcactccagcctgggtgacagagcaagaccctgtctcaattaataaaataaaataaaaagactgacagtgccaactgatgatgaggatttggtgcaaatggaactttcacacactgttggtgagaatacaaaatggaaagctactttttaaaaagatgctaaaaatgtttaggcaactggacttagttgagataatcccaatttgttggcagtgtccaaagctttgtagccagggagcaaatgcatgccttcgttatgccattaggcctaatcagagtatgggctttggccagtcaaggtcgtagggctccttcgtagcctctttgatctggtgttgttggccttgatgtccatgatgaacactaatgtgaccagtatgtccttgccattgagcttcatggccaacttcatggtaataacggctaagcttattcctcctagggacctctgtgtgtccatttctacatttataaaatggagtgtattcgttggggtaggctaactactgtaacaaatagacccgaaatgtgtcatggttaaagacaggtgttactgggtcacataacagtctaaggtagttctaatttggaggtggggcagagccttactgctaacttggacagctcatcttgggactgttttatcagcgaaacctcaatattgtttaagctattgcattttaggacctcttcgtcagagcagctgagtcttaacctcactaatgtggtcagactcaactggtaaacatcttgcctctcacacaggccgtattgctcctgcaattctaatccgagcttcagctaaattcaaaatggctgtgtgtcaggggccttcagggttgcttatgaatagtcaaaactgctgatttgtggaaaataccaaaggtcccatcaatcagtcatggatcagtcagataacatgcacataaagtgtttattttcagcataaaaacaaggaaaatgcagcttaggaaaaggaggagggaaggaaggaaccacttctgctgagcacgtccatgtagaaggtgcggggttgggcgtttgcatgtgttatcccatgttgactatcaagagagtcctactgcagaatggttatctttattttattacatttatttatttatttttttagacaggatctcactccgtcacccaggctggagtgccgtggcactatcatggctcactgcagcctctacctccaccggctcaggtgatcctcccacctgagcctcctgagtcactaagactacaggcacacactaccaagcccggctaatttttgtatttttttgtgaagacggggtttcgctctgttgcccagactggtctcaaactcctgggttcaagtgatttaccgaccttggcctcccaaaatgttgggattacaggcatgagccaccactcctagccaggactgttatttttacattgcagatgaagaaattttggtcagagagatgaagtagctctgccagtacacagcatggaattgaaagcaatgggcctggcactgactgagaggtactcacagcttggggcagactcccatttggagatgggatcctgaagaagcctggatgtttgtgatggcggtcaacagagcttccagaatggtaaatctgatcttttgtttacaacctttcaagaggccctcattgccttccaggtaaaacatccaaccctcagtagctagccatcaagtccttagtcacctgacccaccatcatctgtttcatttgtgtcacatcccccttttataggctacggtctctttttctcttggctgttgcccttgctgtcccctcttcttaaacactccctctgtcacccctttgctgactcatcctcatgcttcaagatgcagacatcacctcctccaggaagtcttctctcctgatgaatcctctgctcccactcatttccacgctctccaatctgcacttccctccctcagagcagttgattaacagtgtaactctattatataacctgcttaaattcctccatcagtaaaatggctatgataataatcgtacttataacgcagcagtgcagcaaagtggaaagagaccatcctcgcagagccctttgcatggggccttgctcagagtaagcactcaatgcatgttagccagttagcactctttaagtaattctctgttgaagcctctgcctcttgccaaagatgccatgcagcactgtatctccagcacctagcccagtgctgagacacagagatgttcaataaaggtgcaggaaccaaagcttaggcacatctctacctatgtttttttttttctctcccctcagcaaacgaaaaggaagggttaggtagaccaattatgtgaataacttaattggcgttgtgtttcactagcaactgtggtttgaagatgtgcagtgacctgcccagtaccacacagatggtattaggcagaacaaggactttcgtcctcttcatacctaggctatctcctgcacagctacttgatggactaagggaaggggacttctaaattttgaggtgggagaaagagaggagaaagaaggtaccaagagtgaacccctatctttttctttttctatttttttttttttgtgtgtgtgacagtctcgctctgatgcccaggctggagtgcagtggcacaatctccgctcactgcaacctctgcctcccaggttcaagcgattctcctgcctcagcctcctgagtagctgggattacaggcacctgccaccatgcctggctaatttttgtattttcagtagagatggggtttcaccatgttggccagactgatcttgacctcaggtgatccacctgcctcagcctcccaaagtgctggaattacaggcatgcaccactgcgcccggccaaacccctgtctttatttggttctctacagctggtgtctgagacttggctctctaaagagatggtgaactctcagagaacaacttcatgtactaacaagagcaatactagctcactacgctccagcccctgagctgggctgaactcttcgtggtatcattgtgtttatgtgcacagaaatccttataggtgggaactatgttaatctccattttatggatgaggaaactgagattaagtaattaccaaggttacccttagtaagtagcaggcctggaattcaaacacaggccacaggacactaaagcccatgcattaacctctgggcagtgctgtcttccgtctttccaattcaagtcacgtcaattacttggcacaactttccttggcaccttctggtataggcattatgctaatacagagacacagtgattcccagaggaagaaatcaaggaagcctacatacatactgattagtcattgccaacatgagtttatggagtattgacttgtcctaggtgcaatcctagaaaccacacaggtattacatttatttaattctcacagcaaacctttgtaataggtattagggttccccccattttacagattgggaaactgaggctaatagcatgcacaagggcacagaattcttaagtagtaatgtctggatttgaacagagtcatgatgccgtggtgctttgcagggtggagtaaggccagaggtcagcatttggaatggccttggagggggaaaaggccagggggagctgggtgcagccaggagaggcaactaaggagagggtaccctgcacaccgttactgactggcaacgcttactgacttgaatccatgtggcaatccacgacctgtgtctgatatcatctctgggaacgggcttggaacacccatgagaaacagagcgcaatggttgagcaatgcagcctcaactcttaggaaatggaaaattctgaaaaggaaggttctaggaacttggagaggcacagccacaggtctgagagtcgcttccatttcctcgctcacccctgaatctgccctgccggttcctccactctgagcctttgctgttgcctagggctgtaaaatgcagccccttccctgcagtcctcctccgatccctgtttgcccatcaggttccctcactgtctgtgacagccctgtccctcccaaccagtgcagaactggctgtggacacgatttccagcatcactcttttttgttttgtttttcacttatgtgattaaaaaaaatttcaactctaattttggattcaggaggtacatgcgcaggtttgttacttggatatattgtgtgatgctgaagtttggggtatgaatgatcccatcactcacctagtgagcatagtacccaataggtagttttgcaacccttgccctccttccatcctccccctactagtaatccctggtctctattgttgccatctttatgtccatgggtacccaatatttgacttctactttataagtgaaaacatttgatattttgttttctgttcctgtattaatttgcttaggataatggcctccagctgcatctatgttgctgcacaggatatgattttgttcctttttatggctgtgtagtatttcctggtgtttctataccatattttctttattcaatccaccgttgatgggcaccagttggttccgtgtctttgctattgcgaatagtcctgcactactcttgcagggccagcagagcctgggttacatctgggctcagcggacagaccaacctggattgaatctggcagagtaactaagacagggacctagagagctctagatttcaccaggatcagaggctcaaagaggtaaaacaaatctcccaggccacacagattgttattattagagcattcttgtcctggttctgcttgaccaatccgagcctttaaaatggggctagtgatacttgtgtgaaatagatgagataatgcttactaaagggtgtggaacagggcactcagtcagcgacattagccctgctccccacccaccccatgtatctcttcagatgtatgtgtcttttttctacaatgaaatcataggaaattgaaggtcagagagtcttctttagcatatttcagtaaccctttgtggggccttgcctattgaaaaaagggctgaaaagatgttggttaacaaaacagccttccaaaaaatgttcagaacccaaagcaaggtctacagtccctggggctgccatgtcaaaatgatgtccttgtggccgtaggggtcgggtttctggaaaaacctgtcctggagacagagcccagcccaggggagtagggtgctaggcagctgtcccggagggagaccccatttttctctgctcagctggttggaagggagctgaatagtcatttaggtgctcgttgcgacaggctggggttgagataggcagcctcagacggcctggatattaatgtggctaattatgtggattgcttcaccaggagatgggagatagaactccccaggagtcccagtgggaaggccctgtggggcccagcccttggtgtgctcattgctgctctgtctgggaaagctgaggtgccctggccagttcctgaagtggctggtccctcccagctgctccaagtgacagtctgcatctctaggatgatcttggtgtggctacagagggagagatggggcctctgggaggagaaagccagggccaggtagagtggtgctgacagatggcttgataatgatcaaaaggtgcacctcccaggcaaggaggaaaatgccgccccctggaaatagagaaaagaaaactgctgaggatgtgtctttgtcaggtactatatttgatccagagagggagagtctggctttaccttctcttctggctctgcaggaaataaaggtttgggttctatttcctgttccctatggttggaattgaacacacctataaagtcctatcaggattagagtctgtctatctatctatctatctatctatctatctatctatctatctatcaataatctattttctttgagatggagtctggctcttgttgctcaggctggagtggcatgatcttggctcactgcaacctccgtctcctgggttcaagtgattctcctgtctcagactcccgagtagctgggattacaggcacctgccaccacacccggctaattttttttttttttttgtatttttagtagagacagggttttgccatgttggccaggctggtctcaaactcctgacctcatgagctgcccgccttagcctcccaaaatgctggaattacaggaatgagccactgtgcctggcctattttcatctatcatctatctatctatctacatagatatatatgtatatctatgtatatagatagattctatatctatatagatatagatagattctatatctatatagatatagatagattctatatctatatagatatagatagattctatatctatatagatatagatagattctatatctatatagatatagatagattctatatctatatagatatagatagattctatatctatatagatatagatagattctatatctatatagatatagatagattctacatctatatctatctacatatatatacatatatatatatatatatatattttttttttttgagacggagtcttgctctgttgcctaggccggagtgctgtggtgcaatctcagctcactgcaaccttcacctcccaggttcaagtgattctcctgcctcggcctcccaagtagctgggattacaggcacccaccaccacacccagctaatttttgtatttttttagtagagatggggtttcaccaagttggccaggctggtcttgaactcctgacctcaggcctgccttggcctccaaaagtgctgggattacagacatgagccactgcaccctgctgtcatctatatttctattttctttcttttgatcaattgagcaatctatctatcatgcacctacctatctacctaactttcatctatcaacatactatctcatgttgggacttaaaaaaaaaaagaagaaaaccaaatatccgtgccatttacaaagctgctgatggtattttacagtggatcagcaactacaaattagcagaacaaatctggtttattttttgtatctctcccctcatgacacaaagctcgttgcgtcttccattcaaagatggtggatttgagatttgagtaaactcggctcaaaagcaagtcatcatgcctagtcagttaagcagaaacgaggccaaactttgggaagcgcctccaagcccgctctcacgaaaccaagtgctgtatctgctaactgctttttagtttgttccctggctttttggaagcatctttgacttcagaaaacacttgctgtgtttacacctgttaaaaaattttttacaagttttgagaaagcactgtgttggctgaaattgtcatttctttggtggtgtttcagggggatgaggatgagggatgcacaaaccaaaatgaacttggctttctccttttagagctggagagcctattgctttttgaggataagacactacaagctcctttatcatgctagactggaaagtgtttctccttcctttgtaagtttcttcctctctccagctgttagatgaggcaaaacgtgaagctttaagcatgatgattctcagtctccaggagatgctaaataaatgctaccttccttcttgtctctcttttgttgcctgatctctcctcatcatcacgacagcatatctccccactgatcgactgtaagatgccgtattgatttattaacagctgttatttatttttggcaaggttggtgtgtgtggtggggacaaatattgattgtacgtggtaccctgatttcagcaatgttagagttcagaaacaaatcacatatcttagaatcgaagggactcagtagcattttcaagtggactcagaagcaatgttgttcagaaaaaagaggcacaggtcagggtcttggtagcacttggtttgtctgttgtctggggatgtttttctcccgtggcttctaggacacaattctctttttctcttaccttgttactgatgtgttttttctccatcacctttgctggatcctcctcccctttctgccttcatgtggaagtgccccagggctcactcctgagcccttttcttctgtgtttgcataatgtcctccgatgatccaatcctgtttcttggttttaaatatcatctatacacgggatgactcccaacacttttgtcttgatagcttcacttggacatcttagacactcctcaagcataacataatcggaactttgggtcttcctctactaacctgcttccttctctgtgttccctttttcagttaacggcacccaggggctcaagccccaaaccaaagagctgtcctggacttacctctctcacatccatcatttgaaccacgagcaaattctatcgatttcactttcagaatatagccccccacctctctctgtctctgtctctgtctctctttatgtatatgtgtgtgtgtgtatatatatatataaaactaaagctcagtgccactcacaaagctgcagatgggattttacagtgccagcctagccccagatgtctttaacttccatctagactgctacggtgccttctaatggggatcccaactcccatcctcaccccctagaagccacacagcaggcaaagcaatctttaaagacaaatcagatcatgtcactcctgattccaagtcctgcctggaaagattggtggactggtctatggagaggacaaaagtattatttcataaatgtttacaatgttttatactttatatatttttaaggcaaacttagttattttgtgttaatttttattgatgaatatcggattatgtaaaccaaagattcccggatgcctggtatgacgcctggcacaatagcaggtgtgcaatcaaagtttttttttttttttttttagacagagtcttgctatgctgcccaggctagaatgcagaggcactatctcaactcactgcaaccatgcctctcaggttccagtgattctcctgcctcagcttcccaagtagctgggactacaggcatgcaccaccacacctggctgatttttgtatttttagtagagatggggtttaccatgttggccaagctggtctcaaactcctgagctcaggcaattcgtcacctcagcctcccaaacttctgcaattacagatgtgagccaccacgcccagccaataaatggttgttgaaaggatgaacaagcaatcctgactcagattctaatttgtcatgtgacctggaagtgtctctttttttctctgggcctgagttttctcctttggtaaagtgattgctgtgatccatgatgcagcctgatattttctttctcttctctttcatgtaagaaatggctactcataaatgaccaaaatgatttcatgatttgctgatgtgtgtagatccagtggaaaacgttgtctggccatgtcagagctgccaggctctgcagattgctgagagcaggccgcgtgttctgcagatcggagaagcactaccatgcaatggctctggagccagaacctggcgcttctttgcagtgtgattgcaggcgagtcagccagcctctctgagccctggttttctctgagccctggttttctcatctataacctggggagtctaacatttttctttgacagccagggttccagctgacctagtatgatgcccagatcaacagctaaccttcattgtgtgtttactgtgtgggcttactgtgccgtgtgctttacagaattggttcagtggttctcagccctggttgcatatttgaatcatataggtaaaaaatgtgaatgtccaggctccacttgatataggtgaagtcaaaatttgtggggtcaaagcttgaacattggatttaaaagctccccaggtgattcaaatgtgcagtcaatgctgagaatcattgtattaagtcaatcaattatttatttatttatttatttttgagatggtatctggctcttgttgcccaggctggagtgcagtggcatgatctcggctcactgcaacctctgcctcccggggttcaagtgattctcctgcctcagcctcccgagtagctgggattacaggcatgcgccaccacgcctggctaatttttgtgtttttagtagagacggggtttcaccatgttgtccaggctggtctcaaactcctgacctcaagtgatccacccacctcggacccccaaagtgctgggattacaggcatgagctaccacacccggccaagtgaattcattcttaaccctatgtagtaggtactaatggtatgtacacctgtgttttagttaagtaaatcaaggcacagagagttaatttgccttggcaggcattcaaactctagcaatctgtcttgacagcttcacttggacatcttagagagtcctcaaacataacaaattcagaatcaaacttcgggttttttttttaagaaataaatgttttattcttccaactaaatttcagtactacaagggcagtaaaacagtgatacactagaaaaaaatgcagcaataaacatttgtttaaatggctgatagaataaataaaactaccaaaaaaaatcctataaactcattcagaaatcccaagaagtcctggaatacagaaatgccctcctccatgactatttcacaggatgcactgcaggctatttgctcaatattgtcctgggattactttcttttttgagatggagttttgcttttgttgcccaggctggagtgcaatggtgtgatcctgggattactttctaaaattaataactgcttacagcttggttgtagcccacaattaaaatcacattaacttcatctgaagttagtttgggaagacgtattagaatgagcattctgctggtaaggatgccgtagagcttgaaagatttggaggctggcctgaggtcactcagtaaggttttggcagagctgtggggctagaactcaggaaccttggtccttgtttaggcaaattgccactgcagtgggctaccctatttggtcaagtataacataccatcagttgtgagatgctgctgtgggagggatgtgacatctgtgaagaatgtatggcccattctgctccactctggacttccttgggctgggaggatgggggctggtgctggggagatggggacccacatcagggaggcaggttgaagagaagcaggcccctctgggacccacatttcttcctgctgccttcgtcaccaggctgaggttgtgttggctttggcatggtgctttccctctattccactattagaattaattattattattattattattttgtagaggcagggtctcactatgttgcccaggctggttgcaaacttctgggctcaagcaatccttccgtcttggcctccccaaatgctgggattactggtttgagccaccgagcctggcctttattagaattttaagcagctaggcgcagtggctcacgcctgtaatcccagcactttgggaggatgaggccggcagatttacctgagttcaggagttcaagaccaacctggccaacgtggcgaaaccctgtttctattaaaaaaatacaaaaattagcctggtgtgatgcctgtaatcccagctacttgggaggctgaggcaggagaatggcttgaatccggaggcagaggttgcagtgagccaaaatagtcccactgcactccagcctgggtgacagagcaagactctgtctcaaaaaaaaataaataaataaaagaattttaaaaaataacacacgtgtattacttttgtaataataatgatgatgattttaaaatgtcccaccaacctcaatgaagtgttaggaagagaggtaatgaaatagacacgaaaagcccctaataccaggctcatagaagatcttaggccaatatcaagaaattctagacatatctttcatcttctcatcccaagaagggggttggcatgggaaaggggagggtgacgagccgagcagtgccacttcctctcccctgcacaggtcctgcaccagctccctgccttttcttaggtggggtcacctgccttttttattttattattattattattatacttttaagttttagggtacatgtgcacaatgtgcaggttagttacatatgtatacatgtgccatgctggtgtgctgcacccattaactcgtcatttagcattaggtatatctcccaatgctatccctcccccctcccccaccccacaacagtccccaatgtgtgatgttccccttcctgtgtccatgtgttctcattgttcaattcccacctatgagtgagaacatgcggtgtttggttttttgtccttgcgatagtttactgagaatgatgatttccaatttcatccatgtccctacaaaggacatgaactcatccttttttatggctgcatagtattccatggtgtatatgtgccacattttcttaatccagtctatcattgttggacatttgggttggttccaagtctttgctattgtgaatagtgccgcagtaaacatacgtgtgcatgtgtctttatagcagcatgatttatagtcctttgggtatatacacagtaatgggatgactaggtcaaatggtatttctagttctagacccctgaggaatcgcccactgacttccacaatggttgaactagtttacagtcccaccaacagcgtaaaagtgttcctgtttctccatatcctctcgcctgcctttttaaggcagcagcacatggtgtcccagggatgggggaggggagagccctgctcaggcgggctgtggctttcccatctccacacttacgttgactcagtttcctttactagaatgcccttcccgcacttccccttgttgcaattcattcattcatttattcattcatgcaacaagcatttatgaaacactcacaaaggaccagatattagctatcaggccccaggcatgagaatcatcgtgagtcatgggtcttcctttaaagagcttggaactcagaagaggaaaacagatgtttgaaccagtgagtgtgccacagcggtgcaggtacacggatggatggatggggaaagtgttagcgggcccttctgtattttattttatatttttagagacagggtctcgctgtgtcactcgtggagtgcagtggcactatcttggctcactgcagcctcgacctgctaggttcgagtgatcctctcacctgagtacccgaagtagctgggaccacaagcctgtgccaccatgccgggctaaattttgtatttttttgtagagatggggttttgccatgttgcccaggctggtctcgaactcctgagctcaggcaatctgcccgtctctctgtatttaatttccttatctctaaagtggggagggtagaagtgcccttctcatggggctattgtgaaaactgaaatgagttcctgaatgtttcagagcgctcagagcagcaggagctgtatcagtgccggcaggccctgggacccgccactgctggaaggcagtcgctttagaggctgggtctcctcccactggcttctctacctggtgcctccagcaagttattcatttttcttttctttttttttttttctgggctcacacaaagcgttcccaaaccctgtgtacctggtggatccttctaaaatatttggtggaaggaataaacctctctgtgccttagtttcctcaaccggacagtgaagaagatataatatgccctctatacttcatggagctcttgttgaaataacatgagagtggcattaaccctatgaaacagggagggggccaggatgttctaccattttacaaaagagaaaactccctcagagatgtttagtgagctgtctaattttgcacagccagcctgaggcagttggaaaatatttctctgaactttgacctatagtttcccttccctcctgcgcccttctatcccccaacagataagccatggacaagaccgctttctagtttcccctccagggattctgtttccttcctttggtactggtaaggaagcttgggtaaagtggctggcactcaggcagcctaccagagctcagtggctttctcccagcctcccatcagatgcctgaggccccctccctcccccacacccctgggctctttttcgaaacacatagaaaagggtcaggaagatgggttctcttcgggctagagatgtttactgggtcaggctgatggattgcaaaatggagattgggcaagggtacagagggcaggacccaggatctcagggctatggttggaccccagcagaccctaaggccatggcccagtgccctgtcaatctaggtgataggtgttcctcagatcccatcacttccgagggcagcgaagctctgagggccccttagagcccacagcccaggtggttgcggggcttgaggcacatacagcgacgcctggcatctagtgagtgctcgcccatgctggctcccgtcattaccgagttctctggctggcattgccatccaccagctccatcagaacacggcccacctgcacccgggcgctgcctccctcggtgactggtcccaccacgcacccacgggagggtaaaactggctctgcggacatcccgacatcccgacatccccacatcccgagaggggcagggggagctctcaggccctaaaatagctgctgagcaagacttggcttctctcctttgggttgagagtttacccggctttttggagatgctagagtctacactgagcaggtttcagcagtcaaatgtgtccctccattccaggaaccgaggtgttggaatggtagcaatggacatggacaaatggtggaagcaggaggcggaagagaatccgctcagaagttaagaggcctggactctcacactgatcacgtgactcgcaccttccgtttcccagaatagcggccacaattcctgcagaatccctcctgaggggtcttggaaagatgcaaatgatgtaatgagcagaagcaggggattgacttccaagctctgccacttattagctttgtggtcacttacgccctccgcaagccccagtgttttcacctgtacaatgggggattacaataccaactgccagagtggatgcaggtggcgtgcagactctaatcacagcagtgaatgcaagaaggaaggtggaaggtggtggcgaggtcctgaaatgggcgtccatgtggacttgcacacaccgtgacaaccccagaaaatggttagtgttttacactctttcatctggatttaagagccagtcgagcatgaggtgtcactttgcagtgtgtttaggagtctccctggtgagactggtgtagcaccagacactcaggcaaatgctgcccagtaaaccacagtggtcaagaacgtggattctggagccagactgcctaggttcaaatcccggctttgcctctttctagttgtgtaacattgagcaagtcacttaacctgtctgtattttatttcctaatctctagagtggggagaggagcagtgccctcccctctcccatagggctgttgtgaaaattgaaatgagttaatgaatgtttcagagcacttggagcagcgagttgtatcagtgcttcgtaagtaaaataaatgacaggtcatcctgggcccttcctcaaggcccagctccctatgtctagcgactatcagggggtgtagacaaggagaaagtagcttttattatttatttatttctgagacagagtctcactctgttgcccaggctggagtgcagtggtgtgattttggctcactacaactgctgcctcccgggttcaagcgattctcctgcctcagcctcctgagtagctgggattacaggcatgcgccaccacacctagctaattttttttgtatttttagtagagacggggttgcatcgtattggctgggctggtcttgaactcctgacctcaagtgatctgcccacctcggcctcccaaagtgctaggattataggcacgagccatggcacccggacttattttttatttttatttttgtagagatggggatctcactgtattgcccaggctggtctcaaactcctatcctcaaatgatccttctgcctcgacctcccaaacttgggattacaggcgtgagccactgtgcctggccagaaagcaggcatttaatcactgttatcctcaaatggttaggtgagaaaaagggaggaaggtagaaatggcttgcctactttgggctttaaagaagtgaggtctgtttcctgcacctaccactttgggaaatatttgttttttggcagcaggtaaccagaaaccagagctggtcaaactggggcacacacatacacaccaccctgccccaatctctggtttaagctcttctggccatctgttcaggcagggtgggaaaactttcacaaagcaggcaggtcccaggccccccaggccccaggggctggccttagagtccaaagacctgattctggttctaggctagctttggtcctgagacaatgtcctcaaagctctctgagcttccgtctgccctttggtaaaatggggattgtcattaacacaccattggagataacagatgcaaacctgttgtaaacaggaaatctcagtatgctcagaacggtgggtaaggggttatcggtgagtagaacttccagggcaccaggcaactgtccgctgtgagatttctgcacagcctggcctctggaggtgtccaaaccttcagctgctggtgttgaggctcaggaagcctggcctctggaggtgtccaaaccttcagctgctggtgttgaggctcaggaaaacctcacatgctggaacttggcaggcagatgactggccatgggcattgttgggtgaggccatacccatgatctgcagtcaggagacctgagttcttttctggatcctgccactgtgtggctttgggcaggtcacttctttgagccccatctcatcttctgcgaaatgagaggatggtggcaggaagcaatgcagtctggcaagatataggccaacgaggtaatatatgtgaaataattttgcaaaccataggggttacagcatggaaatagccctggtcaggagtttgggctctagccctgcctctggagcaagcatgatgtgtgactttgggcaagtcactgctcctctctgagcctcattttcttcatctgtaaactgagagtctgggactatatcagtagttcccaaactggatacacgttagaatcaacctgggccaggtgcggtggctcacacctgtaatcccagcactttgggaggctgaggtgggtggatcacttgagtgtaggagtttgagatcagcctgggtaacatggcgaaaccttgtctctgcaaaaaatacaaaaattagccaggcatggtggtactcgcctgtagccccagctaattgggaggctgaggtgggaagatggcttgagcccaggaggccaagcctgcagtgagccatgatgcaccactgtactctagcttgggcaacacagtgagaccctgtctgaaaaaaaaaaaaaaaatcaacctgagaggatggatataagagatgctgatgcccccactccatcccagaaccacttaatcagaatatctggggtggggcattttataagctacccaggtgttgccagtgtataaccaggattggggatatctggtccaggtgatacaggaggttccttttggcttgagcttgtttgatttctaggaagttcttggggtatagagttcacagatgcttccaacactggggccaccatcctcctccctgctgagaatgataaattcctgcccaaccgtggagcctatgatctcaactctggctgtgcactagaatttcctaggaagcttttaaaaaccttccatgactcaaccccacccaaagcaagttaatacaatctttgcggatggttcagccctagtttgaaaaagctccccaggtgattctaatgtgcaaagtggcgaaccactgctttgagaacagccaatgagccaagaaaacagacagccctccgcctggccccttccttttcctcctcagaatgctcatagtctgatgtgggttgtcgacttccttaccctggacagtgtgctctgagtgaggcacatgtttaatggctaagatcatggactctgaagccaggtgggtttcagttccaaccctatcatcttattagctgtgtaacttaggaaaaatcatgtaacctttctaagcttcagtttccctatatgtaaaatggggacagtatccacctcatggagctgtggggattgaatgggttcacgcacagaaagtccacagaacaaggcttggtccatggtgagtagcagctataatttgagagagggtgtgcgtctagttcatgtccagaccccaatgttagagtctgatagctccaacaatgatctggatttaagattggatttaacaggaacctatgtgtaaaagatagataggctcatgacccatatttctagatatcctgcctgaccttatttcccataaagtttgtttgctaatcctgcagttattaatcttggttgtggatcagaatcactgggagaacctttgaaaatgtagattaccagcccaatcccctcccacttccccatcccaatcaaaattcttattcagcagggacgtgggatttggacacgctcctcaagtaactttaatgttcagccagggctgagaaacacggcattcaatatataacttggtatgagcctgttggttcacctttgtccacacattcatgaatcggagggaagacctttgttagtctgggactgtggattgttgattcagaaaatataactttaccagattattttctatgctgggaagttttccatggaggcatttatacttttttgccttgcggtagcttgaaaactgtattttttggcaatttctatcaagaggcagagcctgtttccttcttcttgaccctgtgctggtctcgtgagttgctctgaccagcaggttctgtggctttcaactttttggaaggctctcctgagaccactatgtaagcgaagcatttagcagactggaggatgagagaccatgtggaggagagccaaggtgaccagccaatagctagcactggagtcatgagtgaggccatctttcactttctgaccaaagtcacttgcactgaccacccagcaaagtacagccatgtgagtgagaccagccaaaatcagcagaaaaactgtctggccaaccagcagaattgtgagaaataagaaatagtcattttaagcgagtatgtttgggtttgttacatagtaatagataccagaaatagaccttatccacccctttcaattcctgatctgtatcagcaggaaaggtagccagaataaggggtaaaatggatgaaatggaaaacactaactctctcaaccccctaggggttgaacctgtgtcccagcttagcctaagaagctacatagccccagatgcccatgtgtggataactgaggccaaggtgatgcagacctcacctgcctgttggtctttggaagcctcattttgtaggtgacccgaggctccaactgtcctcagcatcttctgtttgcatttgtgacaatatccgttctgtggcccttgggtcttgggaaaacatggcgcaatcataaatgagttaaatgctatctgatcataagccagagggcctgttttcattttcaaaactccgtgtgtcagtggctgtaatgcaatgtccagcaatgtcttgagcaagtgaccggcaggggacagaggatgctgtttactcaagatagccccatcacgcaaaagcagcttgcctaaccgggtttgtaagcgattgttacgagaccaccgttgcaacagggattgccctgggtgatggtcccaggaaggggctggtcccctcaggccagatttggggctatctccctctttctggagccctctgggaccctgggcctctggcaaagagcagagaaaaagcattgttgggaaatcccactcagatgtggagttgtcctcctaaggaagggtgccctggggagaagggcttcatgctaccctgagaggagacagcctcctgtgtcagaggaggctggaggggtggctagggacctgcagaggcggaggatggtgtggtatggttgctgagcaagaacatggtgactcggggttttgaaaggcttggtctgggtaatggttctgagtttgggagtggtcattgtttctccagcaccaaaattatggtgggtgggtgatcacatgcatatggctgacccctatgggtattttcctgaaggtcaaactattaaatcctttatcctttcaccccttccctcttggcgaagatctgagttacaaccaccgtcaccaccaccaccaccaccaccaccatcaccatcaccatcatcaccaccaccatatccacctctttatctgaacagcttcttaagatttaaaagctctttcacatggtttctcaattaatcctcacaacaactccaagagataagcatcacgacacccattttatacctggtgaaatcgagactcagagacgttaaatgtctgacgcaagactcttggtcagtgtgtcccatagaaatataaagtgggccagaaatgagagcggcatacataatttgacattttctggtagtcataattaaaaagtaaaattaatttcaataatatattttaacctaatagatcaaaattgttatcatttcaatatgcaatcaatgtaaaaattattgaacaattttacgtactttttcatataaagtctttgaagtctggggtatattttgtacttatagtacatctcaatctggactagtcaattttaagtgctcagcagccataggtggctagtggctgctgtgttggaagacacaattctagattttttttttattattatacttttaagttctagggtacatgtgcacaaggtgcaggtttgttacttatgtatacatgtgccatgttggtgtgctgcacccattaactcatcatttacattaggtatatctcctaatgctatccctcccccctccccccaccccacgacatgccctggtgtgtaatgttccccaccctgtgtccaagtgttctcattgttcagttcccacctatgagtgagaacatgtggtgtttggttttctgtccttgtgatagtttgctcagaatgatggtttccagcttcatccatgtccctacaaaggacatgaactcatccttttttatggctgcatagtattccatggtgtatatgtgccacattttcttaatccagtctatcattgatggacatttgggttggttccaagtctttgctattgtgaatagtgcctcaataaacatacatgtgcatgtgtctttatagtagcatgatttataatcctttgggtatatacccagtaatgggatcgctgggtcaaatggtatttctagttctagatccttgaggaatcaccacactgtcttccacaatggctgaactagtttacactcccaccaacggtgtaaaagcattcctacacaattctagatatttttgtccttcctcaaagcttctctgctcttccataatatgcatcatattttctccatttctaaaagggggtgtttgggccaaggagtttccaaggtctttttcagttctaaggttttctgattccagagcaaagccagaattctgcccaggctccgcttagccccatgacacagagggtcccagacatatggagaaagaactgtgaaaacgtcttcacactagaagtttgtgtttcttttcctatggtctacaggggcaaacagagacagatacacagacatggacaggaggactcctaggctcccagatacagttgcatgacccacaggaacaaagacacagacacagcgcccaggggagtgttctgagcatgttctttgtgttcttgcatgtgtaaccctgatgttgaggggagtcgtcctgccccttaagggccagatgaagttgccacagacaccccaaaccccaactccaatccatctcctccatttgtttcttttatatgtagatatgcacgtgtgtgtgtgcacacaagtcaccctctatgtgtggatattgggtcactgcagaagaagtgtttctggtccgggcacggtggctcacgcctgcaatcccagtactttgagaggcccaggtgggtgggtcacgaggtcaggagatcgagaccatcctggctaacacggtgaaacccgtctctactaaaaatacaaaaaattagccgggcacggtggtgggcgcctgtagtcccagctactcgggaggctgaggcagaagaatggtgtggacctgggaggcagagcttgcagtgaactgagatagcaccattgtactccagctcaggcgacagagtgagactccgtctcaaagaagaaaaaaaaaaaaaaaagtgtttctgaccatgggctgttgttaagcaaagtttgactgtcccagctcaagagacctcatggcctctggccagccacctctgtgactgtctcctcagccactttgatactgcctccatttctccaactgtcaaatgatgtttttgttcctcacagccaatctcgcaaatcctgcatttctctctctctctcttttttttttttttttttgagatggagtctcgccatgtcacccaggcaggagtgcagtggcgcaatcttggctcactgcggcctctgcctcctgggttcaagcgactctcctgcctcagcctcccaagtagctgggattacacgtgcctgccactatgcccggctaattttttgtttttagtagagactgggtttcaccatgttggccaggctgatctcaggtgatccgcccacctcagcctcccgaagtgctaggcttacaggcatgagccaccacacctggcccaaacccttcatttctttgctcttgacactacagagctctcccaggatttttttttttttccttccacgtgcaacctcatagatctttctttggtctctgtatgtcacaaatccccaggaacttcaaactttaggagatgctcctgaagattttctgggctttttcctttccctcccactgcacagctcctccctgattactgtagaccctccaggtccctcccagtctcatcttgcctcctgagtagctatcaagggatttataatcacttcagagtaccttgccaaaggtcatgcaactctgccctggtctgctctggtcttcctcccctctcttcaaggcttcctggtctgggtctgtgcccggcggccagttctccatcagcagggtagagctgtgtgtggagtaggttcctccctgggtaacaggtaatgtggacagatagaaggccaggatctggatgcaaagggcagagtgactggtggtgagacactgtgctgtagagtggtgggaggggctggtccgagcctttcgcccattccaccccaagggcagcggcaactcatgctatcttcagggcaggctgttaattaattatgagggactgtggccttagaaagaagggtgctgggtctgagtgtctggacactttctccagttcccttgcacccatctaagtgagggagcctggctcagccacttcagagtcattggtcaccctgattagctcaccctggatggaggatgttccctgagtgtctcttcttggcccctggaggcattgcctaacaccatgtttgccaaatgatccacatggtccagtgttttgaaatgaagtttttaaagagaaggcaaaggcaatttttttggagggggtgggtggttgttttgttttctttgttttccccatagagcagaatttctttgcatcatgagagagttgtgtgatctcaggtagataaatctgtcctaactcagaaaggagaagtgtgactagactctcaccggccttcaggagacgtcagttctcttcccaaagtaattgcatgatggtgaaagtggtttctgaagctcagtttatgaagtggagagggcgagggaagaggctactgggtcctgaatggtgaggacttgtaaaagggcagcggctaatagaataaatgcttcaaccagcattaggattaggggtgggtgcacacagtggatgctggcgttagggtgggttgttcttgggggtgtagggagtgggagagtgttacatggggcaatggtattacacagtggtgttcaggtgggacttggggtgtatgtgtgttttgtttggggtgtagg

SEQ ID NO: 1399 - DNA, 69740 bp, Homo sapiens
gagggacttctagagacactactgaaaatattccaccacctctagtgggtggcagcttagccaaatcttttcaatttaggaaaaaaaaaaaaaaggctgattcttgcagcaaattcatacctgcaacagaaggaataactaagacataccctatacttaaaaaacccccgcttttttgcaattatgtactgagaagcaccacacctgggagggcaatgagtgatattttgccaggtttatggctggaatcatcctccccatgactattctcagactttgtccatcagtgtaggtgcctagacattctcagcaacctaagaagatttaattttccccactcttcttctgaattattttctactctctagaaattgacatgcgaacaagaatgggtacatatgaccaaggagaatggagatcttttaaaggtatatatttgaaaataatgagaaaggatgaagagaaagcaaagcacaaaggtcaagaagatgaaacagaagaggaggatgagaagagtagaaaagggaagtggaggaaaaggtgaagagtagaaaggcagaggaagaagagagggaagagaggctaggccaggtgctgtggctcatgcctgtaatcccggcagttcaggaggctgaggttggagaatcacttgaggccaggagttcaagaccagcctgggcaacatagcgagaccccacccatctctacgaaaaatttttaaaagattatccaggcgtggtggtgcatgccagtagtcacagattcttgggaagctgaggcaggaggatcacttgagcccagtttgaggctacattaagctataattgtgccactccattccagcctgggcaacagtgcaagaccctgtctcaaagaatgaaaggaaaggaggggaggagaggggaagggaggggaggtgagaggagaaggaaggaagggaggcagggagggagcgaaggagggagggagagagtcttagcaaatactatatatgcttgaatatacagagctcctctcttccattagttgaagaagccccaatagtatatttcggccaatttggttaactaaatttttatagacgtaagtgtactaggcatatgtctccttataatattaatttatgtagtgacacagacacatttaaaatcactttaaaaataatatacaaatctataaatattgcttgttcttactttgacatttcatttagtaaactttgtacattcatttttgacagaagtatctttgttatcaatagagccactttttgagtcatcctatgctattttcaggaaggacattcaacattaaggtttataactcaggaatgatgctttgatgctataagcagcagagaaacctgccatagctcagaacatacctgagaatcatccagtgaccctcacaggccaggagagtccaggtgggacagatctcacaacaggcacagtaaaacagagtccatctaacaggtagattgggatctcatcatggcaggaaatatgagtcttttatttaacaagcatttgattgctccatgactggcatttttttttagacactagggaaactttaataagaagcaaagatgacaatctctatactcatggagattatgttctaacaagaggaagaaaacaacaaaaattaataagtaaagcacataaaaatttagatagtgataaatactatggagaaaaataaagaacgggccacacagtctctgggcccttgaaagaagcaagagaatgcagaatgcgccatgttagtaactggaggaacagtgttttaggcagagggaacagcaagtgcagatgtcctgaggcagagccatgctttgtttgaagaacagcaagaaggtcagtattgttggtgagggtaagtggagaaggagatgggtttagggggttatctgtgagcctgattacagtgtcttggatattgcgaagacttctgttttttctctgaaggaaagggattgtgagcagaggggtgggtacgatctaacttgtggttttacagtatcattctggctgccatgtggggaatgaacttagcggggaaaatgtggaagaaggtagaccagttaagagactctttcaataatctgagaaaaagtgctggtagcttggaccaagaagtgggcagtggaagttgtaaaaagcagtaaagaaggtggggaaaactagcagagcccacatgcagagccagaatcagaatcataactgttgagtcaagggcaacttgaccaacatatgaaagaaaacccagggtcagtgtgtcagaaaccccgggaatccactaacatcaacatcacctgaagcctgcagatatcacgccccactcacaaccctacagccctgatatctctttgtacaccttgtatttgaaatgatccaggcattataaaaaatgaaaatgctattttgagggaagagggacctttaccattattgaagccttgagaattggaattcaaattgccaatcactgtcttctgctaaacatttctaaaaaggagacaaaaatgtgattccacagaacactgagcattatcattcattgaatctgtgagatttgtgaattgacaaaactaaacacacgcagtggacggaaatggggaagagctatgcgctgatacttttaaatgccactgtgtttcgctatgaatgtttctaattacaagacaaacagaagtgtgcaccggaggaggagcatcagccaccagatggcactatttccctgaaatacccaatggtacccaaaatcaccaggatggcatactctccaggattctgcaatactctccaggctagaaaggagagtctttcattattattaacatctcttctaaagtcagggtctagaaccacagaggcaaaggttctgtctgttctgaggcaattcggttcccctggcacaggatggcctgaaggattctgtttttcccaacaaagctctcaaaagagtttaatgcaggagctcttaatccctatggcagtctggtgagacttctgaactccttctcagcattgtgattttaaatgcaaaaaataggatgcgtaggattgcaacggaagccagttatattgaaaagctgctactggaatatttaagcaaatgcaagacatagtaatatatgtgcttttttatgaatgcagtaaataataaaagccagaggcaggcctcctatccattgtaatcttgaaatagcaataagcaaaaacaatatctcaaaatatctgcaacaactataatatgatgttgtggcttaacaatcatattttataaactataattttacttaaaagttagtaaaaaaaaataaaggtgtattttcttttcccttctctctctctctttcccttcctcctttcttatgttcctttaaaaaatattttcactggccaggcatggtgactcacgcctatagtcctagcactttgggaggccgaggtgggcagatcacctgaggtcaggagttcgaaaccagcctggccaacatggcgaaaccctgtccctactaaaaatacaaaaaattggccaggcgcagtggtgggcgtctgtaatctcagctacttgggaggctgaggcaggagaagcacttgcacctgggaggtggaggttgcagtgagccaagatcgcgccattgcactccaacctgggcaacagagagaaagtctgtctcaaaaaaaagaaaaaaacaagacaaacaaacaaaaacaaacaaaaaattatatatataatgattatattattataataatatatttagaatatatatatttatatatatataaatatatatatatttagaaactgtttctgtccatgaacctcttgatttctgtccatgaatctcttgaatattggaagaccccaagttaataacctttggttcagtgcctttttaatgactgtatcatacatttttgccaactgaagaaagtaaagcctccctcaagctggccacactcaaagaagaaatgagttaaagagattttttttttaagttacattttttttaaagaaaagatcaggtgcagtggcccacacctgtaattccagtgctttgggaggctaaggtgggaggatcacttgaggccaggagtttgagagcagcctggccaatatagccagaccttgtttctacaaaatattaaaaacttaacctggtgtggtggctcatgcctgtagttccagctacttgaggtgctgaggcacaagggttgcttaagtccatgagatcgaggttacagtaagccatgatcacaccactgcactccatccagcctgggcaacagagtgagaccctgtatctaaaacaaaataaaaaacaacttccaccccccaaaaccatctgcattttatactgtctctctacaaaatgtttgttgtgggtcatgagcaaatttctattgctatcaaatagaatacacatatttatatatatatgtagctaaatatttatatatatatatagctaaatactctagagactgggataaactataaatataaatataaatatatgaggaagagaagaatacgtgttaactaactttcaatagtacaaatgaaagtaattttgttattaataatttaatttatttgtaaattgtctcactttctcatcatgaacaacatgggtaagaatattaatcattttacctttgtgtctcatggcccaggcaaatcaaagttgtagtttactgagataatatgcaaatgagatcatggaactgctgctagtgggacttttttaatctcatgggtaacaagagactgcaagcaagaacttcacatcctttacattttctaagatgggaagaaaataaactctacaaactgcatattggggaactcagtcttcgttcccaagaatgtacgaacctggaaagagacgctgatcccagtaggtggcgccagcaagcagtcaccaaggacaagtcccagcacagtcactccactctttttctggagcttactagactggagtggcgtattaagaggatgtgtgagtcccctgaaaggtgtctgaggatcttgctaatggtatactttctcacaagtgaagagatgtatgctaagcacaaattaggtgaattcagaacatttaaaaataaataatcagccattctcgtatcttattagtttgtaagatctgccatcttctccttttttctgtgggaaaccagtcttctagactcacactggcatatgaacttgttttcatcaaatgagttaataggaatgggagagttgatttaggaaattttgggctacattgagggaagaagttgaatgtcttgaatcaaagagatgatgcatttactctcttttgggtgaggcaaaccaacctggaaagttgtactctgtttggaaaatcacattttaaaattagatacagacaaattggaacacctcaagcagagagttaaggatgctgacgattcaggatatgtataggaaatagtacaaaggatttgagatgtttcaacgtgagaaggagcgtgggtcatgacagggagggggataaagcgtgttgctcacaggttggggctgacacatagaagactgtacaatttagacagtaagtgcagtcactagtctaagaccacaaacgaaggggaaataattaggttcaacagcagaagagcattcagtcacaaatgttctaagaggaagatatgttagcatctctagtagtgagttctaattcatcagaagtatgcaagcataggcaagccccagttacaccttttatggatttggggaagaagattcaagtattggattagtggtaggtaaggtcaaagtttctcatacaccaactagtctagggattgatggtagtttattcaaaaatttttactggctggtgcggtgacccacgcctgtaatcccagcaatttgggaggccaaggtgggtggatcacccgaggtcagtagttaaagaccagcctgaccaacatggtgaaaccccatctctactaaaaatacaaaaaattagctgggcgtggtggtgggagcctgcaatcccagctactcgggaggctgaggcaggagaattgcttgaacccgggaggtagaggttgcagttggccaagatcgcaccattgcactccagcctgggcgacaacagcaaaactccgtctcaaaaaaaaaaaaaaaaaacaccttttttttttttttttactatgttcctggaaagaaataggcagcatggttcacaaatctaaatttattcaatgtaaagggctatcatttattctaaaattatttacttcttactttgtgagggtgacacgccttttctttgtatgaaataattgttggtgatagattgtagtatgtttgtaaatataccttacctgttggaataaagtttggaaatactctattgaactctctaatttttattgaaatataataataaaaattgaaatgtaaaaaattaaaaggtcacttatcttagtgatctttaggctcctttcggtcctgagatgctgtaattctaggcactaattattcagcatcgttaaggagtgagagtctcttccatttgatttgtcttcccagtcagcctggagtggggctggcacatgttaggccctgccttccttgcgcactccttctatgctcatcactgtctggcttctcttcacacttttaccacataagtgtgtatccctaaatactatcatttatgctttgcgtgtatttggcctttataagaacaaaatcatagaaaacgtgtccttttgtttctgttctcttttgcccaacacttgaaaaaagaagatcgatctggattgtcgtggatagcttttattttgcggcgaaatatagccagaatatagcacatttatcgattttactttgatggacaccttttctacttttggctattttgaataatgcttctccaacattcttattcatatcccctcatgcagagtagagaagaactgataagtagaatattttatattaaatataacctttgtgaaaatcaagtatcctttccatgcacaacgactggcccaatccttattgcccaaaagggacccatgattgaaattctttcagcctgttcacaaaaccagggaacacatatccaaaagtatcaagtatgttgttggaaatatgaagaggtcaatttgctgattttccccctacttcagatatgtctgcctgaattgggtcagtctctctctctcttttgttttcagggttcagttgttttttttttcttttaatgcttatttggaaaatgactagcatatacgaaaaaggtacaaaaatatacagcttactgaattagtgtaaggtgaccatctgggtaactaatgctcatgtcaagaaataaacaacattttcagcaccctaaaagtccccacaggagtctcctggctgttctttgctctttacttttgtattgaatcttcaacaattaaacatagatttatctggtttcattcttttctctccttcctcttccccctaactgcttgctactaggaagtctttttatctaaatttattttataacagcatacttgcttatgtaattcctgttactttctttcaggctcaaaaaatctggtattataaaaaaattattctctcaaatttttttagtaaaaaatgtttttttctacatatttaatagggtagaaaagagaatggagaataaatgaacttaatggatcattcagagtaactttacatgtcatgtgaatttaaacaagatgattaaaccaggagagcaccagaatgccaccatgccttcagctttatcacagctatgccagtctcattattggtactggtcacctcttccttctctcctcccaaagtttcctcccctatttggtaatatttggcctcttttctatatataccaagtacacttattccttttcttctaagttttctatcaagtccccatttcagatattacactaaaatctgtatcaatgataagacccacatctctcccaatgatacttgcatttaaataattatcaaaaacatccaacggaattttataagctctaaatagtatttatatgcaggctttatatgaaaatattgatgtaacttaccgttaagaaaaatggggtaaattttgcagaagagagacctatcccatgagtcaacctttaggaatgctacactgaaatatacaagctgagcatccccaaggaaatcttgatagatacaaagaatatggagattaatcattttattctctcaaacaatgtcccaaaagacaagagagaaatctcttaaacataagaaatcacaccaggcctagtggtaaagaaattttaaatataaatcatattaatacacttgatattgtaaacatttctaacaacagggaggcaggagtgtgatatggcttggatctgtgtccctgcccaaatctcatgtcaaattgtaatctctaatgttggtggggcgggaggcggggggcgctggtgggaggtgggtggaccatgggggtggatttctcgtgaatggtttaacgccatcccctcggtgctgttcttgtgatagtgagtgagttctttcaagaccaggtcgtttaaaactgtgcggtaccttcccccttactttttcttgctctggctcctgccacgtaagatacctgcttcccctttgacttctgccatgactgaaagcttcctgaggcctccccaaaaaggagaagccgctatgattcctgtacagcctgtagaaatgtgagccaattaagcccctttcctttataaattacccagtctcaggtatttctttatagcaatgcaagaacaaatgaatacagagtggaaaggatctacacagggaagatttggttaatgatatattgatgatatcaagagcaacatgtataaagaaaatgtggtaaatatacaccacatggaatactatgcagccatgaaaaagaatgagatcatgtcctttgcaggaacatcgatggcactggaggccattatccttggcaaactaacaacaggaacagaaaactaaatattgtattctcacttataagtgagagctaaatgatgagaacacatggatacctagaggggaacaacacacactggggcctcttggaaggcagaggatgggaggaggaagaggattgggaaaaatgactaatgggtactaggcttaatacctgggtgaagaaataacctgtacaacaaaaccccacgatacagtttacgtatgtaacaaacctgcacttcttctcctgaacttaaaagttaaaagaaaagttacataaaaaaagagcgacatgtaaagctagtaaccaggaatctcagagctgctgcttcttgattagaagtcccttttaaattcgtcagatctatgtagtgggttctagtaatcaacttaatcaccttgggtatccttatcaattggaactttttccctctggctccttcctaacaaaaatctaaataaaatgataaagatttgtggaaggaagcctaggcaccagcttgagatggcctagaggaagcaagattcttcctggtattgtggaagccataccccatcaaccctacttctgagggctgctctgccttaccccttctgtttaggtaacccatgtgtttggccactgacgctggtctggcccatcttttaccaggtccttcacataaatttggaggtcaatacatttcattaagaggaggttgagtttcatttggaaagctggagaaaatatattttacggaggatctttccattttaactgttaaagcccacatctgctcactcttgtgtgttacttgcacaagacctctctacgcatcatcatccacctgctccagagttgccaaacaactggattttggaaattaaacaaaacattaactactcaattattcaggaaagtttcatagtatttcaggaaatggttgtcagactttcaacccaagaaattcatggccagtgtgctagtgaatagagctacaaaagctttattaaaaatttttagctctgaactacatccgactgatggtaaccagagacctgatcggagaagcttaaacagataaggggtatatgttttgatattaaaaaaaaataacagaggtagtcaggataaggcttgtatggtgaccactgccatcaggaatgcagacatcttcctcctttctgcctcaccatccagaaggcagccactcttcttgcagtttagcaaagcctgaacaatgtgaacagttacagtgagttccagagtgggaggatggagaggctttgcctttgagggcaacaagagagaagagttaaggaatatttcccctgaaagagaagaggttggaagtcaatggatgccacatatttttgtgcatatttctgtgtagatttctggatgattagtggatcaaaaggatcttgattcatatttttaaattgctctccagggaggttgtaaagcagcagtccatgagagcgtctatctcactgccgctccttggtgatgcttgccctcatctccctatgtaccccatgcactcatgccttctctcctgttttctatcaagcctcagtttcatgtattacactaaaatgtgatcactgataaaaactgtaactcttttaatggtatttggatttcaacagttgtcgcagacatccaaaattgaccattgtaattgctttacctcatttccagtttgggattaaaaacaatatttcattgctttattttattttaatgtattactagtaagtggattttaaaaatatttattggacttttgcatttctgctggaaattctcgcccatatcctttgcatatttaaaatgtgtagtgttagggttttgtttcatttccaatttacgcaggctcttcttgtgttaaagatatcagtccattgtctaccatattggttacacactgatcttccaactcactgattcattcttcaattatattcatcctattatttattccatctctcatgttctctatatagaatagtatagctttcacttggttcctttttgatttcttcctcttgtttcatgtatctaacatctttaatcttaaacttttttttttttttttttttttttttgagatggattctcgcactgtcccctgggctggagtgcaatggcaccatctcggctcactgcaacctctgcctcttgggttcaagcgattctcctgcctcagcctcccaagtaactgggattacaggcccccaccaccacacctggctaatttttttgtgtatatatatatatatatatatatttttttttttgcattttttgaaaccccatcagacagggtttcactatggtggccaggctggtctctaactcctgacctcgtgatccgcccgcctcggcctcccaaagtgctgggattataggcatgagccaccgcacccggccaagcttttttaacattcattttttattcttatttccacaattctgctgtagatgaaataggaagggagcatctgtgtgagtttaggtgagtcagaggagaggggagggatgagccccaggtggagccctgggtacccacagaaccactgttgatctgtgccatttgctgccaactcactatgcagcttctctggtcagggttgcaccattaaaaacataggaagaaggggccctatgggaagggagactcccctcttcgttgtcagcaatagctccgggattgaaggagagcagaggattactcagccttgtgtctcttttctttcaatgtcttgttcctataaggcttagtgcctgcatccaaaccatcctgtggacactggcagaggaagtgtggacaattgcaggattttttgcagtaaagagtcagttgctctcacacagtgtctaatttacattaaacataatggacacatagttctttttaaagtgaaaagatgatagaaaacagaacacataaaacataaaaagaaaaagaaaaagagtcaattggtggttgccccaagtaacctagggaagaggcctgtgcagaatttaatcagcttttctgcaactcctcttttcactattgcctcgggtcacccttcctctcagctgtagccacccatctatcctagcacaaaacaagacaaccttgtctatttagggacaccttgcattttttaaattactagtttccagagttcttgtttcctcttggttctggggtttctccaggactgattttggaggaaggagacagcagcctgggtagttggtcattttattagtttcctagggctgctaggaaattgccacaaactgagtgggttcacaacagaattgtattctctcacagatcgagaggccagaagtccaaaatccaggtgttggcaggattggttccttctgggggctctaagggagaatctgttccatgcctttgcctcatttctggtgtttgctggcaatccttggtgctccttggcttgcagatgcattgccccaatctctgcttccatcttcacattgcctcttccgctgtgtctatgtcttctcttcatataaggacatttgttgttggatttatggcccacccagataatccaagatgatctcatcttgaggtccttaatttatacatctgcaaagattctttctccaaataagttcacctttacagtttctggtgggcatagcgttttccccccatttatttatttatttatttttaactgtttttttttttttttttttctgagacggagtctcgctctgtctccaggctggagtgcagtggcgagatttcggctcactgcaacttccacctgccaggttcaagcaatttccctgcctcagcctctcaagtagctgggactacaggcatgtgccaccacacccagctaacttttttgtattttttagtagagacagggtttcaccatgttggccaggatggtctcgatctcctgaccgtgtgatccaccctctgcctcccaaagtgctgggattataggcgtgagccaccgcgcctggcctaacttttattttaggttcaggggtgcatgtgcaggtttgttatataggtaaattgcatgttgcagggttttggtgtacatattattttgttatccagataataagcatagtaccgcataggtagtttttcgatcctcatcctcctcccaccctctatcctcatgtctgttgtttccttctttgagtccttatatactcagtgtttacctcccacttataagtgagaacatgcagtatttggttttctgttcctctgttagacatagctttttgggggtggctattgaatccactgttgttgagctgaaaattccaagggcagctggttcacctgtacttgttttcattaattcatcccagcagggcatctgtgttacctgatatactacctttgcctcttgtgagacatgcattcctgagctttggagccaaattcccctagaatccaccaaaagggccttctttctctctcgagtctccaggaggtcataagaactcttattaagaagacatttctcggtctggcttggaggaaagccgtgcatttgtcccaggccctttgaccttctctctcctctgtcacccataatagagacttaatagacatgcctagcagggccagactatataaaaatctataagccattaaccatagctgtattaaactaataagaatcaattcccacacttgctttcaaaggatgctgggcttcagaagtgacatgaaaagtgacagtctgcatctgggctgtgatcagaggggtctggcctggagcagtcagctcctcagagttcacaaattgtctgaccctcaggagaaggctcttggcataaccttaggaggatgattcatcaggagtcgagaagtccattccttaacatggacaagaaatgaagggtccaggaaagattgaaaagggaattagtaatggccaagctcccgaagtcactgggctttgaaaaccctgagttttgctttgccgaacagctctgggttgcattatgcctattgatcttcctgagctttcgcagcctgtaaatgatgagccttttagcgcactccatgactgaagggcacacaactgtgagaacagctcatttcatttttttcaatttatacaaaagatgctgtggcccaagccctctaggcacccatctcaatacataaatatgccaattaagctaaatggagatcctgcaggttaaaagtgcctcataaaagaaggaggctttttcaaagccagaaagtttatccacagaagaaacaccaaatcaacaaaagtggatccatgccaagccatgaaggccagaaaaacaaggcttctgggatccaaaaaagaagaaaaacaaccattagttgttccctagaaaactggggaaaaaataccttttagctgtgacttcaggattccaatcagatgctactattattattatttttttcattgcattttcctgggcagggttgatggttggggtgggtgagtgggagagggaggaaatcagtcctaaagctgaactgatacaaaagtgtctcagttacccaccaaatgtcacaagggcaggtgtgggcaaatcagtgttagttagatatgctatagccttgccactcaagcatggcccatcacactcatgcctggcagccacagtagctgcatcagctggggatggctaaaagtagagaatgcaggccccatcccacattatgttagcaagagactgcatttggccaagatcccctaacgatttgcctgcatattaaaatgccagaagccttgacctacactaaatggccagcctgatactcaccatcccatctctggagaacttatactctttctgcctaccctacagcactgagggagtggaggtctggatccagggaatgggctaagggaaaaagatagacaaatgggtttttgtccagcttttagtcaacttcaactgagtgtaagaatctcaggagatgcttctgaatggatttatatactcagacttgtccatcatacatctccaaatctttgatgatcagcttccaatcaaaaactaggtttcttgggtcatctttaacaccttatttggggtctgaggaaatagcctccactattggagggcactgaggaaaagtttggcagtttagagagcaacagatggtagcaggtgaaaggatttttactttatgttcttggcccttggatgtgcttttgtgtgagccaagaatgttgtatagttcttccaatgtttctcccactactaatactaaaaaggcttagaaatgccacagacccaacaacatcaccaatgttatcaaaaccatttcatgaaactccaagcatctttgctcactcactcagttactccctcagccattgactctgtgagcatttatccattatctacttgtcataaacccattgctctgggattgctgccctctcgtctactttcttttcctgccaaaatttacccatagtcatcaataactgccttcctttcctgagaccttgctgtctttatttctctgccatctgtctctatccccatgtctctatagaaataagccttgaaaatcccttctatctctttgccaaatgcaagacagaaattcttgaccatccaattggaaacaagaactaagggtcgtactctctctgtggcttccacgatactgcattttatctgctttcttactcctgtaacttctctctttctttgctgtctctatttcctctcattattcatcttctccaagttgaaagagcaatcacaaagttttcaatttccatctacagactcatagagtagataggcagtggggcaagcactctactacacatttaacttacattttcagttaaagtcacagcatgccaacaagtaatagttctcattactattttattttgtttatgttttaaatagagacagcgtctcactctgtcacccaggctgaagtgccatggcatgatcatagctcactgcagctttgatctcctgtaacttcctctcacctcagcctcctgagtagctgggactacaaggcacacaacagtatgcctggctaatatttttgttttaaaattttttgtagagatggggtttcactatgttgctcaggctggcctcttaaactcctggcctcaagtgatcctcccacctcagcctcccaaagtgctgggattacaggcctggcccattattttaaagacaataaactcaaggctcaaaggaagtaggtaacttactcaaggttacagagcttgttagtggggagcccaagcccattacatccaaaatataaccagcaggaatccgttgccctctgagggaatctagaataatgggagctgaaagtactgaccaaactgtcagggcaatagaaatcctggatggatggagggcttggtatgagggctggagggaaactgggccgtagaaggagtcacataagcgttctagtcagaactgactgaggctggtggagcaagctgggatgggggctgctttatgggagctaatgctgagataaggaaatcagtcacttcagtggaggagaagcttgggtctagagacaatcttacctgtttcacctatatgctcttgaacccactttaccaatttccaagtaggtattatcacaaattaattcaatccggtgaacgctattgtgagctttttctgtgcctcatggcgtctagttggcaaaaggggaaagaccacgttgatttaactaccctaaacctcaatatcagagagacatggtgtccaagccaagctctaccacacagttgctataaggtactgtacaagttatatatctctctaaacctgttttcttatctgtaaatggggatgataatagtttgttactcattcaattgatgcaatgtctaaatagattatgctcaagaagcacttattacatagaaatactccctgaaatgtctgatagactggaggctggcggggaggggaataagacacagtctttgctctcaagggcttataatggggtgggagagggtagggaaaagaccttgaactgggcagtttaaacatttacccatatttgtctcatgggattttcatggggaagcatttgttgggtaaatgtgtgagatgacagattctatctttatcacactgaacagcagaatgacaaaaagggacggaaatggtggcgaaccagattcttccagctcatcagaagtaataaacttctaacaataagaactgtcaaacagcaatgaaagagggagttttccaacactgcaattgtataagtcaaagatggatggcccttagtaggaaatgttttacaaaggcattcgctggaacgaaagactgaatttatgttgttttgctcctccccatctagctggcctttatgtacgagagactctcaaggtcagggcaacctcctcctcctcctcttttctttcatctgctcctactggccactctctcacttctatcttcttctgaggtctctcttctgagctccagacacatgaatcctattgctgattgaactcagaaggctccaattccccaagacccaaaaggaacctatgatcttcccccacaaaacctggtccttctccaatctgtgaaccagaactcaaaggcatttcacaggcatgtcactttcaaaggacttccctgccgtgttgcaaggcaaaagtgagagaaggtactgtcggtagagggagatgtcagataagaaaagaacctcacagcctctgtcaacacacttttcaatcgtggatttttttaatctaaaaaaaaaaaaaaggttttaaaatctgctatattttgagttttgaaaaaaattaatgttgctgttttataacctctgacaaggttttattctatagttggacaggttctttctgttaatttgccttatgcaagtgaagcaatttttgtatttgcgttttaacgtatatgatactcacaaacacacccatttagcccgacttccccccagtgctacccattgcatatgccacccacaaagcccaactgggtgtggctgagtctaagcaagacataatcatagaggcagatctggagaggaagacacatgccacaggccagaacacaggttcagcaagattctcactctagttatgtgtatcactgtttctcactgtcacaggcagttccttagacaggcacacgatccagccatagtaagcgtgtgtggccagccccattcctggcttcattttgtccccatccttgtgtttctgtgtaattttgcctaattatagtttatactatattattacatacactttatggaacgagctcaaatccttttggaaaaaggcaggatagatgaatagatgggtgggtgggtagataggtaggcactctttacagccacctaggaaaagggctattgataaatctttactgtttccatcgattgatttccacttagaattcccctctcttcttttcttcctctaattcagtttctctttgcactcatcttcctctcttgcctccatccctgcttctcacctcatctctgggccaagatggggtttgggctgactgcaggcttaacactattagaactttccagagagagtccctcaaccatgttccagaagtgctaagccagtattaatttccctggctactttcctgcccttgtttcatttccttattccccccgatcttcattccagaaagatcatttcccacttgtatcccacccaggttggcatgagtctgcttttctctaagactgagatcaattttatcttgaggcatttgggcattaactgtcataaaatagataagaattctggaggatggggagtcttgagacaagaactgtcagagaagaaagaaccccaagtgctttcttctggtagaatggacatatactgggaatgtcccgtagttctggaaaatataatgcccatgcgtgcccacgtgcacacacacacacacacatacaccccacacacgatcagattcatcacattttagccatgccatgaaccctcacacattcccacaaatttactctcaaagggaagaactgtcttcaactattcagctctctctttctcatcaggacatggcttcatactggattagttcatgcaagataaagctgaatgaatcagccagttcaaaagtggagcctcacaatcctctaagaaagagaactttcagtcagaaaacatgtaatgagtacctactgcatgcaaggaaacctaataggcaaatgcagtgagggtggaggaagacacatgaagatgtgtgcaagtcagtctcttaagactcttcagggaaagcaccaaaagcaaaatatttattcaagattggcgatttagaatcagcagatgtgacggattatgattgttcttggcattcattgccaccacattaatcaagccagattctttcacaatttacatggatacattgttgcctttgagataagagacaactatgaataccgactctccaggaaaggcagttaccatcagtcaagtccattactgagtcaccaacagctaggaaaatgtttattcccaaaccgctggaagaaggggcagaccagacagggaaccagtaagcatttttttttttcagggaaaaaaggaaagaagcaacaaattggggtatcagtgcagacaaacttcaggcaactctccccaagattgtggccctcaaagatactgggcagaaaagcctaaaatatactgcttattttcttttggtttagctgcagttgctatattttaatacaaagctatgtattacctatgctataaataaaagaaccaaaaacctactctggccacacagttgttcactagccctcaatcttgaacattttgtgataggtcctcatttgggtttaaccctcttcccacaatgtgtctctctcaaattcttgaattggaatattttcatttcagcctctctgagtttggcattgataatgcttcttcttttgtgcttagctctgtggtctgctttgatagtctcctttctaagaaactgtctgtttcctccctgtttctaagattaggcagtaaaataatacagtttttttctctgcttggagccaccatcaccccctaatgtattatgacagtgtacataaaagtgcttcataaagagtaatgcaatgcacaaatgttaattgacaagattatgagtagctgttttaagtatcccaagttgacttccaatcgcaatttctgttactaggtcaaacataaaataaaattgccctccttgcttctgtgatgactgaaccattcaggcacaatgctattgtaccctcacccacggtggggtggaagggcatggtgttgaagatataatctgatggtcacttgtggtagaattgcaggttccggctgtgttggatgaaggggagccaaaggccaggttggcttgtagctgcaaagcccgactttcctgctggttgcatctgcacagagagctgtggggaagcaaggagtccaggggttggatgcagagcctgggggtgcatgggacgcaaagaggatgggtgggagaggccagtctgctggttagcatgttccatctgcttttgcaaggatagggcaccaccaggctgtaggaaatctgtctcagtgggctgaaagtggctgtgcaggacacagggctgtggctgtggctgagataggtaatgcactgcagggaaagacgaaggagctctgagctgctgactaggactataagctggctgtgtgtgcctatagtgaggtgggggctaagcagtcccataggcaccaccaggactgccttggaattgtccatgctctggtgtctccgcaaaagcagttgctgggccaacgtagtgccggatcgtaagcaatttgggtccaaacatttgtttggctctgtcagctgccatgagggtgcctgggcgattgtgtcctccagggctcccctgcgtgctgaggagtaatgtacctgtgtgaacagtcaggctctgctggtatgcagctgatgtcagggtggtcaggtcactctgttcctttcgcctccgtttttcttcctcatgtaaaacttccttgagctgcaggaaaagctggtgcttctcttcctgtagggccaaaagcttctcctgcaacttcagaatttgttccttggtctcctctagtgacattctctcctccatctcctttttcttccttctctcctgttcttccttcatcttctgttccgtcatcttgtccacctcttctttctcctgtcgcttatgctcctgctccatcacaatgtgcttggtgcagtgttctggccatggcgttggaaagcttggggtgctccaagactgcgggcatggtgctgccgtgggcgctcgggccttgggcgtctggctctgtctctgactccagacctcaaacagggaccgccttctctgtgctttctccgtgtctcctgtgcgccctggcctctgcgtcacagcccgcggctgggccgaatccttccagagtcccacaatgctattataacagccgggaatcatttgaaaacgagcttctcttcacttggcgtgtcaggtggtcattttaaaaaccgggctctatgtttttatatattggaattggttcagatttaaaaggcacacgccccctgcttggagagggactcaggcaagcagtggggagtgggacatcaaactagggtcatggggacctggttccacggtaaatcctgatggaagcatcgcaagaatggccagccaagagggaggcgttttgcaatacaaggccaattttgacaagggacaggtggtgattctggcagctgattaacttaagagagagccaaccaaggacctgagccagccaagggagtgctggcaggagggcagggcttgcccagaggttctggaagggaggggatgatagcaggtggatacatcagtgacggcaaggttccatgacatccctgggaacttgtgtcagaatgcttaggcacaaatgtcacatctcctatatttattctcccaggtctcttctgcctcctcataggtcagctgtattcaacagacactccagacacatgggaactcaagttagactctacttaccatgcttactacctaagaaataactgcttttctaaaaaaaaattatgaattcagaagctgttagtggatttgcaaaaacctacttctttccacgttggcagatttctggctttgtagatgcagaatagcatgtgggtaaaacgccacttgtgtcagaaggtggagggtgggaagactgtgcatgtatgtatggaggaatgacaagaaagtaataacattagtttctttggggggaagtgaactggaaggtaggaaacagtgatcagttggagacatcattgtgcatcctttttacattttgaattttgaaccgtctgaatctattgtatttatttgagtttattgtatttaacaattcaaaagttaaatttaaataattcccagcactgtgatcatctgtcaccttgatggctgatgaggtgagagctgtgactttctcaccatcacactcatcttgatggccatgtttttgggggatccaacattatcatcggctgtcatcaagtgcataaaccctttctgagtttgtgaagaacagatgtatttatttactctttctctttttgttcatgtctctcctgaggatgtggtttactattactttatatggagattctggcagggaaaaatttgttctcggagtggtctgtctggcaggtgtacattcccagtcttggggatatgattcagaagaagactcaagcccatatggagtctacaaataccaagctgggggcccaagtctaaccaaaattggagggcatgaggtgttatacacgttgtcaaggcagaggttcagatacagggaccctactcctactccatttttttctgctgttcttcccattgaaactcctgggaaaagctgtctagattctctacttggtcacatcccctttagtcttcactcctgaaatggttcttatcagggtcactgataacttccatgctaggtattctaatggccaaatctctcttttcatcatatttgaacttatagccacatttgacacaaattgtcatctttccttcttgaagcaattttcttcatgttactgcatgcctcctaccttactgggtaaagctctcagtctgcctgatgaccctttcttctctgtccaacttttaaatgttcaaattctctgctcctgcctctcatctctatgctatcttcaaacggtcctatgctttatcatctgcatgctccctgattttcccaaccctgtctccagataaggtttctcctgagttccagatacacgtgtctaactgccagcccaatagctccactcgactgcaagtggccatctcaaacctaatatgctcacaaccaaactctcgattttccctcccaaacctgctcctggcctcccctttaccattttattaaattttaccattttattaaatgacactgagttgctcagaccaaaaacctgggagatgacctttgattcttctttccctctgctaccgacagccaatctgtcagcaagttctgttacgctgtctccagaatagatcctgagtcaggtcacttttcagcaacttcactactaaaagcctagtcttaatgccccgtctctcatttgttctatcacaatagcctgctgactgattttcttgcttcctttcttgctcacatacagtctgcttatcaaaagtaactgcagtgaacagtacacacgatcaatccaatctgcttcaaacctcagacttctgttccgtctgccagagttcctttctctaaatctttatatggctatgcctcatcagctcaactaccagcacttctgtgaggagtctctgagcactgctgcgtaagcagcaacctccaagtcactctgcatccagtttcccagtataattttcttcatggcactcatcattttctaatactttacatatttgtttgcttatatgtttattgcacatattcctcctactaaaatgtaaaagggaggtgcttgggatgatgctgtattagctagggtaggcttggtcattctgcaataagaaaaagtctcaatcctctgtggttttaaacaacagaggtttattttttgctcaaactacatgtataacataggctgacaggagagattctcacctcacacatattcagaggctcaggctgaaggaggccataccgtgtcatgacactgtcaacacaacaggactcctacaattactaaggaggaagaagaggtacaaagaatctcacaccatctctcaaatgcttccacatggaggtgacacacatcacttctgctcacagtagatgggtcatggaagtcataaggccttgtctcatttcaaggggcctaggaaataaaatcctcacgtttccagaaagagaagaaaactgggaatattggcaggtagcacgtacacctaccacaatgcctagctgagagtaagtactccataaatatttattataaatggaatgggaaagaaagacacccagttctcagatatgggtacaaagtggagacctggatttcatgcacagtgcggaagtttatgaaaactggagcaccaggtgagagcagggcaagcggcaaggctaagtcagtgcagagtcaccatgtgcattggacgagggctcctgatactccctaactaggaatagagtaggtttcagaggcagaacagaaaaaaaatgaatgcttgggagaataagacttatttcccctgagaattcactggaaatgagagaagggactcggctttactaaagaacccgaggccaccaggcaggtctgctaatatgaaaccgtgatttacagaggggtatagctccacaagagccaggtgcctcttagtggtttaggttcctgagagtccctgaaaaaccttattcagagtgctttcctttgtcagaacagccatggcctcagaccatagactaagattttcccttttgaaactctgtctgttcatgtgtctgtgtctgtaccacaacctaatagaactaaaaggaaaggattacaactattcaccacctagtgattactagggactttacatttatttcatttcaccctgaattaaatctttgagatatgtgttagtatccatattccacatctgagaaaactgagacttagaaaggttaacaaggtttcgatggttttggtcttccctgttttggtcttattgatataagaatatcaatagagggcactcaataaatgattactggtgaatggtcactgatggtgttttattcctttgagggtaggggccaagtcttctgtgtgctcccagggcttgggccagtgaagagcactgagcacccagtgatgtgctaatggatacaatgatgtgtcaaacctgataaaaaatgtgtgcctattttttttctgaaattacagcactggtgctcaggattaagaatatggcagtgctttgaagaaaaggaaagagaacaagggagcagcttcaaaagaagaaggtggagaggttgcaatggcagtcacaacaggagagttaaacagaacacatctccttgctactcaaagtgtgacccatgaccagcagtgttggcatctccagggagtttattagaagtacagaatctcaagccatactccagactattgaaccagactctgcattttaacaagatctccaggtgattcatgtgcacgtttaagtttgaagagtagcactctagagaccacctgcatctctatctcctgctctagcccagcaccaacttctcttactgactgttaggggccaaggaggccatggagcattgcacctgctcttcatttgaccatccatcactcagtgggcctggcagtgcaatcctaagtgcacagaacagccttctacaggtgccatcacttcgatccccaaatctcccactctttacatacatgcaaatctggtgtgcctgactcaaagttcatggtcttaacccttccattgttggaagaacatggttctggagtttctgtgttaacgaatactttcttttattctaatttctaggtatttccaaatatctggaaaacaccaccagccacttttggtgcttccaatatataagtgcttctgttgttccccccaaaatcacttataccctaataagtaatctataagtgagatttccaaaaattttcttcctttttacattattataacaatgataaagtaacttttcagtaaggacaatatactacaaatattaaaagaatgtatttttatttctcctttaaatgaccaaacttcagttcttcctttatataggatttttgacccagggtaatagaggatgaaagaatgaaggaatgaataaatgattgagattatttctttagcaagacagtacatttaaaattaagctatggacaaaaagtggatttttctgaattttcacatattctggactcagtcagaagtttcttctgtaaagtggataagctgccactccatatctgacagctagatcacaagcctgttgcctttaggtagaagaataagattataaagtaggggaaggaataagtagccattccttctgctcttaaagagtgtgggtcgcagagggagagaggccgattgaaatgggtggtcatgcacatgtccctctttccctgtttggaagcatggtggtttttagaaagggcataagcatggagctgggaagggaaacaaataacccattccatatgataataacaataatagctatagttaatgagtcaggcactgtgggaagtgcttcatatatctctttgcgatcaaacttcataagaaccctgttataattactttgttttagtagataagaaactgaaacttagagatggcaagtgactggctcaagtttatacactgcataaatggcagaagaagaatttgaatggacgtatatctaagtaaagagcccacgtctttaaccaccatgctacaatgccattttcagtaatagttgaagtagaattgagttgctttgcgtgcctaaaagctctacttccttgaatccctccttcttgctgccaccaaagaggtccatctatgatataaactggattgtgttactcttccctttggctcacgcctgtaatcccagcactttaggaggcagagtcgggcagatcatgaggtcaggagactgaggctggtagtatcacaatgtgttcggtggacaactctgcggggccctcttgcccaactccaatccaggtatttagaggttacaatctctttggggttgtcacctgtccactgtgggttggagcattaggcccatgaaaataggagattgacccactccaccacagctggggcttcatatcttctttttgaactaaatcctgcaatttatcctggccaacatggtgaaactccatctctactaaaatacaaaaaattagctggtcatggtggtgcatgcctgtagtcccagctactcgggaggctgaggcaggggaatcgcttgaacccgggaagctgagatcgcaccactgcactccagcctggcgacagagtgagattccatctcaaaaaaaaaaaaaagtgctaaatagctcctcattaccggataaagtccaaagtcaacatagcgtacactgaggggagaaacgactaaataaagtcatgggatgcatacttgtgcggtgagcagttacctcccttgttgtccaatttcttccaccattccattaaataagctattcattcagtaagcttttggaatgttagcatttctttttgtgtgtgtggcttttttttgagttttaatttatttgttaaatttcttattgatacataatagttgtacgtattttaggggtacatatgataatttgatatattcatgtaatcacatcagggtaattgggacatccatcaccttaaatatttatcttttgtttaggcttggaacatttgaattattctcttttagctattttgaagtgtataatagattaatgactatagtaaccctactgaactattgaataccagctcttaagaaataatagtatatcttttaaaaaaaattttattattattttttaaagttccagggtacatgtgcaggatgtgcaggtttgttacataggtaaacatgtgccatggtggtctgccgtacctatcaacagatcgcctaggtattaagcccagcatgcattaacaattttccctagtgctctccccctacctcaacctaccccaacaggccccactatgtgttgttcccttccgtgtgtccacgtattctcattgttcagctcccacttacaagtgagaacatgcagtgtttggttttctgttcctgcattagtttgctgaggataatggctttcagctctatccgtgtccctgcaaaggacatgatctcattcctttttatggctatattagtattccatgctgtatatgtaccatattttccttatccagtcaatgatagtatttcttaaaatgacacttatcctctccacaaatgaatatttattttttctctttttttttggaggggacactattcaacccactatgctacattaaaaaaataagaaaaaccaaacattaaatttcattaattctaatgctttatttaactgagaatattccatttaaacaaggcactatacatatatggccaggtcatgtgatcagtataattaaacagagtcccaagctcagaagtggttgggatttaatgtgctatggtcatcatcttgaagtccttaataattacatctttggatttgtgttttgtaagtaaagtacaataggaaaatggagcataagccaggaatttaaagcctcagatcatggttgtcctgcttcgctgctgcctctctgggatggattttcatccacgtaccaaacctcagcccccacctagcctattcttccctactcctgccccttgactactacagccaccaggtctcattggttgggggttcttcccttcctgggcacaggccaggaagggtcatgcccataaatgtgtcctgctgcatcacaggatggggcaaggcaatgccagcctctgttgggagctggtaatatcacaatgtgttcagtggacaactctgtggggccctcttgcccaactctaatccaggtatttagaggttataatctcttgggggttgttacctgtccactgtgggttggagcattaggcccatgaaaataggagattgacccactccaccccagctggggcttcgtatcttctttttgaactaaaccctgcaacttatgtagcctattctgtctatggctttctaatgtgtctctttgaatataatgtctcttgaatatagaagaaatgtcaagtcatgataaaattgtgacattaatgttacctctaagggtgccaagtgcaaggtactaacaatttaataagtttgggcttttgcatgacctatgttaatatgtgatttcttgctatttcacatggcaagggaagtttttcagaattcatttgattgcaagatcaatgtgaaaatgcattacctgcctgccttgagcatggccaactgttgacctctccaattaaggagagttgagaatgaaaattcaattacaatgaacaaatgtttcttgaacattttccatgtgtgaggccctatgccaggctttgtggagaatatgcagatctatgagatttttttcctatctttgggataattgcaagcaagttgaaggaggcacagacacatgcacggatgatcacggtatcacatgctatcttaacttatgaaagcagaggaaatggagttagggaagctggactttttgtaggtagcccctcatagcaggcatggctggttccttgccatacgttcattccctttctatgagagtaaaaccctactcctatttttttagggcctcttcgttggaaaagaggagtccatctccagctcagtgacaaatcttgatagctttatgcttttcttgataattcatgcctcttgttagtgattagttaagaggtgggcctgtgactcagttctggccaatgaaatataaagtcaaatctctgggttacttttggaaaggttttcttgtagtagaaagagtttcacagttaagagcacagattatgaagtgaaccgcctggtttataatcctgggtccactgcttactagctgtgtgtcattataagtcacttaatgtttctgcctccactttctcatctgttaaatgggattaatatgtacctaatggagttgttgtgagcatcacgttagtgaatattttgtaaatagaccaagcctacaactcattggcattcttgagagagaaggagagagagtaagcaacttgcaaaatatatttgaggacacagtctttgaaaatttccctaatctcactagagaaggtgacatgaaaattcgagaaatacagaggtcccctactagatactatacaagatgatcatccccaaggcacacagttatcagattcaccaaggtcaatgtgaaagaaaaaatcttaagggcagctacagagaacggtcaggttacatacaaagggaaccctatcaggctagtggcagacctctcagcagaaaccttacaagctagaagagattggggacctattttcagcatctttaaaggaaagaaactccaaccaagaatttcctttcctagcacactaagtaagcttcacaagcaaaggaaaagtaaaatccttctcacacaagcaaatgctgaagaaattcattataactagaccaggcttacaagagccccataagggggtgataaacatggaaacaaaatgatgacacctgttaccacaaaaacacacttgaggacataacccacagacaccataaaggaactacacaatcaagtctagagagcaaccagttaacaataacaggatcaaaatctcacatatcagtatgaaaggggctaaatgcccccacttaaaagacagagtggcaagctggataaaaaggaaagactcaattgtctgctgtcttcaagagacccatctcacatgcaatgagactcaccagctcaaagtaaagggatggagaaagatctaccatgcaaatagaaaacaacaaaaaaagcaggagtcactatttttatttcagataaaagagtttaaaccaacaacaataaggacagagaaaaacatcccatgatgataaggggtacaattcaacaagaagatttacgtattctaagtatatacatacccaacattgggacacctagattcataaaacaggtccttcttgacctaggaaaatacttagcacacgataatagtgggagaatataacaccccattgacaacattagattatcaaggcagaaaactaacaaagaaattctggaataaaactcaatgcttgaccaattgaacctaatagacacctaccacagaatatacattcttctcatccacactggaatatattctaagattggcaatgtgcttagtcataaagaacgtctcgataaattcaaagaaaccaaatcataccaagcacaatcttggacaacagtgcaacaaaacagaaatcaatatcaagaaaatctctcaaagctacataaatacatagaaagcaaacaacttcctcctgaaaaactctgggtgaacaatgaaatcaaagaagaaatggaaaaatttgaaattaatgaagatagaaacatgacttaccaaaatctctgggatacagctaaagcagtgctaagagcaaagtttatagtgctaaacaccttcatcaagaagttagaaaaatctcaaattaacaatataactttgtacctagaggaactagaaaataaagaataaaccaaccccaaagctagcagaagaaaagaaataactaaaattacagaagaaccaaaccaaaagatcaatgaaaccaagagttgatttttagaaagaataaacaagattgatagactgttaggtacattaacaaagaaaaagagaagatccaaataccatcagaaatgacagagatgacattacaacaaatcccacagaaacacaaaagatcctcagagattattatgaacaactctatgcacacaagttgaaaaatctagaggaaatggataaattcttggaaacacacaacctctaaagattaaaccaggaagaaagtgaaaacttgaatagaccaataacaagttccgaacttgcatcagtaataaaagacttaacaaccaaagaaaaaaaaaaagccctagatcagatcgattctcagccaaattctaccagacaaagaactattatcagtcatactgaaactattccaaaaaatcaaggaggaggggcttcttcttaactcattctataaagccagcatcagcctgatactaaaatctggcagagacacaacaaaaaaagaaaactgcaggccaacatttctggtgaacatagatgcaaaaatccttaactaaatactaccaaactaaatccagtagcacatcaaaaaattaaaacaccatgatcaagtaggcttattcctgagatgcagggttgtttcaatacatgcaaatcaataaatgtcattcacctcataaacagaattaaaagcaaaagccatctgattatctcaatagatgtagaaaaagcttttggtaaaatccaacatcccttcatgataaaaaccctcaacaaactaggcattaaacaaaaatacttcaaaataataagagcaatctatggcaaacccacagctaacatcgtactgaatgggaaaatgctgaaaccattccgcttgagaactggaacaagacaaggatccctactctcaccactcctattcaacatagggctggaagtcctagccagagcaatcaggcaaaagaaagaaataaaagacatccaaataggagaagaagaagtcaaactatctctcttcactgatgatacgattctatacctagaaaaccctaaggattctgccgaaatgcctctagaactgataaatgactttagtacagtttcaggatacaaaatcgatgtacaaaaatcagtagaatttctatacatcaataacgttcaagctgagagtcaaatcaagaacacgatccaatttacaatagccatacaccaagaagttgaaagatctctataagaagaactacaaaataccggtgaaaaaaatcagagatgacacaagtaaatgaaaacacattccttgttcatggattagaataatcgctattgtttgaatggccatattgcccaaagcaatttacagattcaacactgtttctgtcaaactgtcaatgtcacttctcacagaattagaaaaaactattataaaattcatatggaaccaaaaacagcctgaatagctaaagcaatcctaaccaagaacaaagccagaggcattacaccacccaacttcaaactatactataaggctgcagtaaccaaagcaacagggtactggtacaaaaacaaacacatagaatagaacccagaaataaagctgcacacctacaaccatctgatctttgacaaagtcaacaataatgagcaatgaggaaaggaatccctattcaataaacagtgctgggataactgagtagtcattgcagaacaatgaaactggaccccctttcatcatatacaaaaattaactcaaggtggattaaagatataaatgtaagaccaaattataaaaatactagaagaaaacttaggaaatacccttctcaacattggccttgccaaaaattattttgctaagtccccaaaagcaattgcaacagaagcaaaaattgacaattaggaactaattaaattgaagggcttctgcacagcaaaagaaattatctataatcagacaaactccagaatgggggaaatattcacaagctatgcattcgacaaaggtctaatatccagaatcaataagaaaattatacaaataaacaaaaataaacaaactcattaaaaaatgggcaaaggacttgagcagacacttctcaaaagatgacatacacgttttcaacaaacatgaaaaatgctcatcactaatcatcagagaaatgcaaatcaaaaccacaatgagacaccatctcataccagtcagaatggctgttattagaaattcaaaaaacaacagctgctggtgagtctgtggagaaaagggaactggataaagaaaatatggtacaaatacaccatggaataccacccagccataaaaaatgaaatcacgtcctttgtagcaacatggatgcagttggaagtcagaatcctatgagaattaatgcaggaacagaaaaccagataacttatgtcctcacttataagtggacactaaacactgagtacgcatgaacataaagatgggaacaatcgacactgtggattactagagtggggagggagaaagtgggctgtgggttgaaaaactacttactggggattatgctcactaccttagtgacgggatctgtaccccaaacctcagcgtcaggcaatatacttatgtaacaaatctgcacatgtatccctgaatctaaaataaaagttgaaattataaaataataataaaagtgctttttcgttttttaagacagggtctcactctgtcacccaggctggtgcagtgacacgatcgtggctctctgaagcctctacctcctgggctcaagtgatcctcccacctcagtctccccagtagctgggaacacaggcttgtgccaccacacctggctatgttttaaattttttgtagagatagggtctctctctgaaatctggtcctcaagaggtcatcccatctcagcctcacaaagtgttgggattataggtgtgagccaccatgcctggccaaagtacatttctttgccaaatgcttaacagagggtcatatctttgctttgcataatgattctttttattgaagctttgcattttcatgtccagacaacaattaaatgaactaattatggtaaaaaaaagttatatttataaagcatttagaatagtgcctggcatataagaagtgttaaatgtcattagcataattttaagaggaaaattatgataacaaaaatgatagtcagttttgctgacgactatcaacgaaagtgatagtctcttttaatgactctgagtgttagggtgtctggatgtgacctctggaacttccatggtcaccttgtgcctataatgggggctggatgcagagcaaaaaaaggaaagaacctcagtccttgatgaaaccacagagccactgattcatcaaccctagagcccactgtacctctggacttcttgcaatacaataggataaatttctttgtttaaagtattttcagtcggggtcttgtgttcttggcaaaggcacaatttaacttccatagcaatttactggtgtgtgtcctggagttcctcagcccatgtgttttccacgtcctcctatgcatgtcccagctgcataccccaagatgtgagctgcctccgagcagttcgcagttcctcacatcagtcatcatcagttcctgctataattcttcatagttttggccttattttaattatgactggttcacgaaagactgagatttccaaggtgtccttaagtccaaagctactcttgatatccacaagtgtattagacaggattctttagagaaacagaaccaacagtatgtgtatgtgtgtgtgtgtatatatggttggatctgtgtccaattcattttacatgtatatgtaaagatatatatatgtgtgtgtgtgtatatatatatatatatatatatatatatatatataaagagattatgagaaactggcacacacaatcatggaggctgagaagtcccttaatctactgtcagcaagctggaggcccaggaaagcccagcggtgtgattcaagttcaattcccaaggcttgagaaccaggggaaccgatggtgtaaatcccaggctaagagcaagagaagaccatgtcccagttcaagcaggcaggcaggcaggaagaagttccttcttcctctacctttttgtcctttcaagctctcaacagattggattattcccacccacactggggagggcaatttactttattaaattcaactgattcaaatgctaatctcatctggaaatacacttgtagacacatccagaaataaagtatactctgacacccctagtgctgtcaagttgacacataaaattaaccatctcaatgaaggacatgctttgaggtcctttctaatttacaaatactaaagttacttaatttcccccacaaaatgcaataaacgaacattttaataagctcctttcattctttaataattctatagatacaagttggaaaaattagtaaagttacaaaattccttaactggaataaacacaaacctacattacttcatttttatagtaacatttacttaagcacttacttaaattttcaaaactaaggtgaagatgatgaatagcaatttttaatatgaggggagttgttgcttgcatggaggtgcaccctctgagtgattgattaaaaagtcagttatttccccaccttgtagcatatatctgtaacaaatttttgcttcagcaaaattagaaattcataaacctcacagatcttcaggactgttcaaagataggaaataatagcaatctgtggatctttaaaagtcataagtttaatctcttatacagactattatatattgataatggcttcctagaacatggggctgagaaggatggcaaggcctcatcaaggttaagcaggaaagagtgctaggatagattatgcatgtctgccctcagtgtgggtggagcagaagccatcatgtatttttgcaacctagggtttatattttctgcctaccatgcttgaaaggcaattagaacattgtcatgtctgattctataattctggttactcttaggatcaattcatttatttaatcaatgtacatttattgagtactttcaatgtatgagacatactgttaggcaacttgggtaataaaaaaatgaattggacacagatccaaccagtaaagaacttaagtctgatagaagagaaagataggtgcatgataaaatgctgcaagacaggactagataaggggagggactgcaggatatgccaaaggtgggaaaggtacctttagtgagtgtggaaggaatcagtaaggcatactggggaaggtgtattagaagtgagccttgtagtgatgtaagattgttcatgtggatagaaggggaagactatttcagactgagtggccagaatgagcaaaagcaccagagtggaaagctgaaagctctgggtgactgcctgactgatgagaatatgtagctgctatttattccagttctccctacagagtgagcaggttgcctggtgggcttcattagactggtgtgctgatgtgacatccatttttataagagttgtttgggccagggaaaaacctgctctttagaaagatcatctctcatgactatttgacatgtgacatataacaaatgtcttaaaggagagccctcactgtggtctcacactgtacatttttactgtaaacctaagagaattgacaaaggctccatctttatcctcttaactacatacagactcatcacctaatgccagcgaagaacattcctgacatcatattattcaataacatgaataaggtaaaaaattcttaacacactgctgagctagaaactagctgatttgttgaaaatatttgcaaaaatagattgaaactgcaaatagaggatcactcctaacatgctgttatctcagtcatatatatggcatacatataaacacgaggtagggttttgttaaatttcttttttttctttttttattattatacttgaagttttagggtacatgtgcacaatgtgcaggttacatatgtatacatgtgccatgttggtgtgcttcacccattaactcgtcatttagcattaggtatatctcctaatgctatccctccccccttcccccaccccacaacagtccccagagtgtgatgtcccccttcctgtgtccatgtgttctcattgttcagttcccacctattagtgagaacttgcggtgtttggttttttgtccttgtgatagtttgctgagaatgatggtttccagtttcatccctgtccctacaaaggacatgaactcttcattttttatggctgcatagtattccatggtgtatatgtgccacattttcttaatccagtctatcgttcttggacatttgggttggttccaagtctttgctattgtgaatagtgccacaataaacatacgtgtgcatgtgtctttatagcagcatgatttatagtcctttgggtatatacccagtaaatgggatggctgggtcaaacggtatttctagttctacatccctgaggaatcgccacactgacttccacaatggttgaactagtttatagtcccaccaacagtgtaaaactgttcctatatctccagatcctctccagcacctgttgtttcctgactttttaatgatcgccattctaactgttgtgagatggtatctcattgtgtttttgatttgcatttctctgatggccagtgatgatgagcattttttcatgtgttttttggctgcataaatgtcttcttttgagaagtgtctgttcatatcctttgcccactttttgatggggttgtttttttttcttgtaaatttgtttgagttcattgtagattctggatattagtcctttgtcagatgagtaggttgcgaaagttttctcccattctgtaggttgccggttcactctgatggtagtttcttttgctgtgcagaagctctttagtttaattagatcccatttgtcaattttggcctttgttgccattgcttttggtgttttagacatgaagtccttgctcatacctatgtcctgaacggtattgcctaggttttcttctagggtttttatggttttaggtctaacatgtaagtatttaatccatcttgaattaatttttgtataaggtgtaaggaagggatccagtttcagctttctacatatggccagccagttttcctagcaccatctattaaatagggaatccttcgcctattgcttgtttttgtcaggtttgtcaaagatcagatggttgtagatatgtggcattatttctgagggctctgttctgttccattgatctatatctctgttttggtaccagtaccatgctgttttgattactgtagccttgtagcatagtttgaagtcaggtagcgtgatgcctccagctttgttcttttggcttaggattgactcggtgatgcgggctcttttttggttccatatgaactttaaagtagttttttccaattctgtgaagaaagtcattggtagcctgatggggatggtgttgaatctataaattaccttgggcagtatggccattttcacgatattgattcttcctacccatgagcatggaatgttcttccatttgtttgtatcctcttttatttcattgagcagtggtttgtagttctccttgaagaggtctttcacatcccttgtaagttggattcctagctactttattctctttgaagcaattgtgaatgggagttcactcatgatttggctctctgtttgtctgttattggtgtataagaatgcttgtgatttttgtacattgattttgtatgctgagactttgctgaagttgcttatcagcttaaggagattttgggctgagacgatggggttttctaaatatacaatcatgccatctgcaaacagggacaatttgacttcctcttttcctaattgaataccctttatttccttctcctgcctaattgccctggccagaacttccaacactatgttgaataggagtggtgagagagggcatccctgtgccagttttcaaaaggaatgtttccagtttttgcccattcagcatgatattggctgtgggtttgtcatacatagcacttattgttttgagatatgtcccatcaatacctaatttattgaaagtttttagcatgaagtgttgttgaattttgtcaaaggcattttctgcatctgttgagataatcatgtggtttttgtctttggttctgtttatatgctggattacatttattgatttgcgtatgttgaaccagccttgcatcccaggcatgaagcccacttgatcatggtggataagctttttgatgtgctgctggattcggtttgccagtattttattgaggatttttgcatcaatgttcatcaaggatattggtctaaaattctcttttttggttgtgtctctgccaggctttggtatcaggatgatgctggcctcatcaaatgaattagggaggattccctctttttctattgattgcaatagtttcagaaggaatggtaccagctcctccttgtacctctggtagaattcagctgtgaatccatctggtcctggaatttttttggttggtaagctattgattattgccacaatttcagagcctgttattggtctattcagagattcaacttccaggtttagtcttgggagggtgtatgtgtcgaggaatttatccatttcttctagattttctagtttatttgcgtagaggtgtttgtagtattctctgatagcattttgtatttctgtgggattggtggtgatatcccctttatcattttttattgcatctatttgattcttctctcttttcttctttattagtcttgctagtggtctatcaattttgttgatcttttcaaaaaaccagctactggattcattaattttttgaagggttttttgtgtctctatttccttcagttctgctctgattttagttatttcttgccttctgctagcttttgaatgtatttgctcttgcttttctagttcttttaattgtgaagttagggtgtcaattttggatctttcctgctttctcttgtgggcatttagtgctataaatttccctctacacactgctttgaatgcatcccacagattctggtatgttgtgtctttgttctcgctggtttcaaagaacatctttatttttgccttcatttcgttatgtatccagtagtcattcaggagcaggttgttcagtttccgtgtagttgagcagttttgagtgagtttcttagtcctgagctctagttggattgcactgtggtctgagagacagtttgttataatttctgtccttttacatttgctgaggagtgctgtacttccaactatgtggccagttttggaataggtgtggtgtggtgctgaaaaaaatgtatattctgttgatttggggtggagatgtagatccacatctgtagatgtctattaggtctgcttgctgcagagctgagttcaattcctgggtatccttgttaactttctgtcttgttgatctgtctaatgttgacagtggggtgttaaattctcccattattactgtgtgggagtctaagtctctttgtaggtcactaaggacttgctttatgaatctgggtgctcctgtattgggtgcatatatatttaggatagttagctcttcttgttgaattgatccctttacaattatgtaatggccttcttgtctcttttgatctttgttggtttaaagtctgttttatcagagactaggattgcaacctctgcctttttctgttttccatttgcttggtagatcctccatccctttattttgagcctatgtgtgtctctgcatgtgagatgggtttcctgaatacagcacactgatgggtcttgactctttatccaatttgccagtctgcgtcctttaattggagcatttagcccatttacatttaaagttaatattgtcatgtgtgtatttggtcctgtcattatgatgttagctggttattttgctagttagttgatgcagtttcttcctagccttgatggtccttacattttggcatgtttttgcagtggctggtaccggttgttcctttccatgtttagtgcttccttcaggagctcttttagggcaggcctggtggtgagaaaatctctcagcatttgcttgtctgtaaagtattttatttctccttcacttatgaagcttagtttggctggatatgaaattctgggttggcaaatgggatgtaattaaactaaagcgcttctgcacagcaaagaaactaccatcagagtgaacaggcaacctgcaaaatgggagaaaattttcgcaacctactcatctgacaaaggactaatatccagaaactacaatgaactcaaacaaatttacaagaaaaaaacaaacaaccccatcaaaaagtgggcaaagtacatgaacagacacttctcaaaagaagacatttatgcagccaatagacacatgaaaaaatgctcatcatcactggccatcagagaaatgcaaatcaaaactacaatgagataccatctcacaccagttagaatggcaatcattgaaaagtcaggaaacaacaggtgcgggagaggatctggagaaacaggaacacttttacactgttggtgggactataaactagttcaaccattgtggaagtcagtgtggcgattcctcagggatctagaactagaaataccattgacccagccatcccattactgggtatatacccaaaggactataaatcatgctgctataaagacacattcacccatatgtttattgtggcactattcacaatagcaaagacttgaaaccaacccaaatgtccaacaatgatagactggattaagaaaatgtggcacctatacaccatggaatactatgcagccataaaaaatgaagagttcatgtcctttgtagggacagggatgaaattggaaatcatcattctcagtaaactatcacaaggacaaaaaaccaaacaccgcatgttctcactaataggtgggaattgaacaatgagaacacatggacacaggaaggggaacatcacactctggggactgttgtggggttgggggaggggggagggatagcattaggagatatacctaatgctaaatgacgagttaatgggtgcagcacaccagcatggcagatgtatacatatgtaactaacctgcatattgtgcacatgaaccctaaaacttaaagtataataataataaaattaaaaaaaaagaaattctgggttgaaaattcttttctttaagaatgttgaatattggcccccactctcttctggctagtagagtttctgccgagaaatccgctgttagtctgatgggcttccctttgtgggtaacctgacctttgtctctatttgcccttaacattttttccttcatttcaactttggtgtatctgacaattatgtgtcttggagttgctattcttgaggagtatctttgtggcattctctgtatttcctgaatgtgaatgttggcctgccttgctagattggggaagttctcctggataatatcctgcagagtgttttccaacttggttccattctccccgtcactttcaggtacaccaatcagacgtagatttggtgttttcatatagtcccatatttcttggaggctttgttcgtttctttttattcttttttctctaaacttcccttctctcttcatttcattcatttcatcttccatcactgatacccttttttccagttgatcgcatcagctcctgaggcttctgcattcttcacgtagttctcgagccttggctttcagttccatcagctcctttcaggacttctctgcattgattattctagttatccattcatctaattttttttcaaagtttttatcttctttgccattgctttgaatttcctcctgtagctcggagtagtttgatcgtctgaagccttcttctctcagcttgtcaaagtcattttctgtccagctttgttccattgctggtgaggagctgcattcctttggaggaggagaggcactctgctttttagagtttccagtttttctgctctgttttttccccatctttgtggctttatctgcttttggtctttgatgatggtgacgtacagaagggtttttggtgtggacgtcctctctgtttgttagttttccttctaacagacaggaccctcagctgcaggtctgttgcagtttgctagaggtccactccagatgctgtttgcctggtatcagcagcggtggctgcagaacagcggtggctgtaaaacagcagtggctgtagaacagcggatcttggtcaactgcaaatgctgctgcctgattgttcctctggaagttttgtctcagaggagtacccagccatgtgaggtgtcagtctgcccctactgtggggtgcctcccagttagactgctcaggggtcaaggacctgctagaggaggcagtctgcccattctcagatctccagctgcatgctgggagaaccactactctcttcaaagctgtcagacagggacatttaagtctgcagaggttactgctgtctttttgtttgtctgtgccctgcccccagaggtggagcctacagaggcaggcaggcctccttgagctgtggtgggctccacccagtttgagcttcctggctgctttgtttgcctaatcaagcctgggcaatggcaggcgcccctccctcagcctcgctgccgccttgcagtttgatctcagactgctgtgctagcaatcagcgagactctgtgggcgtgggaccctccgagccaggtgcgggatataatctcctggtgtgccattttttaagcccattggaaaagcacagtattagggtgggagtgacccaattttccaggtgccgtctgtcacccctttctttgactaggaaagggaactccctgaccccttgcacttcccgagtgaggcaatgcttcaccctgctttggctcgtgcacggtgcgctgcacccactgtcctgcacccactgtctggcactccttagtgacatgaacccggtaccttagatggaaatgcagaaatcacccatcttctgcgtctttcatgctgggagctgtaggcgggagctgttcctattaagccatcttggctccacccaaatttctttttttttaactgtataattattttatttttaatgtccagaatgtgtaatataagggccagatcttcctcctggactcaattttataaatccttgattggttggtgaggtcattagggatactttttcttgtctaatttggtttctgggaaagtttttttcaagtcctcaatggtcatctgatcaaatggaattaagttcttcatcttctccttctgtttctcatattctacaatcccggcctttgagagagacacccactcagcacaagatttcacatcttctttgtcttcagcatccagctgggcagtatatttatcctctggcacagaaacttcagggcattaagcttcttctcaaagtcatccaccaagcctgccttggctacatgggccttgtagtaagcctagtcaatagctggtggattctcaggtaaagtagccaacctggaggtgagggtctcattccaggatttcagggaattagcaatggccttttagttctggggtatgatctccacaaaagctacacagtcagtggtttttagagcaagttttcgcccaaccatcttgggatccttcaccaaccctggctgcccacggtccacagcctaaatttctttaaaaatacttctaaaattaaagtaatgctgtttgttttgctataatagtaataaagagaaacccaaaattaaaagaaatttaatcttcaggcccatgcagaaaattataaagagctagtctaagaatcaccaatagacttttcaaaaaagttagtatgcaaattttagagttagaaaaaaaattaaataaaccgaaacacccttgtaaagtttagaatgcatagatcatgaagtatgaacttggatgctgataaacttcacaggccttcattttacttattgcttgacttgttactgtcttctaagcaaacctaaaacagagaaagtgattctatgacactgaagtggttaagttccagccagatccaaagctataagcaagcaagttttgttttcatgtcctctccttctcctcctttcccctttcccctttcccctttcctattctcactcccgtgcctttccctggagtttttaggggcagccttaaatctatatttacccactatattcagtatgtttgattatgcacagcctgaattcagatccaagacgatgatccagatttttgttcatcaaaagaactttatttcttttctgtagatttatagcagagcctaagcactgacttatttttctgctactcaataggctcatcgtgcctggggcccttgctcttacttctgtcttctggaaggctcttcttgtgcatctgcccatgctggctccttttttgacatttaggcctctactcaggtgccacctcttgggacagatctcctccaccaatcctccaatccttcagtcctggccttgacacttcctagtttatcattcctttttcactttcctataattcctttatgtaatcatctttaaataggtttttatgtaattagaaaaatttacatacagtaaaattcactctttttaatgtatagttctttcagttttgacaaagtatatagctatgtgttgccaccactacaatcacagtttggaaaagttccattgctcacccctaaaattttcccatacctctttagagccaacccttctcagaaccccagctctgttctgtttttgtttgcttttgaaacaagctcttgctctgtcactcaggctgcagtgcagtggcacaatcttagctcattgcaacctccacctcccaggctcaagtgatcctccagcctcagcaccctgagtagttgggactacagttgcacaccaccatgcccagctaatttttatattttttgtagagatgggtttttgccatgtagctctgatctattttcttatccataatgttgccttttccacagtggcatataaatagaatctaatagtatgtagccttttgaatctggcttctttcactgaatataatgtagtgttattgttacacatatcagtactccattccttattattattattattccattgtatgaatgaacgatagtttgtttgtttattctctatttaagagacattttagttgtttccaggtttggtgattacaaataaagctgcgataaacattcaaatatagttttcactgttaatgcaagttttcatttcgctaaggtaaatatcaaggagtgagattgccaggtcacatggtaagtgaatgcttaactatatcagaagctgtgaaacggttttcctaagtgatagtgccattttgtattcccaccagcaataaatgagaattccagtagttctacatatttgtcagcacttagcattgtcggattcttacattttagtcacctaatagttgtgtagtggtatctcaccatggttttaatttaaatttccctgactaatgatgccaaacatcttttcatgtgcttatttgctattatatggaactcttttttttttttggtaaagtagttgttcaaatcttttgcctttatcattattttttaaattgagttttcttattactgggcttttagacagaattatatcacaagttcttttaatattctagattgtttttttcaggtttgtgatttccaaatagtttcacccagcgtgtgacttgtcttttcattttcttagtgtgtctttccaagcttatgagttcttaaagtattatttatcatttttctcttttgagtttttgagatcatatgtaagaaatctttgtctaactcgaggccacaaagattttctttgatttttttcctagaaattttatgctttcaggtttttttatattttaatctatgatttcttttaatttttgtagatactatgagatatggattaaagtttattttttaaaatcgcacactgatatccaatgattccagcatttttgaaagactaactcttctccattgaattatctgcaactgccaaaaaccgattgaccatgtatgttagggtctgtttttgatctaatccatcctattgacctacacatctaccctttcatgagtactgcacagcctcaattactgtagttttatagtaagtaatgcaatcaggtagctattactcttcatcctttttagaaaacttaccatcatctgaaattatcctatgtgcttagcttctttttttttttttttttaattcctttttgagatagggacttgctttgccatccaggctggagtgcagtggtatgatcagggctcactgcagcctcaatctcccaggctcaagtgattttcctacctcagcctcctgagtagctgggactacaagtatgcaccaccaggcctggcagggttttttttgtttgttttttgttttggtagagatggggttgggatgttgcccaggctggtctcaaactcctgaaatcaagtgattctcccaccttggcatcccaaaatgctgggattacaggcatcagccaccttgcccagcctactttttaaaaaaacttctgttgggagacatcaaaccatgagactctctagaaccatgggaccagggagtttgtacctatctcattctctgttctactccagcaccaagaacagtacctgacacaccataattgtttaataaattggttgaaagaaagaagggaagttaagaaatacttaagttgaggaaattaagggaacttaatattttggaaaaggaaggatcaaattgttttgtgagagctattaatataataatagaggtttgctgtggtgctagcctggaagattaaatgctcttttggccatgatattttgatcataagcttacttcttttaggacccatgaggagctctttggggacacattcattcactcattcaccaaacatttatccagcacctttgtgtaacactttgttacaaagggcagtagacaaggtcttgtgctcaaagtattaggggtcccagacaagttaaacaataactgagaccaacctcatccagatgccataaaagtgatgtttgtgcaggggtctttgagtgatgtgggagaggcatctaactcagccttgggaaaagctttgctggagaggccatccttgacgaagtttttaagtttcaataggaaactttgagccccaccttcccttcaaatgggtcactctgtaacaatgtaccacaggtttcttcttgtgttctaaagcacctccagctgtttctggatttgggtcactgtgggtggttgttttacagattaactctgcaactctgctctaggtctcccactaaatgctcccttaacaccctttccctctccttcatatcacttattgcaattatgataattaattatgcatcaagctatttaatgcctacttccctcccactacgatatgagtttcctggaggcagggattgaatctgtcccaatctgctgcatttctgctgcctgacatagtgagtgacccagccactgaatgaagcactagtctcaaagctcttgtaaaatctgccaggttacctgagagcttgtcctctgtgatgaagtgtttttgtcctcttgctcagttttaggaataactgttagcttttcttttattttcaaatcactttaagataattaattttcaaaataaagttttccaccccaccaaggaaaaatagaaactttcacattatatgcaatggtggatgtttgtgcctttagtaataaattcgctgatcttgaaatgtttctagtatatcaatgatgcccagatggtatgctcttgcatatcagtagtgtttatagtgtcctaaaatggtagaacaaaaaacaaacggagaaaaagttattttggtgctaaattaccaacaattcctctgggtaacacaatttattttagttcttcctaacacacacacgtgcttcctctcagatgctgtaatagcaaattgacattgaactgggggtgggagtggtctggagaagggcattaccattgctgaacacttaattgagcacctactgtatgctaagcacttttctaatattctgtcatttagtccccatctccactgaggatgctgaagtctagacatcaggaaatggatggtgaagaaatatagtcaagatctggaattctcagggaattaagcaccctcttctgcttctgtctgttagctgctgagtaagaggcaaaggaaaaggaaagtcatgtgcccttcactcaacagccagtctgttttgactgagctgtggccatcctgaattatcctcagaccttacaatctctcactatgaccttatggtcactgtttgtgccttcacacaaggcaggtgttggccctggccaggatctctctgggtggtattttggtaaaagccttgtttttgtaagagaaagcagaggtggaactcaagagttagtagtttacatgtatttaaaaggtgagttttctaaaaccttctaagtagtcatattctttttcaaatcccaaatgattctgtttggaataaactacaagtcatcatctatttaccacattgagagagttggaaagcagacaacaggaagaaaagggaggaagaaagaaaattaacatttattgagcattaattctgtgaactgttaggtacttgagcatgttatgtaaattcttgcaatcctagtgaggtatatgctttttatctcattatacagataaaaacactgaggcctacataggttaaatgatttgcctcaaattggcctgcatgttagtgagtagtcagcttgttctctctgaggcccaaacctgtgctttgctttacatggcatgattgtgttaaggacggatgaaagcaaggtcacctcccttccctcagaattaaagacgttatctgtatctctaatgggcaatgagtttcaaagatgtacaccttatgtgacaactggtatgcaatatattacattgtagctttgccctttttttttcctcccctgcttcaaggtcaaaatctctcattttcttatatctgctaaagaattattggtttggtttcctgagtttcctctttgcttcaagtttttcaatactacagagatatgatgctttgactaatagcctttgggagacattataatatgaggaaaaagcctctttttaataaggaaatcaatagtagcagtgtccagtggttttattcgtgtggctgatttcatgtgtggatttttaattggctcatatttgaacaggtgtctaaagatggggagtttttttctggaaacatttgttgtattcatctcattgtggcgagttccttgtatcagatgaaatctgcatagctcttaaagagaggaatgtcctgacttatgtgagctacacatccgatgagtctcaaaaaaagtaacttaaatgaattcatgttttaggagtattgaaataactgctacaaaactgaatgaaagccagattatctttgaatcccacattttacagatgagaaaaccaaatgccagggaaagaaactggctttgcctgaggttacacagctcattatagctcagctggaggactgagctcacttggaactggaggacatgatagctcactttgtaggactctctagtgcctttgtttcagtatcagattgttatgtactgaattctatttaagggatcataaaacattcaactccatacaggcaccaagtcttctcagagaggaagagaactagtagatactttcttttcctcttaggaaatatagagttattctgcacctctttacctggtcatggagtgattgagattttataaacataggtgtaaaatgcatgggaagacttcttacctaaagaaaggattctttaagtcgaggatgttctcagatctgaagcctgtttggttcaccaacgccacggtctgaatgtcatagctctgtctgcattacagagtaaaacacgtctcacaagactggtcagctactcatgaacatataaggcatctttcatatacacctacttcataagggctttgagagtaggtgtttggcatcttgtatatgcacatgtgcatttatttagaagccattaatatttgtagaggcaattcaaagtcttgtttattcattagaagagtttgatagctataatttcttgatctaaaaattacaaaggtaatggtacttctggttgatcaaagcacatttttgtgagggggtgaagtagggaagctttatcaacatcaatgacagaaaatggctttaagtaacagagatgctttatatgtcgtcattgaagttccaaaacaatctcaatcatggaaggattgggtgagctaaaatttcaaactgatgtaaaacagctaacagcaaacagatgtgattgattttaagaggcctcagatgaaggctcatgcaattacagtaagaggaattggctgttaagaataaataacattcttggtgactaatctgaaggagttatgtttgtaggattttattagtcattattaattatatatttctgctgattataaaaatgttacatattcactgtagaaaaattgaaaaacagagaaaaatataaggaaaataaaataatccataataatagattctttcagctattttattttcctatttttctctctgtatacttatagatgtaaatgtttaacaaaatgatgcttaagtattgctttatatattctttcttttatttgacataagcaagtgtttatcctatataattcttgaaaatgtatttttcaattatatgaattacataattacatgcaattatgtaattatatgaatatatagctctatttaataacttcccattgttgaatatttatatttttataatatattattacttataataacaaacactgaattttttacagaaatgtggtaaaggacattcttgcaatacatctttatgtcctacctacaattatttactggaataaattagaggtagactcacctggctaaagcataccaatgtatttaaaattcccaaaactaattgctaaaatatcttccagaaagtgtaccaaattacttcctcacctacaaagcatgtaagtgctgttttttttttaagagacagctctcactcttgcttaggctggagtgcagtggcatgatcacagctcactgcagtctcaaactcctgggctcacgtggtcttcccgcctaacctgcccaacagataggactataggcacttgccaccatgtctggtcaatttttattatgttttgtagagacaggtctactcatgttgcccaggctggttttgaactcctggcctcaagcaatcctcttgcctaagttcctcaaaacatcgggactacaggtgtgagacatcatgtccgatgtgaaactgctaattttattatgcctttccaaatccttaatatttaaatatttggagttaaaatattatggatttctaatttccttgattattaagcttcttttttaaatttcagaaattaatgagtgatataaagtcctctatccccacttccacactgtcattgccaatagaagcctgagtagccttaaatataatgtcatatcctgtaaaaccaataactcaagttctggattttattgggccaggcaaactagaaagaaaacatagctacaacgtgtttaaaaagcaagactatatcctttgatccttttttaactcagctaattggctcagaacttgttttaaaatttttcttccatgataactacatccaagacttcaccacatttgtgatacctgaaggtagattcaaggggaactagatatggtgacaacgagctccttaggagaggttcaaaccttgctggaatcatagaaagactgagatatcagcctggtaaataagtcagggaaagacacatctacaatttttgccaaatgaaagacatcttaatgatgtctgaagtaattaacatagaactccaaataggaattgagtactctgacgtatgagtggatgtgtgtatttacggacgcatgtatgaaccaggttagtcacaagaactgcatggttcttgtggtggttgggatgaacaatcaatagattcttgttatggggtcttcagcaaggctctttttcagaacaggatgtatcacaatgtagctacttcatactcactttttacaacccactcctctttgccgactgtcaaaatcctatcttctctaatggaaagaaaaagagggagcaatctggggtcagtctgggcagtgaaaagctgaggtttgtggttaaagcccttcagtgtgtggcagggcagaaagagcggtgcagtgaaagaatagtcaggtacactgatttgatagtgattcatctgaccaaggagaatgtgtcctcatttaaaatttcaggaaaataatatactgtagtagcagtgtcatgctaatgccaagatacccagaaggtcaactccaaactcaacaattacagtgcaatgtttatggaatgtttctaaagcaaccaataaagaataatctaagactgtgtctacagaacttttaataactattagtttttttgaactagttatttggcaatgtacattttttaaaaccctagttctttgccacacttagttattttaaactgtatagagacagagcaggtgggttaagtgggaacatatcttagttcaaggattgaatacgaaaccatcactttgtataccagcatttcttttgcaatatccaagaataaattggaaacttgggaacaacatatgcagaacatgtctttccagagagtatggtaattcatgataatttcctcttacagaaaacagaagatgaaatagtgggataggcttagttctgaccatcaaagaataatgggatggagaaataagtggcaggaagcttgggaaaaaattacgcaagtcaccgaggattcactgatacataaagaaatgaaagtctctgcaggcatggactctagaccagtgttcttcagaggggttgagttttctcccagagagaatgtgggatgacacattggagtgtggaagaaaatgctgaactgttattttaaaatgttttattagttatggtggattgaattgtgtccttccaaaacatatgctcaatgcctaactaccagtagctatgaatgttaccttgtttggaaatagggttttgcacctgtaaccaagttcacatgaggccacactgaatttgagtagattccaaattccatgactgtcctcataagaagaggagaggacacagagatacatgcagggaagacagccatgtgaagacagaagcagagactggagccacgcagctccaaggaatcccagggactgcaaggcaccgtaagaagctgaaaagcaaagggcagcttcttcctttcagctttcagaggaaatgtggccctgctgacactttacagcatttctgtcaaaaattcagtgtttattattataagtaataatacattataaaaatatgaatattcaacaatgggaaattattaaatagtgctatatattcatataatgccattgaaaactacattttcaagaattatgatataggatagacacttgcttacatcaaataaaagaaggaatatatgaagcaatacttaagcatcattttgttaaacattcacatctataagtacacagagaaaaaaatagaatataacagctgaaataatatattatcattatggttagattcaacaagactctaatcacatttaaaataatatggtgcaacattagtgagtaaataccagccatgtgatgggcacacgggtcagagctagaagaacatgagtaacattgtagagcaaaaaaagtcacctaaagctgcactggcacattctattacttcactgtgctgagtaatgcacaacagtttcttccataattacttctgatgaagatgaacacatatataactatggagaggttttattttatgtgatgtccacggtaaagcagtttaacagtgaccattagaaatagcaatgattgcaatgatgtttcctatgctttaattctttgatcagcatttcttctaggtttataaactacaaagctcatcaaactctctccaaaccaaatcccttggcaaatctgggtatagcaggccttcacagggatccaaaaattttaaataatgtttcaaaatattttggtacaagtggctgagctagatccaacaatcagcctatatttatttttcaatgcatccttttgatttctatttttgtatgtcttacaaaatatataatatatgagtttctatatatgcatatgttcacatagatctgtctatgcatgtgtgtgtatatatatgtggataggtatatatagcatgtctgtatatatctctgtgtgtgtgtgtgtgtgtgtgtgtgtgtgtgtgtgtgtgtgtgtgtgtgtagctagagagaaactacttagttctggactttctattattattactgtagtacatgcacataattaaaagataaatattggtatacttggggaagacatacgtaaagtgtttttattcataggtgcagatgatcaaaaactttaaagaccacttctatgaactttcaggatataaatttcgtaaagttaatgaaaacactcggttctattttattgccagggcaataaattgaatgacagctccagaaagatgggagactgtcaaaaaataaaatgttaacagtacaatcaaaaatgggcctgatggggaagaaaagggcagttattgtcacacctgtgaggttgcatagggagctcttctaggagttcagagtttaaaagaatatttgacactaagggagggggagattctatccaaagaagtacaaagggacagcaccttactgaaaaagaatgaaaacactgacattcacgaagtgcagaggcttttagaaaataccaaggaaaacaaggatttcaaacccaaaatatctgaagagatacattaagaataaggatgagaataagggaagaggaattggaattaagatactgtgggcttactgtgtgttaatcacaaatactatcttctctcttttaatatttgtaaaagtgtggtgagatgatgattacaaatattactttataggtgatggatgaggtgaggaaactgggatgctagattcattaacttgcccaagatcactccagcaccaaccagtatatagaagagactgaacagaaccaggacatagcagactccaaaccctggtctcttcactacataagggtgctaacctaataagattaaaaacttcctcccttcctttcttcctttgcaaaacattacatggccatattttagctgcttcattcaattgtgctagactaagttcttaatgagaggcggatatcagctcatgacaccttcactccgtaattccacaatatttctgggtctctgaaatacattaggtaaagagggatacaccatagagtaagactcactctctcttctcaggcagctcacatatagcaaattacagcaataaatgggtgctctaacagaggtactacagggctgtaggagctgtgggcaggtgtgtgaagtagatggttttcctccttcttacctactagggaaaatgaaggaaagaagggtagaaaaaatattacccataaggatgaaacacaaggtgtgtcagaaaaaaagtaacagaagaataagatgatttaaattcactcacaaaattatatactaagaaactgtaaaaatataaatataggaaagaaaaagaatgttatcctggtttgcaaaaagcagaaaaggcaaagtccaaaattccaggcagatgatggctattgctcctttgcacttttcttttttttctttttcttttttttttttttagaactggtcattaaacagatggtttataaggatttagaaagaaagtagtaactttcaggatgaacatggcataagtcagcattttccacttttccttctggaagctatccaaaaacaaggagaatcgaaatattctgcagatggcaaacctcattttctgtaacactaggagaacgagataatctgcagcctttgacatatgtgtaagggttgtaaaagcagtcaagactggttattagtcatgtgggaaaaggtacaaaagaagtgcaaagagggacaaaagagcccaggggtagcacatcttagcacctgaagatgagaagcatttttctgaaatgcaaaaggtgtattccttgtttgtaacatcttgtgcaggaattgtggtgagcagaactttgggcagaaatgctcctggaactggagcatggtggaactacctcaacaatacaagaggggccattcttgcaggaagcagtgtgattctgtggcaacctagaaggagaaaaggtttgagttgagaaaaaccgagagcatgaaaactgtcacatcttcttctgccacagaaacttcctcctgtaaacagctgcccaggaaagtcctataatttgatgaacgacaagaacatcaaaacaagtgagagagaggtgatcaagaacaaaagtagaaaaaaagtagtaaaatttacaaacacatgaaaaacatgtatcagtaaaatgatgccgtggcacatgtaaaaaaggtgagcaaatattttgtcacaatttttaaaacacaatgaaggcttcacctctatggaggaagcaataacttccatgaaggaagatcatgatgcagacggaagagaaccagaaggatcttgatgtgcagatatggaaatgtctttgagatgtattgttaagtgaaaaaggacatagaaaacagatacagaatgttactatttaggtataaaagcagtgagggggaaataaataagaaagtagattcttgcctttacagtgttttgtaattttatgtctaaaatgaaactctgagaggatatgcaagaaataataacagaggctacatgatgggggaaggggaggggcacaaatgaggttaaggagatagaaagtcatggtaattagagatctagctcagtttcactaaaataaaagctatgtccaattagtttcatttcctttctattggcagagttattggactgggctatgagagtaaagtcagaaattaagcttatttagatatcatattccaaaaaggtcatatcatatttcgttctggcctagatggagaaatgtgggctgggaatgaacacagggagtggattttgagctacttccatgaccaaagccaaaaggtgtgaagaaagctggatagcaaactttgaaggaagattccatccttggcctttttctacttaatattttttaaataaaaatttgcctattaaatctacaaaagataaaatggtaggaatcactaatatgctaaaaaaaattaaaagaaataatgcactggctctggtaaagatccaaaaacagtagataattgaatgagtggaataaatacaaaaacctgtaccgaagttgaaaaagacctgctgcatgctaggaaaagggagaaatgtgatttaaaagtcaatcatgcaaaaatatacttcttgtgtttaattgactatacactcaagtaaaatggatcccaaacttaaaaatatattactatgattcaaaacagaaatagttactattgctctgatcccaacatttatcagaatacatatgctgttgtcctgtaattagttctgaagaaacattttaaaaggggacattgataaccagggtatttcagaggggagaacttagaatttcaaactatttcaaaatcacttttataggaggaaggagttgaggatgttagcttaaagacaggtagcctagaaggacatttggtaaaactctccaaatatttgaacaattgccatttagaggttagagccaacctaccttgttctagttcagaaacacaaccaagatcaataagtagaatttatagaaagtaagatatagaatcaacagcaaggataattttttaataattggagatgttgaaaatgggagacattaatagccaaggaccatatgaagagcgacttaaccttaccaaaaattaaatacaaaccaaacaacaagattctactgtaaaaaaatatttttgggtctatcagactgacacaaatcatagagatggataacatgaagtttaggaaaagatgtagagaaatgaacatgtttatttattgctggcgcaaggggaaattggtgcaaccattgagaaaagtagtatctaccagagcgtaacatgcacatactctgtgattcagcatttccatttctaggcatctcatttgaaaacactcatgtcaccgtgcacactatgtgttccgagatgttcactgcagaattttttgcaatgccaaaataattgaaagcaacctgaatcagtcaatcagagatttttttaaaaaaaaaacattatagtatattcatgctctggactattctgcgtgtattaaaaagaacaaaaaagatctatctgtgcagattcaggacttattactaagtaaaaattaagttgcggacttgtagtataacttgtacaaacaagccccaccatgatgttatttgttggcacatcatggaaaaatcacctgaaagtatacaaatcaaactgtcacatcagaggtgtggggtgaggtgtgagagtggaaaaggactctatacacttttgtagttttgaattatatgggagtatgttaggtttttgtaattaaagaaataaagactttaaaaatgaaagggtcaatttgtgaggtggtgagctctttgtcacaggagtattcaagcacaggcctttttctgcttaatagttttgaaataaaaatttgactattacatctgcaaaagataaaatagaaggaagagtgtgaggtagtgaggaaagaaagctgaataagatgacctctgagtacccttgataccctgaaggtcgtagaaccccttctctactcttctatcctctaattcacacagcagagttccaacaaggtgaaataggatactgaaaaaatgagagataaatcgaggtatatcttgcagataactcatgaaatccaataccacagagtccttcctgatactatatactgcctctggaatgcttttgtcccctgtatacagatcaattttattgtactaaatttgggggtatgtggccagaccgatgtaagtcagtccaggaagctgacacaaggtttaaacacctgatcattcaagccttggcaagtgctcctgtgagctgctggatttccttccttccttcctccatggtcagctggagaacactgcccttaagttatctgaagctcctcttcgttaccacacacagtgctcaggcaggcctctggaaagcctgctgtccatttgtaggtgctggagtcttaggggcctgccagcttcctcctgctcccagacctcaatgccctggaaacagaggtgaaagcacatctgtactttcctgcttaccatttattggctacaaacagcactttccctgacagtgtcttcccttccttggcaaagagaggagtctgcaggaggcactgcacctggtaccaatgagtcagaggctcagctggggctgttgacagccaaacagttaccctatagggcaagaaaagagataaaagccaatcacatgccagacccacattaatgggttggattggaaactaaggttgatagtggtttttgttcttttgactcatagagccctttgatgagaaggatagctcaatttatggagcaggttgggcgcggtggctcacggctgtataatcccagcactttgggaagccaaggtgggcgaatcacaaggtcaggagatcgagaccagcctggccaatacggtgaaaccccatctctactaaaaatacaaaaattagatgggcatggtggcaggcccctgtagtccccgctacttgggaggctgaagcaggagaatagcttgaacccaggaggcagaagttgcagtgactaagattacaccactgcactccagcctgggcgacagagcaagactccatctcaaaaaaataaaataaaattatggagcaagtaccacatgttgagtactgaattaagagtttatgtatataattttagtaaatctatacaatcgtcctatgaagtatgcccagagaggttaaacaacttgcccgacatcacacaggacaactggagagtcatgcttcaaactcatagacttggccaccatggcaacctgtatttctgaatcaaagctcattagaggcccaataagtaacaaggttaaatcagaagctgatttgcttgactagtgtagcaaagggagatgtctagagtctggtctcttactgactcctgccaacctgttcaggggtcttgaaggggcttctggaagcaagaaaaactactagagcagatgacctctaccatgcttccagcccagacatcctgtgtgtgtctgcctgagtgttaaattgagtttcctcagttcatatgaaaaagtgagaaagtcttgctgtgcttctacaccaaggtcacgtgttcagtggttgtgcagtggttgctggctggagaggagcaaggggcacattaagcatggggaaaattcctaaagggttaattttgactagaagatttggggaaaaattttatgtaatttagctgcctaagaatataaatgacctttatatcaaaatatactgagatataatatagaataaaatgcaaatcttccttccccttcttctttttttttgaaacagggtagaaaccctgttttgaagcctgtttttctgttgcccaggggatcaagtgattctcccacctcagcctcccgcgtagctgggactacaggcattcaccaccacacccagctaatttttaaaaaattttttgtgagatagggtcttgctacgttgcccaagctggcccacaaattttctatatatatattttttaaaaagataaagcatttaacttcaaagacacttcccccttgaggtaggccacttcaagcttgtctctctcacccttgcaggaccaaattcatttacatgggttattacagagaggagcaaatgtatgtattctttgaacaaatatgttcatacggagtcaagatgatttgtgcctcattttatttttctcagattgtcagctctgacaaggtttccaggggtcccctctcttgagtcttcccccagacccccaagctgtattacagccccatgggcatttctttctaagcaggtacaatgataagcctgggcattctcacaaggaatggaggagagttacacggtaaacattttcctccacttgggcatgtgacccagaccagatctctttgctagttggaacatactagaaagcctgggaagagagtagggcagtcaggaagagaacagagatttggtggccatggagtggtgcagcccacatgaggaacaccacacagtgacagccaacgtgtaggtagtctttcccctcttttccctgcaactttcaaacctgtgcagtaggaaggtgcacagatagcgaattttcctaatgttgcaactagcattagtaatacacacctgcctgatcgtcacaggactccagagtataaaccaaaatcaggaaaagtataattccaggcatcacccagatacaagagatagtataaccaggtgtgtcagaaacaaaagcaaaggcttggggtaccaccccatcgattctattaaagaccaagaaggttcaaaaagcacaaaccctctctcactcctccaaagctcaattcatttggcttaagaggctttgcgtagtttagttagagttgatatgacacacagaaaagcatctcattttcactttttcctaaaatctaaaattaacattaacatctgtgtttatttccttgaaaattggagaaacaagaattagtgtcattaaaatcaattattaaacactttaaaattgtgattacaaatagtagatagcatggggtagagcagactgagaaaatgttggtggggggtatacatacagagatccaacaaatgccacatcaaaccagaacgccaggccatggatgagcccagactgccatctgaaacacaaagggaatttctactctgtaaggaaataaaaaagatgaaagactcgaaactattgttgttgttggcagatgtactagatacatttgtgaggtcagtaggaatattttctttctctcttgggcacttttgccttggcagccaagttctctcagtgtgtgattaatgcttgggtgatgctgcacatttgagaagcttacttcttgacaaaatccttcaagaaccacgctactctgctgcaatgacctggaactgcatagggtgaatgtaacatctggagctgggtttgactagagaagaggagcatgactcaggacacagagggcagccatccttcaataagccaaagcatgggcagggacagttcccctacaaagctgctcaaagggaaaggttgttcaggcctctaaaaatggactggagcacaaaggaaacatcgagctcagaaggccatcctcatagttaatttctttttgcgggaggcaatttaacttccagtaggctataacaagagtcatgcagaagtggctatggtttatgccaaatgcagaataagtaggaatagaaagaatattgggaaatacacaatgcaatctagatgctggacctattttagctgtggaaccttggaaggcacttaaattccctgaaacttggtatctgcatttgttgaagggtgacaaaatctctctcctactttcctcataaggttcttctgtatgttaaatggaaaaacatgtatataagagttctttgcaaacatgtatatagagttctttgccaactttagagtgattcataattaagaggtgatattattggctcattgctggggctgtatcattccaaggagttggattttctgaagtgctttagaagttttcaaagaaggttgtatgttatctgtattcatggtgtccccaaagacttaacttccttcactctgctgaaaataaaatatttctagagttttccattgtacttggcacagtgaatttattggtcttgactgttattatttcttttcatgttttgcatctccctagataaactatgagctcctgaagaatagagactttaaaaattactttccacacatgtgctagcaccaccacagtacctggcacatagtaggatctcaataaacatttgctgaattgatgcacaaatgaatgaacgacatcggtggaaaacccacatagacataattttcaaaatattccctaggattcaggaggtagttcagagcaataaataaagctaatcaaagtcgattttgtctggatctttgatagttattaaagtcgtttgcaaatgccatttctcttgctctgagcatatggaaggattgcagttttccatccacttgagctcaggtactgccacatgatttgcttcaactgatcaaatgtgaacgaagtgacttgtgccgtttccaggcagaagctttcattgtccttgcatactttgacatactcattctttctcctcagtgaccagcatcatttcagatagaagctgctgcactggcccaattactagtgtgtgtaatgcatggtagagataaagctggtgcatgatggatacattgtgtagaaaacaagacacctaagttattagaagccgctgaggtttctttttgtttctgcagcatgttctagcctatcctaacatccaggataccctttgtgcatcatgatatcaagatggatgattttttcattagccagatgcaccttctgaattctcacccttgcttcttcagtagctccaggcaaacaaccatctggctaagtcttaactttcttgtccagaaaacaaatatgactattaatcttctaagggagaaaaagacaaaatatgagtgaaaaatcaccccaaatggattcataccactatctaaataaatggagccaagtcaaggtaggaatcctcatttcagagtcttttaaaatggaggggaagaggacacagatgaacatttattgagtgccctctttagaaatcagctggtgcctctaaaacacttagcacagtacctagtaagtagaaagtacttaacaagttgtagctctttgcttgtccttcatacattcactggcctaagtgcattcacatatatgctgttactttagaggcacaaagcagagtggctaaaagcacagactttggagccttctgaaaggtttaaatcctagttctaatatactttttaattctgtgactttaggcaacatatcattccactttgcctcgtatgtgtcatctataaaatggggataatatcctaggaaggagacatcattatctttatttagcaataaatgaagctaatattgacacatcattcccatatgtgaccaatatctaaaatctctcccctgtgtgagtagcaaaagtctgcaatgaagttttgtgggtgggagatgtagagggaagattttaaacatcaagagcaacactgatttgcacaaacctgtgtagatcttcctcttctgcatccataaagtttgctgtgtatttgactgttccagccatcaaaatcctaacatcaaatgtgtccttagggggaaaaatcaaagatgttacctttctgccaagataaactgagctcaaggaaatttgaagtttagcttttctcctgtaattttaagtcatcagtagttgggatttagaaagcatgagcttaatgagaatactgttaacaataaaaacgtttatgagtacctactatgttaagcactgagtgcttttcgtgctttactaagtgctaagggctttactaggatatatcatttactctataaaaaatctctggagcaggcatttggggtgtgtgtgtgtgtgtgtgtgtgtgtgtgtgtgttttctgactatccagaatttgtttagcagtgcggattcatctcttctccacattctgtccaaaaagttccatgtgaacttagtctaccctcagtaacaggtgtggcatatgaccccagattggcaagtcagagcactacttttcccctgaagacagtgattgatccgtagatgagcacataatccaaggtacgataacctcactgaactacctaaactaaatctggagctctttgcttaagttattaggaaaaggcaggctttcctgtggaatttacagtcgtaagaatcagaggctggagtttctgtagccatcttgctaccatgaagggaaagcctgtctaggaaaagagttaaatcagaggaagtggagataagtgacaaggatagaaaaatcatgtcctggtgacatttttggagcccctgcaacaggtgccagaagcaaactctgtctccaggctttgtaatttttgaaagacagtcattcaattttagcttaagccaatttgatttttctcccacttacaactgaaagaatttcagatgatgcaaacttaaagttttccaaggttatacagcaaaatggggccatggctgaaatttaaatctgattaacggcaaagctcctgttctaagctgttatataatgcttgctcttctattatgttttgggccatgagaatgaatgggaggatgtgaattactgaacaaatgtaagggctgagttgtgtatggggtgggtcagggcagtggggaactagaagttacttactgaaaggtagtttaaaaattcccttgctttcaatagtatcattgtctgatgattttcttaattgatggaggagattagagctggaagacttgaaaacatagtgctctagggaactctttctcctattctgtgatggcttagcacagaagctggcagcacagtgcataccagtgaatgagcgagtgaatgaatgaatcaatatataaacatgggagaaagcctgcaaagagagcacacttactactattggctgcctgaagtattcatccactgtagcaccctggagactggacagattgaccccatagaaacattgctggtacctaaaatagcacaaaaaatcaccatgcatcttgtctgtcatctgagtccccaggccccccatagctgttatgtgcttcgaggctgcctcatgggtgctctgcgttagccctagggagaatgtttgcacatgtgaagggcagctggtctatagggtgtggcaggaaattctctctagaaaatttgcagacctgtatttgacctggggtggggagagaaagaaggggaaatgaagttgagttgaaataaattgggctcacccctgtaatcccagcactttgggaggttgtggcgggaggaacacttgagctcaggagttcgagaacagcctaggcaacatgctgaaacctcatctctactaaaattacaaaaattagccatgcgtggtggcaggcacttatagtcccagctacttgggaggctgaggcaggagaattgcttgaacctgggaggcagaggttgtagtgagccaagatcatgccactgcactccagcacgggtgacagagtgagaccttgtctctaaataagtaaataaataaataaacttgcaaggagattatcaagaatgatatttgctggcaggaaggcctttgagctcctacccttgatctcccctgacagatggccccccaactctgtgctgttctgtgctgtccaagtgctgaaatgcagtttccttggtcctcccactttcccaaccaagagcacgactttagatctccaaagccgcttgaccctcctgctgtttgagaaaatagattttccttctctgttcttccctagccactggctggtgccttcatgatggcatttgttgtgatacctgacaccaggcagcaagtcacaagtgagcagaggatgtatcaggtggtgatctggagccagctcataacagcttttcagagcgcactgtgcacatttcttcccaattctatggtcagtgacatctgaaccatagaaactgacaaacattacaaatcatgtctccacccctccccccacccggagagccagatataacgtgtttaccagcacacactggctctgttttattaggctgttgcaaaagtgattgtggtttttgccattaaaagtaatagcaaaaaccgcaattgcttttgcaccaacctaatacctttatgtatccactgcaatatagactgtgcctggagcatagcaggtatttcgtatcagcttggctaatggccttgaaaatttagaaaagcaatctaggctatgaaatcattctagttctgccactgactagccgtgtgattcagacaagtcatttgaactctgtgccccagtttccttatctctaaaatggacatagttataagcttgccttacagggttcttatgagggttaagtgagttaatttttaaaaagcaatttgaatgattcctggcattttgttactactagataagtgttagctagtatgccctgaatgtaaccttctcacatcagcactgggcactagggaagtgctgtccaatctgactgtgctaagggtttact

SEQ ID NO: 1400 - DNA, 64055 bp, Homo sapiens
aggtgaggctggaaatggtaaggggctgagctcactcagaggctagcacgaccccaggctcacacctgccagcaatgttaagaggcactgggagctgagaagggctgagggtgccacgctggggttggccaggtccaacctgccccctcctttgaggccctctccttccttcctgtgctggcctttggagcccacggtttcagcatccatcacggaccccaccgcacacccaagcgctgctgaggactttaactcctgctttggaattttcagtgcttctgattattcgtagactcaaaatcagaagaggctacttgccctaaacagaacatggtatatttgcattgcagatcattttacatttttaagaaaaaatgcagtttctctacaaagtcatccccctccaaaaacaaaacaaaacaaaaaacctccctagggattttgacagggctgccatcaggcgtgtgactgatttggggataattcccccatccctttgctttccattaccctgtggcccccgcgtccttcagggcaggtggccttgccttgtgagcatcctgcccgtttgggggcatttcctgggcacctggtagagccgtaggtgagaatggccccagtggtactgggcagatgtgagcacagggacaatgttagtgcaggaagtcaggggcccgtcagggctgttggtggctgacgcggcatccattcccctccccgcatccccccaacacacccgcaccctcatggatggtgactgcactccccactccagggcttgtctgattgatctaatggggcgccgtccctctggtctgtgattgctctggaatgagccacggagcccagagaaggaacatgcagagggcatctgagaactgcagcaggggacccagttgggatgaggcagccctggggaccttgaggagagaggcaggaagtgcccagtccttgacaccatccccgaagcctgccccacgcctggactccagccaaggcatgtaaggccaggtggactcagcagtgtgaggcaaagcacggtgcccggcttggatgccacatgtgttgagccagctgtgctgtggacagggcgctgtggacagggcacagcagacaggcgggggatgtaggcatcgggagggggagtcatggctggtgagagcacccctggagcgggaagtgctgggcagcgagaggtcagggaggcatgggggcttgggacggccaccagccacatcagagcagcactgctgctgattcccagcaacatggaatgaggccccttggcaaagtaacagaacgtatctttgaaatggcagcagctgatctttaaaacagaggcaagccgttcctgtctcaaaacgtttaaatcctcaccccaaaccattatgcggctcactgcacccgtggaaagccaacatcaatacctgcgtgcatgctggcctccctggcatgggcattctttgaggttgctggctcaaagcccccagcactgccagagggggaaaccggcaaacccaggaactccaaggctcagctcaacagccacacccttccgtaggccaaaggaagcaagagctttttctttctcactgttctcagggattcattgtttttgtttctgttttttgttttgttttgtgttttgggaaggggaccacgtcacaggttactatagaaacaacgcctgaactagatggatgacgaagctgttattcctcggggaggctcttcaacttgaaccaattgtggggccattctttagaaaacggctgtttttgctctgggaacatttttaaattatttcttcttcctttgcctcagatgggaggagcatcgcgctactggatcacctctaatcattttttcctttttttcttttttttatccaaagcccagctggcccatcacagggtcatgtgtgaaaagagggctccatgcaggtgttcagaagaatgttttcagtttgtactcatctcagaaaatgcttctgaaatgatgttaataaagaaaacaagatgccaatgtgcacattcagcctgggcctcacgcagcctggggaaaatgtgccaaaatgtcagcatggaaaggattcacagtgatctctaatttctttctcagacctttatcaagttcttactatttatgtgtttgtttatggagatggggtctcactttgttacccaggctggtcttgaactcctgggctcaagcgatcctcccgcctccacctcctaaagcgttgggattaaaggtgtgagcctccatgccgggcattactttttaagagcatatataacttagccacgagaaaaacagcagcatttttcagcaacaacaaaagggagagagatgagagaaaggcccccagagctgggcagggttgggggaagaaccgtgggcagtgggagcagcgaccccaaattcagccccgggccccgcctccaggccagctcctggcagggtggccccaccagggtgaagggcggctgtccgcggcctccaggtcaccagcagggcctggcttatgatctatgaacccccggccgatctagaggttagggctctagatggggcggggattcggttagagagggcagggtggaggggaggatagacaggaaccagggaggtccaggcccagtgggggctgagctgagcgggggaggcggggccgagaagggcggggcagaggagtgggatgagcgtggttggggcagggccagtggggcagggtcaaggctgtgttgaggggtagagtgggcgtggtcggagcggagccggtgggcgggacccggcggtgtggagctgcacccggagtttgtaaggatcaggaaagctgcctggagctgggcagacaggctgacccagggaccctgaccacctacctgagcttccacccagcttcaaggctgtggggatcgtttcttagccaaggtgaaaggccctgagccctccagtgggctctgagggtttgaatgtttattctaaatgggctccaacacggagtgcgcgtgcgctcaaggaccagctggctaggagcgccttctctccccgaggggatctggaatgttcatccgcggtcttcccagtggtcctctcctgagcaccctgggcatggggttgggaagtgggcacacttcttcagtgcgtggtactttctgtccctcccaatgacattggtctcttccaaattccccaggcataggaacagccacaagagccaactcacatttcccaaagccctctgggggcacggcagcgccctgggcagaggagagaactgcccagctcagcggggagaaatcccagtggtgctttccgttccccccaggctcgatgactgccatacttaccagctgggggcgctggtgagcactgccagtctccagcgcccgcccttaccccggggcagtgctgcttacagcacggcgactcctaaaggcaaggagttaaaggcacacggatcctagcactttggggaggctgaggtgggcggatcacttgaggtcaggagttcgagatcaccctgaccaacatggtgaaacctcgtctctactaaaaacacaaaaaagtagctgggtgtggtggcgggcgcctgtaatcccagctacattggaggctgaggcaggagaagcgcttgaacccgggaggtggaggttgcagtgagccgagatagcaccactgcactccagcctggcaacagggcgagactccctcaaaacaacaacaacaaaaacaaaacaaaaccaggcacacagagcaagcggcgggaaagccagatggaagcgaaatgggactttgcccttccgagcctcctgtggataaaatgtcaaagctgggcactcccccttgactcaacggggctgccgccccgagcccctttcatcatcctccccacagccctgaaagttctgtaactccactttagggatcagggattcccgactcaggccctgagctgtttctggagctttcactctgggcggtgtgggggagggggcccctgcggccttcaggtctgggcactgtccaggacaccagggctagccctgagtccggccacctgagattctgaggctgccctctcttgagcccacggtgctgactgggggtccctcgtctggcaaactcagctatgggcacaaagtcgggacaacaaaatggtgtgcacagaatgactcatttcatgtttttaaaaaccttttggccgggcgcggtggctcatgcctgtaatcccagcactttgggaggccgaggcaggtggatcatgagatcaggagactgaaaccatcctggctaacacggtgaaatcccgtctctactaaacacacacagacacacagacacacacacacacacacacaattagccccgcgtggtggtgggtgtctgtagttccagctactcgggaggctaaggcaggagaatggcgtgaacccgggaggcggagcttgcagtgagccgagatcgcgccactgcactgggcgacagagcgagactctgtcaaaaaatgaaaaataaaataaaccgttttacagctgcgcatgtgtgtaaaaacaggacacagcacttctgccgccccacgtgccagtaatgctccgactcctttactcctcattcccaggcccaggggcaggctctactgtcctctccattttacaggcaaggaaactcaggcttggggttagagagcagagatggcctgtagtgagttggacaggagcctgggacctttggctccagggtgccacactcccccaacctactgtcccaggtagaggagcttttgggggtgggtggttactttctgctcatctccttccttttttatgtttatgttaattttattttattttattttattttgggacatggtttggctgggtcccccaggctggaatgcagtggcctgatcacagctcattgtagcctccaactcccaggctcaagtgaacctcccacctcaccctcccgagtaattgggactacaggagagcgccaccatgcctaatttttttttttttgcattatttgtagagatggggtttcgttatgttccccaggctggtctcaaactcctgagctccagtgatccacccatcttggcctcccaaagtgctgagattacaggcatgagccaccacacccagcctgtctgcttctatatgactttatttttctcccatgaccatttattactcttttaatcatgaagaaaaagaggcttccttgttggagtccggtcaagcaagaaggaagcatgaaggaggaaagcatagctggggagcagtgtgtgaagttcagtgaccacccagtgagcaggggcgccccagccaggcagttgctcagaagcacagcttcagacacagggacccattctttctagaaccttcccagaggcctgctgcttccaccaggaggtacttgtgatttgtatgagatgtgagttgtccatttcctattcctcgtgaccaaatgtgtcttttcaattacggtcatttaaaaatgaaatgtgagtgaagacgatgattctagggcaatggttgtcaactgtggctgctctgtagaatcatcggaacttcaaaagatactgatgccagccgggcgcagtggctcacgcctatattcccagcactttgggagcctgaggcaggagatcccttgagcctagaagttaagagaccagcctgggcaacatagtaagactccatctctacaaacactttttaaaaattaaccaggcatggtggcacgtgtcagtagtcccagctactcaagaggttgaggtcggaggatctcttgaacccaggagttcagcgctacagtgcgctatgattacgccactgcattctagcctgggcaacagagaaagacccccatctcttaaaaaaaatattgacacctgggccaggcaaataatcacaacgttcaagtgtggcgcctggcaaagggaattttaaaagcaccctaggtgactctaacatgcagccaagattaaaaccattgttttctagagagagggggacatgcggagagggtagcaggaaagagaacagatgtgtttcgcttgttctttcagtatttctttaggctcattaatcaggagtgcttggacacgaagaagggaacaacagataatggggcctacttgagagtgaagcgtgggagtagggaaaggatcaaaaataaatacctatcgggtactatgcttattacctgggtgactaaataacctgtacaccaaacccccgagacacggagtttacctatataacaatcccgcacacgatcccctaaacctaagataaaagttttttcaaatcaggaatacttagcctagtccattttcatcccgaatattgcagttcatttttcatattctacatttccacagatctttaaataaaaacagagcaagaaacaggcacctcaagggatggtcactgttacagcgttcgcctgagacagccacttccgttgagaagtcacagaaacctccacccaggcaggtaccgaggacagcagacccagtgatgatgcgctgaggggcagctccagaggctgcagaatctctttcaacccctgagcgggagcccaagtcaccaccctcagctgacacaggaggaaaacgacgctcagaaggtccagtggcccaggcagcagcaaagctgcgatttcgaggccgacttggttccaaagcccaagcttttaaccgtcacgctataggacaccatgcagtcctccagattcgttatattttttattatttatttatttatattttttcagaattgaataattttatttttgccttaagaaactctaagaaccggcagtggctcacacgtgtaatcccagcactttgggaggccgaggcgggcggatcacgaggtcaagagattgagaccatcctgtccaacagggtgaaaccacacctctactaaaaatacaaaaaatagctgggcgtggtggcgcacgcctgtagtcccagctacttgggaggctgaggcaggagaatcgcttgaacccgggaggcggaggttgcagtgtgccgagatggggccactgcactccagcctgggcgacagagtgagactccatctcaaaaaaaaaaaaaaaaaaaaaagaagaagctctgagaactaacatcaggaatggttaatgaaacgtagaagttaaagtcatgacagggaagattgtagaagtatgaacatcacaacactgggagaaatgaacgaggtttcctatggttgaccagccaggaagccagtgctgctgagttggcatttaactctttagaatatgcacgcgttgacaatacaaaataccttgattaatgtttaccatctttatctttttggtacaataggggaaaatgtggcgtcatttcttcacagcggttgtgtgtgggggatcgttaccaccaaaatcataataatcatttatagtatattttaaagttagtcttgcaagatcgttatggcattttaaaatctctgtagtttgaacattttcattttatcatttcttttaacaaatactatttcaaatagttcctatccagaatatttacaggtaatttagcatagaagcaaatttgaagctaacttcaaagaagaaaaaaaagttcaatagccagagagctaaggataagatagaaaaaccacatagtaattttaaacagcattttgctgcagatttccaatccaatgaataccaggaatgaaggatttttttctcccaaagaagtatttcacatgaactctgaaccttggatatggaaacttctagaaaaactgaagaccctgagacacatgcaagtaagagtcttctggcaaaaatacaatttaattttccagtttccctcctctcaaaaaactccagaggatacctttagtaggcacagagtataatgtcatgttcaaaatttacaaaggacagcagcagcaaataattacgtccctatcattcagaatggatagtttttcattacagaattagctcctggtttgtcataataggcttgtagaaactgccaagttttattatgcaaactaattgacctagtagttgagtctgaaagatctggaagctctgtgcgcatcagtgtcatttacactggtagaagtaattatgtctaactagtgaaatagcattaatgaaactcaaacaaatttccactgataacatttcagagtgcacgctatagtcaaacagcaatgttataaatacctacgcagaaaagaaacagatagggtgattccagagaccacagagtcttaagttataaggtaatttcaaatttcccaagggttggtttacaaaatggtttgaaagtctaaacttacagaacagaaaacagataaatgcacatcactctaccccttggcaagcaaaggatatatatttttttgtcttattgcatgaactgatgcctgataccctcagctaccaacttaagtaacgctgaaacccctaccttcaaatccagcttaccgtcagatgaactatgtatacgtgggaaattatgattaaagctttacgttcaaagtcaagtaatagactatttttaaaaatacatggtaaggagaaaaaagtgtctatgttgaacaactgagaaacacttaagcgaggttacaaatgactaataactatgcacaacaatcttttccaggatcaactttttcctttgcaaaaaaaaatcatttacagacattcaacaagttaattctgttataaatgataggccatatgtatgttccaacctgcttccttttagtactaggacagtgtagtaccggcacttcagtaagtgttaactttattttctaagtgtttaaatatgttttgttttgttttatgaggcggagtcttgctctgtcgcccaggctggagtgcagtggcgcgatctccgctcactgcaagctccacctcccaggttcacgccattctcctgcctcagcctcccgagtaactgggactacaggcacctgccaccatgccctgctaatttttttgtatttataatagagacggggtttcaccatgttaaccagattgtctggatctcctgacctcgtgatccgcccacctcggcctcccaaagggctgggattacaggagtgagccaccacgcctggcctaaatatgtgtcattttcaaaagaagaaatgtgatatttattgttgttaagataaatgggaactgacaagcctatataacattccttacgtagtttctgatcgctataacattgccacaatttgcagatgaaataaaacttatttttgaaggggtaaaaacctaacagatcttgctgaaaggaaaatactagaacacggattcaactatttcaaataaagacttcctattggagattctaagtaatatgaacatttaaaaatatatgccagtaggctcccacctgaaatacataaaagtctcacctatggaatctatcatttacaaggatttatacataaagattcatttggtggctttcaaattccaaatttgaacattttcatgggaatatttccaaccctaagaagcaaaagggaaatctccattcaattccattctctatcatgtgacagccacagaattaaaaatacgtgcaaccggtgaaacccagtctctactaaaaatacaaaaaattagccgggcatgttggcaggcgtccgtagtcccagctactccggaggctgaggcaggagaatggcgtgaacccaggaggcggagcttgcttgcagtgagccgagatcgcgccactgcactccagcctgggggacagagcgagactgtctcaaaaaaacaaaaaacaaaaaacaaaaaacaaaaaaaaaaaacacgtgcaacagaacttttcacatcctcctgtctgcattacagatatttgttttttacccacggagaccgtattgcaaaggtataaagtggtctacccaacaaagtattttacagatgatggcgatgaaagcaaggattaattctaattagctaaatctaattcgttcttcagaggagagacttgtctgcaaggttgcaagggagggtagcaggaagttgctgtccacttggactagcagaatacacaactcaagtggagatttattctgacattttccagaacaactctaaaacttcttatttactctttatgccatctacaagacacaacacacatttattgtctcaatgttaagaaaactgagaagccagcactaaagtgctaacatggaagggaaagttgtaagaggtactagggtatgctaataactccagttttctactctccatgcctgcttcagagagccactgcttctccttctcgggccacagggaaggctgggagtcccccagcaacaacaagggcactccccggcgattctgtcccttccttaaacttcgctccagtcttggtcgacgtggacgcagccgccgcctcattatattttttaaaacacatgaaaagtcatgtcatattctagccatataacaaatgaaccgtttcggatcacaaatcccaaacccagtcaaaagcgtgtagccattgtcttaaattccaagtcattggttcagatgaaacctgtgaagctaaaaatctactaaatccatttttaggaagaagaaaaaaccaccctgccacaaaccagcaaactaatcgcacctgtatgttcacagggatgggatgcgcaaagcaaaccctgccgtgtgaaggcagctgagacaaagagctggccaggtaggtccctgcccggccatcccccgtcacagtacctgctgaggctgcagagcaggggcccaacacgcagacacccaacgtgcaggccacgggcggggcttctgcccaaaaccagctgtaccaggcgccatcctgacacctgcccgcccgggagagcagaacacagtgggagatccaggggcttcttcggaagagcaccgagagatcccgtctcctctgcaggctccctctctccgggccaggcctgcccttcacagcacagagttcacccttagtgtccccaaggccctggacttcttgggtgtgctggtgtctctctgactttctccctttggactttctggtaactctggccctccagggcagctctggtacttgggaagcctctagaaagacttgggcagaggcagcgatggcctaggcccactcaacccagagagctctgaagacacgccctgccttctgggagaactgcctggtgcctcctcaagcagatcctggggggccctgtgtgggggtcagttccctgtcctcaaggagctcactttgactctggggcaaacctagtgtgggtggtcggcatcagccattgtccatgtggggagactgaggatcagaggggcacatccagcctgggaaagccagaccacgcgcagctcttggcattgtcttcacctgctccgtcagcaacaccaccccctggggggcagctgggtgacccccatctcacagcaggggagacagggcttcgaaaagcccctgtgcaaagcagagctgggacttgaggccaccggatttggtgcagaggagacagcttggatccagggacaagctctgccagcagggaggacaggactgggtgatgggagcttagttttggaataaaaaaatctgcaaaggagcctatctgtccagtaagcaccacagaaacagagttcccagtggcagccaccattccttgagggcctcccctgtgtctagcactttccagagttttctctctgattcctccactcagacctagtagggacaactgcagggcctgggctgcaatggtggggctgggctgcagtggtgggctgggctgcagtggtgtgtctgggctgcaatggtgggctgggctgcagtggtcgggctgagctacagtggtggggctggggtgcagtggtgggctgagctgcagtgggtgcagtggtgtgtctgggctgcagtgatgggcctcagctgcagtcgtgtgtctgggctgcagtggtttttctgggctgcagtggtgaggctgtgctgcggtgatggggctgggctagcgcttcacgtgtgggtctctcacgcctggtaaaccaaatgccctgcagcaaggagtccacacaggagcctgccaggggcggctgctgatggctccggcttctgcaccacttgcccggggatgtgggggctccgtataccctagtattgttaccagaaaggagtcccagtccaaaccccaagacagggttcttggatctcagctgagtatacttatactgatttctggattataggctcaacaacaggtggattgtttgtgagttttccaagaaaggggaggggatttttctgaactgagggtccctctcctttttagaccatatggggtaacttctggacgttgccatggcatttgtaaactgttgtggcacaggtgggagtgtcttttagcagctaatgtattataattagcgcataatgagcagtgaggacaactggaggttccttttgtcgccatcttggttttggtgggttttggctggcttctttactgcatcccatttgatcagcagggtcttggtgacttgtatcttgtgatactaatcctgccaacctcctatcttatcctgtgactaagaatgcctaaccccctgagaatgcagtgcagaaggttcagcctcattttacccagtccctattcaacatggagtcgctctagttcactcgcctctgacagtgatgatctatcctttactggggctcagccttcacccactgaggggccctggatggaagcatgtgtttgcttggtggggatgacaagtcgaatttcccagcccctgtgatccagaggctcttccaagacaccgggactggagaggagtggggggcctagatgggggtgggcacgagaggctggtgatggcttcaagaggggaggggcacacttgccaggaagaggctgagtgcagcagagagcagcgggactgacatttgaggcaagggtcctgtggagggaggagggaagaagttggagagtgatgcctggaggccaaggtggcaccactgggcccttccgcagctcctggggggaaactgggttgggcccaggtgagcaggagggaagggagggttcaccctgggagtgcaggatgggtgctggtttagggtgaggacctggggaagcaggagaggttaggagaacgaccacgctgaaagtgaaaccgcctttgcaaaaactctatcaattagaaaaattgtaagagtgagctgagctaacccgcccctcatctttcctttcccttaatgattcctgggcttttgggctgagctaaccttgggagacatttaatttatagtttaaataacagcaggcctcccccaaaactcttctgcctgtgtaaacctaatgaaaagctatgaggcgagagggagaagctaaggtgtagacctctctagcaaaatacacaatttccccaactgtagattggtcttttgagatatcttttcaggttttttgcaggtctgatacccatggctctacctggaacccccaacctcactcctgtgacacccccctaagaagcgatttagcctgcaggaggacagctttgaccctccatgagttcatgtctgccccagccaatcagtacctgttacttggccacccctgaccccccaaactgccttgagaaacccctagctatgagcctttgatgagatgatttgagtacaaactctctctaccatgtggttggcctcatgtctattaaactctttctttactggaatgcatggtctttatttagaaagggagcaggaggaaccccttgggtggttacagagggcaggatgaaatccctttgaaatgagcagtacagaactccaaaggaagagatggggtctgtgtgtttcttctgccacctgaaataattgaaaggttcaaaatccaatgttatagagtttattcgaactctaagtttgacgaccaccactcaaaaaacacagactctaaaggaatgggctcagtgctctgaggtggagggattagggcttcacttaaatgggaaaatacaaggaggtttagcatgattacattttccacataagattggcttatgagttgcagcaatttgtttggttatatcctgttcccttcgggaaaagtatatttaacatactgtcttatggaatttgataggcatggggtcttttgtaccatctggtctgagttgggtgcaagaaaagaaagaagttaattcgtaacaaaaggtcagtaactaagaaagggaaggggtcttacatctggtgccatttagtctttcataacattttacaaatcaagaaaggaagagcgttaatctataattggagaagcaaagttcacagcgacttgctgcttgactagggtgtcagaatcacattctttcaaggctcgaagtaatttaaagttccaacagctttaatctgatgagcttattgtcgacaaaaagagtcaaactctgaaaaatatttgaagagatttattctgagccgaatctgagtgaccaatggcccgagacagagacctcaggagggcctgagaacatgtgcccagggtgatctgggcacagcctaattgtatacattttagggagacatgagacatcaatcaaatacatgcaagatccacattgcttctgtccagaaaggtaggacaactcgaaggtggagcggggaggttccaggttataggtagattcaaaatttttttattggcaattggttgaaagagttattatcactagaaaggagtgtctaggttatgataaggggttgtggagaccaaagttttatcatgcaaaggaagactccaggtagcacgcttcagagagtatagattgtaaatgccactaatcagacttaaggtctgtgttaatgttcatgctggtcagctttgctgaattccaaaagggaggaggacataaatgaggcatgtccactccaccttctcttcacagcctgaaccggtttttcaggttaactttggagtgccctggccaagaggaggggtccattccgatggctgggggagtgggcttagaattttatctttggtttacactactttcaagctgcgaacatcataagccaccttctgccaggtgtggccctggggaggggtcccttaacatgtgataggaggtgccaccacggctaggcagctacttgtcatcaggacacagaagagcctcttggacctggggaaggacctgtgagactgtgaagaggaaaagtcagttttgaatcaaacccattttataaataagaaaaattacaaaacgcttctcagaaggcggcggggtggggggcggtgaggagggggacccagggcacctaaaggctaattcttgctagagtcatttaaattttaacttaaattttctaatgttgctaatagacttaattatctgttcacaccttttaaaaatggctaaacatggctgagcgtggtggctcatggcaaaatcccagcactttgggaggacgaggagggtggatcacttgaggatatgagtttgagaccagcctggccaacatggtgaaactccatctctactaaaaaatacaaaacttagtcaggtgtggtggcaggcacttgtaatcccaactactcaggaggctgaggcaggagaatcacttgaacctgggaggtggaggttgcagtgagcccacatttcacgactgcactccagcctgggtgacagagggagacccgtctcaaaaaataaaaaataaaaaaaggaatggctaaacataaacattacttttacaatcaaaaccatttcaaaggccttacttcactggattctcagccagtgctgcccccagagcagaaggcagctgtggcaagcagaggggcggccccacctccacctggaagattcctgctcagatcctgggtcacctgcccaactgatgatgccccagctgctcctgctgcgaagctgaacccagaacccactcaggtctggtccccactccgcccccagcacccctagtgcggccacgcgggaggatggggcccgaggctgcaggggaggaagcgggtggatcaaggcaagcctcgcctcgcctcgcctcacccatgggtgttggtttttgttttttaaaccaaacagagcagagaggggcaaggaagcaaaaatgactcaagcccacagaggcagcagctctccctgtgctgggcacatgcccaaggctggctttggggacaaagaataatcaaagatgacactttggggctgccctctccccagccctcctgggcaaagtcggtgcgtcccaggagtcagcctggacttgaacctctgacacccgattgctgctggcctggtgcagggacccgaggggcccgaggacacaggaaagggcctggagggagagagcagccggactccgcccaagcaatttaggcgcctgcctcatctgtggtcccccacacccccagctcaccaagcagcaggacaacccctggaaatcccccagggaggcggggcgcagggattgcagtgaggccctgtgcccaggctggctgtgccctacctgcgggaagagtcactccagtccctctgggctggtccaggtgcaaccacagtaggacacaggtcaactccagtgaaatgtggagggaggaagggtgtgcctgcctgctccttcccctcccttgcagggaggggcggttgccctcagcaacagaatgcccacgtgggatactggaagcttcagcttaccccaccccacccctccaggcccggtttgtcctgggcgcaaggggctacttcagagctgccaggcctccacagcaacacattaaatgttctggaaactaggagatgtggcactgctgtacaacggtcaggaatagccatcctgtcctcctgacccggtgaaaaccagcttctgctgggaaggagcatggggtggcgcctggcttttggagtcaggaagaaccaggcttaagtaatagaactgcctgacctccagcttgtctcttcagctcccaggtctgtgctcgatttgggattattgggtggggcacataagaagctgcgttctgtgctctcagggtgctggacgctgtttcaggtaccagtacacaccagagggaagagagtgcctgatggcatggtgattgattttagtggagacagctagacactaaaccaggagttctgtcatgccagttggtgataaattgatttcttgaagatttttccacttccaagcaaggtagaatagatgcacctgtccccacgccctacactaaggacagttaaaatctctgtatatttccctgggtattacacatacatatataactacatacataaacgtatgtatatcaaacactaaaaggtggagagaagaaggcagaccatgtagggaccttgggacctgaggaatgacatgacaggagttccctgggttttctttctgcctcatatatctgtgactgtgtgctggaaaagccagcaacacgaaacaccaaaagacacagacaaaaaccaacaacaacaaacccaacaagttggccctcagccaaaataattaggcaagaggaagaaataaaaggtatccaaattggaaaggaagaacttaaattgtccctgtttacagatgacatgatcttatagaaaaccctaaagattccaccaataagatgttagaataaatgaaatcagtaaagttgcaggatataaaattaacatacaacaatctgtagcatttctataccctaacaaagaaatcaagaaaacaatgtcatttacaatagctacaaaaaatacttgcaaataaatccaaccaaggaagtgaaagatctgtatgctgaaaactataaaacatttgtgaaagaaattgaagatacaaataattagaaagctgtcccatatctgagatcaggtgccaaaaaaaagacatcccatgttcatgaattggaagaattaatattgttaaaatgtccatacaaccccaaacaatctacagattcaatgcaatccctatcaaaatttcattgacatttttcactgaaataaataaaataatcctaaaattcgtatgagggagtaacacctgctccacagtggcacaaagcactgtcaggtgccacacacagcctgttgggacatgtgggccacagtacttccccacctaaagtactgtagaggcccaggagacatgagccagggccattttaactgtcagtaatggccacaaagacccctaaatagccaaagcaatcttaagcaaaaagaacaaagctggagacaatacactacctaacttcaagatatactataaagctataataatcaaaacatcatggtattggcataaaaacaaacagaccaatgaaacagaatagagagcccggaagtgaatccatgcatttacggtcaactgatttttgacagaaatgccaagaaacacaatgtggaaacgacagtctgttcaataaatgatgttggggccaggtgcagtggctcatgcttataatcctagcactttgggatgccgaggtggaaggaccacttgaggcctccctccaggctccggaagagacctcctccatgatcccttgtctaaggggaaggttcctcaggaccttaccgtgggggctgaaggtggccacccctccaggaacttatgccccaggcgctgaatttgggctgcctaagtctgtgtgcgtgagtctgtgtttgtgtgcatgtctgcatgtctgtgtgtttgcatgcatgtctgtgtgtctgtgtggtctatgtgtctgtgtgtacacttctgtatgtctttctctgtgcatttttgcatgtgtctccatgtgtctctgtgcatgtctgtgtgtctatatgtctgtgtctttgtatctgtgtatctgtgtctgtgtgtctttgcgtgtctggtgtatgtctgtgtgtgtgtgtatgtctgtgtatgtaacggtgtgtctctgtggcggggggtgtgtgtgtgattgtgtgtgtgtgtgtgtctgtgtatgtaatggtgtgtctctgtggcggggaggggctgtgtgtgtctttctgtgtatgtgtgtgtaacggtgtgtctctatggccgggagggggtatctgtgattgtgtgtctgtgtgtgtctgtgtatgtaatggtgtgtctctgtggcggggaggggctgtgtgtgattgtgtgtctgtgtgtgtctgtgtatgtaatggtgtgtctctgtggcggggagggtgtgtgtgtgattttgtgtctgtgtgtgtctttctgtgtgtgtctgtgtatgtaatggtgtgtctctgtggcggggaggggctgcgtgtgattgtgtgtctgtgtgtgtctttctgtgtatgtgtgtgtaatggtgtgtttctgtggccggaagggcgtatctgcgattgcgtgtctgtgtatgtaatggtgtgtctctgtggcggggagggtgtgtgtgtgattttgtgtctgtgtctttctgtgtgtgtctgtgtatgtaatggtgtctctgtggcggggagggtgtgtgtgtgattttgtgtctgtgtgtgtctttctgtgtgtgtctgtgtatgtaatggtgtctctgtggtggggagggggtgtgtgtgatttgaggtggggacggggcctaggcttcagttactcacaacaggacggacaaaggaaacagagtttacccgttctgctaaaaccaagggcgggagggggacggggctgccggcagccctcccagagcccctggcagccgctcacgggttccggaccgcctggtggttcttgggcaccgcagtgaacctcagcttcctcaggacggcgggccagcccagcagctgctggtcccacaagtactcgggggagagcaccttggtgggtttgtggcgcagcaggtacttgttcaggtggctctcgtcgtgccacacggcctcgatgccgttggcctggtcgaccatcatggcctggtggcaggccctggtgagccgctgcacctcttgcaccgaccccccgaagaacccccccaggtagtagaaatcgccctcgtccttggggatgtaggcctgggactggggccggcgctcgtaggtgaaggcctcccggctgcttccgtagaagccggggtgcagggtgccgaacagcggagtcaggatctccacgcccacgtggtcgcggaactccatgtccacgtccacgcacaccaggtaatccacctcgctgaggaagcgccgctcgcagaagtcactgatcatctccatgcggcgcatggacacgtcctgccagcgcttgtaggcgcgcacctccagcactgacagctgccgaccggtccccagcgtcacgcggggcaccgcggccggctggtcggtgaagacatagtagtggacacggtggcccaccatgaagtgcttctccgccgtctccaggaacagcttcaggaaagccacgtatctgcaaggcaggcggacgggggctgggggagccgccggccgtgcacccctgggctgcaggaggcccgtcctgcacccgcccgccagcggccattggaaggcttagagcagcagatgcaccacgttctcctgccctgtcctgagcgagtcctcgggctgcgattcacttcatcctcttcccagcgatgggggaccaccagcaccccctcttactaaggagggctgagggcaggtggctggaggctggtagcaggccgcaggctggcgtctgctcactccccctcagcctggcctgagccacgcctccccacgcagctgcccctcttatggccaggccggccacgtgctccctcattataagctgcacgcgaggcctccacacacccgcctctgcaccctagagcttcctccctccaggcttgaactgcacctattcctaagagtaagtcattcctggcctccgccactgtcgctggcccagctgcccacagctgccgagaagtcaagtatgtgtctgcggttgcctggctagctccctctctggcctggcccagagtcccagggccttgtgggtcagccacttcctttggtgtctggggccaactgctttgcctgccccacctacatctgacagagaagtgaccacggctctgccagcatcctctttctagggtccaaggacagcaaacaggtgtccccctcctgctatctctggtcagtgagcaggaaacatctggagccttgtattgagggggtggctcagcatgacggccggccacagttacagagaggagggggcagcagaagccaccatccctgggtgagacgcagcctctggagaaggagctgggttttaccgacctggcgagcccacgagcccacgagcccacatgagctcagtaagatgctgcatgaatgacctttcccatctaccctctgggaggacaaggctggccgccaccccactctgtcttgaacacaaggagagacctcaatgtccacagtcactcgccactgcctgggtctctaccctcggccacctcactgacttacttcttgatggcaaacacagttaacccaatggtggtgttctggagcctgaactgctcgttgaggatgtcgatgttgaatgtgccctcccagacaatgggagccagccaaggggtaccacgaggacatccttcctactgcacatggagagaggcgtgcggtcacatggagctggcagggtgccacccacatgcgcctctggcacacggccgcccccacctggaaactccactcagcttctgcctcctctgaccacccttccagaggcagccgcccttccccgggaaaccaaccagaggcaaatgcgactccaaccgggcaaatcattcccagccctccctcaacattggacctgtgggaacacacagcaagctgagctttgctggcaaagagataggaacaaaccctccccagcacccaacccccgctgcccctccccaggtaggaggtacctatcaggcctttgcaggggctttggagaacaaagggacaggaaacaagagacgcaagtcagagaaagcaaagggaaagaggacagccatgtgggcctctgaattcagatgtcaggagaatctgagaggagagaacggggaagcagccccaactgagatttacatcaaggaaaccgccctctaataccttcagaacagccccttgagctgcgttcagtttcagtgtcagtaactttactcaccacggtgtcagcacctttgactgggggtagaccatcctgcaagcacaaagcgccgccacgtgagtttgcatggaaagcgtgggatgcaggtaagcagggggtgtgcacagccgctgaaccatgactgggcattgaccctcccgccaaggccacactcccaggctggaatcactgtggttgcttgggggctgtgtcagctcataatcccgggacctcgggaaagggccgaagctcagagtctctgattcagcacttataaactggcaagagggactaagtgacctcaggggccattgctttccacttgacttaaggctgggagggacgtaaggggttgtgtctcaattcactgtgggcagagaggaggctgggtgtgtggcctctgtccctggttgttcccagggaaaggccctgagatgtgcagacctccccacctgggcccgaagcctgctgggcctccttgtgggctgctggcttccagagcccggcttcctctctgagaagtgggagagtgacacctgctccacagtggcacaaagcactgtcaagtgtcacacgcagcctgtggggacgtgtgggccgcagtactgtccccacctaaaggattgtagaggctcaggagacatgagccggggccattttaactgtcagtaatggccacaatttgaatgtccaagatggcctttaaaagcagggagtcagcagaaaacaggaaggaaattctgacacttggtacaacctggatggaccgtgaggacatcacgctcagtgatttgagcccgacataaaaacacaggtaccattgactccacttataaaaggtagttggagtagcagactcataacaacagaccatggaatggtgagctgggggagggaaaatggagttgctattttatggggacagagcttcaggttggcaagatgaaaagagttctggagatggatggtggtgatggctgcacagcaatgtgaatggacttaacgctactgaacactccaaaatgactaagatggcaaattttatgttaagcgtatttcatcacaatttaaaaaaaatcaaaagcagtgtggccagcttggccttgattgcctaggtcagcactgataaaggcccacatcctgggaaacagccctccaaggccccagacagaacagaccagctggtcatcttctttaaaagccaatttgaaggccaggtgccggggctcatgcctgtaatcccagcactttgggaggctgaggcgggcggatcatttgaagtcaggagttcaagactagcctggccaacatggtgaaacgctgtctctgctaaaaatacaaaaattagccaggtgtggtggtgggcgcctgtaatcccagctactcaggaggctgcggcaggagaatcacttgagcccaggaggcagaggttgcagtgggcagagatggtgccaatgcactccagcctgggcgacagagcgagactccatcacacacacacacacacaaaagccggcgacacgcagctggtcaaaactgaagctccagctccatcgtgctctctgagtggctgcaggatgagggccaagtcagggtagagactggggaaggagcggccccctccctcagagccacaggaggaaagaggacctgccccagctcccacatgcttctgtccacacgcacacatgtgccagggctgcaggacaattctgtgacatgggaggcactgaagggaggcactgacattataccttggcaacgagacatgctgcagatggtcaggttccctaacagccatgctgcagaatgagaacacaggagatgaagtttagtctaggagcaggatttagggcacaagtgcatggaagccacccgagggtcccagtggaagggacacagcgtcagcctggagtgtggagcagaggccaccagaaacagtcacagaacaaccatcactgtggcgatgggcctggcgtgggcccgtgtgccagaccctgtaacggccaacgttgcagtctgaggtctacgttcggggagcctcacagcccacacattcaccagacacgtcgaagccaaggccgggcagagtggagtttcagaacatgtctacaaaccatgaggccccctcccatcaagagatggggtctgatattctgtgtttctaagaaataaatgcagcagaagtgacgctgggtgacttctgaagccaggcccaaaaggtgatctggcttctgtctcatctttcttgggatgttggtcttggagcctcccaaccaagctgagcaggagcccaggccccagggagaggccctgggtaggtgtctcagatgacagccagcatcaactgccagagatgcagggaagtctttgcagtgaccccagccactgtctgcccatgactgctgaggccccaaagtgaaccacccagctgagcccagtccaccccaggaagcccagggagagatagtaatcaatgattgtgattgttttccatggatggagtggtgtgttctgcagccatggatcactgacacgagtgggaattagcagacacagcaggggagagacaagagtggtcccaacagaggccatagcacaggcaaaggcctggagtcaggacagtatggcaggtggacgagtgacaggccacgttggctggagcacagagggcgagggcagaggagggagagatgaggctggggaggtcaggaaggcaggatcagaacatggagagcctcctaccttatgttctggaaagatcactccagctactgtgagaagaagggggacagggctgatggggatggggagacaagtctgaggctgtcacagagatgagggcagccccaccggagccctggagcaggacgtcgaaggcagggaggccagtgggcacgcgagctgctgaagagcagggctggcaggatttgggaacccagtgtaggggtgagagcaaagggagagttgaggatggctggtggaggaggggtggggatgggggagcagagaccatgcatgggaactctgggtaagcctggagttggagactggaggtcagaagggaggtcaaggctgactccagaggtatccaggtgacccttcaaggccacagagttgagcatgtctacactgggcagagcatagagagcgggcccaggaaggggagggggagttcccagagtgggacccccgcccacagccagcaccccggccagcatggatgctccacctgctcttccctgcactcaccagaacccccgttccaggcttcctggcattagacttctggggcttaggaacccgtaactgcagaaaggaagtgtgccaagactcaggacacagaacgaagactgcctgttggtcccttcctccaaaaagtgcatggtgcggccagcagcgtgagcacaagagttcccggtgaagctgcaaggcctcgaggcaggtagggcaagttctcagcaaagctcaggcgcctcgccacgtcccacaccgggaggtgggcaggagggtggtccctgggatattgctcacgtatgggcacctgctggagctccagagccccagctccctcaccccccgccaccagtgccttgatcagtgcagtccctgaggccacgtcagggagtgtttccaggccgtgtccagagatgccccagtagaggtgacaggtgacttcactcttggttctgggaccttctgtgtctggaagcgactaacagcttgggacccagaattgccttccccacccccagccacgcaattgtgggcaaggggcttgctctcccagccccagactccacacttaggaaaattttaaatgggagtgagatgagcctgttgcccaggtgaggctaaaataagggagcaagtaagcacaccctccgccagagctggacgcaggcaataactgtccttaggaccctgataactgtgatacttggggagctcagggaggccccatgggtctgattggctgctgtggtcacttctccccaaaccaggccagcctcgatggtcaaatgtgtcttacccaaacaagaccaagacaagcattattaggaaaaggatcataggtcgaagtgcgtggcattttggttttcctggaaaacaggagtagaaaaatcacatcactcaccctccttctctcacctgccccactttacctgtcccgccttgtaattcaggcatcacaccctgcgacgggccttcatctgccaagatggtccctctgccccacaggtgatgctctgagccccacctgagcatctccaaacccagtccagatctggccctcctcccactcagagaagagggaggcggtctgctcctcccagctcatcagcccgactgctcctgcagactctgagagccaccccggcttcccagtgacctccttccactcagcacccccttcccctgggagaccggaatgaaccacactgaaatgagcacgtcgaggtcactgtcgaacccaccgagggaggccaggacagcctcatggccaggctgagccaggagcccagaccagttcctgccagggagaggagccaccaacttcccctagtatctccctgctgtctcagaggctcatgttctggaaacaatcattgtctttaaggtgattttatgtatattaaagtcacgtacagtagtgcccttatccacaccttcgcttgctggagtttcagttacccatggtcaaccaaaggccaataataggtgagtacagtacagtaaaatattttgaggacaggcatcgtggctcgtgcctataatcccaggactttgggaggctgagccagcagaattgctggaagccaggagttctagaccagcctgggcaacatagtgagaactcatttctatcaagaaaaaaaaaaaaaaaacaattagctgggcatagtggtgcatgcctctggtcccaggaggctgaggtggaaggatcacttgagcctaggaggtgaaggctgcagtaagccatgatcacaccactgcactccagcctgggtaacagagcaagaccctgtctcttaataataaacaaaactacaacaacaaaaaacccacaaactaagatatatacacatttttttttagagagaccacattcacgtaacctttattacagtatattgtttttgttgttgttgttgttttgttgttgtttttgagatggagttttgctcgttgcccaggctggagtgcaaaggggcaccttcggctcactacagcctccgcctcccgggttcaagcaattctcctgcctcagcctcccgagtagctgggtttacaggcgcccaccactacgcctggctaattttttgtatttttagtagagacaggtttcaccatgttggccaggctggtctcgatctcctgacttcaagtgatccacccgcctcggacagtatattgttataattgttctattttactattaattatggttgttaatcccacccggtgcctaatttataaattaaaccctatcataggtatgtgtgtacaggagaaaacatactctctgtagggtttggtactatctgtggtttcagacatccactggggatctcggaacctatcccccgcaggtaagaggggactatcgttttcacaagggcaagcctgaaaggcgtctatctcctggcccagttcctattccttcccccgaaatcagtccctttcaactaattcatctgttacttcttatcttataatgcttgtgtgtgtttacctccacctttctaagtcctgtgaccacggagcgatttatctcgaatagcttcttgaaaccgaaacgtgggaggcaaaacatttgaactttacatgtcctaaattattttttccatttttgtagttggtagatcgtttggctgtagggaaatcttggtggaaataattttccttcaatgtggcaaaaatggttccattttttaaaactttgaaaattaatttaatttgagggataacttacatccaataaaatgtgcccactttaggtatacggttttgatgagtttcacacaatgtatgtacacatgtaatcaccccagtaaggtccctcctgaccctgacaaccatggatctgattccctggcgtttcccatacacggaatcctctgatacatgctcttttatgtctggctgcatcacaccgcatgctgttttgaagattcacctatattgtcacgtgtatcaatcgttcgttctttttcatttctgagaagcacgccattgttaatccgccacaattcatttattctgtctcctattgacagacactgtggttttttcactgttcggggccactagcaacaaagcttctgtaaacactcatgtgcaggtatttgtggacctgtgttttcatttcccttgagtaaataccaaggaatggaaaagatgggtcatatggtaagtgtatgtttaactttgtaagaaactgccaaactgtgttccaaagtggtgactgaattttccattcccgccaggaatgtacgagaaccacagtccttgccaacacttgatggtcactcttttatcctttagccatgctagtggatgaggagtggtatctaagtgtgtccaatgactaaggaggtaaatcatcttttcatgtatttattggccatttgcttgcttcttatgaagcctgtccagatctttagctcattttattatttatttatttatttatttacttatatatatttttggggggcacagtcccactccagttgcccaggctggagtgtggtggcatgatcatggctcactacagcctcgacttcctgggctcaggtgatcctcccacctcagccttttgagtagctgagactataggcatgcaccacatctagctgattttttgtggttttggtagagatggggtttcaccatgttgcccaggctggtcttgaactcctgggcttaagcaatccacctgcctcagcctcccaatgtgctgggattacaggcataagccacctcacccggccctctatttttattttttttagacaggatcttactctgtcacccaggttggagtgcagtggcacgatcacagctcgctgcaacctcgaactcctgagcttaagtgatctttccccctcagcctcctgattaggtgggactacagacatgcaccaacatgcccggctaattattctactttttgtagacactgggtctcattaagttgtttctctttttattattgagcagaatttatttctatattttggatacaagtcctttgccaaatacaaatattacaaatattttctcgccaggcacagagagacagacactgcatgttctcacttatctgtagtatcaaaacatcgaaacaattaaactcatggagatagagaatagaaggatggttcgcagagacttggaagggtagtggcaggggtgagagggtatgtagggatggttaatgtgtacaaataaatagaaagaatgaataagacccagtatttgatagcataacagggagactatagtcaataataatttaattgcacatttaaaaataactaaaagagaggtcgggcacagtggctcatgcctgtaatctcagcactttgggaggccgaggcaggtggatcacctgagatcaggagttcaagaccagcctggccaacatggtgaaacctcacctctactaaaaatacaaaaactaaggccaggcgtggtggctcacgcccgtaaccccagcactttgggaggccgaggtgggtggatcacgaggtcaggcattcgagtctagcctgaccaacacggtgaaatcctgcctctactaaaaatacaaaaaattagctgggtgtggtggcgcatgcctgtaatcccagctacttgggaggctgaggcaggagaatctcctgaacctgggagacggaggttgcagtgagccgagattgcaccactgcactccagcccgggcgacagagcgagactccatctcaaaaaaaaaaaaaagaagaaaaagaaaaaagaaaaaaaaagtttaaaaatacaaaaactagccgggcgtggtggtgggtgcctgtagtcccagctactcaggaaactgaggcaggagaatcacttaaacctgggaggcggaggttgcagtgagttgagatggcgccaccacactccagcctgggtgacagagcgagactccatctcaaaaaaaaaaaaaaaaaaagaataaaaataactaaaagagtatagttggattgtttgtaacacaaaggataattgctcaagaggatggataccagttctccatgatgtgaattttccattgtatgactgaaccacaatatctcagggaccccataaatatatacacctactatgaacccataaaatgaaaaacaaaatacttcttagaaaacaaatattttctctcagtcggtggcttatttattcatttttccttaatttttcttttgaagggaagtgttaatttttataaactctaatttatccttataaaaatgaaaccatttttatggtttgggccttttttttttttggctcatctattaaatttttgcctaccccaagttcatgaacattttctcttattttcttcagaattccataatttttgtgtattgtgtgaaaggctaaagtccctttcttccctcaatggatatccagtcatttcagccatttgaattgaaaatactttcctttctctatcacattaccttagcacccttatcaaaaagcaactattaaaaaatcaattgactatttctgtgtaggtctatttctaaactctgcattctattccattgaactatctgtctatcctaatatcaacctattctgattactatgtaaaattttagaatcagctgtcaactttacaaaaatttcttctggggttttaagtgagattatgtggactctgtagatccatctggggagaagtgacagtttagcaatgtaagtcttccaatccatgagcatggtatatttctccatttatttatgtcttctttaatttttgtcatcaatattttgcagttttctgtttttttgtgaccttctttttcttttttttttttttttgtcagggtcttgctgtgtagcccaggctggaatgcactgcaatctctgcctactgggctcaagtcatcctctcacctcagcctcctgagtagcaggggctacaggtgcatgccaccatgcccagctaatttttttttttttttgtagagacagggtctcactatgtcacccaggctggtctcaaacttctgggctcaagtgatctggccaccttgacctcccaaagtgctgggattacaggcatgagccatggtgcctggtttatattgcagttttaattgtatagacatttctcctaatttggtaaattattctctaaatatttcatgttttatgatgctactgtaaatggtatttaaaatttttcatggttcaattgattgtggcaagtattatagaaaaataattgatttattcttgtttttcttttttctttttttttttttttttagactgagtcttgccctgttgcccagtctggagtgcagtggtgtgatctccagtcactgcaacctctccctcctgggttcaagcaattctcatgcctcagcctcccaagtaggtgggattacaggcataccaccacactcaacttttttttttttttgtatttttgtaaagatggagtcttgccatgtgggccaggctgctctcaaactcctggcctcgagtgatctacctatcttggcctcccaaagtgctgggattgcaggtgtgagccaccacacccagcctgatttattcattgactttgtatcttgagaccttgctaagctgacttagctgatgggctcacagcataaacatatataatatatatgacaataacagcataaaggagcaaggaggcaatgaagttattatatatactggagcaaggaaaggtcaccagacaataacttgaatatacaggaagaaatcaagagtaaagtcagtgataaatatacagtgtaatataaaagacttgaaaagtgtttttctccttacttgtcttactgaattgaaaagaaataagattgtgtgaaacaataattataacaccatgttgttgagtttataacatatatagatgaacatatacgacaataatactacaaaccacaagcaaggagggaggaaatggagttatactggagtcaagttcctgtattttactaaaattagtattaatctgaagtagatcctgataaattaaaatgcatattgtaatccctggagcaaacactaacaaaataactttaaaatatacacttaaaaagaaaaagggaatttaaatgctacactagaaaatacttaatacaaaagaaggtagtaaaagatgaacagaagaacaaaaaggcataaaacatagaaaacaaattgtgaactgatagatggaaatccaaccacagcaataataacattgaatgggaatagaatgaacatgccaatcaaaaggcagagatcgttagactggattttttttttaagctttgactatatgctgcctgtgagagacatacatactttagaaacaaagatacaaataggtcaaagcaaaaggatagtagatttgctatgcaaacagccgtaagggagcttgaggagaaatgctaacgtcagactaaataatttttttgtttttttgagacagagtctcactctatcacccaggttggagtgcagtggcacgatcttggctgactgtaacctcagcctcccgggttcaagcaattctcgtgcctcagcctcccaagtagctgggattacaggcacacaccatcatggctggctaatttttttgtattttcagtagagacggggtttcaccatgttcgccaggctagtcttgaactcctgacctcaggtgatccacctgccttggcctcccaaagtgctgggattacaggcatgagccaccccatctggccaacttttttaagatcaaaaatcttactaaagagaaacattctgccatgatataaagtgaatacatcacgaaaatataacagacagaaatatatacatacctgacaacctagccccaaaatactagaacaggaattaaaagaaattaaaaactgtgtaagcaaaaactcagttgtatgtaaaaaaccaattccccttgaggaagagaaagggctggagtcctttaaaaattaactgtctgtttttctgtggctagtgagccttatctctccctttcccaggcattgcgaagactctgtttctctagctgtgcagctgcaaggtcactaaacagataatcttgagtcataaaacgtgttgttccttgaaaagtaagaaataatgtaatgcatgtcttaactgaataactgtctttgtttctcgcttctgtaatactcttccccctgcacaaatctccccccaccccacaaaatgcttaaaaggtagcttgactctttgtttggggcccggtcctttggatgttaatctgattgggtcggtgcgcctaaataattaaataattcctcctcaaccccatcggtctctctgattccttaattatcccgcagcaatacatgaagcaaaaactcacagaattgaagggtgaaacagtcaattcaccagtaacggttgggccaggcatggtgactcacgcttgtaatcccagcactttgggaggccgaggtgggtgggtcacttgagcccaggagttcgtgaccagcctaagtaacatggcaaaaccctgtctacaaaaaatgcaaaaatcagctaggcatgatggtacttgcctgtagttgcagctactcaggaggctgaggtgacctaagccttgggaggtgggggctgcagtgagctgtgatcataccactgcactccagcctgggtgacaaagtgagactccacctcaaaaaaacaaaacaaaacaaaacaaaaacaacaaaaaaacaataattggacaccaaaatcctaccccactctcaataatggatagaaaaattagaaagaaaatcagtagatacaaatgacttgacatcactggacaccaactgacatctctagaacactccacctggcaagagccgaagtcacgttctcctcaagtgcacatggaacagtgtccaaggtcaatcatatgctggaccataaaacaattctgagaaattcgaaaggactgatatccacagagtttcttctctagccacaggggaatgaaatcagaaattaacaaaagaaatttgggaaacctataaatacatagaaattaaacaacataattctaaataagcaatgggtcaaagaagaaaatcaaaagatacactgagctgaatgaaaatgtaaacacaacataccaaaatttatgagatataactaaagctgtgtttcaagggaaatttatagctgtaaatgtctacattagaaaaaaaatcttaaatcaagtgtgtaagcttccattgtaagtaactacaataagaaaagacagaacaaattaaacccaaagtgagaagaagggaaattaataaatattagagtggaaaccaatgaactagagaacagagagaaaaagataaagtaaaaaaaatcaaatgtcagttctctgaaaagatcaagagaattgacaaagctttagctacattgaccagagagagagagaacacaaataactaaaatcaggactaaaagaggagacagcaattccaatcttacagagattaaaaggatttcaaggaaatactatgaacaactgtttgccaacaaattatgcaacttaggtaaaatggacagattcttacacataaactagaaagcggttagaagaaaatataagattaaatctttgtgacactggattaagatttcttagatatgataccagatacacaataaaagaaaaagttaataaattggaatggatcaaaatgtaaaacttttctacttcaaaacaccaataaaaaagtgttaagacaaactattgatgattgaaaatatttgcaaatcatatatctggtatatatatatatatatatatatatgatactgtgtatgtaaagaactctcaaaactgaacaaaggagacaactcaatttttaaaaaggcaaaacatttcaacaggcatttcaccaaaaacatatacaaatggctaaaaagcacaagaaaagccacttgccatcatttgtccttggggaaatgcaaatcaaaactataatgagataccaccttttacccacaagaatggtatgtattgctgcagatgtacagacagtggaaccctcagccaggcgcagcggctcacacctataatcccaggacttggggaggccgaggtgggcagatcacttgagcccaggagtttgagaacagcctgggcaacatggcaaaaccccatctctaccaaaaatacaaaaattagctggatgtggtggtactcacctttagtcccagctactcaggaggctgaggtgggaggaccaattgagcccaagagattgaggctgcagtgagccaagatcatgccactgcactccagcctgggtgacagagcaaaaccttgtctcaagaaaagaaaaaggaaaagaaaattagaaccgttatacactgctgatgggaatgtaaaatggggcagtcactttggaaaacagtttgctagtttcttaaaatgttaaatcagacttcctgtatgacccagcaattcctctgctgggtatcaacccaagagaaatgaaaacatgttcacacaaagtcttgtacacaaatgttcatagcagtgctgcgtgcagtttaaaatagctaaaaaagcagaaacagccgaaatgtccttcagctgatgaatggataaacaaaatgtggtctatctgtacaatggattattcagtaataaaaaggaattaaatactgatacatactacaacatacatgaatctcggaatcattattctaagtgaaggaagtcagatgcaaaagaccatgtaacacaggactccattcataggaactgtccagaaaaggcaagactggagagacagaaagtgattgtctgaggccaggtgggaatggggaatgactgcagaggagttccagggagttttggtgggctggggatggaaaagttataaaatttatttcacaactctgtaaactaactgaaaataattcatttgaaacaggtgaattttatggcatatcaatgacacggcaataaagctgtttctttcaacggtgccatcaaccccagccccttgaccctaagctgaaggaagagagatgctaggtgtgttcagtagggctccgtcaaagctgattttttgaagttatgggcagcattccgagtaagatgttttgtggcaggtcaggtctcactaacgcaggcctccctaacaactgtttcagtactgactgagtggttaaattaaatattaaaagccagtgcccttataaaaaggctggaatataacaaaatcccaccaagagttttgcctagacctttcctgggccttcaagcatgacaaaataacaaaggaattcttaacaggacccatttaggattaaataagttttattggggatctgaagaaattccccaggactccacaaataagtttactgggggtctgaaggaacttcccaaacccccatgatttaggagacaagataagggttttagattaagtaaatttactgaggatccagaggaaggtcttcaggactcagaccttagttatagattaacataagtcaattacttacgtcttgagatgaatgcacacttacacatagacatatagcttagaaggtatataagctctggaaaactttgtaattttgagttggtctggagataatttccaggtcttctccttgtaactggttacagaaataaaaagtctctttctccccagttcatctgcatctcgttattgggccacgagagatagcagccccaccctcagtttggtccaggaacagtttgatctcttcttggccaatctctggtgagacccaccagaatggaggagagccgggactgggtgcactgccagcttccaaaactcctgcacgtggtctcagtcctccagggattatgatgggtgtgaaggagctgagcattctctaaggagccagcacatgacacccagctcaccgcccaccaaccacatcctcatggtcatctccaaggctctctcatgtcctcttcctgcctttcgggggatcactccctctgactccactaccctgctctcctgcccgccccaacaagcctgactgatttgtggagccgggccttccccatgtgagctcttctccctggcatgcttgtcccccagatttccacacactgggtccctcgccattggtgtccctaaggacaccagctcaccagctcctggctgcaggcaccttctagcacaggcctgcttgttctcatcagtgttcaaccaacattggttggatgactaaatcaacatgcagaatgtgggtaacctgagaatgggcactcatttgccaggtttctcaaagacctaacctcttagtcttcaagacgtttgtcttgggtgcggtcatgggccagagccagtgccagaaccccaggagtatagagaccaactgcccagtccctggtcctccaaggctccctgacatgagaccaactaagacagcataacccgtggggcaggacagactcctggggtggcagctgtgttcatcatcttgactgggtcaagatgtatccagctgtaccttttatgtgcggtttattgtatacatccgttgaaacatattaagacaaaaaagggaaaacaaagaccacaaaggagggacagggaagaacccggaaggcgctggcagcacagggaggaggcaggtgtttgcagtcagacctgagtcccaggccccactcagcccttcctgcctgggaccagagcactgtcccagatctctccaaacctgttttcccgtgggtgaaagaatgacccgggaagtatttaccgttccttcctgagaactcagcgatattgaacacagtgctgcctcacagtaaacactgacaaatggtgagcattactgagggcagggcctcgacctacaccatacccagttttcttcatgaattttccactcctctgcctcccgctcctccagggctgcacctccggggcaggagccctcaccaagtcaggcctcagtatgccttatccgccacctgattccaaatcaaagtaaaacatctctccccaaatgtgtacacagcactcctctaaattaaagggctgtgtgctggctctgggtaccccacccggctctccctggcctttggcgttggggttcactggcctgcagcctgcgccccgtggccctgcgttctgcatccctccctctgaagcgacgttgttgtctgggtaaatactcaattcatcttctggcgccaagaaaattaaggacaggtgatccaccctcggcctcccaaagtgctggggttacaggcctgagtcaccgcatctggttgcctcaataatttcttcttaactcctatatcacctgagggcccggggcacagttcccccgtcacgcttggcattgaacttgcccacctcgccttcccgaggcgcctccgcgtttggggtatggaggctgttcccggtcaacccgggcgcctggccgccgtgcccgagggaagggctggggggcgggcagggcagcccagagccttgtcctagtccagggtcgggcggtaggtgctgaaaatagcagctcatggaaggcggggagcgtggaggggcgaggagaggctggagaccgccacggcgtcgagggaccccgctctcaccaggacccggggaccccggagacgagccccccgccaggccgcgccaccgcgcccatcctccctgcgggtcccaggcacccacagcgcggccaagcccacctgcccgccggctccccaggacgcagggtctcggaggctggggcggcggccggcccgaagcctcgcagccctgagcgcccccaccccggcccggctgtcgggtgcaccccgcattccctgcggtagcggctccctcgcgggcacccggggccgaggcctgcactcaccggccagcgtccgcaacacctcggccatggctccgcgtctggtctcggcctccgccttccgcccggcggccctggggcggggtgagcccgaggcgccccctcccggcccgcgccgcccgccgccccgacttcccgaggccgaacacgggaggggacagaggggcgcgggaggcggccgcgggtccccagggacccctgctaggaagggacggcgcctcctcgcgcgcatccccaagggacccgcgcgcccctcgtggccctggtaccttggggccctgtccccgcatcccgccctggggccgagcggctccgggtgcccctgaagccccgtccccgggggccccttgacaccctgtctcccgggcgggggcgaccccctgacatcctgctcccccggggaggcgggggagacgaacccgtgaagctgcggccccagaacccacgatccccggccttccggctcgcgcgcgccgcagcctgtagccctccagccccgcaggaccctgtgccccgcgcccgcgacgtccccctaggcagagtcgcttccccggccccggctcgcggccccacggagctctgcgtcccgcagactgaggaaccttcgcgttccccctgcgagcaagtccccctccggcgcccgcgccgggccctgaggcctcttcgcgcggtccgtggacaaagccccgctccgccccgctacgacccccgcccttgcctggcgtccgctcgaggaagctcaggagagggcggcggcggctgcagggactgggagagcgcgccccgctgcgaagaggagttacctcccgaagggtcccagaggcttcttcctgcttttcctgatatctctcagaggagtttacactgataacccgttcacaggaccctgatcccgtcccgccctcccggggcaccgttctcatctccgtgaaagctgggggcatctttaatgcttcctttccctcccaccccaagtccagttcgccagctccgagacgtgtccctggtgcaggcgcaggaaaaaattgtggcaattcctcaaaacatcacacagaattaccgtacgaggccgggcgcggtggctcatgcctacaatcctagcactttcagaggccgaggcgggcggatcacttgaggtcagaagttcgagaccagcctggccaacatggtgaatcctccatctccactaaaaatacaaaaattagccggtcgtggtggctcgagtctgtaatcccagctacttgggacgctgaggcaggagaatcgcttgaacttgggaggtggaggttgcagtgaaccaaaatcgcaccactgcactccagcctgggcaacatagcaagactccttctcaaaaaataaaaataaaaataaaaatattattaccgtatgagctggcaatcctgcttttgtgtatacacccaaggaattgaaagggggtctggaagagacatgtgcacatctgtgttcctagcaacggaactcaccatagccaaaagctggaagcagccgtggtgttcaccaaggcgtcatggctgcacggagtgagtctgtctctagatggaatgtttctcagccctagaaagggaggagacgctgacacctgctacagcgtgggtgagccttgatgccttatgctaagtaaaatccagtccaacaaggaaaaatgccatgcgattctattaactttttttttttttttttggcagagtctcgctctctctcccaggctggagtgcagtggtgagatctcagctcactgcaacctctgcctcccaggttcaagcgattctcccgcctcagcctcctgagtagctggcaccacagatgtgtgccaccatgcccggcttatttttgtatttttagtagagactgggtttcaccatgttggccaggctgttctagaactcctgacctaaggtgatttgcctgccttggcctctgaaagtgctgggattacagatgtgaaccaccgcgcccagccacaattccacatatctgagggactggagtcatcaaattcgtagaaatagagaggagaatggtgggcgcctggggaaggcgggaatggggagctgtgaacggtgttgagtttcagtctgggaagatgaaaagagtgttgtagatggatgctggtgatggctgtacaacgatgtgagtgaactcaacaccatggaactgtgcgtgtttaaatagttgagatggtaaatttcatgttatgtgtattttaccacagtaaggaaggaagaaaggggaggatgaaagaagaaaaggggaaagaagggagggagggaggcaggaaggaagggagggagggagggaagttccctgtgggcagcccttaactattcagagggacaagtgggacaagcctgggggctgtgttcctgcccctgagggactctggcccaaggcttccctgcctgcagaccccattccaacaggccacttctgagactgcagagccttggtggtctccaggtccacgaccagggagccccacatggggagggtgctctccactccacccacccatgagctgagggttaggctgccgcccagcatcctggtgccacctgccctgtttgtggggctgagtgttctccctggacgggcctggcacatggaagagctcagtgatcagctgtggatctggtcctctgaggctgtgccctgtaccgtgaaggacaccagaatatgtcactccaaaatgagcctcagaaattatcttgagttgaaggcaactaagatgcagcagaagcagggaaatctctctctgccctgtccctctgctgtctgaggcaggatggaaattataggagagagacgcatcagccagaggaaagaaggcaccctagggctctgtgaatgaaacttccaccttagtttcctcccaatactcaccttgctggtttcccaaacttggaagcctaaaaccgctctcctgggtcctgtcatttccccacacgttgattattctttgttgaagttgctccataacccagttctaagtcactgttctgagttgctttttgttgaagcttcttcagtgaggtgcactacatgcattaatgaactgtttttctcttttgtaaggagccccagctggaaccctaagaggagcagagggaaactttcactcccctaccatggcacagtggcctgccatgttcagggctgggggctagtccgggttctcacaccttttggctgactttctagccccgacccctcgtcccatcagctcactgtttccataaaacatttgtcatggcgatgtgcaaggagctccctgccactgccctgaacttcttccctgaaagcagccagccagtgttcagaggaagggaaggaataaaaggctctgcaaaggagagcccggtcagaccaggaggtgtaagcatgaaaccgatgtgttactcacaagaccaggaggtgtaagcatgaaactgatgtgttactcacaagcggctgggccagggaaggacttggttcagaagagggaacagtcttgcccaaggtcttgcaagcttgtggcccaaacccaggtccagggagacctccattctggtttgcatgtgttggaaacaagtgcttggtgtagcgaaaagaaacccgcacttagaaaatttctcagcaagtcacttttacttctgtagaagggtgctgcctgtgcctgttacaatcccaagagcacactgaacaaaggagggaaggggtttttatccctaacgcagtttctgtttctgtgtccttcccctattggctggggtaacgcagtttctgtttctgtgtccttcccctattggctggggtaacgcagtttctgtttctgtgtccttcccctattggctggggtaaggcagtttctgtttctgtgtccttcccctattggctggggttgggccgcataatctaagctgaccccgacaggctaatgcttaaaccttcccaaataaggtaaaggtgtgatttttgaaaaggttgtaggggtaggatttgtttccaagttatggccaggaagttgaatctttgaagaggaacttagttgtcccaacaatttcccctcttctgttttatagttcttccccttcaaatttatttaacaggagttggctttgttgttcttctttatcatctaggagcaagagcttatctgactatggatggggagaggtgggggaggtttttgtgagagctgcttctatgagcctttgggttaacccacgaatacaaggtatgatacagcagcccacaaggatgagtacacctgtaactgttgcaagggaggtaaagatttaggtcatgagtcccttccattttccaaaccatttctccatgacacctgcaaaggggtcatctattccagagttctcggctaattcatttgctagggtggtaaggcttgtaaggcttttgtgattgtcccgtccagggctgtgttattggggataaaagtgcaacattggaccccaatcatgacacagactccgcctttttttggccaatatcatgtcaagggctatcctgttttcccaggccatctggctggtagggcctaattgttgagctattctttttatggcatctctggtgtaattgatgaatcactgttgattatagtatatataatgtatccagtctacatttttgtttatagtggaccaccagaataatacagactcaaacctggtggctatttggtttcgagctttgaattcattttgtaccccccagcgcaaccccgatactgtctatgtaaatatgagagatcaaaggacccgtgaggggtttctcttttcctttgggttacctgcttcctgtctggttgttgaaatgccaaggtgaaagggatggccaattggatcggagcgcaaatgctgctccaattgtttggcagagtactcaatattggtcccccacaataccactgtacatctgcttggggatggattagggctgactgactggttagctcttggaaaggtttaggcccagtacatcccatcaggtttcccaggaacgtcagattttccccttgccatgagagacatgaggtaaaattggcatcaagagctggaagtcgaatggcccttgggggctgtcccgtagggcttctgacttttgggaaaactggtggttttggcaatttgagggtgtgactcctttggtaaggtggatgtaaggttttagggcggtgcaaccctctgaggaggtccagccctgatactgggtggtctagataacatctccccaattataacataacccctggaaggctcgtggttgtccatcacaagggtttctgatttgtctgaagcgggtggaggggcagaggtacttttctgaagaagctagctgtttttgactctaaaggtctccacagggcatgacaaggcaagcattgaatgtgatcgtttgagggcagggtgatcgggttacattgatgataagatgttctttggtaactaaaggaattaaaaaaaaagacagactaaacccttttgaacattggtttggagggtgttggtcctggagtgacagtccatgactttgcaaggggtgggtccctcctttttcggcctttggattgctatctcagtggttaggagtattagataaggtccttcccaggttggtttgaactttccctctttccgtcttttgataaggacatgatctctgggctggtgttagtgaactgggaattcgaactagggtggagtttgccctagaaggccttgagtcctgagggaggaaagggtggaagacagacaaaatatacatttttttagaaactgatcttttgtttcaaatgtaggaaggtcagtagtggaatttagataaggcagtccatagagcatttcgtaaggggacaggccgagatcttttcgaggggcagtttggattcttagtaaggcaatgggaaggcattttgtccatggtaaccgcgtttccaagattagtttggttaggtgactttttagagtttgattcattctttctaccttccctgatgagggtggatcagggaatatgatattcccatcttattcctagtgcttaggttagccccttaatgatgtgtgcagtgaagtgggtcccattgtctgaatcaatgttctctattagtccaaacctgggcatgatatgttccaacagggctttgactacgttactggctgttgcgcttgggaaggggaggcttctacccagtgggtgagatggtctactattactagtaaatacttgaggaggcctactgggggcatttcagtgtagccaacttgggcactttggaatggcctcaaccctgggttttgtcccccaggaggttgcttctttaagggtttgcttattagcttttctgcacactatgcaaccatctgtcacttgcctagcaagggtatatatccctacacacccacagactctctgagggctgcatcacacatagcttgaggaccccagtgagttccctgatgaagctgtgacaatatttctctcatgaggggtttagacagcatttcccttccatctggtattacccactttccctctgggctctcgttagctcctatgttctttagtttctcttggtctgcacgggagaaggtggggatcacagctggagggggaagacaaggggtgagatggaaaatgggtgcctcttgggaagagacagcttgtttagctatctgatctgcgaagttgtttccccagctttcaaaagatgggtgttcgggggcctaggacatggacaattgcaatttcttctggcagctgaagattttcattcattcatttattgagacgaagtctcactctgttgcccaggctggagtgcagtggcacgatctcggctcactgcaacctccgcctcccaggttcaagcaattctccagcctcagcctcccaagtagatgggattacaggcgcccaacacaacacccggctaatttttgtatttttgtagagatggggtttcaccatgttggccaggctggtcttgaactccggacctcaggtgatctgcccgcctcggcctcccaaagtgctgggattacaggtgcaagccaccatgcccggctcagcagctgaagattttctagtgcttgcataattaattccttgtggaccagatcttggcccttactatttacgaggtcttgttgagtccagatttttcaaaggtaaggactactccaaaggcatacttggagtcggtgtaaatagttccttcctgattctgcagggattttaaggcttggtttaatgcaaagagttcgcatgtttgggcagaccaggcatttggcagtcttcctgactctacctctgtgaggtctccccaacaactaaggagtacccgttgtgcctttttccttcaatgacccgggaggagctgtctataaattggtgaccccctgtttggaaggcggtttcgtttagatccagtctgactctagtttgataactgattagacccaagcagagatagagtcatcaaggttcttggtgtgttgaacaaagaactgaacaaaatgcacaaagtaagaaagaacaaagaaagaacaaacgaaagacaaagcaacaaaagacccggaaagcacagctttattgaaaacaattcacagggtgggagtggctggagcaaacggctcaagagcttcctcaattagggtttttattaagctaaaggaacctggcaacaccccttgctgccctttagaggcctccgattggctgccatctgtctgctgctatctgtcaccaaaatgtgtcttattttagcaagaagtggagcataatctatttaaccaattgcctcctgctggactttgagaatatttttctattttttaaaaaaattgtttttgttttgttttgctttttttgagacagggtctggtctattgcccagtctgcactgcagtggtgcaatcatagctcgctgcagcctccaactcctgggttcaagcaattctcctacctcagccttccaagttgctgggattacaaggcacatgccaccatgcctgactaatttttctgatttttagtagagacaggggggtctcactatgttgtccaggctggtcttgaactcctggccttaagtgatcttcccacctcacgcctgtcagccatcgtgctcagttgttagaggttttataaaaatgaaaaatgtcacatactgtttttccagaaacttcattggcactagtaaggttctagggagttggcaaacactgattggtgaatgactgcagtgggtaaagcttagatgagtgatggtggcagatgaagctgtgactagtgagtgatggtggcgggtgaagctctgattggtgagtgatggtggtgagcaaagctctaccagatgagtgatggcagcgggttgtgggggaaagaaagagcgatcagacagttactgtgtctatgtagaaagaagtagacataagagactccattttgttctgtactaagagatattcttctgccttgagatgctgttaatctgtaaccctagccccaaccctgtgctcacagagacatgtgctgtgttgactcaaggtttaatggatttagggctgtgcaggatgtgctttgttaaaaaagtgcttgaaggcagcgtgcttggtaaaagtcatcaccattctctaatctcgagtacccagagacacaatacattgcagaaggccaggccgcagggacctctgcctaggaaagccaggtattgtccaaggtttctccccatgtgacagcctgagatacggcctcgagggaagggaaagacctgatcgtcccccagcccgacacccataaagggtctgtgctgaggaggattagtaaaagaggaaggcctctttgcagttgagataagaggaaggcatctgtctcctgctcgtccctgggaatggaatgtcttggtgtaaaacccgatcatacgctctaaatactgagatagcagaaaacctccctatggctggaggtgagacatgctggcggcaatactgctccttaatgcactcagatgtttgtgtaaagtcaagcataaatctggcctacgtgcacatccaggcacagcacctttccttaaacctatttacgacacagagatctttgctcatatgttttcctgctgaccctctccccaccattactctatagtcctgccacatcaccctgtccgagatggtagagatagtgaccaataaatactgaggaaactcagagaccagtgccagtgcgggtcttccatatgctgagcaccaatcccctgggcccacttttctttctctatactttgactctgtgtcttatttcttttctcagtctctcatcccacctgacgagaaacacccacaggttgtggagcagctggccaccccttcagcaggtgaagctctgactggtgagtgatggcggtgggtgaagctctgattggtgagtgatggcagcggggtgaagctctgattgttgagtgatggcagcgggtgaagctctgactggtgagtgatagcagtgggtgaagctctgactggtaagtgatgatggcgggtaaagctctgattggtgagcgacgatggcaggtaaagctctgattggtgagcgatgtggtgggtgaagctctgataggtgaatcatgacagtggttaaagctctgactggtgagtgacagcagcaggtaaagctctggtggatgatggcgggtgaagctctgactggtgagtgatggtggtgggtgaagctggtcttagtgtccctgcaggttgtttcagcagccatgagataaaactggcctcctccaactggctaaaccttatgaaggattggcctgctaccaatcagaggctgaagtggagacttggcccatgatcattcagaggctgaagtggaaacatctgtcatgttatcacaagagtgaagatgtggcttgtatgctgcctagaacttggtaggcaagtggttgaatctcagtctctcgggcttaccgcccctcagtggggccaggcacggtggctcagcccataatccaagcactttgggaggctgaggcgggcggatcacgaggtcaggagatcgaggccatcctggctaacatggtgaagccccgtctctcctaaaaatacaaaaaattagccaggcctggtggcgggcgcctgtagtcccagctactggggaggcagaggcaggagaatggcgtgagcctgggaggcggagcttgcagtgagccgagatcacgccactgcactccagcctgggcgacagagtcagaatccgtctcaaaaaaaaataaaagaaagaaagaaaggaaaaaagaaaaagaaaggctcagggggtagaggaggaggccagataggagagttgtgtggagcccagataaggatcatgtttatattgacacctctgggcagtgagcctggcacctgtaaatgcctgtaaatcgccagggagcagaggacagtgctggctgggagcctgtgtctcagccctgccccgtcgaatgatgtggcctgtggccaggaatatcacctcagtctttcaatttcctcatctgcaaaatggggatagcaatgctggccattccttctcccagatcagtgatgtggtccgaaagtcctaaacagtgtcactaagtaaggtgaagtctaataagtcataaatcccagcctgccatagggacctaagagctattccctttctccttccctgtggaatctgggacacagcaaggagcaggaccaggtagcagcaggcttcatgctccttccccagcagccttcagagaggacaccagggttacccagggatggttacctggtccccagatcaccttgttgtggcaagtaccagaattgggcactggccagtgatgggctcataatagctccagccaaatgcccctctttcctttgtccttacagggaaggtgggttacacttatcctcctggagccataattccttttttttttttggagacagattctcactctgtcacccagactggagtgaagtggtgcaatcttggctcactgcaacctctgcctcccaggttcaagcaattctcctgcctcagcctctgtagtagctgggattacaggtgtgcaccaccacacccagctaattttttgtatttttagtagagacggggtttcaccatgttggccaggctggtctcaaatgcctgacctcaggtgatccacccaccttggcctcccaaagtgctgggattacaggcgtgagccaccgcacccagcccggagccataattccattaggccttaccctgcagtgcctgggcacctgccctagtgccctatgtgattacgagcataggtaactacttcttctttcttcttcttcttcttttctttttttttgagacagggtctcaacctgtcacccaagatggagtgcagtggcatgatcttggctcactgcagtctcaattgcctgggttcaagtgatcctcccatatcagcctctgcagtagctgggaccacaggcgtgcaccaccatgcctggatgacttttacattcttttgtagggatggggtttcaccatgttgcccaggctgctcttgaactcctgggctcaagcagtcttcccacctcagcttcccaaagtgctgggattacaggggtgggcgactagccaagcctaggttaacttcttatactgcaaagttacagagtgtggcaagaaaaaaataaagctctccatcgagttcagggatgagtcatttcaggaaataccattagttttcaagacaatgcaatttatataatattgtaattccaagctcatcaatgtagttcagatattctcacagtcatggcagactaaatctaacttaaaaggaagcacatgctatagaggtctcacaaggacctcactaggaccagttctgatactgtcccagtctattgtgttgccttcacagaatgcttgagacttagtaatttataaacaaaagatgtttggttcacagttctgcaagctgtacgagaagcatggcacccccatctgcagggcttctggttaggcctcagactgcttccactcaaggcggaaggcaaaagggagctagtaaggagtgtaattcccagttttaaaagtaaagatttgaaagcattagtttggagacttgtagcccacaaaaatttaggattttgtccaaactgccgaaaaactcaagaacagcgaacaacaggtatactatagcttttcttttgaagcataatttttctctcttcagtctccatttttattaaaaacaaatcatgatagaatgatttgtttacaaaataaactttagtcttattatacttggcctgattatttgcacaaagcacaccaagaataactatttttcacataggcctttaaaattggctttgatggaactctgttctgtaaggaatctcaaataagacttttttaaagctaagcccagccatgggtttgtacactcaaatacctatgagttgggtaaatttctctcctcctgaggtcccaagaaaacttgggtctcctgagactgttagaaagtgacattctttacttaccacaggtcaggaactttgaacagggactgtgtagacaaggtataaggccagatttcccaaggggcttttattagctcaataactcaactttgattctccttttttttttttctgagacagagtttcactcttgttccccaggctagagtgcaatggcacgatctcagctcactgtgacctctatctcccgggttcaagtgattctcctgcctcagcctccagagttgctgggattacaggcgcctgtcaccatgcccagctaatttttggaattttttttctttttagtagagatggggtttcaccatgttagccaggctggcctcaaactcctgacctcaggtgatccgcctgcctcagcctcccaaagtgctgggattacaggcatgagccacctcgcccagccaactttgattctttaaagaaagcatgccattctagtcaaagccttgataaaataaccagtttctcccattgtgtcctgttacaaaagaaaacagattatcattgtacttatgcaaataactatactgccatatgttgagaatattcacaaatagtttccaaattctggaaaaatcaggtagggagaaacaaatatactccaaattttttcacaggagtatattttattcaactgttaaaagctgtaagtagcttaaaagaaaagttttcttggctctggaaaacaaaaaggatcagcaatgttttaagcaaaaaagttaatacaaaagattactgggctaggctcaatggctcacacctgtaatcccagtactttgggaggccaaagtgggtggatcaccttaggccaggagttcgagaccagcctggccaacatggtgaaaccccatctctactaaaaatacaaacattagatgggcatggtggtgagtacctgtaatcccagctacttgggaggccgaggcaggagaatcacttcaacccgagaggcagaggttgcagtgagccgagatgatgtcacaacagtccagcctgggagacaagagcgaaactccatttcaaaagaaaaaaaaaaaaagattacttcagttttctattagttcaatcaattccattaactcctgttctgtttgatatttatgaacatttcagctccccatgagagtcctggaagttatttcctctattctaatgtcacattctccaaagttattggaaacctgaattcaagagcacctgtcaaagttctagagctgattataaaccaccttttgaagagcatcaaacaagacaacaattgtctgtggatgacaacaattgtctgtggatgacaacaaatcttaggacggccattattaaagccacagttgactaggaatttggttacttctgtggcatacaacaattttacatacaaattataactattatattaacagcatacattcaatcatatcagaattataggagtttctcataattttggaacacatactaataacatatttatacaaatacagcccaaagaaagccaaacaacatttcatatttgacaatgcttcctgtatgatttttataccacgtaagccagatgtcatttttggacattagaggacctaatatctaaaagattaggttagaaagagacataattataatcaaattataatttataatttgattttggaaagtttgtcaaatatcaaagatttattttgtggatatcacaaaatagaatcccaggtcaccataagtcattcatttgaccaaaatgataactccaaaattttaaaaagaaaaaccctttactctgatagaggagacatagctttccaaacaagaagacccaatgaagatagcatgaggccaactgaatcgtatcttctctctcctcccctttttccctgtagtttacccaaaggggcaaacaaaaccctttcattttcttttactataaaaaatcttttacataatcttttatgtaaaaaatcttttacataaaaatctttttcaaaagagaaaaccaaatttaatgtttgtattagtgcatttttaatgctaaggctggttttacaataaaaatttacaaatgtattcagttttaattagtctgaccataaggtaagattttcataaacttttttgaacactttataatttttcattaaacagtcgatcagttttctaagaaaaccctgttatttggacacctgggctcagattctggccctgtatttgtgtgcttttattttaatgttcaacctacagaaaaaaaaattaaataatccccttccaatattagccaacttgctcatacccacagaacttttttttacaagaccaacccttcataagcccttttcactttgtttaaacctccagttttgtcccattactcttttaggttaagataatctttaaaccctctgaactagacaaaattatattccttttttgttttgttttgtttttgatatggagtcttgctctgtcaccaggctggagtgcagtggtgcaatcttggctcactgcaacttccatatcccagattcaagcaattctcctgccttagcctcctgagtagctgggactacaggcatgtgccatcgcatccagctaatttttgtatttttagtagagacagggtttcaccatttggccaggatggtctcgatctcttgaccttgtgatccacctgcctcagcctcccaaagtgctgggattacaagcgtgagccaccgcgtctggcaacattccctttaataaaagccatattcccatgccttcctataatcttttactttccttacacaccttacatgtagaactgtttctccagtggtctcaattacatgttacaatgttacctcttagcagcttttatttttggtgaaaacctgataagtgattttaattatgtactaggtgtggagtctaggacatcagacagaagtgaagataaggcctaactctttccaaagtaggcaaattaaacaattttcaaaagtcaaagaaacagcttacaaccttaaaacatttagtaaatctgatatctgacgttaatttagaccaaatgtctacattttgaagacatttttgtttttatcaataatttctaaaactgtctttatttccaaaagattattaaagtcacgtgtacaaaaggcattaaagtttctctttttctgacaaaatatttgatttcggcatctatttttaagccaattaaacagagctctttttgtgtaaatattacacacacaacacatatgaatacagacagatagaagattcagcacttgtaagattttttatttaccagtttcttaattggattactggcttcagggtggaggaacagggccaggaaaccatgcagtttctggggcctaataaggaggcacagctggaaaggagagacagatcccccaaattagggtgccattctatatgtatcctggatccctaaaaaggaaagaaatactacaagagaagacagtgcagtgcttccaccacacatgtcatcgcaaggaaaaccaaagccaatcagcccattttgtaaccagccaatcccccatgggagtctcatctctcagtgggggttggggatgtttccgtatcttccaggtggccaagagcatgtttctctgatccaagcttgcaaagagctaagtatgtcttcataactgacattagccaattcttaaagtatattttttacctagttattatatatcaagccctcctataattcaaagtaatttttgatacccccaagactcaaaaccgttagatagcacaatgcaaaacagaacagacttagattttgagggggacctatctgcttttaattcctggggtttcatgaggaaaacagggttttttcccaaaatggggtctatagcacctcctctgtttttcccaaggaatctcaggctaccagaagttatcttagggcctctcatgtgtgcattaatagtggtaagacaaaatggagaaaaataattcagtcgactaaaagaaaaaaaaaacctttttccagcaaaacaagatccatgaaaagaaaagcataaagaccttttaaatatacctacagcttgcttatgcacttttaattaagttgacttttaaccatagtggtctttaaaaaaatcctttcacatctctgattacctgactttatccatgcagtcaatatttctggcttttgaactttaccaaaagtaaccaacctcccaggtgcttcaaaggcatggtaagcagtttcttttttactagatttagaatctccctaaggtagttcagagaaagaaaaattcaagagaagaaatcagaagctatccataaaaacctcaaatggcaaagttacacacataacaaaccagaaaggaatcattccagaagccaagaactgaacccaggccaccactgtcaaaagataaacccttagttaccgaactatacagcattgagcagtttctattgcttttcccaaaaggagcctagagaggccaattttgagtttgagaaggcttttaactgctcaagataattcttagggctgtgacatgaacctcaaaattcctgtcctctggatggcagaaaccaagataaagtatccccacaaggttaagctcttaaggacacaaaacaagaccgatcttaccgagtattgttttcagggacccgtagcatagtttgtaattgaccagtctgctgggttggcttgaaaaatgggcttatagggatcctaaacccacattgtatcctgtgatactcctttctccattacagaatatagaaagacaaacttttagtacaaagtacaccagatttgctacagcctaagaccagtctcacaaatccatttttctattaatcaaactcttgcagaggagacaaatatagtgacatttaccatttatgcagacagagaaagagagaccagaaacttggctggtaagaatttcttatccttttttggcataccagatttatgggttccctttctctgcagcttccagaagaatggagcaccttctgatgaccctgctcgctgtgccatagctgtgggattcaagccactttacaaaagaaaatcacccttttctgttttatggaaccataggcaaaagataatcaatttgcaagatgttgcccaatgggctgcattggggaactgaatgaacattttccatcccagcaaaatacacaaaacaaaacagacactagtcaccccattcagcacccaatatcaacctagcaaagctcaaactttctccagacggtccctgttgtctttgatccattccagctggggagggatgacctccaaatgataattcacagtggggtctctgggcaaggcaaagagccaatagtcaccccgagaaaggcctatcgagctttcttcagggctcaccaaatgtgaccagacaaataaggaggattctccaagttaggcctgctggacttccatcagcaatttcttctgagatcccctccacatatacaaacacacacaaagacacgacagacagaaggccttccaaatcagatccccaacaaagaactcaagagtatccctcccaaactatcttcctattctctgtctgagaaatctccccaaaatcttctggactgagaagaagtctccccaaccaagattcttcctactagttagggagagccaacagagaccccctaggagccaaactgagacagacaccccgcaatggggctacagacaaacagacaccccaccagggggctacagaaccagtcgggagaaggaaggggtcattggcggtacctagaatgctcatcaacccagacccccacaatgggatgcagacagacaccccaccatggagctacagacagacaccctgtgatagtgctacagttaagggatatcgccccaggactatttctccattgcaattaaatccatgcacattgggttggcagcaccccgccagtagagagtaccaaagtcagcccctagtccaagagaactaggcagatgcttgggctagcctctggatccatcgctagagaggggctaccaaaccacgggcaggtagctgcaagggcaatcctgatgagcctcgaaatttgtaaccacccagtgggttcactttgcccactgcctagacagagtggatttatcaagacaggggaattgtaatagagaaagagtaatttacacagagctggctgtgtgggagactggagttttgttattgatcaaattagtctcctggagcatttgaggatcagagtttttaaggacaacttggtgagtcaggggaagccagtgagccaggagtgctgattggttaggcaagagataaaatcatgggacgatgaagctgtcctcttgaactgactgttcctgggtgggcgccacaagatcagatgaagcaattttatcgatctgggtggtaccaactgatccataaggtacagggtctgcaaaatatctcaagcactgatcttaagaacaatttagggagggtcagaatcttgtagcctccaactacacgactcctaaaccagaatttctaatcttgtggctaatttgttagtcctacaaacacagtctagtccccaaacaagaaagaagtttcttttgggaaagggctattattgtctttgttttaaactgtaaactataaactaatttcctcccaaagttagttcaacctatgcccaagaaggaacaaggacaacttaaagattgaaaccaaaatagagtcagttcgtttaagtctttttcactgtctcaatcataattttgcaaaggggatttcaggatcaactcaaacagaacaccaccaagacacattatataatcaaatttttgaaaggcaaagtcaaagacaatcctgagagctgcctgagagctgttacttgtcagtataagtgatcctcaatcagattaacagccaatttcccatcaaaaacaatggggttcagaaggtagtgggataacatatttaaagtgctgaaattattttttttaactatcaaccaagaatcctacattcagaaaagctagccttcataaatgaaggataaattaagacattcataaataaacagaagccaactgagttcattgctggccaatctgtcctataaggaatgttaaaggaaatcctttggactgaaatggagaataacaaacagtaggtctaagccatagaagaaaataaagaacgcaggttaaataaatataaaagccagtattgttgtacttctagtttgtaaatccttttttttttttttttttttaagatggagtcttgctctgtcaccaggctggagtgcagtggcgtgatctcggctcactgcaacctccacctcccaggttcaagtgattcccctgcctcagcttcccaagtagctgggactacaggcgtgtgccagcacgcccggctagttttttctgttttgatagagacggggtttcaccatgttggccaggatggtctcaatctcctgaccttctgatccacccgcctcagcctcccaaagtgctgggattacaagtgtgagccactgtgctgtgaatcctctttttaaaataggatttaaaagacaaatgccaccaggcgtggtggctcacgcctataatcccagcactttggcaggctggggcaggcagattacttgaggtcaggagttcaagaccagcctggccaacatgctgaaaccccatctctactaaaaatacacaaataagccaggcgtggtggcaggtgcctgtaatcccagctacttgggaggctgaggcaggagaatcacttgaacctgggaatcggaggtgacagtgagccaagattgtgccaccacactccagcctgagtgacagagcaagactccatcttaaaaaaaaaaaaaagacaaataactaaaacaataatcataaatctatgttgctgggcacagaatgtaaaaagatgtaatatgtgacactaacaatgtaaagagggaaggacagagaagtacaatagtagaacttttgtacactattgaaactaagttggtataaatttaaaataggttgttataaatttgttaattgtaatccctgtggttactactaagaaaataaaatattcagaaagtaaatgaaaagggaaacaaaatggcacactaccaaaagaccacttaaacaccaaagaatgcagcaatgggggaatagaagggaaaaccaaatacctaacgcacgcggggcttaaaacgtaggtgatggattgataggtgcagcaaaccaccatggcacatacatacctacttaacaaacctgcacattctgcacatgtatcccagaacttaaagtaaaataaaataacaggtataaggcattaaaaaaaaataagaaaatggcagaagtccttccttattagtaattactttaaatgtaagctgattaaacacttcaattaggccgggcactgtggctcatgcctgtaatcccagcactttgggaggctgaggcgggcggatcacgaggtcaggagatcgagaccatcctggctaacatggtgaaaccccgtctctactaaaaaatataaaaaattagccaggcgtggtggcgggcgcctgtagtcccagctactcgggaggctgaggcaggagaatggcctgaacccgagagacggagcttgcagtgagcagagatcgcgccaccacattccagcctgggcgacagagcaagactccgtatcaaaaacaaacaaacaaaaaaaaccaaaacacaaacagcaacaacaaaaaacacttcaattaaaagacagagattggcagaatggattattttattttattttattatttgagacggagtttttctctgttgcccaggctggggtgcaatggcgcagtctcggctcactgcagtctctgcctcccagattcaagtgattctcctgcctcagcctcctgagtagctgggattacaggcacccaccaccatggccagctaatttttgtatttttagtagaaacgaggtttcaccatgctggacgggctggtctcaaactccggacctcaggtgatccacccgcttcagcctcccaaaatgctaggattagaggcgtgagccaccacacccagccttttttttttttgagatggagtctcgctctgtcgcccaggctggagtgtagtggcgcgatctcggctcactgcaacctccccccctcccgggttcacgccattctccggcctcagcctcccgagtagctgggactacaggctcaacgctaccacgcccggttaattttttgtatttttagtagagatggagtttcaccgtgttagccaggatgatctcgatctttttctttttttttttttttgagacggagtctcgctctgtcgcccaggctggagtgtaatggcaccatctcagctcactgccatctctgcctcccgggttcaagccagtctcctgcctcagcctcctgagtaactgggattacaggtgtgcaccaccactcctggcatttttgtagagatggggtttctccatgttggccaggctggtctcaaactcctgacttcaagtaatccacccgcctcagcctcccaaatgctgggattacaggcgtgagccactgtgcccagcctagaatggattgtttaaataatacattgatatactgtctacaaaaaacttactttagatccacacacaaaccattgaaagagaacagaaaaacatatttcacacaagtagtaaccaaaagatagctgaggtggttatatcaatatcaagcaaaataaactttaagccaaaaattgttacaggagatcaaagaagacattatatattgataaagtttcaatccaccgagaagatataataattataaacatatacacacctaacaatggagtcccaaaatatataaattgaaaattgacagaaaggtggagaaatagttctacaaaacagtaggaaacttaaatatccgactttcaataaggcataaagcaaatccattaaagaagttttattgaaaaaaaaagatcaattaggaagtagaggactcgaacaactctataaaccaaccagatgtaacaaacatatatacaacacccagtcaaataataataaggctgagtgtggcagcttatacctgtaatccaagcactttgggaggctgaggtgagaggatagcttgagcccagaagttcaagaccagcctgggcaaggtagtgagactctgtctctacaaaaatttttaaaaattagcctggggtagtagtgcatgcctgtaatcccaactactttggagagtgaagttggaggatcatttgagcccaggagtttggggctgcagtgactatgattgtgccactgcactccagcctggaggagagagtgagaccccgtctcaaataataataatacagcagacattcttcttaagcacacgtggaccattctttctccaacacaaaccatatgtaaatcaacaagatatgtctcaataaattttaaaagattgaaattctacaaagtattttctctaccacaatggaatgaatccagaagtcaataaaagaagaaaaactggaatattcacaaatatgtggaaattaaacaatatactgtcttaaacaacaagtgggtcaaagaggaaatcacaagagaaattataaaatactttgagacaggctgggagcagtggctcatgtctgaaattccagcactttgggaggccaaggcatgtggatcacttgaggccaggagttcgagaccagcctaggcaacacagtgaaaacccttctctactaaaaatataaaaattaacggggcatggtggtgcatgcctttaatcccacctactcaggaggctgaggtaggagaattgcttgaagccaggaggtggaggttgcagtgagcagagatcgcgccactgcactacagcctgggcaacagagcaagactctgtttcaaaaaaaaaagaaagaaagaaagaaaagaaaagaaaaaagaaaaaaatgctctaagacaaatggaagtaaaaacacaacatatcaaaatttatggaatgcagcaaaagcagtgttcagaggaaaatttatacctataaacacctatacttttaaaaaaaacaaagatcacaagtcaatatatatataaggagctgaatatataaagaactctcacgattcaacaagaagataacccaattttaaaatgagcaaaaaggacaggcatggtggctctcacctgcaataccagtgctttgggaggctgagatgggcggatcacttgaggccaggagttcaagagcagcctgaccaacatgacaaaaccccatctctactaaaatacaaaaattagttgggcgtggtggcatgtgcctggaatcccagctactcgggagtctgaggctggagaattgcttgaacctgggaggcagaggttgcagtcagccgaggtcacgccactgtactccagcctgggcaacagaatgaaactctgtctcaaaaataaataagtaaataaataaataaaaataaaatgggcagaagggacaggcgcagtggctcacatctgaaatcctagtgctttaggaggctgagtcaggaggatcattggaggccaggaattcaagaccagcccggccaccatggtgaacccccatctctactaaaaataaaaataaaaacgtaagtagaggaatttaaatggcagaaaaattaaaattaaagtaaaaatgctttaaaagcaacagtgatcttaaacgaaatttactaatttctatgtgactatttcatttataaaattagtaaatttcatttaaattaagatcacttttaaattaggatcatttcataaatgaaataatatctatcttccttccatgatgaagtaatggggatcagatttactgttctgttttaaacagccatcaaaaaaacccatcaaagtgtatggaacaatgattcccagaccttaaacaacagatggcaccccatctcctaggagagcaacccctaggagacgacaaaccaaccaggtgaggtttatgattgtcccatcttcctgtctggagagtttttggacaatggagcaggaagggagaacccaaaagagcctggcagtccctgagttgaggagacaagttgagaattcaaggaggccaaagctaaagaaagaagaaccataggggagagaggttccccaggagggtggggggctggg

SEQ ID NO: 1401 - DNA, 201 bp, Homo sapiens
gtgcttgaagtttctccagtgagcaagtctactcaccaggattggcttcaggatgtccatgttggaacgaagtactcgctctgctgcagccagtttctccyttggtaggccacaaagctcagaaacttcttggtcaccaagttgaatcatctcttctgattttgatccattgcacagacttgtcaaatgtaactggtagcc

SEQ ID NO: 1402 - DNA, 201 bp, Homo sapiens
ttttagaaaggcaggagacatcgcttgcccccaacagttagcagaggcagcagcactaggttaaagaaagagcaggaggtcaacagcacttactttctgayattctcttctggttggaaccagggtggctcttctcatcactttcctcgccaaaccagtaggacttggtgcaaggaaaataccagggcctgggaattccgt

SEQ ID NO: 1403 - DNA, 201 bp, Homo sapiens
cttgaaaggagctatgaaaaataaagtaaatatttttagcttcccagtaaatctactttaggcctctgggttcatggctgcccttccagaaagctctgggrggcaattttgtgaaagaaagaaggccaagactttttgaagaacttctgtcatcattattattcgtaggctctgttgacctgggctaacacaagggaataa

SEQ ID NO: 1404 - DNA, 201 bp, Homo sapiens
ggaagagcgagtgaggctgccttaccttcaggatgaccactagcaggccagcgctcacaagaagaggaatgaggctactaatgaaccagctaaaccagagkatgctgttgtccaggcccatgatccgcatggtctctttcagccgtgcctccttctcatacacgatgcccttgatgatcacagccactgagtaaatccagg

SEQ ID NO: 1405 - DNA, 201 bp, Homo sapiens
agaagactaaaggtaaacaatttaataaaacacaatgcttgcccttacccttaaagagcttagaatctagagctaaggttcatgtcccattggaaaagacwatcatcttctgttctcaacttgctgcttttattcagggactccaaaggaaggtcaaatgcctacagccactgaagaaaggccagaggtactcacagcgaa

SEQ ID NO: 1406 - DNA, 201 bp, Homo sapiens
ccccacacacatgcgcatacccacagtcttctgaggctccctgctcagccaaggatggctcaggatcagaggtgcctgtttggggctgctgatgcctatgragcccagactgaggcaacaggagcatcctatgagtcactcttagctttcctgataagtgacctggggacatctgacaacttgcacttgtaggggctcaca

SEQ ID NO: 1407 - DNA, 201 bp, Homo sapiens
caggctttgccatgttggccaggatggtctcgaactcctgacctcaagtgattttcccgccttggcctcccaaagtgctgggattatagacgtgggattayagacctttgaagtgatctcgtccatcccacctgagctttgtgacactagtccgttcatttctgtttccccagtgccatctcacagagctaaaattggaga

SEQ ID NO: 1408 - DNA, 201 bp, Homo sapiens
gtttagaaggtgaaaaacaggataatttctggtgaccttgaaaagctatagatagccatacaaggaaacacactattcaatgcaaaacagagaaccaatamaagcagaacccagctcctcccgcatcctgatccctacacacacacacacacacacacacacacacacacacacatcccaccaccaccaccaaccacagag

SEQ ID NO: 1409 - DNA, 201 bp, Homo sapiens
atacatccttcctccaggaatctttccctggttttaagagaatctatctggtgagtagaaaaccagaatcctggatattaaatgatgatgtttggggtagsgagaggaatttcaccagagctctcagaacacctagagacatatttgttctggaactatataaaacactctgatgaccaaactgctcaggctcaccagtat

SEQ ID NO: 1410 - DNA, 201 bp, Homo sapiens
accaaactgctcaggctcaccagtattttttggttaagaatgaatgggtattctcatagagtgcttctctgaactattgattcctaggctgaaaaaacttygtcggaatttttctttgcaatgttattactaagtaagctaaatagtgtggtctcatctaattccagggccttccaactgtgacagcccacaatgtcatct

SEQ ID NO: 1411 - DNA, 201 bp, Homo sapiens
ctgaaaaaacttcgtcggaatttttctttgcaatgttattactaagtaagctaaatagtgtggtctcatctaattccagggccttccaactgtgacagccyacaatgtcatctttatgatgggtttttaaacataaatagatatccatcttcccatcaatggtttcaagactttttttttttaaatatgaagaactctgtt

SEQ ID NO: 1412 - DNA, 201 bp, Homo sapiens
aactcaagagccccattttgaagagaggtctcttggtaacagcagaggggcagaagcagaacctgagtgctccacaaacccgagatatgcagaaagcaccyggtagtagccaccttaatcaatacctggtcataaaccaacgcatccacaaggcacaaccacaacacagcaggatgggacacagtgtagctgacggttctg

SEQ ID NO: 1413 - DNA, 201 bp, Homo sapiens
ttaagaatgaatgggtattctcatagagtgcttctctgaactattgattcctaggctgaaaaaacttcgtcggaatttttctttgcaatgttattactaartaagctaaatagtgtggtctcatctaattccagggccttccaactgtgacagcccacaatgtcatctttatgatgggtttttaaacataaatagatatcc

SEQ ID NO: 1414 - DNA, 201 bp, Homo sapiens
tgagtaaacagaagtgaaatggaatgaatgggcacagcaccggaacaaattacaatgtcttctaaaaacacccatcttttccaaaatttcaatcattccarctgaaagggtgagcatttgtcatgcagtgaagcagcccaaaacagtccaagaaaatggttttgtaacaaagttttgtaccattcataataacctttcacc

SEQ ID NO: 1415 - DNA, 201 bp, Homo sapiens
tgtcatcttctgcctctgcccaatcatgctttgttccctttcctttccttacacaagtattgatcccaagaatttttcaataaatgtcttgtatgctcaaraaaaagaatactgaaaatacagaaactccaaggaccatccaaggaccatctccatgcttaggatgccccttattttaaactgattagatgtgacagatat

SEQ ID NO: 1416 - DNA, 201 bp, Homo sapiens
ctccaagatatccccctgctctgtacgagggaaggaagtgtccaagtcaggaatttgtgggatgaggcacctgctcctcagttgtgcttagttcagaaaayattactcaagcaaaacaccatactggacacaaggaagacaagagaggtcatctctgacatcaagagttttcagttctatttgtggccttggctttgtcat

SEQ ID NO: 1417 - DNA, 201 bp, Homo sapiens
cttctactccctagtatccttggctttgtccatgggtcctaatttcaatccttatctttaggcattgaccctatccaacttggccaggaaggagtacaccrttggagaaacagtgaacctgatgtctgtggatgcccagaagctcatggatgtgaccaacttcatgcacatgctgtggtcaagtgttctacagattgtctt

SEQ ID NO: 1418 - DNA, 201 bp, Homo sapiens
agatttttttgtagatactttaactccccctctttttaaaagaattttaataaagctgagataagaggcatatttacttttaattttacttttagtttgcyccattattaccctagcttcttccgagctcacaagcttaccgtacggctgactgtatatgtactcgggatctctcgtcgacttgtgctcaatgaccacgct

SEQ ID NO: 1419 - DNA, 201 bp, Homo sapiens
ctgtatttcctgtaaattgatagttagatctaaaggtttgattgatttatatttgatttgggggcgggagtacaaggttgctttcaagtggtgctgtgtgyttcccaaactgcagcgatggtaacttgagcgggcccaggtgctgtcagcctgatccatcccttacaaggtttcctgctagtctttcactagagcagtggt

SEQ ID NO: 1420 - DNA, 201 bp, Homo sapiens
ttaatgcaatgaaaaaggatccctgagctgcagcttacctgatcaaacttgttcacatcattggacagcagattgactatctggcctgtggttgtcttccmcatggccatgttactaagacgaagtgcctgaaataaaagaggtaagtagagaattgtattcatgcagtgatactaagtcaggcttaggacacagcagacc

SEQ ID NO: 1421 - DNA, 201 bp, Homo sapiens
caggacaaggttgcagttctgtcccagaacaggacagagaatgcacagaaagctggccattttgacaaagagattgtaccagttttggtgtcaactagaaraggtgagtatatcatagtggtttaaacatcaacctatttataggtaagagtaacatctaaaagagtaatacataggaatctttagaaattatatcttagt

SEQ ID NO: 1422 - DNA, 201 bp, Homo sapiens
gtttaaaagtgtgggggagaaaaacgcttataaagtcactactcaaactctttgcattcatcatgcttaacacagagccaaaatgtcgtaagtaataatayccgttcagccatttcatataggaggaggacatgaaaaaaccctccctcttcagatcatggcaagtttaatctatcccataagcatagccactaaaatcta

SEQ ID NO: 1423 - DNA, 201 bp, Homo sapiens
tcctgggctcaagtgagccccctgccttaacctcccaagtagctgggggactacaggcatgagccaccacacccaactcaatatttatgtacaaaattatycttaaaacagtttaaggaaacatgtcatttctctgtatttgatcattgacttaacctatactgaaagaattaatttggtttcttgacatcccaactagac

SEQ ID NO: 1424 - DNA, 201 bp, Homo sapiens
gaagatggtaattatggggaagcatctgctgtgatatagttatgtttgtatgtgttacatctatcactgtaataattgtaagcaaagacagagagttttgkcttcattttgtgatggatggctctttcctttgcagccaaacagggaaaaagttaatggcgaagtgtcgaatgcttatccaggagaatcaagagcttggaa

SEQ ID NO: 1425 - DNA, 201 bp, Homo sapiens
gccactaataactgatgtgggatgaattttctgtttgactaattcatctgcattttttaggagttctgctgcaataataacctgttgagaaaacattcacyggtctgagtgtgccggatattcaacatgtgcaatacatatggaatgacactaaaatggccatatattattaaccaaaatggtagtgatgaaatgaattaa

SEQ ID NO: 1426 - DNA, 201 bp, Homo sapiens
tccaccagtggttagaataacattggcaccagttgccaggatcttctgaattctctccttggtgatatctgattctctgcaaagtatttttgtaacctgarttaccttctgtgatttttaaaaataatttaacttccattaagtatttatcacaagataatcatagatcaaattgtattatcctttgttatctctgaccag

SEQ ID NO: 1427 - DNA, 201 bp, Homo sapiens
gcctaaattttgaacaatttcagcgtgcaaataagtaatgatagtaatgggttataactgcccaagtattgaaaaatttcagcatcaaagtaagtaatgaragtaatgagttataacttattcaataaaatgaaaatgtatgagtccatcctgatataaataactgaataaatgggagaaaaggaaaaggttttctttgtg

SEQ ID NO: 1428 - DNA, 201 bp, Homo sapiens
ttttcagtctcaagtaaccttacccgtttttagtttccagcctaatcccagattgataacattgtgatgaatataatctctaagtttttatcagcgacttmtttgctagttcttccccacaaactctccaaggaagggtggtaggtttgagtatatctgaaactgggaatagagtaaccactttataaacatttaccattg

SEQ ID NO: 1429 - DNA, 201 bp, Homo sapiens
tctcctgaaattgcactgttatgcaatttttttccttctctattgccccacctctggggcctacactctttaccttctctgatttatctgacccatccgcrtatctctgcaaagtcttaatgtaggtttccaggatttaatgattctttcaatcaactttaaagttcttcaggaagattctccaggtccgtcaacagtttt

SEQ ID NO: 1430 - DNA, 201 bp, Homo sapiens
ggttaattgcaaagatgatcagtagccaagtaatttcttctgaactacctaccttttcaaaatcttcaggaattatttcctgtgacttttgtccttttatrtgtaacagtccttggttgagaacatgggcctctttggagtgttatagaggaccacactatccttaaggatcagacttgctatggaactaaggcactggat

SEQ ID NO: 1431 - DNA, 201 bp, Homo sapiens
gattacagacttgagccaccgcgcccggccttcctagtatttctttaccaaattgtaggtttgcgggccagccccaggctctgagagattggtaacagaargtgtaagtcagactggtctcactcttcctaggttaccacattctcatctggagccaggaggaagccaggacacggaagtgagagacactaaagaaggtgt

SEQ ID NO: 1432 - DNA, 201 bp, Homo sapiens
tcaaataatgatgggaggaagcagggattcaacctaccttattgaccaaaagtgaccagaaatcaggtgtctctgctaataccttcaccctctcctcatgytgacactcttgtctctgcagcttaatgaattcaatcccatgggggacacgctggcctctgcaatgggtgagtaggaggagaatgtctctgacttgccaag

SEQ ID NO: 1433 - DNA, 201 bp, Homo sapiens
acaaggagattaatcaaatatgtaagtatattgagtaaaatgggaaccacatttttcactgtcaaagaagggaattataaacatggaaagagagaaactcraatcaactctgtggtgttgactttgaattgaagacattgatacaaatttaaggttttcagtatacaaagtaagacagttgtgaagcaatctgattgcaga

SEQ ID NO: 1434 - DNA, 201 bp, Homo sapiens
cctcgacctccaccagctggcctttgcccttttagcttcagggaagtctttggtgagcccatctctcattaccaaggtaacgaagcgcagactccgggccygggtgggcggcatcaccaccaggttcacgccgagaaggagctggaggagagccgcccggctccagccggaccgcttgcccgccatcaccgttgtaatcta

SEQ ID NO: 1435 - DNA, 201 bp, Homo sapiens
gtctcctgacctcgtgatccgcccacctcagcctcccaaagtgctgggattacagacttgagccaccgcgcccggccttcctagtatttctttaccaaatygtaggtttgcgggccagccccaggctctgagagattggtaacagaaagtgtaagtcagactggtctcactcttcctaggttaccacattctcatctggag

SEQ ID NO: 1436 - DNA, 201 bp, Homo sapiens
cagaagaggcaacccgcataccttcccaggtccatcctgggctgccacctgagttgcctgtcttccttctgccacctccacccctatcccaggcctgccaytgctcatagcagatttcctatcaaaggctctcctggcctcctctcttatctgtggcccccgcagggcacccactttcagaaactccctggaaggcccagc

SEQ ID NO: 1437 - DNA, 201 bp, Homo sapiens
gactggtttttctttcctcaggctggaaagaaaccttcaaatccagccttctggtggatcaacagaaatggagaagagatgcgatggagttttgaggaacygggatctctgtccagaaaatttgccaatatactttcagaagcctgttccctacaaagaggagatcgggtaattctgattctgcccagggtcccagagtgg

SEQ ID NO: 1438 - DNA, 201 bp, Homo sapiens
tggaacggtggtagaaacaagtaccaattctgaaccaactgttgaagccttagatttggtattaaatgcaagatgttcattttttccttgcttttgcatayagataggtgaattcaaggtaggagactgcaactgccccacagaagtagaggacttagtattaaaaagaggtaaggaacttttgacattgtgaagacttgc

SEQ ID NO: 1439 - DNA, 201 bp, Homo sapiens
gtgaggagaggaggatgaatggacagacaaacgagagcaattcttctacctgtgggctgtcctacgccttgcagtgccgggtcctgcggcgaccactgagscccttcgtcctcgccctcagtcccttcgtcctcgtcttcggtctccgctttcccagtcggccggggctcgtcgtccacgaccccgcacgtgccgccgacg

SEQ ID NO: 1440 - DNA, 201 bp, Homo sapiens
catgtcgctgcccagcttgcgccttccgaacccctcgggcacagctcgctgcattggagccccaggagacaccgctcgtagcagcgcacggagcgagggasctttagttcgggtcgggagagcaaagcctcgttggcctgctctggattgttaaaattaacaatttctattattcgttggaagggcgcgcagagccggcta

SEQ ID NO: 1441 - DNA, 201 bp, Homo sapiens
ctcttgccaattccgggcacaaggaccacccactctgcccagcagcctctggccccactcccactgccccagcgaaataagttccagcttccaggcatgaytgattatttggaacagagccttccactccggactgagacccaacccctgcagaaagtcctaaactgggctgcgaccactttgctcccaggagcagaggag

SEQ ID NO: 1442 - DNA, 201 bp, Homo sapiens
tacaaaactcagcgcaacgttgcaacccgcacaaaaggcgcacacaaaatcattaaaaagaaatacacagagtggaaagaactcgcacaagctccaactcsctaaaggtggaaggagtcaggttacaaactctccctccccggcctaaatgctttgctttagtttgcagaaaatcgtttgtcagtttttttcttggttatt

SEQ ID NO: 1443 - DNA, 201 bp, Homo sapiens
gagccccttcgtcctcgccctcagtcccttcgtcctcgtcttcggtctccgctttcccagtcggccggggctcgtcgtccacgaccccgcacgtgccgcckacgtcgccctgccgattccgccgcaggaggtggaactgtagtggtgccggcggcttctcccctggggcggcggtggcgaggcgctcgctggcggcgggca

SEQ ID NO: 1444 - DNA, 201 bp, Homo sapiens
ccccaccgccttcagcccgcctgggtcagccttataagggggaaaggggacagaagtctgcagaacagagatcctagcgtagccgctcagggtaccttccyaggtcaccattgctcctctgccctctccacatccgccctcccgtgagcgcaggatgcacgcacaggcagcggttacaaaactcagcgcaacgttgcaacc

SEQ ID NO: 1445 - DNA, 201 bp, Homo sapiens
gcctcgttggcctgctctggattgttaaaattaacaatttctattattcgttggaagggcgcgcagagccggctacagccgaagctcccggagtcactaaraggaggcgctgcagttctgccggcgcgcgggaagtttttcttccagcgcaaagttggagacactgagaggcaggcgcaggcagagtggctctgctgggac

SEQ ID NO: 1446 - DNA, 201 bp, Homo sapiens
ttctccctcgccggtttcctggaccacccttcctccccaccgcccggttgcggtaactcagttaccgcgctgggctgcggttcccaggagggagggttcgrttggagaacgcagtcccttcttcaacatttccctatcctggagctgccctgggtctccttccctcctccctcagttccctcttccccaatctaggagatg

SEQ ID NO: 1447 - DNA, 201 bp, Homo sapiens
gccgccgcctgctctctcttcgccccagcttttctagggaaagcttggccctgcgcttcccccagaaagcatgcctgggtgaggggccaggtgacacttcytacgatctggattttaaaatatgtttgcttatgccttcaccctccaccaacccccaccccgcacgccacctcttcaccagagacgactttgtgagggccc

SEQ ID NO: 1448 - DNA, 201 bp, Homo sapiens
ttcgggcacttgctccccactcagacacagttttcagaagcagcagcgggagaagacaagatggctgaactctggccggggcgacgaagcttccgaggaakggcagaatggaagcagtcccaagtcgaagactaaggtgtggacgaacattacacacgatcacgtgaaacccttgctgcagtctctctcgtccggtgtctg

SEQ ID NO: 1449 - DNA, 201 bp, Homo sapiens
gaatgcatagattctctccttgtgcttttttctccctgtggctgcgtcacaagcaggagacggatgcgctagagagtacctgttaccctagtaagtaccgygctgcctccgctctccaccggtgccctgcgctttgcctcattctcctgcttctttgttgtttattaagttttgttttctgtttatttaaaataaaaacag

SEQ ID NO: 1450 - DNA, 201 bp, Homo sapiens
ggtgtttggggtgtgggagacttgaacgtgaggacagtctgtggggacgagctggggaaagggagaggttgaggcctagaaaccaacctgtccagctcccygcagccaaccagcaggacccaggctggattgtgacggggaagaagaaaaggagcggctgggagaggagacacaggcagtgcaggctgttacgaggcttag

SEQ ID NO: 1451 - DNA, 201 bp, Homo sapiens
ttagagcacattgtgtcactataagccttcttatgaagacactagactatccatctcctatatggatggacttttgggttgtttccaattgtggtttacgrggagtagggttgctgtccacattttagtacctggtttttggtgaacacatttgcttctgtggggtgtaaaattaggagtggaattactgagtcatagggt

SEQ ID NO: 1452 - DNA, 201 bp, Homo sapiens
aaaattaggagtggaattactgagtcatagggtatgcatgtgttcaacttttgtggatgtttccacatgattttccaaagtgaaaccctgttttgagatckggaatattgactgtctttcactctccttggaccctagggctacagaactggctacccttatcgataccctgctctgagagagaagtctaaaaaatacagc

SEQ ID NO: 1453 - DNA, 201 bp, Homo sapiens
gttgttgaaagaattcagttcagttcatgttatcagacatcataaatgaaaaatcttcagtgtcgtaaaggataggaagtgttaatttctcctttttactyttgtgacttttctagagggtccttatatattggggcaatttttaaattacaattaaaaaaatacctagcttaggctgggtgcgtcggctcaagcttgtaa

SEQ ID NO: 1454 - DNA, 201 bp, Homo sapiens; identical to SEQ ID NO: 632

SEQ ID NO: 1455 - DNA, 201 bp, Homo sapiens
aactcatttgctggaggtcacccagggctctttcaagatagtaaaaacagtgacttgtacagcataatgaaaaacctaggcattgattttgaagacatcaracacatgcagaatgaaaaatttttcagaaatgatttttctggtgaggttgacttcagagacattgacttaacggatgaaatcctgacgtatgtccaagat

SEQ ID NO: 1456 - DNA, 201 bp, Homo sapiens
gcagtgtttttttaaatgattttaaaagtccacccttctcagactcatctttgcacaatatttacttcaattatttaccagtgattaaccttaaacacaaragcaacagaaatatttgcatatttgtttttggtagaaacctccagtgatcattccgccaaatgaacttgtcacttttcctacttatgtagtagttacaca

SEQ ID NO: 1457 - DNA, 201 bp, Homo sapiens
cggaccaaaaattttatctttagaaccaaacacaaactagacttcacacctattggttgtgatgccaagtaagtgagactttttcacttttattttattgkatgtacattatgtttcagtaagtctctcttagcatgtaaaacatacagtgtatgtaatattgtttattattagattggctattatcgtacattcttccag

SEQ ID NO: 1458 - DNA, 201 bp, Homo sapiens
cattcaagatgactctctttgttctttccagaattccatcttttctggaaaattatgtgtgcctctgccacttacaaaatttactcttacatttgtgtacrtgtcgaaggaaaagcttaaattgcaaattggatatttaaaaagttatgagaatatttcagtttaaaatgaaaacacaatacttggataatagactcccat

SEQ ID NO: 1459 - DNA, 201 bp, Homo sapiens
ttgtgtcttgcagattgatcaaaagcagttcgacaaaatcttagagctgatcgagagtgggaagaaggaaggggccaagctggaatgcgggggctcagccrtggaagacaaggggctcttcatcaaacccactgtcttctcagaagtcacagacaacatgcggattgccaaagaggaggtacaagggggctgtggcaaggc

SEQ ID NO: 1460 - DNA, 201 bp, Homo sapiens; identical to SEQ ID NO: 639

SEQ ID NO: 1461 - DNA, 201 bp, Homo sapiens
ctatagtgaaaggattcccgcccctcccgcccccacctttgtacacctggttcttacccttctccccacggtatccccagttcttagttcctcatgtttcyctctagaatgttttcgtgtgcatgcaagcagatgaatgcaagtcctgattgcctttgttatttttacacggaagtttccatgatagtatatcatcttgca

SEQ ID NO: 1462 - DNA, 201 bp, Homo sapiens
tgcgtcatctcacttcctggcaggtctctcttcctgtactgtaaggcaccagctgacatttcatggaggattattagatttaaacaatgtgttcctacggrctctccagggagtgtggagtttggatgtgtaggttttccacggggacccagcactgcctgcaggacaaacagggtctgccagatggcatatgcccagcag

SEQ ID NO: 1463 - DNA, 201 bp, Homo sapiens
agtgcgggggttggtggtgatgaaaccagccaacggttgaacactagaaacccctctgtagatgtaaatgacatcccaataccattcttatccactaagcrtgtcccccaagatcttattctctaaataccctctggcttggtttgaataactggttttagttcaatgtcagctctgcaacttagtcagcccttctaagtc

SEQ ID NO: 1464 - DNA, 201 bp, Homo sapiens
gtttggagtttggcctggtataaagtgtgaggtatggatctgagttagtatttttaaactgggtccatatttcatgagatgattggtcaagtggcatgcayggtttatgccctctctcctgctcctccaggacagaccgtcatccaattgcaccactgggtttgcttctttttctgtttatgatcattggaatgaaaccag

SEQ ID NO: 1465 - DNA, 201 bp, Homo sapiens
aagattcccatagatttcaggaagaaggaccagtggagggggcagaaagagcattttccctcttgagcagtctcccaaaagggtgcgcttttgacaactgstcagtagcgtgttcacaagctgtgggtcaggctggtggcacagggcaaactccagccaaggagacgtctagacaagatagcaaaagggagagtctttctc

SEQ ID NO: 1466 - DNA, 201 bp, Homo sapiens
atggaaacgttctagggtgtcttccttggtagaaaacacagctccaagaggtaggagcacagtcttacaaagtgcctgcagatatccttcaggacaactcygaaaaaagttacctaaaggttttgtgttctgtgcatctatgggttactccaaggctctctggctgggtttctcggaaaccctgatgacaacaagacatct

SEQ ID NO: 1467 - DNA, 201 bp, Homo sapiens
ctttgctataggattattctttttggtgggtttctctgtaaaccaggagccgtacgttgggttccacaagctggtgggcttgtttctggatccgtggaccytgtgcaactccgaaggagggttggactgagagaatgccatattcacgtgtcccccttccacggccggccctctagggactcgaacagagatctctgcagc

SEQ ID NO: 1468 - DNA, 201 bp, Homo sapiens
actcacgtgagctgaaaggaataagaggatggagtagtgaggctggaaaatgactacagtttgaaaaatgtgtctgtctttagtcacaatgaagaggaggrgatttaaagaaatagtaggtaggccaggtgtggcagcactttgggaggccgaggcgggtggatcacttgaggtcaggagttcgagatcagcctgccaaaa

SEQ ID NO: 1469 - DNA, 201 bp, Homo sapiens
ggtggggggctggggggaggaggagaggagacacatgccatgttggcctacagggtttattttttgatctcttcccagctgctttccatttccatttgggkactttacacttgattgtaagttttcctgtgccacatcatcacatgtgcaggtaccacagtgcatgtttttgtgtttgttttttagagacagtcttgctca

SEQ ID NO: 1470 - DNA, 201 bp, Homo sapiens
ccacaattcctttcctcatcgcctcctagggaaaaaattctttgttttaatctgcctttgacagctatacaaattatgcgatgtgtatttcagcacatttrtgttcccagtgtacttggatcacatgaggaagggagagaaaacgcaggttaacggtgaaaggaaagagactggatcagtgcctctccttaggaccaccag

SEQ ID NO: 1471 - DNA, 201 bp, Homo sapiens
agaaccactgctgagcacgagggcagggaggcatagacatacctgcccccacacccagccccacctcacctgggggctgccaaggtgtaagagggggcgcytgtgctttcacatagtgcatgatctccctgaggagctgtgaggaagggaggtgattgtcctccttttatgtctgcagacattgaggtaccaatgggtcag

SEQ ID NO: 1472 - DNA, 201 bp, Homo sapiens
aagataccttagagatgatgttatctaaacatattctacagatgaggaaaccaggatttattgagaatatagtaacttacaggcactggggcatacaaaaygaatgggaagtcatccttatcctcaaagaccttagaggataagcgctataatggaagtgtgtatgggtgcctgggacagagtggagcaggaaaagctttg

SEQ ID NO: 1473 - DNA, 201 bp, Homo sapiens
tgttgggttttgtttattatagctcacaatgaataacattactccaaccttataagtatagtgtgtttctgatgatctgcagtaatgcaagatccaaaatkggagaactgagagcagggcttgtgtcttaatcattttggatcctctgacactcacacagcatttagttcagtataggcaatcaaccagtaatctagacag

SEQ ID NO: 1474 - DNA, 201 bp, Homo sapiens
tttggagaaattaattaatattttatgcaaattgagaaaataccctcattacctgagtaacagaaaaacacgagtgttcgagtttaaaaaataactacctstgactcattaaaacattctttagttccctctgtgttttagtaatttctatagtgaatcaatcattttaaatatgcttgtgtaaaactgccttttaagagg

SEQ ID NO: 1475 - DNA, 201 bp, Homo sapiens
ccactgcacctgtgccccacttggcagtactgtatctgtaattttctcttcatcggtcctccaaagagaaattctctgatgatctgcccagttgccagtaytcttggtgctgaggggccagtgggggccaggaccagggagacttcagttcagtctcttcagagagagagcccaagtcttgtgctgatggtagataaggga

SEQ ID NO: 1476 - DNA, 201 bp, Homo sapiens
ttaaaagctacatttttctccttaatcataacctgaaaggaggttatgattaaagaaaaaaaaaaacattgtggaagatggtctccaggtgtgatagaggktatgctcttaggaaaaatgggagccaaaaattaatatctttaaatgtccatccagtggattccaagatctcatacaccaagatctcatacagttctctga

SEQ ID NO: 1477 - DNA, 201 bp, Homo sapiens
tcttacttagtcatctctgtttccccaagaatgctgactataatgtcatatacggaatgggagttcaataatttctctttctcccagattcagcctcccarccccagctctccaaccccaacactgttcctgccctcagaccccccacttgcctggctcctggcaaagtcctgggtccgaaattcagatttccaactgcac

SEQ ID NO: 1478 - DNA, 201 bp, Homo sapiens
ttcagctaccagttcctcaatggtgccaaccccatgctgttgagacgctcgacctctctgccctccaggctagtgctgccctcggggatggaagagcttcrggctcaactggagaaagaacttcaggtacctctccttcccctgcctggcactgttctctccttagtagtgtggtgagaacggacagagagaatccaaact

SEQ ID NO: 1479 - DNA, 201 bp, Homo sapiens
ctgccaccacatccacacacaagacatctaccctcaccagactgtttcttcactttaagatgagaggaactggaccaggggctctagttctcccaacaggrctccggtactgatgcaggagaatggcaagaagctagactaaatctcttgccctttgccccggccccctgggggtagactttgaactctaaaaatggatac

SEQ ID NO: 1480 - DNA, 201 bp, Homo sapiens
ggcaggatgatgagttgttcagctaccagttcctcaatggtgccaaccccatgctgttgagacgctcgacctctctgccctccaggctagtgctgccctcrgggatggaagagcttcaggctcaactggagaaagaacttcaggtacctctccttcccctgcctggcactgttctctccttagtagtgtggtgagaacgga

SEQ ID NO: 1481 - DNA, 201 bp, Homo sapiens
gccttcccgggaggtccaggaaggtcccgccgcacccaccccgttggcctcaccctggctcgggcccctttatcatcctgcagctacgctccgaccaggargcacagccagtccccacagccggctctaccgctctgctcgcaggtttgggctagtctggggcggggacttgggagcgcctaaaacttgcgaggagggcgg

SEQ ID NO: 1482 - DNA, 201 bp, Homo sapiens
ccggtgagcaggcggcgtcggggaaggaggcacaaggtctcgggaactgctgcggggctaggagggcagagttaaggacggtcggagcagacttagaggakgtatgggcccagggcaggtgaaatgtagggatcccagggtgctggacagaaaacgggaaggagttatgaattcccaaagttttacacaggctaagagagg

SEQ ID NO: 1483 - DNA, 201 bp, Homo sapiens
ggccctggagcctgcgcggaggtggccttcccgtgctaccgctgggtgcagggcgaggacatcctgagcctgcccgagggcaccggtgagcaggcggcgtyggggaaggaggcacaaggtctcgggaactgctgcggggctaggagggcagagttaaggacggtcggagcagacttagaggatgtatgggcccagggcagg

SEQ ID NO: 1484 - DNA, 201 bp, Homo sapiens
ttcttcaaatctgttaagggtgagagagataaggaagctgcaggaagctagcagagttggctcatgaggtttaaggaaagtagccatctccataacataaragtgcaaggtgaagcagcaagtgctgatggagaagctgcagcaagttatccagaagatccagctaagatcactgaagaaggtggcaacactaaacaacgg

SEQ ID NO: 1485 - DNA, 201 bp, Homo sapiens
cagctaagggaagaaaacataggatgctggagagctggtttggttggaataacacggaagacacccgtgaaagacaagaagcacactggcccgcaggagaygaggaggaatgaggatggcaaatagtgaattttttttttttttttttttgagatggagtcttgctttgttgcccaggctggagtgcagtggtgcgatctt

SEQ ID NO: 1486 - DNA, 201 bp, Homo sapiens
tggtcttccagctgggtcctgaaaggagagtccgagggttgggtgttgtgtccctgaagactagtctagcagtgggggcttgaaggggggtgccaggatgrgcctcccaatctctttacggaaatgttagaggccgggtgtggtggctcacgcctgtaatcccagcactttgggaggctgaggcaggtggatcacttgagg

SEQ ID NO: 1487 - DNA, 201 bp, Homo sapiens
attattggggttctccatccactgcttgaaaaggccagagaccatctcctcacactctggaactccgttggagcaggcggtgctgatggcattaacctcgytgtacctgccccaggggtgacacgcggttagcacacctggcgaactccagccaagattcacctcttgacacacaaccccaggccggcaccctgcctaagg

SEQ ID NO: 1488 - DNA, 201 bp, Homo sapiens
ggggcagctcagctctccaaaggggccagcatctgcacctgctcctgctgctgctcctgctgctgttcctgctgttgctccagctcagggagggagagagwcttgtcctggctctctttctccttgaaggtgctgaagaaggagttgaccttgtccctcaggtccttctccaggaagctcaagtggccttccacgtccccc

SEQ ID NO: 1489 - DNA, 201 bp, Homo sapiens
gtctttctgaaacgtattagaaatcagctcacgtgacattttcctccctccctctcttccatgagcctgaatgataggatgtggccatttgtcaaactctrgaacgtcaaagcaaaaggacatggcagggattattcggtccaaacttccggtttacatatgtggatcctaggttcagaggcccggccagttagtggcagg

SEQ ID NO: 1490 - DNA, 201 bp, Homo sapiens
tctgaagccatgagctcattgcctacaaaatgacaggagatttttaaggtaatgggcttggatgagcctcaaagagcaatgaacattaggcaaaaataccratttgacaagttaattattaagctggacaatgcactgaaagttaaaaataaataacagaaaattatgaatcttcgttgccagtcactgatcactgtccat

SEQ ID NO: 1491 - DNA, 201 bp, Homo sapiens
tctgagctgcagggccccggaggaggggggagagtcctaggggcttggaatccagtgactttccaggatgggagcccagggtcacaggtcactgggattgktctctagggtctggagtagtgtcgaagaccaaggtaactcagagggaagattgaacctatgaccttccaaacactgtccaggaggaactctgtcctatac

SEQ ID NO: 1492 - DNA, 201 bp, Homo sapiens
catgtgatctctgctatgcacagagtagaaggaacaaaccaattaactaatggaatgtggagcatctaggggaactgcaggggctcggaaaagccaagaaragcagcaaaacgatccccacgtggacaggagactgctgctgaagtgtggccagaactaaaactctagtggctttgacaaaatctggatcattctgccaag

SEQ ID NO: 1493 - DNA, 201 bp, Homo sapiens
atctaatgtgaaaagaggagattggattttcagaatactgtatagcttgccaaaagtaggtacttcaattgtgtgtgagatgtggggaagctggaattctrgtatgtgaaggtcaggaacttgaaaatcattaaggttgagagttgggattatgaattctggaattgcgatttctggtaaacggaagtctggcagggtgat

SEQ ID NO: 1494 - DNA, 201 bp, Homo sapiens
agaagcttcctgaagctcgttttgaataaattcattgaacttatgaagattaaggcataggttttctttcaacaatttaaaaacatatgggatataatcaytgaagattgtgttgatctcatcttggatataattaataagataagtaaatttcatctctttcagctgtttaatgttatcttctattagttggaaaatgaa

SEQ ID NO: 1495 - DNA, 201 bp, Homo sapiens
cacttaaaattaaagccttcctaggactgaaaactggaagaggagtggggggaagagaaagaagaggagagagaagaagagtcaggaaatgacagataggraaagaagaaatagcaaaaaaggcaagttggagcccaccctgcagagacccagaatcccaacatcagtacgcattctccaagcccatgacaaacttttagt

SEQ ID NO: 1496 - DNA, 201 bp, Homo sapiens
atggcagatattctcaacttggccaagacaatgcagcccctgctgtgcccttcttctgagccacacagacccagtgaaggactgggtgttgcaaagggcaktttcccatttcctgggcttggccttatacctggacaaggaaaggagtcaccttgtcatatggtgtcagtagatgtagagtgccctgctcccacatctgcc

SEQ ID NO: 1497 - DNA, 201 bp, Homo sapiens
gttacaagtggaaacatacaaagtgttcatttattatgaaatgtaaagaaaacatcacttcctgcaagaggcaaaccccactctcccttctcttctcccartgggtgacaggacctggcttagctgcttggcctgtttgcactggccctggtaactgaaagatagtcagctgcctgcttccctgtggcgcagacattacct

SEQ ID NO: 1498 - DNA, 201 bp, Homo sapiens
caagagacactgcaaatgcattttgaatgagggaggggaattcccaggagtttgggctgacctgtgacatggggggaggactctgaggtatgaaacccatkagatagggagtatggagaataggaagttcactaggttcagggattagtgtttgggggatgatgggaaagtaggtttgggactcactgagtttgtcaaagt

SEQ ID NO: 1499 - DNA, 201 bp, Homo sapiens
tctggcactacacacccaggagctggctattttcgagagtaggaggtatgtgggagaagacttggggatttgggtctgcatgcatgaataaataccaggtstgtaccctgtacccccagatctcagagcctggcagagcacacaccccatggcagatattctcaacttggccaagacaatgcagcccctgctgtgcccttc

SEQ ID NO: 1500 - DNA, 201 bp, Homo sapiens
tgtactttccatttgtggagactgcactagaaactgccctgggtcctttatatccactctcttgactcccaaaccatctttccatcaaaccaaccagtgargtctgacattccactatggaaaagtcatatctcaagtttacaatttccagggttaaggtgcaattctcctgggggtgcaagggcacagtgtgtggtcact

SEQ ID NO: 1501 - DNA, 201 bp, Homo sapiens
catgctcggccagagcaccgaggagctgcgggtgcgcctcgcctcccacctgcgcaagctgcgtaagcggctcctccgcgatgccgatgacctgcagaagygcctggcagtgtaccaggccggggcccgcgagggcgccgagcgcggcctcagcgccatccgcgagcgcctggggcccctggtggaacagggccgcgtgcg

SEQ ID NO: 1502 - DNA, 201 bp, Homo sapiens
tcttctgtcggagtctgcaccaggcccatgctgagacgagagctggcgctcagagaggggaagcttggatggaagcccaggagccgccggcactctcttcycctcccaccccctcagttctcagagacggggaggagggttcccaccaacgggggacaggctgagacttgagcttgtatctcctgggccagctgcaacatc

SEQ ID NO: 1503 - DNA, 201 bp, Homo sapiens
gcagctggtggggaaggcattggactccagccttgggggacggatgtagtgatggtgggaagcaggcttggtgccaggaggggcgtcagagggtgaataaragcagatagagtgtttgggggaggtagccagccaaagggggtgaggcccggtggaagggaagaagggacatacacgcagagctttgcagctgagggtttt

SEQ ID NO: 1504 - DNA, 201 bp, Homo sapiens
aagaaagaaactttatcaccatgtagcattccattcttaaatttttcctgaatctttactctctctccttggtacaccacagtggcttttttcacaggtamtttacaagatgctgaaagagagaatacttgtaatcaggacttaagagttcaggaagtctttctgaaagagagtatagcatttgaaacagtagatgagtac

SEQ ID NO: 1505 - DNA, 201 bp, Homo sapiens
ggccaagatgactgtttctaatataaagcaaagaaccatctctttttcaggatgacaaaagtgaaccaaactgagtaatcttcattattcattttcttacrgcctactgacaccaatgaataaaagcaatgcagtctatttccaatgaaaatatagcattctgactgggtactttggctcatgcctgtaatcccagcactt

SEQ ID NO: 1506 - DNA, 201 bp, Homo sapiens
tgacagtgtgcctatgcagacagagggagcagtgaatagcaatagggtgtttccaccatggtcttcactcaggccccggctgaaatcatgggccacctccrgatacgcagcctcctggcccggcagtgcctggcagagtttctgggtgtgtttgtactcatggtaggtaggatcactgcgggaaggaaagaagggggttgg

SEQ ID NO: 1507 - DNA, 201 bp, Homo sapiens
gtgcatcgttggacgcctcccctgggtcaagctccccatttacatcttggtgcagttgctgtctgctttctgtgcttcgggagccacctatgttctctacyatggtgacagagggaacagagggagctgtgccttgagagcacctgtgggtgggcaggggtgcctcagaatggttttggatgaatgagcaaagagggaaat

SEQ ID NO: 1508 - DNA, 201 bp, Homo sapiens
gtcttctagttctcagatgtctcccctttccttatatggtgaaaactctaatagtctctcttcagcggagccactgaaggaagataagcctgtcactggtyctaggaacaagactggtattactctatctcctaacttctgttatttctatttcagattgagcttaggttccatttcttaaaagaaaatgctggattaaat

SEQ ID NO: 1509 - DNA, 201 bp, Homo sapiens
attttaccttctttcttgttcattttattataagtttttattgtccagtgggtaaaacctttcctccatgttttccagttaaagatattaaggcagaaccycagccactttctccagcctcctcaagttattcagtctcgtctcctcggtcagtggactcttattcttcaactcagcatgttcctgtgagtagccagtctt

SEQ ID NO: 1510 - DNA, 201 bp, Homo sapiens
attgtccagtgggtaaaacctttcctccatgttttccagttaaagatattaaggcagaacctcagccactttctccagcctcctcaagttattcagtctcrtctcctcggtcagtggactcttattcttcaactcagcatgttcctgtgagtagccagtcttttacaatgattttggttataatatgctatctggaaaata

SEQ ID NO: 1511 - DNA, 201 bp, Homo sapiens
agcctcctcaagttattcagtctcgtctcctcggtcagtggactcttattcttcaactcagcatgttcctgtgagtagccagtcttttacaatgattttgsttataatatgctatctggaaaatatgtatatggaggaggcagttaacatttattgaatactactatgagttatattgtctcatttattgagggaactgag

SEQ ID NO: 1512 - DNA, 201 bp, Homo sapiens
acatagggacacagtgcttgtttctttgtcaaataattgaattgacagttcatttctattcttttcctttgtccaaagattctgctctctttgctgaactyggttatttcacagacactgatgagctgcaattggaagcagcaaatgagacgtatgtaagtatttactaaggttgaataatgtgatatttagtctttaacc

SEQ ID NO: 1513 - DNA, 201 bp, Homo sapiens
ttttgtttttattatgctacaggaggagttggatttgtcttctagttctcagatgtctcccctttccttatatggtgaaaactctaatagtctctcttcascggagccactgaaggaagataagcctgtcactggtcctaggaacaagactggtattactctatctcctaacttctgttatttctatttcagattgagctt

SEQ ID NO: 1514 - DNA, 201 bp, Homo sapiens
atttataagaattgtttaaagaaggcagtcatcagttacttttttcacatgattgtattgctgagagtagtatctgcattagtctcttaagcaagactttwaaaaaatcctactgttgtccccacctttatttttgaaagataaacttaaaatttacatttttaaaaatttttaaaaagtaaaattttaaatgactcaaca

SEQ ID NO: 1515 - DNA, 201 bp, Homo sapiens
tggctctggaatactttataaagtccctacttctgcaaaaattaatctctttgtgattttcccctttcttgcaaatggttggaaaaacttttataataatraacttaggaactggtgttacaatatggtatccaatgtgaatcatttgcctgttattagtacttgttacttgaagccacgtttttgttccttttaagatgg

SEQ ID NO: 1516 - DNA, 201 bp, Homo sapiens
taatctctgaggaggctgcatggtttagtaaacagtatattgacctggtcatgaggagacctgaactctgctttcaactagctaagaatttgtgtgtttcrtattttatccaccagatggcctcatacacttgtgattctatgagaggtttatgtcattattgaaagaagttcaagtctgaggatttggtactattcagat

SEQ ID NO: 1517 - DNA, 201 bp, Homo sapiens
ttagaagactattgaggtgtttcaggtaataaatgagagtctgaacttacactatggttataaaaaggatgagcaatcttagggtacctctctgatgtagmttttgtgggatttgttaactggtataatgtgggacatgaggaagaaaagagggaagttaaggataattcaaaaatttctaccttgagggaccgaatggtg

SEQ ID NO: 1518 - DNA, 201 bp, Homo sapiens
atacaatgtatctgagtaccaggtgttactgaatctggaattgcaggagggtaacagagccaaaggcagtcctttcctcaaatagtcttaacgtattcatstttgtcaaaaatgtgtctacacaaagtaattggttctcttttctctgtagatttcatcctttgttgaaaaagatgtcttagaacctatcaagtgcagagc

SEQ ID NO: 1519 - DNA, 201 bp, Homo sapiens
gagtaacatcttgaacccagatctcctgtctccaaattttgtgctcattccactatttcacattaaaacctgaagatctccctgctcttttcatcttaacrtaatttcagctttttgtgtgtggctctccaagccacagagcagcagcagcttttgaggataagaagcagtttcttttaaggataagaagcagtatggttc

SEQ ID NO: 1520 - DNA, 201 bp, Homo sapiens
tatggtgtcatggttaagatgctagctttatttgccctgttgggcagagttcaaattataactctacctcttactttgtgggctcaagcagattacatgcmattgaagttttctcatctacaaaatgctggctgcacagagttgatataatggttaaattagataatatatttagagcacttagcatggtacataagtgcc

SEQ ID NO: 1521 - DNA, 201 bp, Homo sapiens
cttgctgagagctttcatacatcatttattgtcatgcacttgtatgattattgtatactgtacacatttttattttacaatgatttgtattttccaatgcrtttattgcagttcagtgtggtagatggctggagcctatcctggtagctcggcgcacaagtcaagaattaaccctggacagggtgccatccctttgaaggg

SEQ ID NO: 1522 - DNA, 201 bp, Homo sapiens
tggtagatggctggagcctatcctggtagctcggcgcacaagtcaagaattaaccctggacagggtgccatccctttgaagggtgcactcacgcatgttcygcacactcattcagactggagccatttagacgtgccagttaacttaacatgcacatctttgagatgtgggaggaaactggagtacccacaggaaactcat

SEQ ID NO: 1523 - DNA, 201 bp, Homo sapiens
ggtattgtatgcatttgtaaatcctattaatttagaatacatgactctccatattcagtgtaaaagatttgttatttataataagacaaatccttttagcrctaataaatttcagaggttaattcttagaaatctagggattacagcaaatttgatagctgtttagttgagaaagataaataagaaagtatattaaagtat

SEQ ID NO: 1524 - DNA, 201 bp, Homo sapiens
cttgaagtgtgggttggagatgtatatttggaaatccttggtatatagattttatttaaagccgtgagctcagctgagattaccaaggaagtaagatagayagaaacgtttatgctgagcccagggacaaatttgtgttagggagatgaggaagaaccagcaaggtaggtcaaccactgaggtgggaggaaaactgggtaa

SEQ ID NO: 1525 - DNA, 201 bp, Homo sapiens
tttcacattatgataaatatatattttcatagtgccagatttactgtaatttcttattgttattaaaacctaacacttggtcatatgctatttactttatrtgtttctaatttttatttgcgtatttggcctaagcatgtttatatctgcttctgagtaatttctgcattttatatgtttttacttcataaaagatggagg

SEQ ID NO: 1526 - DNA, 201 bp, Homo sapiens
agcaagaaggagaaagggaaggaggagggaagccttccaccattaccaccttgaagaagttgccatttcttcttacagtccgttgaccagaccgtgtagcyttatttggttgcaaaggaggctaggaaatatagtctttattctgggtggccttgtgcccaactaaatatcacaagtcctgttgctattttaatgttacag

SEQ ID NO: 1527 - DNA, 201 bp, Homo sapiens
gtttttgttttttttagagtttcttatattgcatcaaataaaagagtgtgctgaattgcacatctagtctttggaggaaaattagggtaaggcttactacrttagaatctaagtgaaaaggtttttgaaagtgaagtggtttgatgaaaagcaaagtatgcatacctccctcttctttactccttctttagaaccaaccct

SEQ ID NO: 1528 - DNA, 201 bp, Homo sapiens
caagtgttcataagcggtaaataaagcccttgggctaggtaatgtaagatccattgcaacctggagatgaagaactttgtaaaggggataattgttatcayccatcagagcatcagagttttaagatgatctagatttagtcccactaattatatttctcctaacttttatagacagagaaatcagtgaaaaatatgtatt

SEQ ID NO: 1529 - DNA, 201 bp, Homo sapiens
ttttaaaaaacaactgctgattgctgacgtctatgagggaagaaaaattaggggctgttattttcctatcaaccatcactctcattaacaagaacaggaawcattacgaataaataaaactcttacatcataccagaaaaaagaacagctgaatcccctaaaggatttcatattctatcatcagacaacgaaagaaaataa

SEQ ID NO: 1530 - DNA, 201 bp, Homo sapiens
catcttggttgcttccaacttttggcaattatatataaaactgctgaaaacatttgtgtgcaggtttttgtgtggacatgcattttccaattgtttgggtraatatcaaggagcacaattgctggattgtgtggtaagaacatgttttttgtttgttttgtaagaaattgccaaactgtcttccaaagtggctataccatt

SEQ ID NO: 1531 - DNA, 201 bp, Homo sapiens
cccacctcagacttaccatgtaagaaattgtttttcaagagttgaggaatgtgggtatttatattataaaatcctgcaggtgattctgatatgtatctttygttaagaacttctgttttagaaggacctaccattggcactgtttttgcttctgatcccagcttcctatgattaaatgctttctgaaagatacatagttag

SEQ ID NO: 1532 - DNA, 201 bp, Homo sapiens
gtagaaaggactatcattttttactaagatgaaaatatttggggggcacggtaatatgtttggtataaatgtggagagttatttttggatacatttaaatktgaaatgtctgtgagacattcaagggaatgtgtgcaattggctctgtgaatctgggactcaagagaggatagatctgagctaagaagagtaattaagaat

SEQ ID NO: 1533 - DNA, 201 bp, Homo sapiens
atttgaaaaagagcttcagaatcagactctagagtgaatcttttaaaactatatatattatgcatgtatacacatatacatactctatgcattggcttagwtaatataaaaacagcacaggaatagtttatgctgtagtattgtgcagtcttattcagaaataagaaaaatagtttttccatttagctgtgagtcattact

SEQ ID NO: 1534 - DNA, 201 bp, Homo sapiens
taattttttgtttggaacaatctcaaattcacagaagtgttgtgagtaccttgcaaataacttgttttttccttatgcatttcagagtaagttaccagtcygatgcccctatcactccaatactttagtgtctacttcctacaagcacagatatttcttagccataatacaagcacaaaatcgggaaataaacattaatat

SEQ ID NO: 1535 - DNA, 201 bp, Homo sapiens
ttactattgatagaaaatggatagatttttaaacaatctagttagagggagatagttcagtttgcacataatgaatttgaagtggtaataactgtaagaartggccttataattaattgaatatatggttctggggcatagccatttaagggccagagatacagatttaagatgtatgtatatatgcatatatatttaaag

SEQ ID NO: 1536 - DNA, 201 bp, Homo sapiens
gtaggtgtatccttacctttgattggttagaggtctgtgtgaaaactattataacactgagtccccgagaatatcttagattttcttttcttgattagtayatataaaactctttgccctatagaactttgattttgtcttattctttaatggatgaggtgctgtttcacttaagaagtaattcaagtgagcagagtaatt

SEQ ID NO: 1537 - DNA, 201 bp, Homo sapiens
tctcagcaaggagacagtggtaattacacaattggtagtacagatttggattatttttcttaattagtttaagaaatattacaaagccctctgtacatgtyatctgctagggctttaaatctgtaactgtagctagaaataggattctttcttataagttgcctaattcattatatttacacctcttctgttctttaaaat

SEQ ID NO: 1538 - DNA, 201 bp, Homo sapiens
tatatacatttttcaaaacacttatactctgccttttctgaagccaagcttctcttggcttattcttacttttagtacttgtgtgctggaaattagaaacytcagatgccctgcacagtgtaggactatacaattgtgctaggcatgtatttataattctttaactcttctaccaaactgtgtgctttttaagggcaaaaa

SEQ ID NO: 1539 - DNA, 201 bp, Homo sapiens
attaaagtgttataaatttcaccttaagtgaaaatttattagttttctaatgacaaaagtagttacatctgacgtaaggggatttaattatctttttctgsgcttgcgtcccggaacgctgctgcattatgtaatctgtagtaatatacccacgagcagtttggagggttctgggaagcacatttgttttgcttacctacc

SEQ ID NO: 1540 - DNA, 201 bp, Homo sapiens
ttttttttctacttttaggcttactatctgaataatgagcatcttaatgttgacaatcatcactgtatgccattgacccattttataatctctaaacataytccaattaattatatgttggtctattagtcagacatcctttattagttctctggtgtgaaagactgtgtctgttcagcttttgtactcttaagggggatc

SEQ ID NO: 1541 - DNA, 201 bp, Homo sapiens
caaatgatcctcctgcagtggcctcccaaagtgctgagattacaggcataagccaccatgcctggtctttttcttattcttttaatagctgcattttaatrgctacatagtaacctacttcataggggtgccataattattgtaaaattttgcagtccttttcattataaacatttcttcattgaataacttggtacttat

SEQ ID NO: 1542 - DNA, 201 bp, Homo sapiens
aatttttattttcaggatatgtcatgatgtatgtctgtatatttttatgatttcaaattcccaaattgccattgctttaatgaatgagcacatttggtttytgatcaggaattactataactactagaaaacaacactagtgcaaaatgtgaatttagataaataactctgaaaggcctacttctagttgatgctttggct

SEQ ID NO: 1543 - DNA, 201 bp, Homo sapiens
tgtattatatgagatacaaatccaattttatgtttttccaaatgactatcaaaatgattattctagtaccatttatcaaaaagttcatctgatttcaattrtatgcatgtattttaaatttatgtaaatggcattatagtagatatctttatattatttacttttaaaaatcagcacagtgtttttaagataaattcctat

SEQ ID NO: 1544 - DNA, 201 bp, Homo sapiens
ccttgctctggagaccccatttggtgaggttcttttcaaaagagattgtatatttttgacccagggattgtcgatttgttgagctcccatgtaagtatgcygccttgccattgacaggtcttcacaatgctttcttaaacgacattctttggaactgtctttcatagtcaggcgacccgccagccaggccgccaggtaggt

SEQ ID NO: 1545 - DNA, 201 bp, Homo sapiens
ttttgtattcagcttagattagggagaatatagtgtctccttaggtaaaatacttactagaaccaaaaagtccagattaaattgtttttatttttattttmctgcagttttgtgcagttgacctgattttaaaatataaaactaggaaggcatatttttcatctaccaaaatgtgaatcttactttcattttgaaacaaac

SEQ ID NO: 1546 - DNA, 201 bp, Homo sapiens
tcttaaacgacattctttggaactgtctttcatagtcaggcgacccgccagccaggccgccaggtaggtggaagggcggcttcgggaactagatccggctsgttctctgctaacatgtggtcctcgatgctctagcggattggccccaaacctcagcacacagagctttggtagggctggggatgcaggtcagcctgctga

SEQ ID NO: 1547 - DNA, 201 bp, Homo sapiens
ttcggatgtggacaattcagatgataatttcctacttcaggtggactcatacacttgatatttttcaactctgatgggtaagaaaagtaagcaaagagtartgtattttaattattctaaacaaatggacatctacttcccttagaatgaaaagaggaatctgtggaaaatgacttccttccataatcttctatcatctca

SEQ ID NO: 1548 - DNA, 201 bp, Homo sapiens
aagttccctagtttcccctgggagatctggccaagaactacccggtcggggcggaacgacatccggtaacgcccctcacagttcacttccgtcctccaccwgcgtctctgcttgcgccatttcctccagcctggagtgtctccgcccttcccgcctcccgtctccgagcttcttaaacacaggccttgggcctacggctct

SEQ ID NO: 1549 - DNA, 201 bp, Homo sapiens
tgaggaaacagctgtgtaggttttgaccagtgagcaggtggtggtaatagtatcacagggttgctacttactgaatcactgctacaacatgcaaggaactstgctagactttacagaatgattcctaatcattgaagcaaccctcacaaggtaggcattattatcatcccagtttcacagaggaggacatcgaggctacca

SEQ ID NO: 1550 - DNA, 201 bp, Homo sapiens
gcggagaagcgcagatggaaacggattgtagcgaaggccaaagcttacctaaacagggagagcgcgtatggcggcagcaacagcgacgaaggagggaaatstgccttcacttccggttgcaggcttccctctactccagcctcccgccttcttggctgcaagagcgcaggcgcaagggaccggaaacagggccttccgcgg

SEQ ID NO: 1551 - DNA, 201 bp, Homo sapiens
cttctaagaacatggggtggggggaggacaactgctccatttgattctcctacttcaactaagagaatctcgtgtgcattagcaaagtggatgtcttttawgatcagaatgctgcaatggacagtcaaaatgccacttaaggagaaacaaaaattactcaagatgagttacttgccgtcagaccacaacaggatagtttta

SEQ ID NO: 1552 - DNA, 201 bp, Homo sapiens
cccttttctcgaattttacattaaaaaaattaaacctctgatcctatcacccccctcaaaaaaaattttttttcaaatctatcatctgataaaggatcagrgttaggttaggcctcatctcttgctgaagatattaaaaaaagacggaaccaaagggagaaacaacaggggatgtcagagatggagggagaaggaccagcc

SEQ ID NO: 1553 - DNA, 201 bp, Homo sapiens
acatcactgttacgctacgaaggtgagactccttttggagaaacatacaatgacaccaatcgtatcgtaaacacttggaaggcactccaaattaagttggscaagtcaaggtgagaaaaatccaactgggcccagaaaccagctcctcctcccagtcccaccgagggccgagaaagagctcaagaaaggacaaggaaggtg

SEQ ID NO: 1554 - DNA, 201 bp, Homo sapiens
tttagtagagagagggtttcatcctgttggccacattggtcttaaactcctgacctcaaataatccacacgccttggcctcccaaactgctgagattacargtgtaagccattgtgcacttggccagaatcctcaatattcacacaccactggagctgttttaaagtttccggctttctctgccacataccccaaaattat

SEQ ID NO: 1555 - DNA, 201 bp, Homo sapiens
tcatcttccatgtcaatttcttggcgacttagtgccagagccctctgcaaatcctcctcatcttcgtctaacattcctgagccatcatttgcttctaacaytcgttccaggtctgttttatggactctaaagaacaaaagcactggtaataactgcaaccaatcttctattttagacataacataaaggcatttgtaatgt

SEQ ID NO: 1556 - DNA, 201 bp, Homo sapiens
caggaaggctacagggcagatgctcatggacatcacaaaggtgaaataggaaagtctgagtgaatgaaacagggaacatcaaaacaaaagtattcaaaatrtatttctcttctttaagaaattacaactttaaaaatcaaatttgggaaaagaaatgtatgaaatgcaaaacagaatcttacataggatcgatcctgagcc

SEQ ID NO: 1557 - DNA, 201 bp, Homo sapiens
tatttatagttaagtgtcactgatgtttttaaaagatcacacaaccatatgaacgtctctgcagcagcttagtgatgctgtgccacaagatggcctcatgyaccacttatggggtcagctctgtgctgccacagacactggggtgccaggaaggctacagggcagatgctcatggacatcacaaaggtgaaataggaaagt

SEQ ID NO: 1558 - DNA, 201 bp, Homo sapiens
aagtgcaagatatgtatctgatattaattctggacccgtcaagagagaattcaagttaaaccactggaaaaaaattgtcaatatttaagttagtgtatatyataggtaataaggaagtttcacatgttaagaatagatacaacccatcaaagcttagtaagattgtttaaactctggaaatatttcaagttgagctctttt

SEQ ID NO: 1559 - DNA, 201 bp, Homo sapiens
attgctatagcagtatgttcttaaatttaatatcctcattacccattgtcccaactggggcagtggttacagctcttcctgcaagttggtttgtggtactstggaggcctggctaagagctgcaccttcatcctttcttaagattatgtaaacccctaatttctatattaagtattttcctctttaaaacatccccagtag

SEQ ID NO: 1560 - DNA, 201 bp, Homo sapiens
gccagttcatctgttctgagaaaaccatcaaaatgaatttatttatgcaactataaagcaaagactcagtttaaagtagactttaaaatttagtctgatayttttctgaatttctaagcattaggcttatggttgccattttcttattaattttagacattaccaacttattgaaaaataaaagatttagcactcttgtat

SEQ ID NO: 1561 - DNA, 201 bp, Homo sapiens
cactgtgttgcccaggctggtctcgaactcctgacctcaggcaatctgcccgccttggcctcccaaactgctagcatcacaggcgtaagccaccgtgcccrtcctatttgctgtaaatttttaaaaaatacattcaaatattcacaggattcaggcagtaaccatttacaaatagacaaaatagccaaagcaaatattaaa

SEQ ID NO: 1562 - DNA, 201 bp, Homo sapiens
ccagagtacaagagtcacccttatggaaatggaaaacctgatggatagcatggatagagagaaaaaaataagtctttcatagacatgttcagtttgaaacrctttttggatttccaagtggagatgccaaagctaggagttagtcaaagctaggtgttcagggtagatgtcaagactaaagataaaagtttggtaattatt

SEQ ID NO: 1563 - DNA, 201 bp, Homo sapiens
agagtcacccttatggaaatggaaaacctgatggatagcatggatagagagaaaaaaataagtctttcatagacatgttcagtttgaaacactttttggayttccaagtggagatgccaaagctaggagttagtcaaagctaggtgttcagggtagatgtcaagactaaagataaaagtttggtaattattgacacataga

SEQ ID NO: 1564 - DNA, 201 bp, Homo sapiens
ccaagtccaggataaatgaggcaaaaagaaaatccagtccactccccaccacactgctcctctggttccaaggtccctagccagtctgtcttctctctgcytttgagattcagctgaatggttttttttttctttttgagacagagttttgctcttgttgcccaggctggagtgcaatggtgcaatctcagcttactgcaa

SEQ ID NO: 1565 - DNA, 201 bp, Homo sapiens
cttaagattatgtaaacccctaatttctatattaagtattttcctctttaaaacatccccagtagtttctgtttctcaacactgtttgataaattataccrtatcactgaagtggtggctcaagtattaggcaatcaaacactcatagcaatccatgtccatgaagatatttgtgtctctccttgttatagaacatttgca

SEQ ID NO: 1566 - DNA, 201 bp, Homo sapiens
attaggcaatcaaacactcatagcaatccatgtccatgaagatatttgtgtctctccttgttatagaacatttgcaacttatgttttttgtaacagaaagmatctgcatccatttcaaagccacacctagagaagacattaataactgccaacatgtatgtatggaatactttacagtttataaaatagtttcacacacat

SEQ ID NO: 1567 - DNA, 201 bp, Homo sapiens
ttcttaaactttggtgtttgttattggatatcctttgttggattaacacataatgggacaaagattataagaactattaatggaaaacctcaaaatagtaygttgaacattttttatgaggacaactgtattcagagtttagacggtttaatgtgttttctgccagtaaaattgtttctgtattgtataataaatatgcca

SEQ ID NO: 1568 - DNA, 201 bp, Homo sapiens
agctcaccatggtattctatgaagagtgtctgaagaatggatactctgccctgttcaggggccatggtaaagatcttgggttttattcaagacttcacatwttttttttttttaatttttttttgagagtctcgttctgtcacccaggctggagtgcagtggtatgatcttggctcgctgtaacctctgcctcccgggttc

SEQ ID NO: 1569 - DNA, 201 bp, Homo sapiens
aaccattactattatcaacatcaggaaagtagagatactttcctgaaaggttaatttggttaataagaaatgaaagccactattacatgatgtgagccaamttacctacaagacagaaaaagaaaacaaactatatggaaaaagcctgaggcgagagctaattagctagtctgcaaaaagatccaagaaaaatgccctaac

SEQ ID NO: 1570 - DNA, 201 bp, Homo sapiens
aaagaaaaagaaacatttagaaaactattttaaatgtctttaattgctgaatgcctctttggctaatatttggaagatcattatttagtcctacaaccgaygcattgttccactttcccatcattttgtttgcaaaccgctaaaagtcttatttcctcatctctttgacacattaccaaagtggaccctatgctgtaatca

SEQ ID NO: 1571 - DNA, 201 bp, Homo sapiens
gtgtataatttgaaactttttttttgagacaggatctccttctgtcacccaagctggagtgcagtagcacgatcatgattcactgcaggcttgacctctgkgctccctcctcagcctccctagcacctgggactacggccatgcatcaccacgcctagccaatttttttttctttcattttttttttagagatggggtctt

SEQ ID NO: 1572 - DNA, 201 bp, Homo sapiens
cctcccaaagtgctgggattacaggcgtgagccaccgtgcccagccgttaggggcatgtatttcaaagaaactggagtttataaggaagaacagtggcctrgaagaggcaaagaagaaaaacatctatccctcctctcagccgtgtgatatgtgatgtataaaagaaaaagccattacttagaagggctgcaaagaaagca

SEQ ID NO: 1573 - DNA, 201 bp, Homo sapiens
agccaggatggtctcgatctcctgacatcgtgatccgcctgcctcagcctcccaaagtgctgggattacaggcgtgagccaccgtgcccagccgttagggrcatgtatttcaaagaaactggagtttataaggaagaacagtggcctagaagaggcaaagaagaaaaacatctatccctcctctcagccgtgtgatatgtg

SEQ ID NO: 1574 - DNA, 201 bp, Homo sapiens
gatagatcatttaagaaaaaagtaaaaccaatcatcatgttttatgttattttttagccacgtccagctactctggtacaggaatggacaaggccaagatktggtttaaccagggttgagatttttgtcattcaagtatgatggagggagagaggggaaacacgttgaagaatgcaatggagtgattatgatgacggatta

SEQ ID NO: 1575 - DNA, 201 bp, Homo sapiens
agagggagaggttcaattttcatggtgtatgagaaaacgtcgagtgtctatgagcaacctttcactgttatttacggggctgggtataacaagaaggcctrggaggagggtctgacgagcaaggggaaggtagccaaggatggagtgaaatacagggtgtcttcctaagcaataattacttctaatgtttttaagtttgcc

SEQ ID NO: 1576 - DNA, 201 bp, Homo sapiens
ttagctttagatttggcaaagaggagccagcgaaaatctgacctatttaggaagagaacagttctgaagttctgaaattaccagcagttttgactaaaggmgggtaagtcatagcgcaaaagaaattataaacacaggacctaccaaaatgccacatccattcttgtaaaagattattcaaaacacaaaatcaaacaatat

SEQ ID NO: 1577 - DNA, 201 bp, Homo sapiens
gaatgtattttcatatggtggaattcctatttagcaagcacttacaaggctgggcacaaggtaaggttttaggagttgatccagatttatggtttgcatcyattcccctgatgctaacaggcttacaggactgcctgaagcggccatgagcagctaaatgaactaccacgtctatttgggaatgcgctcccatacctccaa

SEQ ID NO: 1578 - DNA, 201 bp, Homo sapiens
cgagatcgcgccactgcatccagcctacgcaacagagtgagactcagtccaaaactaagaggtttggattttattctgtaacagggtcaagaaatttttamgcaggtttgtttttagaaagtaactgacaatacaatagaaaatggactggggtagggagaaatgggtgacaggacatgaaagaggaatagtccctgggaa

SEQ ID NO: 1579 - DNA, 201 bp, Homo sapiens
acataattttaattgcttctatgttctcagcagaatgtaacggaaagccacaaggaaggtgtgtaagggagaggaaagtgcttaaaggtttaaagacatargctgtgaaattagtcaccttggagggtggcacattattttttataaacttcttggagagtggtacataattttttataaacaccttggagggtggtacat

SEQ ID NO: 1580 - DNA, 201 bp, Homo sapiens
aaagcacaggtgaagatataagcaaattgataaatttgctggtagaaagaacataattttaattgcttctatgttctcagcagaatgtaacggaaagccayaaggaaggtgtgtaagggagaggaaagtgcttaaaggtttaaagacataagctgtgaaattagtcaccttggagggtggcacattattttttataaactt

SEQ ID NO: 1581 - DNA, 201 bp, Homo sapiens
aaaagcttattttactgcttataggaatattacaaaaaaagggggggggaactgattatataagagagtggagagatgaaagcaggaacatcttgagtagrtgagaagagctgggatccagcccacaagtgagggactggttttggttagaggtaggggaccattcatctatttaaataggctcaaagcacaggtgaagat

SEQ ID NO: 1582 - DNA, 201 bp, Homo sapiens
tgtaagggagaggaaagtgcttaaaggtttaaagacataagctgtgaaattagtcaccttggagggtggcacattattttttataaacttcttggagagtrgtacataattttttataaacaccttggagggtggtacatcactaagaaaacatagtagaaatatcagacagcactaaaggctcatctgaattttgtgatt

SEQ ID NO: 1583 - DNA, 201 bp, Homo sapiens
aaaaatccaatttgaaaaccactactagaactgtttgaaaaaagttaaaagtacacaaaatagcctaattcaatgaacctagacattacacactgtctttyaagatgttgaaaaacatgaaaaaaattactcaaattgtatgtacctaaatattaaattatcttaacctattatcattccttatttgaatgaaataataag

SEQ ID NO: 1584 - DNA, 201 bp, Homo sapiens
gaagacagccaacaagtaacagtatttctatatgcataaagttaagcaagtagacaaaaaccaaacacatttatgttgtatgtcataacaaacaagttttycatattggagccccttctcaaatggaaatttatagtactgtacaaatttcattcattttcccacaaatgacatgagataaattccatcttggagaatatg

SEQ ID NO: 1585 - DNA, 201 bp, Homo sapiens
caactgatacccacaaagattaaaaccacaatttactattgtgttagtacagtgttgaaaccaaataaaataaccaggagtaaaaatataactactcctartaaaatataggttgtaaaaagtgatttccattataagaaatctaaagggaaagcccactatatagctattgcttctgcagtaattgtcaaaacacctcta

SEQ ID NO: 1586 - DNA, 201 bp, Homo sapiens
cttgcagtgagccgagatcgcgacactgcactccagcctgggtgacagagcaagactccatctcaaaaaaagaaaaatatccatgatgtctaaggaatttytggagactgtacaaattactgtgaagtttaaattattatgttaaagtattcattaaatgttctagcaatcctctcctgccttggtttcccaaagtgctgg

SEQ ID NO: 1587 - DNA, 201 bp, Homo sapiens
gagggtggcacattattttttataaacttcttggagagtggtacataattttttataaacaccttggagggtggtacatcactaagaaaacatagtagaartatcagacagcactaaaggctcatctgaattttgtgattataataaatttaaagtaaaaccttagctaggtgtggtagcacaagcctgtagtcccagcta

SEQ ID NO: 1588 - DNA, 201 bp, Homo sapiens
aagacagaacctagagagacaacgaactacctaggctaagtaatcaggaattttagtgaaaggcaaatattagcttcttagctcctactaatgagctctayaaggttttgaatgcaagccattgttaaaaatgaacatcaagaagttagttcttaactcttctcagcaacatgtgactatgtaagatattctcaagctctt

SEQ ID NO: 1589 - DNA, 201 bp, Homo sapiens
actgtcagcttccctacttttgaggttttgggacttggactggcttcctggttcctcagcctgcagagagcctattgtgggacttcaccttgtgatcataygagtcgatactccttaatacattacccttcatatatacatctaccttattagttctgtccctctagagaaccctaatacacttactcacagggctgctgt

SEQ ID NO: 1590 - DNA, 201 bp, Homo sapiens
aaacacatttttttaaaagagatggtcatctagtctggagtgcagtggtgcaatcatagctcactgcagcctcgaacacctgggcttaagtgattctctcrcttcatcctcccaagcagctgggactacaggtgtgcaccaagatgcttgacaaattttctaatttttttgtgtggagaaggggtcttacactatgttgta

SEQ ID NO: 1591 - DNA, 201 bp, Homo sapiens
cctgggtgacagagtgagatttcgtctcaaaaaaaaaaaaaaaaaaaagtctgaaataaacatggtgaaagtatcacatgggaattattctggaaagcaawttagaaatctgttccaaggccttaaaaatgttcatatcctttaacccaataatctgacatcctcagaaaaactagaagaaatgataagacatttgaggtg

SEQ ID NO: 1592 - DNA, 201 bp, Homo sapiens
agccacacctagagaagacattaataactgccaacatgtatgtatggaatactttacagtttataaaatagtttcacacacattgcttaatttcatgcttmtgtgagttaaggcaggttttacagtgacacagctgatgtagtagagttttgcttggggttttatgatggtaaaacagatttagagactactgctggaaaa

SEQ ID NO: 1593 - DNA, 201 bp, Homo sapiens
cttaaaactagtctactatatacatctgataatttggctgctgtgggtgctactttagaaaaattatattcaacttgctacctgcaatgtcagaaatcatrtctaccaaaataagttctccctgggcatttaaactgaaggttccatagatgtcagacttctagggtcatgggcttgccgcttgtagaaaaaacaaaatgc

SEQ ID NO: 1594 - DNA, 201 bp, Homo sapiens
acctgcaatgtcagaaatcatatctaccaaaataagttctccctgggcatttaaactgaaggttccatagatgtcagacttctagggtcatgggcttgccrcttgtagaaaaaacaaaatgcaaacctgtttatttcaatctgtctgacaaaaaaagggaaatttctgaaaattcactatctgccctccaaggtagccaac

SEQ ID NO: 1595 - DNA, 201 bp, Homo sapiens
tacaggtgtgagccaccatgcccagcttagtgattttcaattaaatcctgaaaatttggggtattatgttatgagaatgtgaatcttatttacatcttccratttagcaagcctccactgacacagcactggcaacagggaaaagggagtgccacctcgctacaaccagaggggagtgaaagtccaggtttcttcaaggcc

SEQ ID NO: 1596 - DNA, 201 bp, Homo sapiens
attcctatttagcaagcacttacaaggctgggcacaaggtaaggttttaggagttgatccagatttatggtttgcatccattcccctgatgctaacaggcytacaggactgcctgaagcggccatgagcagctaaatgaactaccacgtctatttgggaatgcgctcccatacctccaaagctgtttttcgtactgattgg

SEQ ID NO: 1597 - DNA, 201 bp, Homo sapiens
attgacacatagatcttatttacagatgatatttaagatccatgaaaggaatctgaaaagtgcaggcagcaagttaggaaaaccacagcatggtgggctgraggccaaaggtagacagggtttctaagaagggatatcatcaggaaccaaggttttaaatataaaagaaaaaagatacaagtatctaaaatcaaagaatta

SEQ ID NO: 1598 - DNA, 201 bp, Homo sapiens
tgtattttctgtatcttaaaacatttggctcttttactatcatgggaattttaaaaaatcatttaaaaaattattcccaactattttaaaaatgacaatarcaagaaaacggaaaacttatgaaatcacctaggagaatgatgcaatggtaaaataaccagttttctgactgcattgcccaaagtattatttttttttttt

SEQ ID NO: 1599 - DNA, 201 bp, Homo sapiens
acacgtgtattcatgtaaccaccaccactacaatcaagacatagaagtgttataataccacaaagatctccctgctatcgatttatattcccacccacctmtcttttacccactttctctaactagtggaaaccactaatatgttctctatctctatacagctgtcatttttagttgaacaagtggaatcatacagtgtaa

SEQ ID NO: 1600 - DNA, 201 bp, Homo sapiens
aaccaccaccactacaatcaagacatagaagtgttataataccacaaagatctccctgctatcgatttatattcccacccacctatcttttacccactttstctaactagtggaaaccactaatatgttctctatctctatacagctgtcatttttagttgaacaagtggaatcatacagtgtaagaccctttgaggcttt

SEQ ID NO: 1601 - DNA, 201 bp, Homo sapiens
ggaaacacgttgaagaatgcaatggagtgattatgatgacggattacagaaaataagcagtagaagaaaggaagaatgcgtataaaggaaatgcttgggcyccacagtagggtttaaagaatggctggaataaaaaaacagacaaaacatggtttaaagataggaggtggtagttaaagagtaatatgcttgcaattgaga

SEQ ID NO: 1602 - DNA, 201 bp, Homo sapiens
aaccattactacaaccaagatagtgaacacattcctcattgccatgtttcccgtgcctctctgtaaccctcccctctcactcctccatagccttctcgtcmccaggcaaccgctggtcaatctgctttccatcactacagatgaatctgcacttttctagacttttaataaatgataccatacagcaggtagtattttgtt

SEQ ID NO: 1603 - DNA, 201 bp, Homo sapiens
attgttgaaactgggtggtgggtacataaggttcattaaactagtcttttgcttttgcatatgtttgaaattttttataataaaaagttaaaagacatacmagtttgatagcatttgagctgaagacatctcttcctttttctgcaaaatatctcagtagctaatatgttgctcttcatcactcaataagcagcaaaacca

SEQ ID NO: 1604 - DNA, 201 bp, Homo sapiens
ataacagcaaatgaacttaacgagggagcacacacagaagggctgcagggctgggtcctgagcaagcggcactgccacagtgcacttgtatcatggccaarcaacaatgctttttgtttcagatattttctgtacttgaatttcaaatatttatacagaacagtaatttttaaaaagttattcctaatagcccagtgttgt

SEQ ID NO: 1605 - DNA, 201 bp, Homo sapiens
ccaagagttcctgaagctcctcatggagcggctacaccttgaaatcaaccgccgaggccgccgggctccaccgatacttgccaatggtccagttccctctmcaccccgccgaggaggggctctgctagaagaacctgagttaaggtaagggtcgttccctctacctcctttccccgtagtttatcagcatcattcacactt

SEQ ID NO: 1606 - DNA, 201 bp, Homo sapiens
gaggactgacaactgtaatgggaatgccttctgagtcaggcctctgcctgatctctagtgctcagtgagctgctccctgctgaggctgcccctctggctcrtgccctgagtgccatcactgcagtgtctgtagctgtggtgaatctgcagtaccaaggagcccatctgcctgtccaggtatgataaagggacggagaggct

SEQ ID NO: 1607 - DNA, 201 bp, Homo sapiens
cacacacatacagattgtggtcattttctggcaagaggtccacatcgtgcaagaacaggcagtcccactcttcatcacgcagggcctctcgcaccccaacrttcaacagttttgccctgttaaatgttccatttccagcctggaagataatggaggggaaccagactatgtctgtaggtggcacggagaaaagggggctaa

SEQ ID NO: 1608 - DNA, 201 bp, Homo sapiens
ctcttgcccacctcttcctcttccctgcaatccaccatgctgtcttggtggtgtctgttgcagagaggcaaccgtgagtggtacgacaggatcctgaatgmcaagagtccccgagagcaggtgcagttgtgggggaccctggccatgaggggtacgggcagccgagaggtgggtacgagctaggcttccttgcagccagga

SEQ ID NO: 1609 - DNA, 201 bp, Homo sapiens; identical to SEQ ID NO: 1548

SEQ ID NO: 1610 - DNA, 201 bp, Homo sapiens; identical to SEQ ID NO: 1549

SEQ ID NO: 1611 - DNA, 201 bp, Homo sapiens; identical to SEQ ID NO: 1550

SEQ ID NO: 1612 - DNA, 201 bp, Homo sapiens; identical to SEQ ID NO: 1551

SEQ ID NO: 1613 - DNA, 201 bp, Homo sapiens
aatgtttgtaaaattcatacctaataaacactagatcaaaaaaaaaaaatcacagacctgtggtaggctgggcaccagtgctctaaagcaagttctgcctraactggcagggacatttttcacatcaggaacaggagttgttcctggactctgtctggggccaggctgggagagacgtggggcagagtggggcaggggcag

SEQ ID NO: 1614 - DNA, 201 bp, Homo sapiens; identical to SEQ ID NO: 1552

SEQ ID NO: 1615 - DNA, 201 bp, Homo sapiens; identical to SEQ ID NO: 1553

SEQ ID NO: 1616 - DNA, 201 bp, Homo sapiens; identical to SEQ ID NO: 1554

SEQ ID NO: 1617 - DNA, 201 bp, Homo sapiens
tcgatctcttgacctcatgatccgcccgcctcggcctcccaaagtgctgagattacaggtgtgagccactgcgcctggcctcatccactatatttgaaccracccaaaggccagtgctttcttaattaagttcccacaggtgaacaaagccaaaattcagattctattttatttatggtttagaattacctactgtgaaaa

SEQ ID NO: 1618 - DNA, 201 bp, Homo sapiens
aaaggaaggctatctccacgtctgttccaatggcctctgctgttatttactttacgagaggcccaccttatccaaagagctgtatgccctgggggtctttsatgggcttcacacagtacatggcacttactacatccaagtgtgtgccctggtcaggtgtgggggtcttggcttcgacacctgtggacaggaaatcacaga

SEQ ID NO: 1619 - DNA, 201 bp, Homo sapiens
aaggacatggtggccttcttcctgggctgcagcttctccctggaggaggccttggagaaagcggggctccccagaagagacccagcaggtcacagccaggygggtgcatacaaggtagggacacagcccacagcccacaagggcagaatggcctgaagatgcagatcaacttacatattcctggggtggggagaacatggg

SEQ ID NO: 1620 - DNA, 201 bp, Homo sapiens
ggggccacagtgagagtctggggccctcccagctttccccttatgtccccaggatgggccatccccagttctggaaatacgagttcggtgcctgcaccggyagcctggcttcgctggagcagtactcggagcagctgaaggacatggtggccttcttcctgggctgcagcttctccctggaggaggccttggagaaagcgg

SEQ ID NO: 1621 - DNA, 201 bp, Homo sapiens
ccaggcactgttgatgctgcacatccagcagtgagtacaacagatggaaaggcttgtcttctctgaactgaaaggaaaagaggaaaaccccctcccttggktgtgagcctgcttgcttgtttctgcgtcacgggaacaacctcagctgttccccatggtgtgatgagcactgcctgctcatgcaggccttgccgggcccat

SEQ ID NO: 1622 - DNA, 201 bp, Homo sapiens
tcatctgccaactttgcgctttggctgccctgctgtccgtccccgacctgcagccctactagcttcctaaaaggcaagtttcacaaatcactcactgctcrgtaccttctgtgatttcctgaggctccgggataaatccaaatttcttcacatgacaggtgggtccccatgagccagccgctgctttcctttccagaccca

SEQ ID NO: 1623 - DNA, 201 bp, Homo sapiens
agtttattacaatgtgaaagaattattcgaagtcattgcaatacttactacaatgtgttaacatcattttgtactttgatatatggaaactgagtaaaaartaactatggaagcttgaagtgaaatagttgccataattagacttgcatcctaattcatgaagaatcctattaataaaagtcaatattatatgtaatggtt

SEQ ID NO: 1624 - DNA, 201 bp, Homo sapiens
cttttagtacactacattcttctttaggcatattgacaataatattctcaactaattagggcttctcacgtaggttgctgatgtggaccctggtgaaggcyggccccccatcactggagttatttccccactctctgccagtgctatgatcctcactgtgtgccgcaccaaggaggctgaatttcaacgacatgttctcca

SEQ ID NO: 1625 - DNA, 201 bp, Homo sapiens
tttcctgtggaatgtgagagccatagatgataatcagtttgaatgggacagaacacctttagtgggctagtaaaggtgtgtgaaatgtgcttgatacatgyaagggaaggctgaaacaacagtactgaagacagtgtggcaggaacataatttctggactagattctgtctagcagtagacctgcacaatagtgggcaaat

SEQ ID NO: 1626 - DNA, 201 bp, Homo sapiens
tgttttgaaaaatgtattcatcatcagctaaagaagttaaaaaaaaaaaaaaaaggaagtcatcttacatctggcatcgaaagagactgatccaatccaayatctactttgttcaggactgcgatgctgaatgacagaacacccacaaatattgctatctggaacaacaaatgaatcataagacagagactgcttagtaaa

SEQ ID NO: 1627 - DNA, 201 bp, Homo sapiens
tggatttgaaataatccaccatgtaggagtcctgaaagaaagataaaagaataggagagagtgtgaacactctgatagtaactaagcaaggcgaggatcayggagaataagagggtgccaggaggttcctggctgagatgcctccagctggactcatgattcctaacaccaccagtcttccccccagggccccagggtgct

SEQ ID NO: 1628 - DNA, 201 bp, Homo sapiens
ctcagtcttgtctttttcccccccagacatcggtaatattcgatatcaagttacggggagagtttgacggctccgttaccttccaccaccccgtgcttccygctcgatcgatccagccctatcagatccccatcacaggtaacacgggttctgtagaggagtctgtgctgccctttcaccatgtggctgtgttctcaccat

SEQ ID NO: 1629 - DNA, 201 bp, Homo sapiens
ttactcagtatcatttatcattatcaaatgaccattagtatgagttcaaatacttgaaaagaatgcctcaggatagaattccctttcagtaatgtccttcyattgtgccacccttttaagatgagaactcttacctatgtaactgagtaagacagggagaaatattaatccgtgagtggctcccagtaagaccatggccaa

SEQ ID NO: 1630 - DNA, 201 bp, Homo sapiens
gatgacacagggagacccagctttgatatacaaataggtataaactgaggcacgatgcaaatgatttttaaatgataatttgaaaatttttcagcaaaacrggaaagatttggtaaaggagaaggtacctgaagcattgcagaactggtcagtgatattgtccactcgacagcaagacgactgtggcttcacccagtcgaa

SEQ ID NO: 1631 - DNA, 201 bp, Homo sapiens
cctcaaaacgatccgcccgcctcagactcccacagtgctaggattacaggcatgagccgctgcacccggcctgagcaaggttttaaagtatggatggggtkcgagcatggtgttttggggaactctgggtctgtgtaactgaaggttacatagggtgtctccacagggaaggggaaatggtggtggtgtggccactggcag

SEQ ID NO: 1632 - DNA, 201 bp, Homo sapiens
gcaagactccgtctcaaaaaaaaaaaaaaaaagatttttaaaagcagctttattgaggcatagttgacacataataaactgtacacacttaatattatgcmatatgtgagttttgacatgtatacacccatgaaaccatcaccacaatcaaggcaatgaacatgttcagaccccgaaaagtttccttgggcccttctgtaa

SEQ ID NO: 1633 - DNA, 201 bp, Homo sapiens
tggctgtaggtttgttactgtaacctgggatcacttttctctttctcacattccgtgtgacagtgatgatgaatattgcattctttgggactgacagtcamagtaagtgcttcggctgtggctcttaggcttacccaaatcagtcctccttctgtctggagaggtggggttgggaagtcagaagagtggaggtcaggaatt

SEQ ID NO: 1634 - DNA, 201 bp, Homo sapiens
aacgatcatgagtcatctttggttattaaaaataacccaaaccacagtgattgaagccttgacatgctttctttttcttggtgagattttcctggattgtyagctccttcccccttcctccccgtacgtgctttcagtgagacggaacagttcatttcttccttgactacaattgaataaacatttcgtaatgacattaaa

SEQ ID NO: 1635 - DNA, 201 bp, Homo sapiens
catgctttctttttcttggtgagattttcctggattgttagctccttcccccttcctccccgtacgtgctttcagtgagacggaacagttcatttcttccktgactacaattgaataaacatttcgtaatgacattaaaaagtattgacttttgtgtcataagtaccagcatttgcagcattttctgactgcatcgttgca

SEQ ID NO: 1636 - DNA, 201 bp, Homo sapiens
taggaggcaaaaggcactggtcggagagctcctggggcggggtgcaattttctaagtaaaaagtgaacatcctgctgtcatcaggctacaggcttgtgcartctctaaagaataacaaattacaggcagactagcccagaactaggccaggaaatcacatttccatggtcagaggcaccatcaggtatactagtatagccg

SEQ ID NO: 1637 - DNA, 201 bp, Homo sapiens
tctgagcacttgaggctaagcaaaatcacctgaccctggactcagaggtcagacccagctgtacatttcagggatgaagaaggcccccagataagggaacrccaaaggtttagcttgttctctcccagactggcttctttttttttttattttgagacagagtcttgctctgtagcccaggctggagtgcagtggcgtgat

SEQ ID NO: 1638 - DNA, 201 bp, Homo sapiens
gtgtgagccacttcgcctggccagatgggcttttctcgattgctctgggttctttggtacatagctgctgtttctccacctggtttcatgtataatcaaakgtacagggtttactcagtcctgttgtgtaataggaagcaggaaagggcaagggccctgggaacaacctcagccctgccacttactggtcatgtaaccccg

SEQ ID NO: 1639 - DNA, 201 bp, Homo sapiens
ggccctgggaacaacctcagccctgccacttactggtcatgtaaccccgagcaaaatgaccacctctgagccccagtctcctcttctgtaaatgggtatamcaccacctactcataggctgcgtgatgagaaatggaataatgtcagggagtgcctggcatgacgctggcaccctggaggctccccaggaacggtggctac

SEQ ID NO: 1640 - DNA, 201 bp, Homo sapiens
cctcagcctcccaaagtgttgggattacaggcgtgagccaccacgcctggcagtacggaggtatattttcatttgaaaaagtggatatctcagtttttaartttgtaatgaaaattttaaacacacaatagagactaataaaaaagaacccctgtatgcctgtatctgattcgacaatagtcaaaattttgcttctaagtt

SEQ ID NO: 1641 - DNA, 201 bp, Homo sapiens
gtgcccttttctgttctgcatgagcccgggaggtgtgctcctctttctggccttgctgaggaagcctcctcagtctgttaattgtctcttcctgggtaatytctttattagagaaatcttttttttttttttttttttttttgagacggagttttgctcgttgcccaggctggagtgcaatggcgtgatcttggctcactg

SEQ ID NO: 1642 - DNA, 201 bp, Homo sapiens
gtcaagactgactcctgttcactgtgaagtagaggaaggcagtgatagccagacagggacgtgtgtttagggaagtcctctgtgttttcagttctgttttygttttgtttttatgatgggagagatgagcaaatataaaggctgcttctaggagcaggagtgaggagaggttgcctatatgagagaaacgggatggtcaat

SEQ ID NO: 1643 - DNA, 201 bp, Homo sapiens
accatcgtgatcctctacgcacgcatctacttcctggtgaagtccagcagccgtaaggtggccaaccacaacaactcggagcggtccatggcactgctgcrgaccgtggtgattgtggtgagcgtgttcatcgcctgctggtccccactcttcatcctcttcctcattgatgtggcctgcagggtgcaggcgtgccccatc

SEQ ID NO: 1644 - DNA, 201 bp, Homo sapiens
aggtgtccatgtgggaactgaggccaccgggaacctgctgccagcgccctcccatgtttgtcttcttggcagcgccatcagggcagtggccaagaacaccrcccccggggcagccctgcctgcgggggagtgggggaccgtgcagctacggggttcttggagagtcggccagacggcggggggcagcaggaactttgcctc

SEQ ID NO: 1645 - DNA, 201 bp, Homo sapiens
gacatattaagattgatggttaagttatatactagttttttggttttctgtctataccacagatactgtggaacactccctagacaataaagatggtcctstctgccttcaggtgaagccttgcactcctgaattttatcaaacacacttccagctggtgagtttttgcataatgacaagaggaagagagttgggaaatta

SEQ ID NO: 1646 - DNA, 201 bp, Homo sapiens; identical to SEQ ID NO: 679

SEQ ID NO: 1647 - DNA, 201 bp, Homo sapiens
tcagcagcagcccagatgcaagcagaaggtcatctttggcagcggcacggtcaccttctcactgagctttgatgagcctcagaagaacgccatggcccacrggaattctacgcaccagaactccctggaggcccagaaaagcagcgatacgctgacccgacacgagccattactcccgctgcagtgcggggaaacggactt

SEQ ID NO: 1648 - DNA, 201 bp, Homo sapiens
cttcctcctctcactggcagtcagcgacctcctgctggctgtggcttgcatgcccttcaccctcctgcccaatctcatgggcacattcatctttggcaccrtcatctgcaaggcggtttcctacctcatgggtgggtgagacaaccaccccacccccacttgccactctccccgcctaaagctcttgtggatgtaggggtc

SEQ ID NO: 1649 - DNA, 201 bp, Homo sapiens
acataagttacataaataaaaaacaggacagtcagaacagcatccttcacattcaataacaagaaaatatttaggagttgtaggtattgaggcttgactayggtaggttaaagattggactggtgagagaaggagttatgagaagtgaaccaaggtatgtagccaaaactttcaagaagtctggtaggcaaagaaagagag

SEQ ID NO: 1650 - DNA, 201 bp, Homo sapiens
cctgccttgaggcatgtgctcctgctggacagctggtagctgaccactcggttctcaggaattctcttggaaacaaagaacatgcagcagggagaggggakgaccacagagcctagaagaggagagagagaagagccacgtcttttcccagcctccccttggctctgggcctcagagctggagcttgaaccctgcaccaaa

SEQ ID NO: 1651 - DNA, 201 bp, Homo sapiens
cacaagggaaactttttctcagccaggaggagggtgccctgtggcatcattacaagtgtcctggcatgggtaacagccattctggccactttgcctgaatwcgtggtttataaacctcagatggaagaccagaaatacaagtgtgcatttagcagaactcccttcctgccagctgatgagacattctggaagcattttctg

SEQ ID NO: 1652 - DNA, 201 bp, Homo sapiens
catataggtcgatggatactcactgtcacatgtgatccaggtctcctccgaggggctggccagtctcttctcccatggagatgatgggcactgccacagcrtgtcaggtccttttggacactgaacattgtccacccacatgggaatggacatggccttgtctaaagatgcagggttgattttccctttgtctgcacagcc

SEQ ID NO: 1653 - DNA, 201 bp, Homo sapiens
ggctgtcagaggccagggaaggggacgagggttggggaacaggtggttagcacttcatcctcgtctccctcccaggttagaagggcccccctctctgaagrcccccactccctgggatgctacaatccaatgatggaagatggcattagctacaccaccctgcgctttcccgagatgaacataccacgaactgggtactga

SEQ ID NO: 1654 - DNA, 201 bp, Homo sapiens
acagtccaggcaactcctagtagtacaacggaagaaacagctacccagaaggaacagtggtttggcaacagatggcatgagggatatcgccaaacacccaragaagactcccattcgacaacagggacagctggtaatggatggtttaacaagtaaatttggatggaaacttccttttgggttaaacggtagacattgagg

SEQ ID NO: 1655 - DNA, 201 bp, Homo sapiens
ggctatgaatggcttgctcatgacatattttgtatttgatgagaataccatagtgtttgataaatattcagaaatgtatcgctaaaacatatggctattckaggtattctttttcagaatcatctataggaaagctctagctgctcaggcattcctttccccactgaaattactaacaacataaagtgattatcatggtat

SEQ ID NO: 1656 - DNA, 201 bp, Homo sapiens
gggtctgggctggcgggaatttctgcccaaaggattctgacctgactctgtcccctgccccttccctgcagagcaccagtcctggcgcctgacagggggcrctgaccgctgcgaggggcaggtggaggtacacttccgaggggtctggaacacagtgtgtgacagtgagtggtacccatcggaggccaaggtgctctgcca

SEQ ID NO: 1657 - DNA, 201 bp, Homo sapiens
tcagtgtgcgatgacacttgggacctggaggacgcccacgtggtgtgcaggcaactgggctgcggctgggcagtccaggccctgcccggcttgcacttcaygcccggccgcgggcctatccaccgggaccaggtgaactgctcgggggccgaagcttacctgtgggactgcccggggctgccaggacagcactactgcggc

SEQ ID NO: 1658 - DNA, 201 bp, Homo sapiens
cacctgcgccttcctcttcgccccacaggacctccagcagaaggttgtctacctgagctacatggcggtggagtacaatgtgtccttcccccacgcagcamgtaagtaacctccttccctttctcattgctaccactagacgccagggttcctgaaaggactaagctggggccagggaggtggataggatctgacccttcc

SEQ ID NO: 1659 - DNA, 201 bp, Homo sapiens
gaagggtaaccctggctctgtctcttgcaaccaggaaaccggagatcccctgatggctgggacctttgtggtctcctctctctgcaacggcctcatcgccrcccagctgctcttctactggaatgcaaagcctccccacaagcagaaaaaggcgcagtagagccagctactggagtcattccgtttccactcattcaccca

SEQ ID NO: 1660 - DNA, 201 bp, Homo sapiens
aaacatcttggctgcttcaaagtaaggtcaacaggtcctcctctctgctgagggtcccaattcaacatcaactgtagccagttttccatgggttctactaytaaactagaaaacatacaaaatagggtgaaaatcaaatcattatgttccaatttccctttatactgttagaaaggtaattttgcaggttgtccattttct

SEQ ID NO: 1661 - DNA, 201 bp, Homo sapiens
tgttctttgggttttggtgattgttcactttagcccatacaaaagtttgggtcttttttcctcaacaaaagtttggactctgttatctgtaagagatatgstaatacacattgattttgttcatttgcatttcaaagtaggaaatctggtgcataagtatttagaaaacctaggattttcaaagatccttgaacaggattt

SEQ ID NO: 1662 - DNA, 201 bp, Homo sapiens
attttttccccttatcctgtacatttgtccacggtcctaagttattacactccttaatgtcagtacttaccctgaggatgtgggtggggatacccatggtrtcctggggtgggaaatccaagttctttatctttttgtgtccctattcaaggtagtggggaccagggggcagtcaaaatcatagagccaagatacaagtaa

SEQ ID NO: 1663 - DNA, 201 bp, Homo sapiens
gagtcatactaccagcatttctgttttcttttataaaacaaatcctttttaggaaacaaatacttgtttcctaaaaacatatacttgtcctgagcaaactmtgtgtatctcagagtaaacaatcaatagtgtccagttgggtgaatgaatttactctccagaactggttttattaatattattgatattttatttctattt

SEQ ID NO: 1664 - DNA, 201 bp, Homo sapiens
cttataaatttaggatattaatttcttattggatgtatggtatgcaaatatcttttcccaatccatgggttgggttgctttttcgttttgttgattatttyttctactgtacactttttagtttgaaggcccactattatttccacttacaaatcctaacacagatgcccaaataagtggtgctacagaaatactaaactg

SEQ ID NO: 1665 - DNA, 201 bp, Homo sapiens
tacaaaagttgggactacaagcaagtgacataaaaagcttctcagctctcgcagagcttgttgctgctgccaaggaccaggcaacagcagagcagccttargcatcttggaagatcccgaggttagattcttaagcaagagaagagttggacttccaggctgaaggggagaaagtgactctgttctcttagcaaccgtctg

SEQ ID NO: 1666 - DNA, 201 bp, Homo sapiens
cagatttctttagtagctcaaagttctctaagatcataagaagaaatacttacataaggtttctgagccatggccatgtgtatacctggtatttttactarttttctcaatagcacgaactgcttcactggctactagagactggaagcaacaagatatagaatttcagttaatgtgcagctttgaaacatgacaagtaga

SEQ ID NO: 1667 - DNA, 201 bp, Homo sapiens
acataaggtttctgagccatggccatgtgtatacctggtatttttactaattttctcaatagcacgaactgcttcactggctactagagactggaagcaamaagatatagaatttcagttaatgtgcagctttgaaacatgacaagtagaagtttctaaaaaataatcatacattaattgaatcaaagtatacaggtagaa

SEQ ID NO: 1668 - DNA, 201 bp, Homo sapiens
aagctgtttgaaaataatttttttaaagcaatttgtttgcctactggtttgatttcctcccggtccagtttgcgcctgtaaagcaggatggcatggatggygttgccggctcttgctgcctgaatgtgagttggaaggatatacagcagatcctgaaaagcgacaaaggtggagagaatttgcatagggaaagataagcaa

SEQ ID NO: 1669 - DNA, 201 bp, Homo sapiens
cttgtattgtttgccataggttttcttccagagatgccagtggtgatccagggtaggatctttatgcaactgtgccactgcagaggagcacaccaagagcrcacaaaccagccgtttcattctgtgtaaggaaaggtaacataggaagtgttgctattagctgcatatgttgtgaccacatgttttcataagagaaaataa

SEQ ID NO: 1670 - DNA, 201 bp, Homo sapiens
agagccttgagtgttgaaacactgcacaagtgtggagcaaggcccgggctggaagctgcactcgtctctgtccagcgtgcaggcagggctgttgggtgaaracatccacccagcatcacagacgcagctgtacttgggctggcaggatgacaacagcgtgaataaagacaatcatgaaaatcagcaagaaaagcctttgaa

SEQ ID NO: 1671 - DNA, 201 bp, Homo sapiens
gtactctctgtccacaggaaaaacaaaggactcacgatgcattgtccatttagacaggggtgacttaggcaaatattactgagctgcacacatccatttgkcccataaccatttccagtataacccgggagacacgtgcagagaggtaaggaacctgttcagaaataaaaacaaacgtgtaaatacaggtctcctcctctg

SEQ ID NO: 1672 - DNA, 201 bp, Homo sapiens
gccaatcttgtcatcttttcactttgattaactttatcagtttccttttaagctactaatttcaatcaaattaaaaaatggtttcccagtagaaatccctkgcttacaattcttcaggagaaatcaatcatttgatcaatctcttttccctctccttggatgtttttgaaatgattgaagacttctaaacaaagtttagta

SEQ ID NO: 1673 - DNA, 201 bp, Homo sapiens
tctttacatagaatatttgtatagagaatttaattagactcttgaggattatggaactttaaaacagttcatacacatatttgagcatttgatccaggagrcttcattactaaaagtttactttgccacctgtcccaacacctcccaacaatgtttaagaatcttttttatttttgtttttgttttttttgagatggagtc

SEQ ID NO: 1674 - DNA, 201 bp, Homo sapiens
caaggagcttagtaatgttcatggatgacaatgtatgaacgacattgtgggaaattagcatttgactgtttgaaaggcatcaagaaccaacctccaggcayaggattcggcttgcctgtggtgggccccagaaccaattgctggggtggcagctttttggcagtttctaaggaagaggagagcaatgagtgtggccagaaa

SEQ ID NO: 1675 - DNA, 201 bp, Homo sapiens
cagtgaggtacaaggagcttagtaatgttcatggatgacaatgtatgaacgacattgtgggaaattagcatttgactgtttgaaaggcatcaagaaccaamctccaggcacaggattcggcttgcctgtggtgggccccagaaccaattgctggggtggcagctttttggcagtttctaaggaagaggagagcaatgagtg

SEQ ID NO: 1676 - DNA, 201 bp, Homo sapiens
caaggaacagggcgtgcctgcgtggccaggcctccctcccatgccattctacaaaggaaaagagctattttaacaagacacagtgaggtacaaggagcttmgtaatgttcatggatgacaatgtatgaacgacattgtgggaaattagcatttgactgtttgaaaggcatcaagaaccaacctccaggcacaggattcggc

SEQ ID NO: 1677 - DNA, 201 bp, Homo sapiens
ggggaagggattgcaaggtgataggattctgaggaaaagaggctaggagtttaaagccacttgacctggccagggcacgaagagcaactccaggaccagcrttagcggggctgtcctgagccctccacctgattctgagaacatcccttgcggggctgtgcaaggagaagcctttctaattattttccttctgatatgtta

SEQ ID NO: 1678 - DNA, 201 bp, Homo sapiens
cataacccttatccaacaaaacataggtaagatttctccataactataatcaccctaagctcgatgtgtcttacggaatactaggtcgcagcatgttgcgraattatatttcaatcctgcacaaggtcatgaacagcatagcatttttgcctgtcagctctgcaagattaagaaatgtggcattttcacgtgacttaaaga

SEQ ID NO: 1679 - DNA, 201 bp, Homo sapiens
gggcagaagagtcaaaagtgactttatggaagaagttgagagggaagtgctcctgagggacagacacatctggatgagaaacaaggaagatgtgtgaggasgtttatcgggagaaacattccaaataaatgaacacagtggaaaatactcatggtggtacatggggtccggtgacgaaagaaaacttgcttgagtgaagtt

SEQ ID NO: 1680 - DNA, 201 bp, Homo sapiens
agcaaaaataccaagccagatctctatttgatgctacggataaaaaatacattctaaaaatataaaatatcttaccataaaaaaagaaaccatagaagtawaaaagaacatgtacttgacaatttttaaagagttcagtaaagaaagccttcctaaacatgactgtgaagggagaaatagtaagagaaaagatttatcttt

SEQ ID NO: 1681 - DNA, 201 bp, Homo sapiens
gggtgacagggagagactctgtctcaaaacaacaacaacaaaacaaaacaaaaccagctactattattacattatctttgtggctccatttctaagaacayccctggagcgcagatgaacctgaggtctggctaattgcctaccaatgcacccagcacagtgctttgctcatagtaggcatcctacaaaaaaaaaaatgtg

SEQ ID NO: 1682 - DNA, 201 bp, Homo sapiens
gtatatattttctaccatattatgtccattatgagtgagaagatatgaaatcacaataatcaagaaaaaaacaagatgaattttcttgcgaattggtaatraaagtattacaagtttctcacctaagaatatttttttttcaaaagaatgttttcaatgccaggaaatagaattcatgaaaactaaatggaaggaaggaaa

SEQ ID NO: 1683 - DNA, 201 bp, Homo sapiens
tagacaacaagcccaaaatatgtgctggatggttggttgaatgaatgaaaaacttcttctcaaaaaatatctgctggcagaggttatgtgtaattgacatrtaaataatcatgtaattaacatgattcacagttgtagctgcctgttcattataggctgggtccagcagatcttctcctagagcccagcttactcaccctc

SEQ ID NO: 1684 - DNA, 201 bp, Homo sapiens
gcacacttctgctgcttaagcctcccaatctgtggcatttttgttacgacagcccaagcaaattaatactctctatatttagacaacaagcccaaaatatrtgctggatggttggttgaatgaatgaaaaacttcttctcaaaaaatatctgctggcagaggttatgtgtaattgacatgtaaataatcatgtaattaaca

SEQ ID NO: 1685 - DNA, 201 bp, Homo sapiens
gctggacaatgctgtcaaggctgaataccatgaaccgattagagacagggcaactgtggccatttctttatttccagggtggggccctctttgaggacccrcataaaaggccctgcaatgttactttgtctcatgtctgcatggccatgttcagaaagagcccacagataaagcctcgttgtagatccgttttcttaaagc

SEQ ID NO: 1686 - DNA, 201 bp, Homo sapiens
gcaaccgtctcagtcacactgagggccagcctcagatccttcctcatgtcacaactgggaaagaagtcatagagcttaagcgtctccaggaaaatcataaygttgtagggtgtccagaagaggaaaaacacgatgaccaccagaaggatcagtttaatggctttggctttcttgtggttcttgcaggaaaacagcgtctgg

SEQ ID NO: 1687 - DNA, 201 bp, Homo sapiens
ctgcaaaccaaaaagttctgatgacatttgcagtaagagaaatgtctactctttgtcattcaaagagttcaatttgttcattcttcaaattttgagcacarttctcaacaacactctagggttgttttgtgtgcattgggtccatcattttgtgcctgtaagaaataacaacaaaaatctttcctcactagtcagcatcag

SEQ ID NO: 1688 - DNA, 201 bp, Homo sapiens
cgtaaacaccctgaggagaaccagcaccccctccattggttgttttagctcagcccacagctaacagctcagctcagaaagttcctaccacccactccgcytctaacgccttttaatattcgcacagagttttctcacattgtggctctcacacacttcctttatacatgctgtttcctcagcctggaatgccacctcttt

SEQ ID NO: 1689 - DNA, 201 bp, Homo sapiens
cccacagctaacagctcagctcagaaagttcctaccacccactccgcttctaacgccttttaatattcgcacagagttttctcacattgtggctctcacayacttcctttatacatgctgtttcctcagcctggaatgccacctctttctttacctggagaacccctgtcccttaaagacgcaggtcagaagtcacgtagt

SEQ ID NO: 1690 - DNA, 201 bp, Homo sapiens
atttccaaagaccaacactctcagagcgtggatgtctaaccttcaagttcaggctcatcagcttcagagacagggtctgaggaggggccaggacagaaccytgtaggcaagaacgtggcaaaatggcctcagggccctgttggtctcactgaagatggtacagttggggagtctggactccacagatggcacctgtaatac

SEQ ID NO: 1691 - DNA, 201 bp, Homo sapiens
ggatgcatcgttcaggtggcaggtttggctttagataagcgcagggacgattcttccatgatacgaggagggactgcagagtgcactggcacagctgcagraagatgggaagatgtggttggggtaggccatggaagttcttttctggttctatttcctcagtgaaataatgcgctttcaaagggaaactcatatagtagt

SEQ ID NO: 1692 - DNA, 201 bp, Homo sapiens
agttttgactcgatgcagtaggcagtggggagcccttgcaggtttggggacatgatggaagagggcttaatgaagacgaggctggtgtaatcaggggagargctggatcaggcacatggtaagggtgatgtgtggcatttgttttgtgtaatcagaatagtacccacccatccaacttcttggaaatatgtatttctgctt

SEQ ID NO: 1693 - DNA, 201 bp, Homo sapiens
tcctactgggagggtggggcgctgagtggactgcaaggtggacaggagcatctgggcaggggtgtggatatctgaagatgccccctctgaggcctgagaarttggggggctggtaggaagtaaatgcttctggtgggccacaatccccgagtaagcatgtccacattctggaaaggaaagaaatgaggaatcaggactatc

SEQ ID NO: 1694 - DNA, 201 bp, Homo sapiens
gatggccaggaggcacaggactggcactgtggctgatgtcctggctgtgggaccagcatttttttccggctgcttctggttctccccagcctcaggcccarctgccagactgtggcccgcagtgtgaatggtggtttcattgggacgagtgagctctttgtccgaggacagtgatcctactgggagggtggggcgctgagt

SEQ ID NO: 1695 - DNA, 201 bp, Homo sapiens
agagcctatgacctacttccacgtgaagttagagaattcctttatggccagctctcacagaaaaacagagcagagtgagctacttacttctgctgttttcktaattaccaaggtgccatgttttggagtgtcatgttctgagctccaacagagggaagagtgagtcagggaggttatcacgctgaaggccagaagaggaag

SEQ ID NO: 1696 - DNA, 201 bp, Homo sapiens
ttggacaaaaagggtatgatctaatggcaataaatggggggtgggggaccagcaaggcctgtccagattcttcttggcctccaagtatagggcaggacccmtctgaaatgagagcctatgacctacttccacgtgaagttagagaattcctttatggccagctctcacagaaaaacagagcagagtgagctacttacttct

SEQ ID NO: 1697 - DNA, 201 bp, Homo sapiens
tagagggggtgcgggacggggactcacaggagatgcaggacggcccgaacatagtaattcctggtaaagggcccgaacagcttcaccacggcggtcatgtrcttctgtcccctgggggagggaggaaggcgagacggcgcggctgggcctctcccactcgggactcctttgctgccctgctgaccaccccagggcacccag

SEQ ID NO: 1698 - DNA, 201 bp, Homo sapiens
cggccttggtttacccacaagcaccaaagggttggttccggagcctccaagtgagaaaccaagctccacccaaccctgtgagccctgcctgggccccgcarcccccggagagaccccagagcaggaggagactcaccagcgctccatggtggagcccttcttcctcttcccccgggggtactccagcaggcacacaaacac

SEQ ID NO: 1699 - DNA, 201 bp, Homo sapiens
ccaggtctgggggccaaggccacaaagtctcaggacaaggcagactgcagacccaggggacgtgcgcggaccggggcttgtttcggtcctgggtgttctcrgccttgatgtggacactagcggctctggtgcacttgctcggaggaagcagccacgtgtgggtgtcctggcctcagccggcagtaaccagcagacacacag

SEQ ID NO: 1700 - DNA, 201 bp, Homo sapiens
gatgttggatactcctgatcaaaaccctgccccctcctctaggagccttggaatggacaaaaacagagagaggggccccgcacctcagggtccggccacayagctgggttgtgatgggttccgaaaacactgatgaggcagataatgcctgtgggagagaagggagcagtcaggagaaggcctccttcactgaggggcccc

SEQ ID NO: 1701 - DNA, 201 bp, Homo sapiens
ggtttgcccctgcccagacctggggccctctcaggacacacccgtctgtctgacaccttgccccacacaggcattttactacccagaggaagccggccttkccttcgggggtccagggtcctccagatatctccgcctggaagttcactaccacaacccactggtgatagaaggtaggcggctctgctgccatcctcctca

SEQ ID NO: 1702 - DNA, 201 bp, Homo sapiens
ttgcaccagcatctttcaccatatatagacacacacgcacacaatgcacacacacacgcacacacacatgcacacatgtacacatatgcacgcagaagcayacacatgcacacactttttctctctctctgaatggtgcttcttcttttcatttgtgcaaggtgcagaagtggcctaagagataggtgctaggctgtgcct

SEQ ID NO: 1703 - DNA, 201 bp, Homo sapiens
gaagcccgcctcctccggcatgtcgggagggcaccgcggcgggaggcgcaagcgccgagagctcctgccccctctcaggtgcagacaacaggagcacaccrccccttcctcgccgccacgtgctggcggctcccggcgaccaccgatgacctcacggccgccccagtctttagaaaaagggactgcatctcccagcatgcc

SEQ ID NO: 1704 - DNA, 201 bp, Homo sapiens
acatcatcagaaatagctgttccttcaacaacactttttcttgccagcatattagatttaaaggtcgaatgatcttgcattgctgcctcttctgcattagractatcagcttcagtgtctccaaatttgacagcatgcttccactgtgcatatacatgcatttcacaatccattcctaccaccaatatcccatctcttacc

SEQ ID NO: 1705 - DNA, 201 bp, Homo sapiens
cagggaccacatcctaccccccccaaattaggagcactcacccacctgtgggagtatctggcccaggctgtgcacttctctgacgggcagttcgtgctgcyggctttcagccgcctgtctccgcacacttgatgctgtttctattttttgatttgagtttaattataaagcatgctgtctactcccctcttccagcctccc

SEQ ID NO: 1706 - DNA, 201 bp, Homo sapiens; identical to SEQ ID NO: 1643

SEQ ID NO: 1707 - DNA, 201 bp, Homo sapiens
tttaaaataacatttgttttctcttatcttgctttattaggtcggagaccatgagaaacagcgtcaaatcatcttttcatgatcccaagctgaaaggcaakccctccagagagcgttatgtgacccacaaccgagcacattggtgacagaccttcggggcctgtctgaagccatagcctccacggagagccctgtggccga

SEQ ID NO: 1708 - DNA, 201 bp, Homo sapiens
actttaccctctgaaatgatgctcccaagtgctatgtgatgagctccttgtgtgcccagtggaataggtgtgtccatgtgtcattttaaagactattaatyacactaatatagtttctttctctctttggataataggcacgttgttccgtatggacttggaagccctaggtccaagagagccttggagaatttacttccc

SEQ ID NO: 1709 - DNA, 201 bp, Homo sapiens
gtggagactgagaggcagaagtgatgatatagagggttagaatcacttaattttacttacagaaaaacctaggctcaaagtgttgaagccatttgtgcagragtgagtttgtagcagagctagaactggagcccggatttcctttgctgctatattttccctttagaaatgcccatttcagaactgaaatagaaatactgt

SEQ ID NO: 1710 - DNA, 201 bp, Homo sapiens
gcaaaaaaaaaaaatctttttaaaaataattgccataaagtatttgctctgggcctactgtatgcttcttttctttttctctcttttcaactaagtcaccrtcaatttattaagatggccataactattcaaaacctatgctgagttcctcaaggcagggtcacatagtgatgaaggttgggatggggctacggaagaaac

SEQ ID NO: 1711 - DNA, 201 bp, Homo sapiens
ttcttgtttaattctttctttgagataattttacctttgatgtttcaaaagcagtgtcacatacatgaagaagttcagcaagaattagccccaaagcgtasaggtccacttcctttccatagtcttgcgaagaaatctaaagagaccaaaatagatttacctttgttatgctccttacataaatatccagccttctaaagc

SEQ ID NO: 1712 - DNA, 201 bp, Homo sapiens
gattcagcttttaaaagcagtgcatcttcaaggccatgaaggacctgtttatgcggtgcatgctgtttaccagaggaggacatcagatcctgcattatgtmcactgatcgtttctgcagctgcagattctgctgttcgactctggtctaaaaagggtccagaaggtaggtttggagacatgataatccagacaaatgaaat

SEQ ID NO: 1713 - DNA, 201 bp, Homo sapiens
tgctcaggccagggggtccaggggatgacttgagctccacctctgtctccgtctgggtgcctcggctcaccaaggaaggggtgcacgtgggtggcagtccygggggggctgcaagactgctggagagatgttgaattaacctgaagccccagaggccccaaggaggaggaaaaatggggtgtgatgacatgcatacctgtc

SEQ ID NO: 1714 - DNA, 201 bp, Homo sapiens
gctgactcgtgcccctagcggtgcttttaaacctgttgtccatatgggctgatctggctctaagatggtaagatttacagaattgcaagtgcttgttttayaatctggttctaatggtattttggtaagcataattggccctagtgattgttggttagtggaccacgttgtgcagtcccagcaagttgttactggggaatc

SEQ ID NO: 1715 - DNA, 201 bp, Homo sapiens
gctgtcagaagatgacctgttgagtcagtattctctttcatttacgaagaagaccaagaaaaatagctctgaaggcaataaatcattgagcttttctgaartgtttgtgcctgacctggtaaatggacctactaacaaaaagagtgtaagcactccacctaggacgagaaataaatttgcaacatttttacaaaggaaaaa

SEQ ID NO: 1716 - DNA, 201 bp, Homo sapiens
aaggtttaccggaacatcttcttcattggtcttgttactccaggaccatccaggtgtacccagacatttcgcagggtttcttttaaaggattggtaaactsaactgtcacagtcatgtcagaaccaactacctgagtgccacggacctaagagagagaatgcaggtcattagcaccaaataaaacctcgttctgctctctt

SEQ ID NO: 1717 - DNA, 201 bp, Homo sapiens
cctgcagggaagaggggccagggcccggctgtgcctggacccagagtggtggggaaggggggtatgctcataccttgcaggttgacgccccggggcaccamgccctgaagctccactgtgggcaggtcatcttccgctgcattagagttattgggtggaactgctcttctgcctccaaaggcggtcctggaagtttctgac

SEQ ID NO: 1718 - DNA, 201 bp, Homo sapiens
aggattaaatgatgaaagtgctggtcaaaccaaccctagttttactccacgccctacagaaatggtcggcaaggaggaggcagcttccaagacattttcaytggggagcagatctatgtttggaaaagacacacacagagaaagcttcccacagccctgcactgcctgcccggtctccccaacccaaggtttaccggaaca

SEQ ID NO: 1719 - DNA, 201 bp, Homo sapiens
acagaaatggtcggcaaggaggaggcagcttccaagacattttcactggggagcagatctatgtttggaaaagacacacacagagaaagcttcccacagcyctgcactgcctgcccggtctccccaacccaaggtttaccggaacatcttcttcattggtcttgttactccaggaccatccaggtgtacccagacatttcg

SEQ ID NO: 1720 - DNA, 201 bp, Homo sapiens
ggtttcttttaaaggattggtaaactcaactgtcacagtcatgtcagaaccaactacctgagtgccacggacctaagagagagaatgcaggtcattagcascaaataaaacctcgttctgctctcttgttgtcttaaccatcatcacttttactagagttttatgatacagttatttttttggcaatggaaccagtgtgat

SEQ ID NO: 1721 - DNA, 201 bp, Homo sapiens
tataataaaagtaatgtatataaaagcaaatttggaagtagcaggccaatacatgggtgcttcagcctcgataggcttggtttggatagggagatgcttartggttgtgtttacttgtcacctgaaagtccctggaaaatagagatgttcaaatttgaggtgtgggtaacattagccatatgggcctaccacctgaaactg

SEQ ID NO: 1722 - DNA, 201 bp, Homo sapiens
tgtcagggacctcaggagaccacctagacttgggccttccgtgggtcttgggcagtgcgtgctctgatgaaagggtttacacaaaaacatggggtctcagytgtggcataaattgtccttgtagaaagagtctgggcaggagaatggctggtcattgtgacctccggtgagggctgaggacaaattgctagaaggcaagat

SEQ ID NO: 1723 - DNA, 201 bp, Homo sapiens
tagaacgggagcttatgaccagactggccattcctgagtacttcagttcccaggtaggctgggttcgtggggctgctagtgaatctggtatctcttcaagrttctccacaggaaggcctcatttcctaggtttttgtgaaaaagaaatgtcatctttcatcactgtgctctctctctcatcttcaagttattcctaatggc

SEQ ID NO: 1724 - DNA, 201 bp, Homo sapiens
aaggcaaacttgagtctgaatgagttggggtggtgagaacagaaggacgaacttgccttaaggtgtgaaggaatgtctctagaagcagttcatttcttttmgatactgggttggagagaattttgcctcaaagacagacataagcatgacctgaggggcaagattctgggtcttcagcgctacctgctcatggtgatttta

SEQ ID NO: 1725 - DNA, 201 bp, Homo sapiens
cagcgctacctgctcatggtgattttacttggctgccctagaaggaacttgtctgtctacacttctatagtttctgacatagacagctctctgtctctacrtgctatctctcccactttatccacttgagcctcgtatgtctcatttcccttccttgaatccaactgtggccacacccccattctgacaccttcttcactg

SEQ ID NO: 1726 - DNA, 201 bp, Homo sapiens
tcctcctggaattacagtcctatatgaatcccccagctgcctttgctgaggccctgacactcgaattagcttttgccaactcccttgggatagaccttgtkcccaggctcagcatctggaatatagccctgcctgctgccatttgactttgagaatcttcatgttctgtaattcaaattcctatttcaaccaccaaattgg

SEQ ID NO: 1727 - DNA, 201 bp, Homo sapiens
tttagaaccatatgcttttccaacataaacgcaatgtgccgcaaaatgccaggtggctataagacttgtttgtttgtttaggagctatgtataccaaatgratggatctgtataagctctaagtaacttgggaataagataagaataatagttcttcccttgcaagaaaggtttggaatgaaaaatgctcataaaacggca

SEQ ID NO: 1728 - DNA, 201 bp, Homo sapiens
tgtcttattcaccttatatttcagcccacttttaactccaatacttagtacttcaataccaatgtccagtaaatatttattaaattaagtcaatggctcaraaatggaatttactggatgtctggatcttccagatgacaacacagccattactattccatgttcctttagccactatataatatgggagaaaatatatgg

SEQ ID NO: 1729 - DNA, 201 bp, Homo sapiens
tccagtaaatatttattaaattaagtcaatggctcaaaaatggaatttactggatgtctggatcttccagatgacaacacagccattactattccatgttyctttagccactatataatatgggagaaaatatatggaaatgaggcgtttttaagaatggacgtaaagaggaaggacattgcccagagaagaggacccttg

SEQ ID NO: 1730 - DNA, 201 bp, Homo sapiens
atttactggatgtctggatcttccagatgacaacacagccattactattccatgttcctttagccactatataatatgggagaaaatatatggaaatgagscgtttttaagaatggacgtaaagaggaaggacattgcccagagaagaggacccttgcttacttatgctacagtcaagaataaaatcttcctgatctgatc

SEQ ID NO: 1731 - DNA, 201 bp, Homo sapiens
ggtggatcctgtaattcatttatttgaggcacccctgttgattacaaagaaccagccccagctgacaaccataattcacatatattctcacataagcctcrcaacacaagggctatatttgtatcagctcgatcagactataataatagttattcccttaagaagaaggaggttttctagggcaggatcactggtgccagg

SEQ ID NO: 1732 - DNA, 201 bp, Homo sapiens
aaaatacaaaataaagatagcatttacaaaagctctctaaactgaagaagatggagctgccacagagacattattggcaaaagtgtttgctatgatcactwtattctttctggaaaaaatattttggagccatctgtcttctccatggtatgctatataaggatgggcataagccccttcaaaagtatatctgatagtagc

SEQ ID NO: 1733 - DNA, 201 bp, Homo sapiens
atgtaactggaggtgtctccctctccttgcttcttttgaggaaaatgctgccaacacatagtgttttcacgttatgtgttgatttcagtgatgcaccatgytatggtacctacaaaatgctgagaacaatgactatttggggagaaaatatctgtttgcatcacattattttaggaatctgcaaagctcccttttccttat

SEQ ID NO: 1734 - DNA, 201 bp, Homo sapiens
gtatgctttttcaagttacatatcacttactgatattgacattcctgtcctttatactaattcatgataatgagctgctactctgattctttggtaaacargaaagttactaacacacacatactctctttctcttatataaactttttggaaagaaattacttttttagaaatcacaagatatcttccactaagcatatg

SEQ ID NO: 1735 - DNA, 201 bp, Homo sapiens
tgaccctgaactaaattagaaaacatctataactcacctctctctttttgactttatagagaaggaattagatttctatgccagagtaaaatgtgacaagktagccttggggccttgatatatattacttgatgataataggagtcactatctaggattttctcttttaaaaatgagagatgccacttttaaaaagagaat

SEQ ID NO: 1736 - DNA, 201 bp, Homo sapiens
gctagttgctacctggaaatgagaaagattctgaggtcttatctgagctacaattgttcagtgatgtctgccatgaatataggatctcctatacgtgattrtcataagaccataacatgtgttcgttatgctaggtctccatgctggctatccactgattcaccataatggttcataagattatttatgagaaaatatcta

SEQ ID NO: 1737 - DNA, 201 bp, Homo sapiens
taattagaatcgcactcttttcctcattataaaaccagcctaattagagctcaggtcaatagcggtggccactgactgctctttgacagcaggagggggawgttcatttggtgtggcaacacgtttccacggtgagggcggccaagtgaactttgcttctggataggcatcaagtttcctgctgggacaaaggggattcct

SEQ ID NO: 1738 - DNA, 201 bp, Homo sapiens
aacatttgcaaaccatcagatggaaaagagatgggccttactttctgtcagtccagatggcagaattaggatcattggcaggatcaaatggtagaaaaacmtgtttccttactgttagagctacctgaccatggaatgggttatcttgttgggtcacactctttgttagtagaagtcacagaaactgagacctgtcaagca

SEQ ID NO: 1739 - DNA, 201 bp, Homo sapiens
tggaaaagagatgggccttactttctgtcagtccagatggcagaattaggatcattggcaggatcaaatggtagaaaaacctgtttccttactgttagagytacctgaccatggaatgggttatcttgttgggtcacactctttgttagtagaagtcacagaaactgagacctgtcaagcacaatttgaagtggcctgtgt

SEQ ID NO: 1740 - DNA, 201 bp, Homo sapiens
gaataagataagaataatagttcttcccttgcaagaaaggtttggaatgaaaaatgctcataaaacggcaaacatattgcaaggcacatggcaaaggcccratgcattacagttgatgctttttagggtagcaatgctctgggtagtttgtcttattcaccttatatttcagcccacttttaactccaatacttagtactt

SEQ ID NO: 1741 - DNA, 201 bp, Homo sapiens
aactccaatacttagtacttcaataccaatgtccagtaaatatttattaaattaagtcaatggctcaaaaatggaatttactggatgtctggatcttccakatgacaacacagccattactattccatgttcctttagccactatataatatgggagaaaatatatggaaatgaggcgtttttaagaatggacgtaaagag

SEQ ID NO: 1742 - DNA, 201 bp, Homo sapiens
tccaaggcttggagctgagaactggcagcattgcttttatcacattctttcaaagcagtcacggcccacctaaaatcaagggcaggagagggaatgtggtycccatttctcaatggaaagagtgacaatcattttatggtcatttaaaatctgccacctttataacaaatcctaaatctggtggtaacatatttttcatat

SEQ ID NO: 1743 - DNA, 201 bp, Homo sapiens
attcagttcctcagttgcacgagccatctttcaaggactcaaaagcctcatatggctcgtggctactgcattggatggagcagatttaaaatgttcccatyaccctagaaagttctatcaactcacttaatcctcccaacactaagaggtaaatattaggagtcttcattttatagatgaggaaactgaggcacagaggag

SEQ ID NO: 1744 - DNA, 201 bp, Homo sapiens
tcatgaggcagtttccaaagtcctctacctccctttctatgccttagaaggtcactccacaggaaatgtgctagattgattgatgctgacaaggacttatytgtggtagaaatgaaagtaataaacctcaaagattgggatccattctgggtgtcacactttaagaggagtagtgacaaattggaatgtgtgggagagaga

SEQ ID NO: 1745 - DNA, 201 bp, Homo sapiens
gcacatgtgccttcttagttttagacacattcgcaagaaatatgccaaggatggagtccttactgttgaacatgaagaggaacctggatactaaaataagkaaaggagatttttcttctacagccacagtaccagagtccaggaaaataaaaggttatttgttggtgagttgatctattatgactctcagaagtatcaggt

SEQ ID NO: 1746 - DNA, 201 bp, Homo sapiens
aatgtaaaaaattcagttcctcagttgcacgagccatctttcaaggactcaaaagcctcatatggctcgtggctactgcattggatggagcagatttaaamtgttcccattaccctagaaagttctatcaactcacttaatcctcccaacactaagaggtaaatattaggagtcttcattttatagatgaggaaactgagg

SEQ ID NO: 1747 - DNA, 201 bp, Homo sapiens
ctgttagagctacctgaccatggaatgggttatcttgttgggtcacactctttgttagtagaagtcacagaaactgagacctgtcaagcacaatttgaagkggcctgtgtgtggaagaggctgagtttcattcatatcattacagaacctggggttgtctttggtcccctgaatggggaaccatctagagctctttaggct

SEQ ID NO: 1748 - DNA, 201 bp, Homo sapiens
cttcaggcaatttagagaaggttagttcaagaagaaacttttatgtgtatttgctttagagaagagtattcattacttgggccagagaaaagaataaagcrtatgtcttacttggtgacgtcaaatgcttttgcatatacttgatggccttaagtttttctcaatattctattgaaaatatctctctctgttttaaaaaaa

SEQ ID NO: 1749 - DNA, 201 bp, Homo sapiens
aacagctagtttaccaagtatcttttaaaaatgttcattgtctttagagctagaaaatgctgtgtataattcctggcaattgaggtgaacacagtttccckgtcccttttcccgatgcaactgaggcgctttgtttctcatttatttgtttgtttcgacaaagtaatttcttacagacacactaaaaggctttttgtttgt

SEQ ID NO: 1750 - DNA, 201 bp, Homo sapiens
aagtggggacttgaaatattcccatcacatgaaaatgatgaatgctcatggtgatggataccctaaacttcttgacttgatcattatacattctatgcatrtaaccccataaatatatatgtatattatatatcaatcaaaaattaaaaaccaactatttaatcctatctcatcatttggtggaacaggaatttgggcaag

SEQ ID NO: 1751 - DNA, 201 bp, Homo sapiens
gtggaacaggaatttgggcaaggctgggcagggtgattcttaagtgacattgactgaggtcacttggtggtgttcaggtggtggatgggctgatctggagmgcccaggatggcctcattatcaggtctggtgccttggcggaggtcgctggaaggctgagctcagagcagggttgaagtgtgtatacccgtggcttctcca

SEQ ID NO: 1752 - DNA, 201 bp, Homo sapiens
aaaaaaacctgaatccaacagttgtagacactgattgggatggtaaaatctgtgaggtgaggctggagacaaagcacccatgaaaagggggtatctctcascataatatctgacacgtggtaggagctcaataaagatgagaagagaccatacgtgagtaggtagtacagcaaagtggttcaaacttgggttctggaattc

SEQ ID NO: 1753 - DNA, 201 bp, Homo sapiens
ctcaactaaaaaaaaacctgaatccaacagttgtagacactgattgggatggtaaaatctgtgaggtgaggctggagacaaagcacccatgaaaagggggyatctctcagcataatatctgacacgtggtaggagctcaataaagatgagaagagaccatacgtgagtaggtagtacagcaaagtggttcaaacttgggtt

SEQ ID NO: 1754 - DNA, 201 bp, Homo sapiens
cgctacggccacgcgctgaggctgaccgcagtggtgctggcctccgccgtggccttcttcgtgcccagcaacctgctgctgctgctgcattactcggaccygagccccagcgcctggggcaacctctatggtgcctacgtgcccagcctggcgctgagcaccctcaacagctgcgtggatcccttcatctactactacgtg

SEQ ID NO: 1755 - DNA, 201 bp, Homo sapiens
gaggatgtgagtctccaagaacttcgggacttcttttcatagtaccagctcttcttttcatcaaaggtcataaatagtaagacaaattctctcatgtccayaggcatgttgctgtccttatgtagtattcctttttggcagattaggaggggacctatcaagcctgagtgaatatctttttcctggaaaaacagagtaaat

SEQ ID NO: 1756 - DNA, 201 bp, Homo sapiens
tctgtgaatcagatatgataccagtgcttagtcccattggcatcctacagtctatgaaaaacagaaaaaaaatgaataatttttgcttagaaaatatatayaataaagtaaaactccatggttagggattatgtttctgactcaataattagatatttttacctaccttgtgtggccctgacttaaatatatctgattata

SEQ ID NO: 1757 - DNA, 201 bp, Homo sapiens
tcactgaaaatgtagtgaatgcttacacaggtatagtagattatattttaaaatctagaatagcttactttagaatcagggttctttctgggtttttgaaygtgagcggttagcaaaaatggcggaagtaaactttgttataaaagcaagttataatcgtgggtctggacacaagattttgaaagaaattaccagaactag

SEQ ID NO: 1758 - DNA, 201 bp, Homo sapiens
ctttcttctggtctacctcccctactaatcccatctttccagactctgagcataacatgcaaactcacagaacacaagggagtgggtaaagcaactccgamtgccataaaagtgggttgtgagccttgaatggaatacaagattttgaaggtggttccatccctattcactctggacaggccctgcatctcactccctcgg

SEQ ID NO: 1759 - DNA, 201 bp, Homo sapiens
ctttctagtggcctaatttaaggataggccctggaattctatagaaagccaggaaattggagtgtaggtatcttaagggagggagatatgaggatagaaaktagggaatttggatttagttggctgaagggatcatcaagttattcatgccattctgatatctcaggtcatttaaagaattaataaaaatgagtcaaatat

SEQ ID NO: 1760 - DNA, 201 bp, Homo sapiens
tgaaatggaggagttgtttctctttttaattgacagataaaattgtatgcatatactgtgtatgacatattgttttgaagtatatatacattgcagaatgwcagataaaggagtcttgactttgcagttcttttcataaagaaagagcagaacatagctaatacttgttcaagaaaatttcaaataaatgccatcttctgt

SEQ ID NO: 1761 - DNA, 201 bp, Homo sapiens
ggttaattagcttgatttagccaattcacaatttataaatatattaaaacatcatgtttacaccataaatgtgtataaaacaacaacaacaaaaaaactgkggtacacccatataatggaatacatgcaataaccagatgaatctccagagaattatactgagtgaaaaaataccagtccccaaaggttacatgttgcctg

SEQ ID NO: 1762 - DNA, 201 bp, Homo sapiens
gtggcaggtaatttctaataaactttcgtcaggaatattcaagtatgggctgtggaccactgcttgtctgtgacctattgattactgggtcaaaataacayaaggagagaaaaatgagaatgaaatatttagtaaacttttgtttttctaaagcaatttgacattgctgtgactctaagcacatgaccagtgcgttcatct

SEQ ID NO: 1763 - DNA, 201 bp, Homo sapiens
atgacaatgatatttatcctcctatgagggcaacctggtgtagtgagaaataaaacaaaccaaaacagacaaccaggagtttgtctgagaccaggcacctkaagaactaagatttagaagacttaaagaggtggtacatgtcactgcatatttgtcaaatgcaaaatactgttattctcattatagcacagtcttcagatt

SEQ ID NO: 1764 - DNA, 201 bp, Homo sapiens
tggtaaaggacttaaatgccatatgagaagtcttcacaccccagcagtcagacccatgaagctcctcccagcccttctataacttctagtgattaaagacyccctaattgtctgttccttattttattctacaaagccagcatcaccctaataacaaaacctggcaaagacacaatgaataatgaaaactaccggccaata

SEQ ID NO: 1765 - DNA, 201 bp, Homo sapiens
tcccctcaagcactgggagccacacgctcagagcaccaccaacttacattggtgattatgtcgccgttgagttcggtcacagacttgatgtttttgaaagytgtcaccagtttattgtcaccttccaactgaaccactgtctgcagggaacagagaggtgacctgtgaggaaggggtggtggggggcaagagccttgctaa

SEQ ID NO: 1766 - DNA, 201 bp, Homo sapiens
gggggtgaatggtgcagtgtttctcctgcaggtatgtccccctgactcttctttgcccccagaatatgctttagggagtcacagacaacagaacactgccycagggcgctgtcatcactctattcaaatggaaaaattcttaaactagagagagtgtgagcatcaaccacccaatgtgcagtttccacctccgccccagca

SEQ ID NO: 1767 - DNA, 201 bp, Homo sapiens
catctccgtcttctcggatgtcatagtgccactgatcatctccagctcctggccaccctgggctttctccactttggcctctatgttttgcttctccaccrtcttagccacgatatctacctctctgtcatgtgatgtgacccttgtttttgaaccaggagtggccctgaggctccttaaaaaagagctgatcttactggc

SEQ ID NO: 1768 - DNA, 201 bp, Homo sapiens
caaagagcaaggtggcagatccttaccgtgaggatgacgtcacccacaagggcattctctaagacccttgtgctatatggatcttgggggaattggggccrgtgttcattgacatcagtgatgttgaccatgactgtggtcacgtcactgagggaagaggagctcttccggctgcactcaatggacaggaagtacttgggg

SEQ ID NO: 1769 - DNA, 201 bp, Homo sapiens
gggaacgcttacgagccttatctttccctgtaggctcatgtagcctcactggagggcattgccccggaagatcaagtcgtgctcctggcaggcgcgccccwggaggatgaggccactctgggccagtgcggggtggaggccctgactaccctggaagtagcaggccgcatgcttggaggtgagtgagagaggaatgttctt

SEQ ID NO: 1770 - DNA, 201 bp, Homo sapiens
caggtgcggcccatcgtgggcccatttcatgccgtcctgaagctggagatgaactatgtggtcgggggcgtggtctcccaccgaaatgttgtcaacgtccrcatcttcgtctctgagtactggttctgagggctggtctgccgcacagccgcaggtgcacctccaggccaaatcattgctgccagtgactgtggtctgtac

SEQ ID NO: 1771 - DNA, 201 bp, Homo sapiens
tgagactgatcctgagttcgtcattgaccacatggacgcaaacaaggcagggcgctatcagtgccaatataggatagggcactacagattccggtacagtracaccctggagctggtagtgacaggtaaggaaacatccagggtccacagccctggtgtgatttttttcttatttttaatagagtatttttcaagaagttt

SEQ ID NO: 1772 - DNA, 201 bp, Homo sapiens
ggccataacctgtctgatgtattaaattctcaggaatcgggattaaaagttaaccagccagcatcctttgctataaggttgaatggcgcaaaaggcaagaytgatgcaaaggtgcacagcccctctggagccgtggaggagtgccacgtgtctgagctggagccaggtgagcaggaggcctgctggggggtcccagcacca

SEQ ID NO: 1773 - DNA, 201 bp, Homo sapiens
gctttgactgacagccaccggggactggggctgaaccatttgctgagcctgcctcttgctcttcgaggctcccgtggagggcaccgctgtccccaggcacwggacggccagcagcagcagcccgggccccggacccctaagcatgttgagacggtgggggagagacgcccgcaccgggaggcaagttgccaccaagtttgc

SEQ ID NO: 1774 - DNA, 201 bp, Homo sapiens
ccattgtcataacaaccggctgcaaataattgaaggaaaacgttacatttgcatttctccttttcccaaaattatggaattttcttcatgtgaatattgasgtacatatttttttccttttaactttgctaaaagttatatacaatgatgtcatttccatctggccaggggtctacataaaaaagttggaaacattttgga

SEQ ID NO: 1775 - DNA, 201 bp, Homo sapiens
cttgataaatgatcaccaggtctaaacatgtatgtgtgcaaaaggatcagttcagtttggtcatcctaagaattctcacttgggaagaagctttgtgtgcrtcaaagacatctaagtgctgtcaggtgaaggggtagaatttttgagccctggaggcagaaaacgtagtccaaacgtgtcatagaaaatagttacaggaag

SEQ ID NO: 1776 - DNA, 201 bp, Homo sapiens
cagtgagctgagattgaaccttatcaaagtgatatgtttttctatttatgtagtcttctctgaagatgcggaataagttggttatgaaagttttcttgacwtccagaagttaccaaagcatgctgatatactggatgtgttctgagtaacatagtattacccttctctctaggaatccagaaaacaatacctggcttaatc

SEQ ID NO: 1777 - DNA, 201 bp, Homo sapiens
tctttaaaggcaagttttggttaattcctagaaggacaatctgaacgtgcagaatttattagaacacgggaaagtcgcagagtcctcgtcctccaatgcayggtcttatcatcccaggccctcagaaccagcgtgctcaaaactcggtccttttgtgtgcacagctggtttctctcagtaaagcgcgcacacactcgcaca

SEQ ID NO: 1778 - DNA, 201 bp, Homo sapiens
cccaggagttcaagtccagcctgggcaatatagtgagacactcttaataataatgataataataaccagatatggtgacaggcacctctcgtcccagctaytcaggagtctgacatgagtcctgggggatgactggagcccagaagatcgagagatcaaagctgcagggagctgtgatcacaccactgcactccagaccca

SEQ ID NO: 1779 - DNA, 201 bp, Homo sapiens
ctctctagctgttattagtttacaatatcaaaaaaggagccttcaaacccaaaggcaacaattaagaccccaagacaatcttagaaggagcagtaaagacrccagaggccagcttctttacagcactaatcaaatgcgttaggtcagagacactatccctaactccagagtagataaatcattttaatttatgggataaat

SEQ ID NO: 1780 - DNA, 201 bp, Homo sapiens
tgacaagcacacactatttcatgtttcggtccaggacattccatatagaaatgtgtccaaagtgtcatttttttttcttttaaataaattatatcttgacsaaggaggaatctgagatcagctattaggtaaaagaaatgactccattctaaatctttcaattctaccttatgcttttgaagcaaagttaagacttctatg

SEQ ID NO: 1781 - DNA, 201 bp, Homo sapiens
gcagtatctttttatcttgatttgagaactctagtgagtctgtccttcaacttttttggtttctccttgttaataatactgatgtttgataggaacatccrgcatctcttaggttacaaagtgttctcttgaaaatatgacctcagtgaactgctacagtaatctgtgtcagattagaaggtccattcccattttagctgg

SEQ ID NO: 1782 - DNA, 201 bp, Homo sapiens
tcaagcacattggtgaattccaattagcccaacctcttacttgttttatgacattctctacttggttatagtcttgagatacatcaactgatatgcaaagyaccacctgttaaaaaagaaaaaaagtgatcaaagttttgcaggtaccaaactatttcttaaagatattttttaaagaaaagacagttcattgaatacaga

SEQ ID NO: 1783 - DNA, 201 bp, Homo sapiens
tagaaaaatgtagcagagcaggcattaagaaacagagaagaaaaaccactcagcagcaaatccatgctgataaataaaatttacaaaactattaaacctayagagaagttgtgtccattccaagccacatagcaaaatggcaagaacaaatcaaaagtcaagcacattggtgaattccaattagcccaacctcttacttgt

SEQ ID NO: 1784 - DNA, 201 bp, Homo sapiens
gtggccttctttggaagatccaatcttccataccaggcaaagggatggaagactaaggaacaacatgagggatagccagagagggaaaaagcatcacttgytctaggaactacaaatagcttgaagaagcaaagatgtctagatgcctcccaatatgcagagtggggtgtacagaagagagtggtaagggcgctgggagag

SEQ ID NO: 1785 - DNA, 201 bp, Homo sapiens
cttagaatttttcaccagagtttcagaaagatttgtcaggaccactccatgcccaaggtaaaaagtgtaagtggtacaaaaaggtagaaactcatcagacycccaaagagtgtcatttaaccatacaaagccctgataaactccagggcagaagaaaaagctgcatccttgactccactggggcattcttatgtaaactaa

SEQ ID NO: 1786 - DNA, 201 bp, Homo sapiens; identical to SEQ ID NO: 756

SEQ ID NO: 1787 - DNA, 201 bp, Homo sapiens; identical to SEQ ID NO: 757

SEQ ID NO: 1788 - DNA, 201 bp, Homo sapiens; identical to SEQ ID NO: 758

SEQ ID NO: 1789 - DNA, 201 bp, Homo sapiens
aaaacatgctttcgttgatgcctctcagcatttatacaccttttaccaactcgctactggccacatagacaaatgaaagcagtaatccagatacacccaaraggacatctgttcttttttctctctgtggagtgggagacttaagtggcttcttaactggtgtgtcgtctgatcaagtggtccaggtaacaggtggatgcc

SEQ ID NO: 1790 - DNA, 201 bp, Homo sapiens
ggtccacctcaggcccctccccttcctgcgccgtttccggcagatccagagtggccaccgccggatgggagtcgggggaagggaggcagagaagcgggccytgaggacaagctctcagtgcttctgtgggaagtggcggcaagacggcagctcccagcgggggatggaggccgagtcagtctgctggtcactggaggccag

SEQ ID NO: 1791 - DNA, 201 bp, Homo sapiens
ccatttgatggagggatgtgacggggctgcgtctttaacgtttcctcttaaataccggagacagcttcgagaaggagataactggatgtttcttagtccaytttctgttgcttgtgacagaatacctgaaactgggcaatttatatggtaaaaaattttcttcttactgctctggaggctgagaagtccaaagtcaagtcc

SEQ ID NO: 1792 - DNA, 201 bp, Homo sapiens
gaaacagccaggttggttacagcttggtgtttgccttaaacttggtttgaacagttggccgcctttgattagccaaaactcggtgattggtacaagagtarattgcagttcactatgtacagagaagcccttagatccgaactcaaaataggtaaggaggcagttttagctacacttaagttaacatactcaggagtacca

SEQ ID NO: 1793 - DNA, 201 bp, Homo sapiens
cgctggactctttagcagagttttttgaagaccttgcagacaagccatacacgtttgaggactatgatgtctcctttggggtacctcttgacttcttttayttttctgtttccccctctaagaattttagttcactaaaatgaagaatttccctccagcagagctaagcatcaagtagcatgtagttgtaggtaggattaa

SEQ ID NO: 1794 - DNA, 201 bp, Homo sapiens
gaaataaggttatatattgatcgattggtaacaatgttgtgaccagcagcttacagggtacctagccttgtatttctcctataaataatttgctcgttgastgtttgtggcaactttgtagcacataactaccaagaataaggactgtaataagagtacgtccctcacaggattgtaatgaagactgagtccatttacata

SEQ ID NO: 1795 - DNA, 201 bp, Homo sapiens
gcctgaataccctcaggctctgtacttggggtatttctgttctcttgttttatgctcacggttgtgaggtttgttgtgagtaccacgatcccttccttcaraggagtaaactgaggttccaaaaggtttagcagttgcccgaggaatattaaattggcaaaagcaggtagaatataaagcaaggagtatttggcaacggtt

SEQ ID NO: 1796 - DNA, 201 bp, Homo sapiens
ggaggtgggggtgttctaccctgctatttgctcctagagaagcttctctgcttcactagtctcacagttctaaaggcaagaacagccctagtgggatcttycaaggattttagaaaagaatgaataagggaaaaattaaaatattgcagggtgccataaaaacatcccagtaaaacaaacacctttctagatgctcattgg

SEQ ID NO: 1797 - DNA, 201 bp, Homo sapiens
acaggataggaaacgtcctgttatgttacacaatgcaacagtgggtattgttttcatcattattataatgaaaatgctaaatagtgatttgaccaacaatmcagtttaaaacatttggaggaatgtgaatgtttatggccagaaaatggggagaaaaatggttaaggaaacaaaatctcatcatctagagtgggaaggaga

SEQ ID NO: 1798 - DNA, 201 bp, Homo sapiens
tagtaatttccccaagcccctttgtcttgtcatttcttcacaaatttatcatttctttgtctaaaacatatataaacttgtctgctatggtgacttcttcrggtctacatttgcttgtgaggactcccaggtacatgtaaaattgtaataagacttgcgtgcttttctactgttaatctttcctgtgtcagtttaattctt

SEQ ID NO: 1799 - DNA, 201 bp, Homo sapiens
cagtgagaaaataaataacatcatacatgtttgtatgtgtttgcatcttgcttctactgaaagtttcagtgcaccccacttacttagaactcggtgacatratgtactcctttatctgggacacagcacaaaagaggtatgcagtggggctgctctgacatgaaagtggaagttaaggaatctgggctcttatggggtcct

SEQ ID NO: 1800 - DNA, 201 bp, Homo sapiens
aaagaaaaaaaaacctattaataataaaacagtataaacaaaagctaaataggtaaaatattttttctgaaataaaattattttttgagtctgatggaaaygtttaagtgcagtaggccagtgccagtgagaaaataaataacatcatacatgtttgtatgtgtttgcatcttgcttctactgaaagtttcagtgcacccc

SEQ ID NO: 1801 - DNA, 201 bp, Homo sapiens
tttcttacttaaagaaggatttattagtggctgggcatggtggcgtgcacctgtaatcccaggtactcaggaggctgagacgggagaattgcttgaccccrggcggaggaggttacagtgagtcgagatcgtacctgagcgacagagcgagactccgtctcaaaaaaaaaaaaaaggagggtttattaatgagaagtttgt

SEQ ID NO: 1802 - DNA, 201 bp, Homo sapiens; identical to SEQ ID NO: 759

SEQ ID NO: 1803 - DNA, 201 bp, Homo sapiens; identical to SEQ ID NO: 760

SEQ ID NO: 1804 - DNA, 201 bp, Homo sapiens
gaatgtacatctggtataagaagacatggcagaagccagcctccgatctgtccacacgaatacagcattcccaaagcaacgtgcatgtgccattattcackggatgagcttgaggtggatgaactagcccaccaggctctcaatgtcatgaatttaacactgaattaagaaaaatatgttttaaaaataatagtttaggtg

SEQ ID NO: 1805 - DNA, 201 bp, Homo sapiens
gttcttacctccatcagggtgccacatgcactagtgttatctgctgccgtggccaatcatccatgaggccatgaggaagtggaatgtacatctggtataaraagacatggcagaagccagcctccgatctgtccacacgaatacagcattcccaaagcaacgtgcatgtgccattattcactggatgagcttgaggtggat

SEQ ID NO: 1806 - DNA, 201 bp, Homo sapiens
cctggcaacccgatagcagtatcagagtatagggccaaggggacggtccttgggcttggtgtggtttattagtccttttcctgtgaccctgatggtttggytcactcatttttatctccatactgggaacaggttcaagccccagcatttggttgataatgcaggaatccttgatacttttattgcccaagcttcccttcc

SEQ ID NO: 1807 - DNA, 201 bp, Homo sapiens
ggcacagctggagacggagctcctgaggctgcagctgatgctgcccgctctgcctgaactgcaccaaaaacgtgatgaggccatagcgggagtccacggargaggatgcctactgcccgacctctagcagagactaagcaaggtgcatgaaaacttgaaccacatgtgtcacacccatgaccactacatgaagatggccca

SEQ ID NO: 1808 - DNA, 201 bp, Homo sapiens
gaagctaatgctctcctaagacaagcaaagcagatggtttgcatacttccttaccttccttttacttcctctgtaatagacttgtcatgtctgatgtttgrgttgacgtggtactctaatagagttagagtctgcattttttttatgtcctctagtatgttctggttgatggttgagggcaacaaaccagcagtcccagat

SEQ ID NO: 1809 - DNA, 201 bp, Homo sapiens
aagtgccaaacaccaagcctggcacagtaggaaccgagtaaatagtggttaatatttttatcagtgtctgcattgctgacgtctccatcatttctatacayttgtttttgaatcagaaaaagatgttattttaaaaaaataacccagtagtgccccttgtcccattcctatcagttatattattattgttactaccctctg

SEQ ID NO: 1810 - DNA, 201 bp, Homo sapiens
ggaagttgactgcagagaaggtgccagggggtgaaaatagcttgagagctgtggagctagaagggctctcacatttgcttattaatatgccctttgaaaargagtggcctgatacctggagtcactcaaaagatttccaattccgataggaaaaagtcaattttggcttcagtggttgcatgtgcaccccctgatttgctg

SEQ ID NO: 1811 - DNA, 201 bp, Homo sapiens
catattttgactattccccctgcacttaagggcatgcacactcccaaaatagactcagattgtctaaggaataatgatgatgatgaagagaaagccctctktatctggtctatttgtagtcagttccaaaagcattaagaatttctgctgaactaatgcagctagtttctttcctgtcaccactttccttccaaaatagtt

SEQ ID NO: 1812 - DNA, 201 bp, Homo sapiens
aactcctggcctcaagcgattctctcacctcggcctcccaaagcaccgggattacaggtgtgtgccagcacacccagccacaaatctataaatttagaaargaggactatttctaaagagggtcccactacctgtaggcaggaagcagagcctctggccataactgaaaaacaagcacttccaagaaggggcaaagggaac

SEQ ID NO: 1813 - DNA, 201 bp, Homo sapiens
aacaactattaacagcatttacattgtactaggcattataagtaatctggagatgacttaaagcatacagaaggatgtgcctaggttagatgcatgtatcrtaccatttcatatcagggacttgagtacccacggattttggtatctgcagatcctggaaccccttccctatggataccaaggaacaacagcactgggtct

SEQ ID NO: 1814 - DNA, 201 bp, Homo sapiens
gattttggtatctgcagatcctggaaccccttccctatggataccaaggaacaacagcactgggtctccttttggggtgatgcagatgttttgaagctagrcagaggtagtggttgcacaacattgtaaatgtactaaatgccaccaaattattcatttttaaatggttaatgtgttatgtgaatttcaccttaacaacta

SEQ ID NO: 1815 - DNA, 201 bp, Homo sapiens
tagattctaccctgaaaaatgttcttggcacagccttgcaaactcctcctccactcagcctctgcctggatgcccttgattgttccatgtcctcagcataycatgtttgtctttcccagcactgacctaccatgtgtcacccctgcttggctgtaccttccatgaggctaggactatgtgtctcctttgttgactgctgtt

SEQ ID NO: 1816 - DNA, 201 bp, Homo sapiens
gcttgaccccaggcggaggaggttacagtgagtcgagatcgtacctgagcgacagagcgagactccgtctcaaaaaaaaaaaaaaggagggtttattaatragaagtttgtattaatatgtagcaaaggcttttccaatgggtgaataaaaacacattccattaagtcaagctgggagcagtggcatatacctatagtccc

SEQ ID NO: 1817 - DNA, 201 bp, Homo sapiens
tttttttttaatctataaaatggagatatctaacatgttgagcctgggcccacaggcaaagcacaatcctgatgtgagaagtactcagttcatgacaactrttgttctcacatgcatagcataatttcatattcacattggaggacttctcccaaaatatggatgacgttccctactcaaccttgaacttaatcaaaatac

SEQ ID NO: 1818 - DNA, 201 bp, Homo sapiens
tcctcccaagatgctgggattacaggtgtgtgccacaggtgttcatcagaaagctttttctattatttttaccttcttgagtgggtagaacctcagccacrtagaaaataaaatgttctggcatgacttatttagctctctggaattacaaagaaggaatgaggtgtgtaaaagagaacctgggtttttgaatcacaaatt

SEQ ID NO: 1819 - DNA, 201 bp, Homo sapiens
tagcttgagagctgtggagctagaagggctctcacatttgcttattaatatgccctttgaaaaagagtggcctgatacctggagtcactcaaaagatttcyaattccgataggaaaaagtcaattttggcttcagtggttgcatgtgcaccccctgatttgctgtatgctgaggcattgtggtgatggacgcaagtgcgga

SEQ ID NO: 1820 - DNA, 201 bp, Homo sapiens
ggggaacagggaaaccagacatggtggtctccccgcttcctggctacaagtccctctgaagaaatccaaaggagtaaagagcttggagagtaggcctctgyagggtgcaagggcacagctggagacggagctcctgaggctgcagctgatgctgcccgctctgcctgaactgcaccaaaaacgtgatgaggccatagcggg

SEQ ID NO: 1821 - DNA, 201 bp, Homo sapiens
atagaattctttgaaagactaacggtatttgcattttttaaaaattataaccttactctaccccctaacattgacatcatttttaggtaattaatattttmccatttattattctgtgatctctaatgctttgttcagaataaatagtgtgtttcctttccccacactttcatccaagaagtgtgctagagttcaacaaaa

SEQ ID NO: 1822 - DNA, 201 bp, Homo sapiens
tcttctctggctgtatagtttaaggaatggaaggcaccagaacagatttattgaaatgtttattagctgaagatttatttagacagttgaggaaaacatcrgcacccagcagtaaaattggctctcaaagattttcttctcctgtggaaagtcagacctctgaggccccatccaggtagaagtactagtgcaagaagggcc

SEQ ID NO: 1823 - DNA, 201 bp, Homo sapiens
tatgtatgtgaagtctccagacccaacatgccatcttatatgtgtctatttctacaagtgagctagtgacaacagtaattgctatttttgctcctacatgrgtagggctgatcttgactaggaggagtcaataagactcaccagccgggcgtggtggctcacgcctgtaatcccagcactttgggaggccaaggcgggcgg

SEQ ID NO: 1824 - DNA, 201 bp, Homo sapiens
ggaggtggggagggtgtccacggagtgagttacctcacacaggcacggaaaaacttgaacctcctaaggacatttttaagctctctttcccattttctctmctggattcccattgcctggtctcatttctctcttctccaccacaccacttcctcaaaaattcctttagggtttgttcttaagcttagataggtttcccat

SEQ ID NO: 1825 - DNA, 201 bp, Homo sapiens; identical to SEQ ID NO: 761

SEQ ID NO: 1826 - DNA, 201 bp, Homo sapiens
cttgaacctgggtggtggaggttgcagtgagccgagattacaccactgcactccagcctgggtgacaagagggaaactccattaaaaaaatgtaattcccrtgtctgccatcttaagtgtaaaggtggctaaattatatagaaaaataagacaatatcatttcccaattacattcctttcctaccgcactctatgatgcta

SEQ ID NO: 1827 - DNA, 201 bp, Homo sapiens
gattcccctaacctctctgagacgtggctttgttttctgtagggagaagataaaggtgacgcccattttgcggacctggtgtgaggattaaatgggaatarcatagataaagtcttcagaacttcaaattagttcccctttcttcctttggggggtacaaagaaatatctgacccagttacgccacggcttgaaaggagga

SEQ ID NO: 1828 - DNA, 201 bp, Homo sapiens
ataaataaataaataaagggacttcaaacacatgaacagcagccaggggaagaatcaaaatcatattctgtcaagcaaactggaaaagtaccactgtgtgkaccaatagcctccccaccacagaccctgggagcatcgcctcatttatggtgtggtccagtcatccatgtgaaggatgagtttccaggaaaaggttattaa

SEQ ID NO: 1829 - DNA, 201 bp, Homo sapiens
ggtaaattataaacaataaattcaaaactttaaaaagaaaacattttattgatagctcactgaatacaaatttataaaatattatttatgcattaagtttsagttacacattttcacccatcattacagatgtcatatggagttgctagagtatgagaagagcttcttcatcccaacagctttcaaagtgaagaggcgact

SEQ ID NO: 1830 - DNA, 201 bp, Homo sapiens
tctcatttctctcttctccaccacaccacttcctcaaaaattcctttagggtttgttcttaagcttagataggtttcccattctgaaatacaaaggcctgrtaattagccaacttaccttgttggggatgtggaaggcaagactctcagactccatgactcaggtatattgcaacaattaggctgaaagttccttgagagt

SEQ ID NO: 1831 - DNA, 201 bp, Homo sapiens
gccaacagagccatactccgtctcaaataaataaataaataaataaagggacttcaaacacatgaacagcagccaggggaagaatcaaaatcatattctgwcaagcaaactggaaaagtaccactgtgtgtaccaatagcctccccaccacagaccctgggagcatcgcctcatttatggtgtggtccagtcatccatgtg

SEQ ID NO: 1832 - DNA, 201 bp, Homo sapiens
cccccagccccaagagagccaaccgatgcccatgtggtcaccacagccacctccgagtccaagatttccaggtgacatgcagtctcctctctcccagcttyaggaatggcttcttctgatctacacacagacacagacacacacacacagacacacacacacacacacacacacacacacgatggagaggggcaggataac

SEQ ID NO: 1833 - DNA, 201 bp, Homo sapiens
ctgtcaggcacggctacagtctaccccctgccaaccagtatctgcatggaccctccttccacactcagatgcatttacccccagccccaagagagccaacygatgcccatgtggtcaccacagccacctccgagtccaagatttccaggtgacatgcagtctcctctctcccagctttaggaatggcttcttctgatctac

SEQ ID NO: 1834 - DNA, 201 bp, Homo sapiens
aatcaaatggggagaaggcaagaaaaagatagtcaatacacagagcaagcaatcagaaactgctagttttccaagtaaaacatgccttaccctataacatyaaccaccttgaagagttcggcatcaaggagcatggatgcagagatggactcccagagattatcacttgctatgattttcactcgctggagaccttgataa

SEQ ID NO: 1835 - DNA, 201 bp, Homo sapiens
ggtggggactgtccctgcaagtgggagttcaggacacacgctccttcagtagcaaaaacagccctggccatcctggcgctcagagccctctgcacaccttygaacgggctgtgtgtcccttctctgatggcagaaagacaacaccagcagaaagacggctgaacaactgcagatcctcctacccccgaagcctggtctgtc

SEQ ID NO: 1836 - DNA, 201 bp, Homo sapiens
catccttgctgatcccttacttcacaaagtatctggcccaggtctggtggtagatgtctccgggctgtcccttgagtgaccccttcccattcaccgctccmttggtcttgagccaagtgggtgatgtccaggggctggcaaggagtgaaacgggacgctgggccaactgcagggctcggtgaatcaggggtatctagagac

SEQ ID NO: 1837 - DNA, 201 bp, Homo sapiens
actgctggcagaatcttcgtccgcacggccccagctggagttgcacttgcggccgcaagccgccagggggcgccgcagagcgcgtgcgcgcaacggggacsactgtccgctcgggcccgggcgttgctgccgtctgcacacggtccgcgcgtcgctggaagacctgggctgggccgattgggtgctgtcgccacgggaggt

SEQ ID NO: 1838 - DNA, 201 bp, Homo sapiens
atccagtgagcagaactgggccaacctgaccacagaggagaggctggcgtcttccaggccccctctcttcctggacccaccccctcagaatggccaaaaayccccaagtcgtcccagcagctctgcttctaagaagcagtatgtatagaggcctgtggcttatgtcacccaacagaggggtcctgagaagtctggctgcct

SEQ ID NO: 1839 - DNA, 201 bp, Homo sapiens
ttggaaataccacttaaaggctttatcagtgcctacttaaaccatgaccctgatattggatttttaggatgtttgcaactaatcatcctctactataaatkgtactgtgatgcagatgtctgtacctaaatgttttccaaatttctatttccttaaaagaaaaagatattccaagaagtaaaattactgggtcacaaagta

SEQ ID NO: 1840 - DNA, 201 bp, Homo sapiens
tcacagcaggttggcaagttggcccctctcccatcaggatgggtgttgaaaacaccagctctgtacccctcatccagagctcattcgctcactcgctgctyacccagcgagtctgaatgctcagcctaataaattacgaccctcttccttttccagctgtggttcccattgttccctctgaatcgctgaaatcgatcaggc

SEQ ID NO: 1841 - DNA, 201 bp, Homo sapiens
aagtggggctttccagccccttttatcctgtttacaatacactggttttccttagacaaaaccctccttccctgccttgctcctggctgttatggctacawgagacaatttgctgatggactctctagggaggacaacttccttggagtccccttcccacctcctgcagcacccggggcaacatcccctctacttggtggg

SEQ ID NO: 1842 - DNA, 201 bp, Homo sapiens
gaaaacgaaatccaagcaagcatagaccagatattcagccgtctagaacgtctggagattttgtccagcaaggagccccctaacaaaaggcaaaatgccaractgtaagtgctgacctctgacatggctctgatactccaggcccatcaagacaggcttttctccctgggggaggtgatagaatattctgaaaaccaacgt

SEQ ID NO: 1843 - DNA, 201 bp, Homo sapiens
tcccagacacagaagagtcaaaacaatagtgaaagaaagccccaacttttagaaccctggacgctcctgtagtctggtgacataaggtattaaattaaatycccctttatggcttcagctacctcaagataactttttatcagttacacaaagggtcctatgtaattcacctgataacatatcataaagatctttgccaat

SEQ ID NO: 1844 - DNA, 201 bp, Homo sapiens
gagtttaggtgttatttttcccgtgctttagatcaagcccagtcttcagctgtaaattgattgtgaagaaatggaggctcatagatccctacttgtgctamccttgtcagaaatagatgaggaatgtctgtgatgcggagggtgcaatgtgctgaaacttactttccccataagatgagatattcagagtaattcatttga

SEQ ID NO: 1845 - DNA, 201 bp, Homo sapiens
agtcccttctttcaaaagctcccaaataacgtggggctgtgtctaggctgtttctttcctcttgggccagctgtagggtttgcctttccttgtctgtctgyacctgcactgccgccatattgtttccattgttactgctttgtaagtcataatggcaggtgggacaagtcattcctccccctccttcttcagagtggtctt

SEQ ID NO: 1846 - DNA, 201 bp, Homo sapiens
ttgccagatgaaacttcttcctggtcattctaccatatggagctataatacatttttctgagagataatggcccatcagccatactgttttagatgggagrgtaagaaagatttgtatgtgaatggcatttcataagtgctagtcaaattactgaagagaagtctctgagtctttcaaacgccagcatcttctgacacact

SEQ ID NO: 1847 - DNA, 201 bp, Homo sapiens
gagaatatcagcagtatatatcaattatccaagtggtttagccatacaagaaaaagaaaaaatgggatataagttaaaaatgcagtaagctggagagtggmattttcttctatttagaggaaggcctaaatacgtataaagacttaagagactgagaggcagaagggagatcttctggacttcaatttccttatctgcctt

SEQ ID NO: 1848 - DNA, 201 bp, Homo sapiens
attcatttgtttattttgtggctttggtgtacagaagttttttgttttcatgttgtcagatgtatccatctttttctttgtggtttgtgggttttgtgggrgtgggtagtttttggattttgtcttatttaagaaatcttctgtaacccgaggtcatttatgcacacctgtattttcttcagaaagtttgaaagctgctct

SEQ ID NO: 1849 - DNA, 201 bp, Homo sapiens
ggggtggggtgagtgaggatgcagaatggggccctgcccactccagcgagttgtgaggaggctgacatgatggctgacctttcctttattaagcatctatwacatgcccagtgcattaaatacattacctccctgaattctctcacaccagcctttgggttctgctggactgtccccttgacatgaggaaacagcggcact

SEQ ID NO: 1850 - DNA, 201 bp, Homo sapiens
attttgaaagtacacagaagctgtgggcagaaaaggacttagataaaagacaagttaatgtatctaccagatctttcctctcagatagtgtgaatacaatmgattcaaacattatgaagtaccatttccgaatagtgctgagaatacaatttcttcttgtttttgtgctcctattcatggttccagaggttctcaagagtt

SEQ ID NO: 1851 - DNA, 201 bp, Homo sapiens
atggttgctgacctttcctccagcgttggggatgatgtgagagtccagcaggcccccttcatgtgggccctaacttggggaaatctccaccgtgagcaccrggaagtggatggtggggccagcataagcagtatcccgaggactgatcatggaggaccattaggaagggggtcttaaggatgaccttggccagaccgtggg

SEQ ID NO: 1852 - DNA, 201 bp, Homo sapiens
gggaatggtaacgggagcccctacacgtggcctttccagcatggtggcctcaggttgctgggcttcttccatgatggctggggctcccagagtaagtgctrcaagaagctgagtggaagctgcagggcttcttataacctggccttgaaaatcccagaatttcacttctttcatattctgttggtccaggaagtcattaag

SEQ ID NO: 1853 - DNA, 201 bp, Homo sapiens
atgagtgtttcactctgtccctcagcagtttagcaatgccaacccctgctcgagcataggaaatcattttcagactctgctagcatagccaaggactccaygcagattctgcaaggtggaggacttttgagtaggcatgctagtcagatgcctttccggtgaaggacagaacgtgttgtagggactcctgtcacctgcttc

SEQ ID NO: 1854 - DNA, 201 bp, Homo sapiens
cccagactctttcattctccccaccaggcatttatgggtctctcctagggtagtctagcccatatcatcttgggtggagggtgtctgcctgtgggacagtrtatatgagcagagtaggggagggcaggacccccttgacttgggtagctacatgtcacctgtagaatctcctcactatggggagatgtaagaacagccatt

SEQ ID NO: 1855 - DNA, 201 bp, Homo sapiens
ttcaactcagtgaagtacatagaatgggtagtattgcttccttattaaagataaagaaaatgagtttcagaggaattaattgatgtgtccaaagggaccascttggagaatcagactcaggctttgtgtctaaaaatactgaactctttctactatcccacatcttaatggtccaggaaaatggggtcccaaaaggagaca

SEQ ID NO: 1856 - DNA, 201 bp, Homo sapiens
tggcctcccaaagtattgggattacaggtgtgagccaccacacctggccacagactgcttttaaaaggttcaggccctttgctccagcaattccacttccmggaatttatcccattgcaatggttttcaaattatgttcctggtggaaccgtggggttctacagaggtgctttgctagttctgcaaaactttgatttgaat

SEQ ID NO: 1857 - DNA, 201 bp, Homo sapiens
ccattcactgaacacgtactgagcatcttctgtgtccagctaagtgctagggaatcacagtgaaagccagtccctgccttcaaggagctcagtctggagargaagacaagtaaagaaactagataatgataaacggtgagaaggtgcgaatagaggaagacataacatgtggggggcacccagaggggacactgtggacgc

SEQ ID NO: 1858 - DNA, 201 bp, Homo sapiens
aggactacagttttgtggtcttggagatggctccattcccgctgcttcactaggcactgccctactgcagactatgtggtggctccaatcccacatttccrcttggcgttgccctagtggggactctctgcagtaccagctttaaataaatagcattaggaactggaggggcaaagaaagctacataggccaatacaaaca

SEQ ID NO: 1859 - DNA, 201 bp, Homo sapiens
taagtcctttttattaaatgtgtgtgcatgcgtgcgacacatgtgtacacgtatacctttcccccaaactggaatgctggatgggggccatttctgctgtwcccgccacctcgcatgctccattctttgcctctgaagccacccccaaagctcaaggcttctttccatctactactgagttggggtctggggagggcgacc

SEQ ID NO: 1860 - DNA, 201 bp, Homo sapiens
cactccagcctgggcgacagagtgagattccatctcaaacaaacaaacaaaaaaccaaaaaaacaaatttaactcttgactcgttctcttctcgccccagwcacatttagtagcagacctattttattagaggagagttctcgcagtgttcgccctaacttggcccggtggaaaagcgtgtaagcctgtgttctttctgaa

SEQ ID NO: 1861 - DNA, 201 bp, Homo sapiens
cattttctggtcatttgggattttacgcaaatgcctgtagctgtctgagctgcattccccaaaccactgagggcagcccagactccagataactgcaccasctacatgacgaagccacttatccaggttgcctgagtcactgaaggctgctgtccccagatcaggctggacttcctgcaagtcacaccaaaccatcaacag

SEQ ID NO: 1862 - DNA, 201 bp, Homo sapiens
gaccactctggaacatacaatgatacagtcgggcacttatatactatacatgtactagctgcgagtacagccaggcagaggtggggcagatgagcacatcractactagcaccactgtcctggacatcacacaacaggggggcagggctgggctttgagcccaggtttgtttggctctgaagcccagtggctggccactcc

SEQ ID NO: 1863 - DNA, 201 bp, Homo sapiens
agcaaacatttaacactgcattaaggggaagccatggaaaggaacatttggaaccagctaggttagtgagtagtcagagaaagcctttaggagacacccartgaggtcttgaaggaatagcttttcctaagaggagatcatgatacagagacaagtatcgttggaatgaacgatacttgtggagtggaactcatttggaga

SEQ ID NO: 1864 - DNA, 201 bp, Homo sapiens
ctgagagtatggctcctgagcactggtcccaggcctgggttctagaatgtctctgtctgcagggctcacttgctgctgtgtgtgtcacccgagaggcagcrtagagtaggaaggggggcactggatggggggtcaggacattcaggttccagctgggctctgaattctgcacaatcgggcagatcacatccctttctgggc

SEQ ID NO: 1865 - DNA, 201 bp, Homo sapiens; identical to SEQ ID NO: 780

SEQ ID NO: 1866 - DNA, 201 bp, Homo sapiens
cctcccacccagcaccttcctttcaacagaagaaaattccagatggaatgcacaaggtacagtgggtttggaggcatggagaagccggtagaacttcctcyttggaggctttcagtctggactgggctgctcctcctcctggcaggctgaaggcaatctagctgagagtatggctcctgagcactggtcccaggcctgggt

SEQ ID NO: 1867 - DNA, 201 bp, Homo sapiens
gctgcacaggaccccagccccaccctgcagaggggccagagttgctttcttatgcctggagaccctaaacaaccgtggaacgatcaggcttccctgctccrggctgggaccagcctctgtcctgatggccagaagctctgatgagcaggtatagacagcagacagtttccttattcagcaataaggacagtgtgcttggtg

SEQ ID NO: 1868 - DNA, 201 bp, Homo sapiens
tctgaatctaccagatgctggggggttctcaaccatgctccactcatgacttcctttttataaaatgtattttgtgtaattacagtaatttttgaacattwtaggcagatttattgaggtattgacatataataaactgcctagagattacaatttgataatatctgagccttagtatacagctgaaatcattatcacaat

SEQ ID NO: 1869 - DNA, 201 bp, Homo sapiens
ctttttcaacttttcacttctcccccctccactctgatgtgtgagcattgggaggattccagctaatgggcctgcccacagccaattcccgggccatgcargccggaatgcacggggtcattagcggggcctcccgggcaggggcctgtgctcgggacgggacgtgctcgcctgtccgctctggggcatcccagccactgg

SEQ ID NO: 1870 - DNA, 201 bp, Homo sapiens
cccacagccaattcccgggccatgcaagccggaatgcacggggtcattagcggggcctcccgggcaggggcctgtgctcgggacgggacgtgctcgcctgyccgctctggggcatcccagccactggagagccggccggatctcggcagagcagacctgcccagacaggctggatcccaccttccttggtggtggcccctg

SEQ ID NO: 1871 - DNA, 201 bp, Homo sapiens
aattggaccaggcagcttattaggcccatctccaagagcattcaggggcagccatgagcttcaggaatttccaccatgtgaacttagcgggggagatgacyccgagcagcaagggctgacaggatggggctgccccaccatcctgcctgcccggggccctgctcagtggcttgagagggcagggactggtctgtgtggggg

SEQ ID NO: 1872 - DNA, 201 bp, Homo sapiens
ttgccacctgccaaaaacaacctccgcttccacactggcctgacacagctggagtcaattcactgatatttactcagccctccagtgtgccagatcctcckagtgccgctgctctagtgactctcacggtggggtaaggcatcctcaccccacatggaaatggagtaattcctgaagatgtcctcttagccatcacctgtc

SEQ ID NO: 1873 - DNA, 201 bp, Homo sapiens
ttatggggtggtggggggcggtgagtagtttcatgaacttttaaaaagcacttccattaaaaaattcttcctagatcttctgtaaaccttttttaaagacrgctacaatgaccctggcttatttgctactatttctctgctttgttatattatcacccaagcccaccatggaccccatgctagagagggctaagacttctt

SEQ ID NO: 1874 - DNA, 201 bp, Homo sapiens; identical to SEQ ID NO: 781

SEQ ID NO: 1875 - DNA, 201 bp, Homo sapiens
ctacccctgctccctccccaccctgccccagatctggtgaaaccaccaaccaggcggaggcagggcagaggctgtcactgccacacaccttcagagctccytacaacttacgttcatgctgctgagatactgatgagagctggagaagctgtcaggctggtgtgggtgtggacaagccccactgtcctaggaagacctgga

SEQ ID NO: 1876 - DNA, 201 bp, Homo sapiens
tctctccttcctgtggaaaacctgtgccacgggactcagcgagggctgcctcctccagcagggtcagcgcctgaagcaggcctggtccatgcaggactggktcagcagcccaaagcagtcggtttggggtgaccacatgactgcgcggtgggccgatcagaatcttccctggaattcccatagacactgctggtttcctga

SEQ ID NO: 1877 - DNA, 201 bp, Homo sapiens
gcctcctcgatttggatgggaggagacccaggacaagagagaagtgacttgtccaaggtcacacaacaagtcagtagagagccagagatgggagctgacarcctacttcctcacacctcttcaaggccctcagatacctggtgtccatgacttattagtggcacagccagaccttgattaagggctccaaaattaaaatta

SEQ ID NO: 1878 - DNA, 201 bp, Homo sapiens
aagcctaggcccttcataaacagcttgcctgtaggcctcacggaggtcagacagggattttcctggctccatccctgccaatctgaaaccctctcacttaygttctccatcatttatcctcattatgcagacaaggggctgagctgtggtgactgtgaaggcctcacaggagtccgagaggagctggcccctcatccagct

SEQ ID NO: 1879 - DNA, 201 bp, Homo sapiens
tgaactcctgggctcaagcaatcctcctgcattcgcttcccaaagtgccgggattgcaggagtgagccgctgtgcctgggaagatgcatgtatttaatatragccatgtatttaattgtaaatttctagatggcacatttaaaatggaaaaaggagcagaggaaattaatacattttatttaatccaatacagatgaaaaa

SEQ ID NO: 1880 - DNA, 201 bp, Homo sapiens
acagaagcatattttcccagtcctgtccttcgagctggcaagaggagcccctgactgggccctgaaatttagagaactctacatacaaaaaataaaataarttaattaattaaggactgcagggccgggtgcagtggctcatgtctgtaaatcctagcactttgggaggcagatcacctgaagtcaggagttcgagaccag

SEQ ID NO: 1881 - DNA, 201 bp, Homo sapiens
ggtaaagagaggttgaccgtggcagtgagtactcggggcacctggggccagctgacccttgtgcttcagacacaggtgttgggctcggtgggaaggtctgytggtcctctgctcttacctgagcatctcctctttctctccagccccagctcttggcataaacaacactttggagaccctcagtgcaatttagctccctta

SEQ ID NO: 1882 - DNA, 201 bp, Homo sapiens
agagagaggtcgtggtgggctgtgggttgttagtctctctcccaggagcacctggcaacctgaactacccctgctccctccccaccctgccccagatctgktgaaaccaccaaccaggcggaggcagggcagaggctgtcactgccacacaccttcagagctccctacaacttacgttcatgctgctgagatactgatgag

SEQ ID NO: 1883 - DNA, 201 bp, Homo sapiens
tgtccctgccaaggtgccagacactctagccagccaagtccttgaaggttgcagttcctgtcagtatcacgtgcagcaggactgagcagttgagcccagtkaacctgcaggatcatgaaagataatgaagtggctaccataaaaccagaaatttctgggagtagttatgcagttatagataaccaaaagaatctctttcag

SEQ ID NO: 1884 - DNA, 201 bp, Homo sapiens
cctttctggccttgtcctttgtctttttgtgcattatgttctagtaacttcaaactgcttgtagtttcccctgcacatcatatatctttgcttttgtgtaygctgtttcctcttcctgggatgttttccccactggccttatcttccaagattcagtttaggtatcatctcctctttgaatctctcttgagtcaccaaact

SEQ ID NO: 1885 - DNA, 201 bp, Homo sapiens
ttaatggtccaggaaaatggggtcccaaaaggagacagagataaccaaagaaggctccccagaggggtgaagtacattgagaggagagtagaactcagatratccaagcatccctcagaactcttcacacttcaatactgacctggtgtatctgatccaactggtgcttacatgcccaaggtaggagtcagtgaggcctaa

SEQ ID NO: 1886 - DNA, 201 bp, Homo sapiens
atgagtggctggataaatgtatgggtgggtggatgggggttagatagatgagttggtggatgggtgagtgactgggtagatgaatgtatgggtggctagayggctggatggatggctgggtaggtggatgtgtagggtggctgggtggctgggcagatgaattagtgggtagatgggtggatgggtggctggttagctgga

SEQ ID NO: 1887 - DNA, 201 bp, Homo sapiens
tctggaattactggtgatggttgcacaactctgtgaatatacactgagtatatacaacccactgaattgtatattttaatagggtgaactttatgtgaatkgtatccccatagaactgttatttagaatatgctaggagattgtgttaagcaggttgattgctgttgtatttcattcttacagtgaccccacctggaatta

SEQ ID NO: 1888 - DNA, 201 bp, Homo sapiens
ctaggggtaggaggatgagaggagcaaaagaatggtcccaagctcaggctggtgtggagtgagtcttagacagaaaaagagaccagagaggaaacaagccyacaagggtagccatcctgtccaaccggaagccgcctgacacttgaaggcgatggatggaagaactcagccctctgcctccttagcaacatacacctactt

SEQ ID NO: 1889 - DNA, 201 bp, Homo sapiens
tgagatctgtgccctggagccctgtgtccttgatttggcttttcaaatatgcctccgctgaggcctcattcttgtctcgagagctgggttatgcacactcrcccagccgtgctcaaaactaccaccagtgcaggtaagacaggtgggagaactagccaccaaggcgggactcagtgcacctgaggttgaacagggagacaa

SEQ ID NO: 1890 - DNA, 201 bp, Homo sapiens
tgaaatattctaagttctcttcagtggctgggatcatcccagttggtttctcttcagagtactctgtgacccacctcttgatctgtgtggttggccaaatrccctgaggcggttcagggctcatgcctatggggttgtccagggcaacctgacaagtagattgcttctgctgaccagcacagtatttattttatggcattg

SEQ ID NO: 1891 - DNA, 201 bp, Homo sapiens
gtcgctgagccctggactggggctatcctctggaacacctgcacacggcttctccatgggaccagggcttcctcagggcatgatgactgagttccaagagkgagtatcccaagggagagagcaggtgggatctgtgtactttctatgaccaagcctcggaagtcatagggcctctgttctgccatactcctttggccgtgg

SEQ ID NO: 1892 - DNA, 201 bp, Homo sapiens
cgtggtgatcacaagccatatggtcacaagcccccagctgcctctcagtgggaagaatgtgggtcacattctaagaagagcaggtgggatggaattgacayggtgggtggccatctttggagagtacaatctgccacactccccttgaatgatgctcacgtctagctgggaagacatacatgagcatgcagcaataaagtg

SEQ ID NO: 1893 - DNA, 201 bp, Homo sapiens
aagtatagctatgctgctgtctagactgtgtggagaagccacatggaggaaatgccatgagttgataaggagaggaaagaggtccagccatctcagcagakcccagccttccagctgtccctgccaaggtgccagacactctagccagccaagtccttgaaggttgcagttcctgtcagtatcacgtgcagcaggactgag

SEQ ID NO: 1894 - DNA, 201 bp, Homo sapiens
gaggaagacaagtaaagaaactagataatgataaacggtgagaaggtgcgaatagaggaagacataacatgtggggggcacccagaggggacactgtggaygcaggtcaacagaacacaggaaatgagtgtttcactctgtccctcagcagtttagcaatgccaacccctgctcgagcataggaaatcattttcagactct

SEQ ID NO: 1895 - DNA, 201 bp, Homo sapiens
cacacatacaatttcccagagcactactcaccaatgaagtactaatgaaatagctccccctgaaccacaagggtcattggactgcagctccctccctcctrcagaatgaagtccaagctccttagactgacttggccacaagctacctttctggccttgtcctttgtctttttgtgcattatgttctagtaacttcaaact

SEQ ID NO: 1896 - DNA, 201 bp, Homo sapiens
agcttggagaatcagactcaggctttgtgtctaaaaatactgaactctttctactatcccacatcttaatggtccaggaaaatggggtcccaaaaggagayagagataaccaaagaaggctccccagaggggtgaagtacattgagaggagagtagaactcagatgatccaagcatccctcagaactcttcacacttcaat

SEQ ID NO: 1897 - DNA, 201 bp, Homo sapiens
ttgtcaactcggtgctcctggttggtagacctcgagaggagacacggagtaggagacacggcccctggccgtaggagtgtactgtttaattggagagtcarggcacgtacgggaaagtatttgtattcttattcgatttatactaaagaccacatttttatggtacaaagaaattgctgtccacgtagcattcactattat

SEQ ID NO: 1898 - DNA, 201 bp, Homo sapiens
cccgcctttcagccttgcaagaaaatctggcttttccctcggggtgtttgcctcgctgcttctcccccccagacatcacctccctcacagcccagctccaygttcacccccaccaggaagtcttcctttctaaaccgtttttctctgcatcctctcagagtggctatatttggttcctgcaatataacttcgtatatattg

SEQ ID NO: 1899 - DNA, 201 bp, Homo sapiens
accatttgtggaaaagacttttctttccacttagcgttgctctggtaccttgatcaaaaatcagtcgacgacatgagagtggctctatttctggctgataytgctttctgtgtattctgggcatgaccaagagaatgtctgttggcaaagctccatctcctgatgccattcacccactcttggtaaagcgacttgatgttt

SEQ ID NO: 1900 - DNA, 201 bp, Homo sapiens
gcctaccaaagtgctgggattacaggcgtgagccaccgcacccagcccttgccagtgtttcttatttctcttgtcccttgatgattgtgtaatgatgaatmccttcgttaggaagcttgtcaaatgcaagtagacgctgagggggcggccatgtgtctactgtctcgtggctcctgttggatgggagtagcctgcgtggct

SEQ ID NO: 1901 - DNA, 201 bp, Homo sapiens
aactctggttctatcaactattagctgtgatttcagatcagtgacttgagcaatttgtgccttgtttcattaagtggagatgacaatagcacctgccttgmaagaattatttgatgtggccgatgagaaaaatcagaattatgaaaagtgcttcacaccattcctggcatgtgaagagccctctctaaatggccattatgc

SEQ ID NO: 1902 - DNA, 201 bp, Homo sapiens
ctcagtgttcagttgtcacttgagaaaatgtaaatgctacatctgctcactgcctgtcttttcttccagacaaagaacatatgttcttgacaagggagtgygccttgttccccacccacagtcaccactggagaagcttgagttttggagaggtggggactggctgaattctctttttttctctttttctcctttttgttt

SEQ ID NO: 1903 - DNA, 201 bp, Homo sapiens
gaattgttgcctgctaaagttcattcatccattctttcgatagctacgaactgagcacccaccaggtgccagtcacgggactgggccttggagaacagacrtgacccacctgcattgtgatccactgctgtgtaacaaatcaccacaaaacataggggctgacggcaatagctctcagttgctacacctcacagcctctga

SEQ ID NO: 1904 - DNA, 201 bp, Homo sapiens
tctgaggccaagcacacctctgaagcagtgcatggcttggaatcctgtctgctcttcaccgaaccattccttctgcactcacctcctccagaaagccttcmaaaccaggtcttaactccatcatcctaactaccttgtcagcactcacttttgttaacactttgattcagcagtacttgggttccatgagtatttgagcat

SEQ ID NO: 1905 - DNA, 201 bp, Homo sapiens
ttgcatttactttgtctcaatttattgcaataactttgcacattggacatggtccccgtaatggataaggaaatggaggttgtgagatgagaagcctcctyattgcaactggcaggcagtggggccaggattggaacacagatctcctggcctccaaagtatgggatttttttcctctgtacactggtataggtcgggcag

SEQ ID NO: 1906 - DNA, 201 bp, Homo sapiens
aagaaagatttgtatgtgaatggcatttcataagtgctagtcaaattactgaagagaagtctctgagtctttcaaacgccagcatcttctgacacactggrcattagctgcatgcagaaaactagttaattcaggcactaggagtaaagcacatgatgaaattaaaagacctgacgcctatctgtgaggagctcccctgtt

SEQ ID NO: 1907 - DNA, 201 bp, Homo sapiens
gggtttgaacccagatctatttattagcttggtgacccagagcaagttattctgcctgtgactcaatttcctcacctttaaactggggatcatgctagttwgcatttcataggattgttgtgaaatttaggtgagtgaatatatgaaacacttcatcagtgcttagcatatgtaggagagttggctgttcacatgattatt

SEQ ID NO: 1908 - DNA, 201 bp, Homo sapiens
gagtcacaccgctgctggcctcttgggagtactcacttggacagaactgcaacgaagccatgcctgaattgaagggtgtgggtctcgttggccaaagaccrtctttcattggaactaggaataagagtgttagttcatagcacacctgctttgtacatagcaagtgcttcttaaaaagggcttcgctctgttgcccaggca

SEQ ID NO: 1909 - DNA, 201 bp, Homo sapiens
tctctggcctcgccctgccccgggtccccaacgccaagggacagtgtcatctcgatcggcacctccgcctgtctggttgcagcctcagccgtcccgagcgrcctccacctcccagaagtctccctggaccgagcatctctcccctgctcccaggaggaagcgacaggaggagccaaggacaccaggatggtccaccaaacc

SEQ ID NO: 1910 - DNA, 201 bp, Homo sapiens
gtcccacagctgccttcttccctccacagcgtcatattaattcccttttgtagcacgactagttggcaatacacctcctttgatgaccacagtggggtttytgtgacccaaatgttagcaccctagagatcaatatcagagcctgggttctaagcaggctcctctcagaaggacagtgtccacattcatcctgaccaccag

SEQ ID NO: 1911 - DNA, 201 bp, Homo sapiens
acaggccaggactcttgtcaagagagagggcttcaagaggccgtccggagagagcatcaggaggccagtgttcccaagggccgcattgtgccaaggggaayagacaggctggagagaactagatcaagccggaagagcaaacatcaggaggcaacggaaacctctctcctccattcccaccgctttaaaaagggccaaaag

SEQ ID NO: 1912 - DNA, 201 bp, Homo sapiens
atcaaaacaggcacagcctctggtgggcagaatcacctccctttgagaactcttcccagcagcgttccccaccttaccccccaacacagaggtcttgcagrtaacatagctatcccaagctattccaaagctgagtgaacgagaaccagaactccagggctcattccaccaggctgtaccacagttttactttgtgtgtga

SEQ ID NO: 1913 - DNA, 201 bp, Homo sapiens
actaactaaaacgtttaaaactgataggttacctggttgagaatattccaggatgcaagcaagcgtgctacgaatcagagctgtccactgtttttgaacgscagcctcagttttggccattgaaagtgtcacaatacttttaatcccttgaagagctgcactgactggtggaggaacctgattatctgcagactttattgc

SEQ ID NO: 1914 - DNA, 201 bp, Homo sapiens
agcaatgttagccagcccgccctgagcctcaaaggaaaaggcttggccaaactcctccagatgccagacggtctccttcttgtccagatccacatagaacwtctcatcttcatcaaattcaaacataaactcccctgttggtctatgcgtctgtacaaacgcggcataagttgacacatggtccgctgcataaagacagta

SEQ ID NO: 1915 - DNA, 201 bp, Homo sapiens
gcctgctgcggagtactggaacagccagaaggacatcctggaggagaagcgggcagtgccggacaggatgtgcagacacaactacgagctgggcgggcccrtgaccctgcagcgccgaggtgagtgagggctttgggccggcggtcccagggcagccccgcgggcccgtgcccagggcgcaggagcagccgggttggccta

SEQ ID NO: 1916 - DNA, 201 bp, Homo sapiens
agcagcagggtagaaaaggcagccataactgcaaggcaggcagaagatgtagcagagtagacaggaagcagtccaactgacagagaatactggaagatatkagaacaactaagggacacaaaataaaatgacaaacacttggatgcaagagtgatgccagggccaaggaaaattaaacatggccaagatggccacaaaaca

SEQ ID NO: 1917 - DNA, 201 bp, Homo sapiens
ccctgtggagtcaaaggttaaaactcacaggtgacagggccagcacactaaaccccacttgcttctcctctttccaccacctcagccctgtgaccagcatracttacaggttccagcactgcaggctctctcttctctcccttcagcccccggggcccatgggcagcctaagggagacacacatgtaaccccagtggggcc

SEQ ID NO: 1918 - DNA, 201 bp, Homo sapiens
atagcagagaagtcttgatctgtgatcttggtgaaagctgttcacatcaaggataccatcttcttctgggaagaaacttccctggttagctttaccttacrggttccaatgggtgtatatttccaagaatgtggagggatccttctcagttgtgagatcatgaagccaaagttcacggttctgatgtttactgcagtgtgg

SEQ ID NO: 1919 - DNA, 201 bp, Homo sapiens
ggtggcctgagtgtggttggaacgctggatcaaggtattcaagttgttgttcaatatagcaatgttagccagcccgccctgagcctcaaaggaaaaggctyggccaaactcctccagatgccagacggtctccttcttgtccagatccacatagaacatctcatcttcatcaaattcaaacataaactcccctgttggtct

SEQ ID NO: 1920 - DNA, 201 bp, Homo sapiens
atttgggaagaatcgttaatattgagagagagagggagaaagaggattagatgagagtggcgcctccgctcatgtccgccccctccccgcagagaattacsttttccagggacggcaggaatgctacgcgtttaatgggacacagcgcttcctggagagatacatctacaaccgggaggagttcgcgcgcttcgacagcga

SEQ ID NO: 1921 - DNA, 201 bp, Homo sapiens
gggagttccgggcggtgacggagctggggcggcctgctgcggagtactggaacagccagaaggacatcctggaggagaagcgggcagtgccggacaggatrtgcagacacaactacgagctgggcgggcccatgaccctgcagcgccgaggtgagtgagggctttgggccggcggtcccagggcagccccgcgggcccgtg

SEQ ID NO: 1922 - DNA, 201 bp, Homo sapiens
acagctggggtcgtgtccaccaacctgatccgtaatggagactggaccttccagatcctggtgatgctggaaatgaccccccagcagggagatgtctacayctgccaagtggagcacaccagcctggatagtcctgtcaccgtggagtggagtgagtctctgatgaccctctagaccccacctctgaagagcaggggactc

SEQ ID NO: 1923 - DNA, 201 bp, Homo sapiens
tgccagacggtctccttcttgtccagatccacatagaacatctcatcttcatcaaattcaaacataaactcccctgttggtctatgcgtctgtacaaacgyggcataagttgacacatggtccgctgcataaagacagtagagaaaaacacgacaaaatgtcagtttgaatatgcaagtggtcaaagctagagaatgaata

SEQ ID NO: 1924 - DNA, 201 bp, Homo sapiens
cacttaccgggagagtctctgccctcagccagtagggagctcagcatcgccagcatcaaggtgacagttgctacccgaaggtctccggggatccgcaaagmcttcttccaagacataactgagacgaagggaaaagcagtggtagtcaacacagctcggacctgatggatctgatgtacctggcagaaagaataaaaacct

SEQ ID NO: 1925 - DNA, 201 bp, Homo sapiens
aagccctctcccagagactacagagaacgtggtgtgtgccctgggcctgactgtgggtctggtgggcatcattattgggaccatcttcatcatcaagggaktgcgcaaaagcaatgcagcagaacgcagggggcctctgtaaggcacatggaggtgagttaggtgtggtcagaggaagacgtatatggagatatctgaggg

SEQ ID NO: 1926 - DNA, 201 bp, Homo sapiens
ctcaaaactgatcttcaactccttggtaactatgtgtgtcttgctataggtgatggtgtttcttagagagaagatcactgaagaaacttctgctttaatgrctttacaaagctggcaatattacaatccttgacctcagtgaaagcagtcatcttcagcattttccagccctatagccaccccaagtgtggatatgcctct

SEQ ID NO: 1927 - DNA, 201 bp, Homo sapiens; identical to SEQ ID NO: 793

SEQ ID NO: 1928 - DNA, 201 bp, Homo sapiens
atctgcaggcaaccctcttgttgtggtctagtcctcatcaggaaaacctaaagtgggattggtttgttgggagatctctactgagcaatgatataactctrtcttcagtagagtgaatctgaaaccccaaggtatggatctcagaatgcatgggatggaggggagcagatggggttagagtggggagaaggaagacagaag

SEQ ID NO: 1929 - DNA, 201 bp, Homo sapiens
gattggtttgttgggagatctctactgagcaatgatataactctatcttcagtagagtgaatctgaaaccccaaggtatggatctcagaatgcatgggatrgaggggagcagatggggttagagtggggagaaggaagacagaagaatccataaacattgcaggatttacatatcaacatcgttcattccagatttaatga

SEQ ID NO: 1930 - DNA, 201 bp, Homo sapiens
tatatttgaagatgtgtctttgagtggaaaagctgagtgaaatttggggttggggagaaagatatgacattaagatgagaggaaggaatatttgaaacacratgaactgttgctcatttgtctataaaactatgacttgatatttatctctaaaatagtttctagaacctgccataaaccactaaggtaaactattcatga

SEQ ID NO: 1931 - DNA, 201 bp, Homo sapiens
aaaaggaaaacgcaagcaaagtaattagatacatgcttagtgataataaaatattgcaaaaaattatacattctgttgtttttctcaaaatttctatagastgatgataaaaatctaagagaagctaaacaaaacaaggataaaccaaagcatcatgaccttctaagccttactaataaataagaagtttctcggctgggc

SEQ ID NO: 1932 - DNA, 201 bp, Homo sapiens
tggctgtttgcattcctggactcttctccgctccagctccgccaccgcccggaactttccgacgtccctatggaagcgcgcatactccttccggtgtggaygagtctctgcacaaaccgcatccgctctgtcccattgcagaaatagcactcgtgtttaatctgctccaagaaatgtgccgcagggacatgaagaaccggt

SEQ ID NO: 1933 - DNA, 201 bp, Homo sapiens
gtgattttcaccttccatcatgattgtgaggcatccctagccatgtggaactgtcagtccattaaatttctttcttttgtaaattgcccagtctcaggtayatctttgtcagcagcataacagactaatagaggagagtggagcactgctgaaaagatatctgaaaatgtggaagtgactttggaactgggtaacaggcag

SEQ ID NO: 1934 - DNA, 201 bp, Homo sapiens
gaccctgccctggccacccagggggccgcactgcacttaccgcatgagcctctgcacttggtcctgcaggtgctggggcaggtgtgggcctcccctgctgsgggctgtggtcagaaagttcagccggtagatggcgcagagctgccgcttcagcttcccacatgcctggagcagcctgagcacgagagaggagggcattac

SEQ ID NO: 1935 - DNA, 201 bp, Homo sapiens
agcgggaagtgtgtgtggcccgtcctggcccagggactcagcctcacctaccatgtcattctcgaaccacaggaagtaggagcagtagaaatccccctccyggaacagcagcgtggtgtagcccttctgcaggtatctgcgcgccagctggatcagagaccagacctggggaaaagacagcaagcatcaccactctcccag

SEQ ID NO: 1936 - DNA, 201 bp, Homo sapiens
ttctcagaacccccaagcctcagcaagcccaacaggcctgtgtggaggctgcacgctcccagacccacaacccaactcttgagcagaggttttacctgggrtgtaggcctggctccaataacgaaggaagccacaaaaaacccaagagctgcaggcgagttcaatgagaccggtttccgcccgccaccctgcctcttatac

SEQ ID NO: 1937 - DNA, 201 bp, Homo sapiens
acctgtggtgggaggctgcccccttccttcctccaggtgatggtggcgctaggcacgcctgcagccctgcagtacagcctgacggtgcggcctgcgtggayctgggtcctctctgggctcacttggactctgggcccaccgccccctgcagacagagtcctgtgagaacacgccctgggctgagcacactcccggccccca

SEQ ID NO: 1938 - DNA, 201 bp, Homo sapiens
ctcactgggcgggacggtgactgtgaaggaggcttcttgctcagggcctgggccgctggctgcacgacacacatactcgcctgagtcggcaggggagacgwggtggagccgcagctgggagccatgggtctgtcagagcagcgaggggacagttatcagggcaaagtccccaggacaaggaatgtccccaagcccaactgt

SEQ ID NO: 1939 - DNA, 201 bp, Homo sapiens; identical to SEQ ID NO: 844

SEQ ID NO: 1940 - DNA, 201 bp, Homo sapiens
cactttcccactgcccatcggggaatcagtgactgtcactcgagatcttgagggcacctacctctgtcgggccaggagcactcaaggggaggtcacccgcraggtgaccgtgaatgtgctctgtgagtgagccggcgggcagagctgggtgggggcaggggccatggacctaatgcaatcctcaccgcctgttgtatcctc

SEQ ID NO: 1941 - DNA, 201 bp, Homo sapiens
aaggactttaaaacttgggctggattctgcgtggtggaaacttgacccaattcacaatccactgtggggaagattggggagggaccaaagtcattggatgwtggagggagagaggggtcaagatcgccttctctcacttcctgaagctcctggggctgggttctctctggggtcgggggaacctgacctggtcctgccggt

SEQ ID NO: 1942 - DNA, 201 bp, Homo sapiens
ccctacccgcttcgagatcctaggtgttcttccgcacccaacccttcgccctggagacccagtgtctctcctgtccgctccccgggtacctccttacgctstgctgtgcaccatggtccacggactggcatcttccccactcgcggtccgcgaagactccatctctccaactaccctgactcagaggcgctgttcccgctc

SEQ ID NO: 1943 - DNA, 201 bp, Homo sapiens
tgagttgaggggaggtgtcacatccagctggagtcctttctaagcagccacagcctgatcctcccacttcctcccccaagaaaacattgtgggttgatggycataccctgaggttctggtccaaatcggactttctatgaccttctgggtctctagtgaaaactaaagactcctctccagaaaaaaacatttggtttctaa

SEQ ID NO: 1944 - DNA, 201 bp, Homo sapiens
gaggcgccgacagccgaggagacctccgcctgctgtgccccgcgccccgccaaagtcagccgcaaacgacgcagcagcagcctgagcgacggcggggacgytggactggtcccgagcaagaaagcccgtctggaagaaaaggaagaagaggagggagcgtcatccgaagtcgccgatcgcctgcagccccctccggcgcaa

SEQ ID NO: 1945 - DNA, 201 bp, Homo sapiens
ttctcggctcccccgacaaacttggactgggtcagcttctttctgcggtccttcttcactgcttcagccttcagctcggagatgcgggtgtgtttgggccrgaagatcttgggggagtaggtctcctcggccatctcagaggtggtgggctcctcgtgctcacgggagtctctctctgcaggagaaggagccggagggtca

SEQ ID NO: 1946 - DNA, 201 bp, Homo sapiens
agttccttcctgcctgagcctttacctgccaagagcctgcaacatggggttcccttgtcccttgactcttctctctcttccctcctagagaagatctgcayacttcctaacagaggcttggcccgcaccaaggtccccattttcctggggatccagggagggagccgctgcctggcatgtgtggagacagaagaggggcct

SEQ ID NO: 1947 - DNA, 201 bp, Homo sapiens
ttacctgccaagagcctgcaacatggggttcccttgtcccttgactcttctctctcttccctcctagagaagatctgcatacttcctaacagaggcttggmccgcaccaaggtccccattttcctggggatccagggagggagccgctgcctggcatgtgtggagacagaagaggggccttccctacagctggaggtgaga

SEQ ID NO: 1948 - DNA, 201 bp, Homo sapiens
ggcacatggtggctgtgcactacagctgagtccttttccttttcagaatctgggatgttaaccagaagaccttctatctgaggaacaaccaactagttgcyggatacttgcaaggaccaaatgtcaatttagaaggtgagtggttgccaggaaagccaatgtatgtgggcatcacgtcactttgcccgtctgtctgcagca

SEQ ID NO: 1949 - DNA, 201 bp, Homo sapiens
agcagctcagttgagttagagtctggaagacctcagaagacctcctgtcctatgaggccctccccatggctttaggtaagctccttccactctcatttttycacctgagaaatgagagaggaaaatgtctacaattggtgtttatcaaatgctttcaggctctggtgagcaagcgtccaggaaaatgtcaagcgcatggag

SEQ ID NO: 1950 - DNA, 201 bp, Homo sapiens
aatcttctatttacctgcagaccaggaagatgagacctctctgcccttctgacctcgggattttagttttgtggggaccaggggagatagaaaaatacccrgggtctcttcattattgctgcttcctcttctattaacctgaccctcccctctgttcttccccagaaaagatagatgtggtacccattgagcctcatgctc

SEQ ID NO: 1951 - DNA, 201 bp, Homo sapiens
gcgctgggcatccaaggtggtccctcatcctccaggctctctttccatgtgatctctcagtgtttaagagttagttggagcttccttacagcatggcggckgacttccaaaagggattattccaaaaagagcctcaacatgcaggcgcttattatgacttctgcttgcatcatcctattggccaaagccagtcacgtggct

SEQ ID NO: 1952 - DNA, 201 bp, Homo sapiens
tcctgtgtcaagtctggtgatgagaccagactccagctggaggtaaaaacatgctttggatctcaaatcaccccaaaacccagtggcttgaaacaaccaawattttttcttatgattctgtgggttgaccaggattagctgggtagttctgttccatgtggtggaacatgctggggtcactttggaagctgcattcagcag

SEQ ID NO: 1953 - DNA, 201 bp, Homo sapiens
agaccttctatctgaggaacaaccaactagttgctggatacttgcaaggaccaaatgtcaatttagaaggtgagtggttgccaggaaagccaatgtatgtrggcatcacgtcactttgcccgtctgtctgcagcagcatggcctgcctgcacaaaccctaggtgcaatgtcctaatccttgttgggtctttgtattcaagt

SEQ ID NO: 1954 - DNA, 201 bp, Homo sapiens
tgttaaccagaagaccttctatctgaggaacaaccaactagttgctggatacttgcaaggaccaaatgtcaatttagaaggtgagtggttgccaggaaagycaatgtatgtgggcatcacgtcactttgcccgtctgtctgcagcagcatggcctgcctgcacaaaccctaggtgcaatgtcctaatccttgttgggtctt

SEQ ID NO: 1955 - DNA, 201 bp, Homo sapiens
ccaaggctgtaaggaactgcctgagcccagagaggtggagcccagcactggtgccctttactcctggggacatgtgctggtttcaaaaacttcagctgagyttttgagcattcatggaacttggtgggggagatgaaatttgtaccttaaatcctgcctacagggagggtccctgataatccccacccaatttggaaatct

SEQ ID NO: 1956 - DNA, 201 bp, Homo sapiens
atggtccctggtgggttgtgctacaatgttagcccatggtcttatgtgtttttcaaatgtgtaaagtaggatgctggaaccactcttagaaccagataccratacattgtgaagaaataaatctctgtgcttaaaactggttcatcccaaaatattttgaactgacacacaataggtgctaaataaatgtgtgttaacttg

SEQ ID NO: 1957 - DNA, 201 bp, Homo sapiens
tgtgtgttaacttgaattggattgaattcgggaaaaaagtgcaataagcttagtgaagacaccatgttccctgggtagaggaaccacattctccatctaakgccaggagtatgggaggtatcaatgtttgcccagcacagaacagggtgccaagaagagaaaagttgacggggtgcatactcggactggaaactggaaggg

SEQ ID NO: 1958 - DNA, 201 bp, Homo sapiens
tccatctgtccactgtctccaacacgatctttataaaacacacctgacaacattacccttttattcagttttttaaaagataagtttccagctcatcgggstggctttaaaggccatttctcctctggacctcacccaacttttcaaatcacttttcctacccctacctctaaatgctactcaaactccagccatcctgaa

SEQ ID NO: 1959 - DNA, 201 bp, Homo sapiens
ccttggtttccccgtctgtgacatctgtgacatgagagtcacgataactccttgtgtgccttacagggttgttgtgaaaattaaatgcacagataatagcrtaacagtattccgtgcattgtaaagagcctgaaaaccattatgatttgaaaatggaatcggctttgtgagaccatcactattgtaaagatgtgatgctga

SEQ ID NO: 1960 - DNA, 201 bp, Homo sapiens
tcgagcatgtgggctcttcagagccacctgatgaggtgggtacagttagccacacttcacaggtgaagaggtgaggcacaggtcccaggtcaggctggccrgagctctgtttattacgtctcacagctttgagtcctgctctcaaccagagaggccctttaccaagaagaaaggattgggacccagaatcaggtcactggc

SEQ ID NO: 1961 - DNA, 201 bp, Homo sapiens
ctcacagctttgagtcctgctctcaaccagagaggccctttaccaagaagaaaggattgggacccagaatcaggtcactggctgaggtagagaggaagccrggttgttcccaagggtagctgctcctgcaggactctgagcaggtcaccagctaatggaggaaaggctctagggaaagacccttctggtctcagactcaga

SEQ ID NO: 1962 - DNA, 201 bp, Homo sapiens
gttaatgggtttcccagccctgggaaaacatggctttgtctcaggggcttgctggatgcaagcttaacctcaatgtgagtggccatactgtggcactgtcmcatccctcaccagggacactgttctggagggtgactgcctgttctgtgaggagtggggatggctaggacattgcatggaacacaccaccaccccatcttc

SEQ ID NO: 1963 - DNA, 201 bp, Homo sapiens
cttcacccactctgttcctcagctttcccttcagtgggatgatatcaactggacaacaggatgtgcgattcttttagttccagccttccaggatgttttcrctcccctgtttgttgttgtaggatggtattacctccaccttcccaccttccctatgccctggttctgtctcctgtgcctcgctctgaaagtggatgagac

SEQ ID NO: 1964 - DNA, 201 bp, Homo sapiens
ttgttcaaaccctaactcaatcccaaattaatccaccatgtataaggttgagctatgtctcttattcctggacaccatactcagccatattctggtccacrcattaaacaagctggatgaccttgaagaagcttcacccactctgttcctcagctttcccttcagtgggatgatatcaactggacaacaggatgtgcgatt

SEQ ID NO: 1965 - DNA, 201 bp, Homo sapiens
gtctttgtattcaagtttgaagctgggagggcctggctactgaagggcacatatgagggcagcctgaagagggtgtggagaggtagagtctaggtcagagktcagtgcctataggcacagtggtcccagggccacagctgggaagggcaaataccagaaggcaaggttgaccattcccttcctcaagtgcctattaaggct

SEQ ID NO: 1966 - DNA, 201 bp, Homo sapiens
tctgcagcagcatggcctgcctgcacaaaccctaggtgcaatgtcctaatccttgttgggtctttgtattcaagtttgaagctgggagggcctggctactraagggcacatatgagggcagcctgaagagggtgtggagaggtagagtctaggtcagaggtcagtgcctataggcacagtggtcccagggccacagctggg

SEQ ID NO: 1967 - DNA, 201 bp, Homo sapiens
gaaggtgagtggttgccaggaaagccaatgtatgtgggcatcacgtcactttgcccgtctgtctgcagcagcatggcctgcctgcacaaaccctaggtgcmatgtcctaatccttgttgggtctttgtattcaagtttgaagctgggagggcctggctactgaagggcacatatgagggcagcctgaagagggtgtggaga

SEQ ID NO: 1968 - DNA, 201 bp, Homo sapiens
accaactagttgctggatacttgcaaggaccaaatgtcaatttagaaggtgagtggttgccaggaaagccaatgtatgtgggcatcacgtcactttgcccstctgtctgcagcagcatggcctgcctgcacaaaccctaggtgcaatgtcctaatccttgttgggtctttgtattcaagtttgaagctgggagggcctggc

SEQ ID NO: 1969 - DNA, 201 bp, Homo sapiens
caggaagatgagacctctctgcccttctgacctcgggattttagttttgtggggaccaggggagatagaaaaatacccggggtctcttcattattgctgcytcctcttctattaacctgaccctcccctctgttcttccccagaaaagatagatgtggtacccattgagcctcatgctctgttcttgggaatccatggagg

SEQ ID NO: 1970 - DNA, 201 bp, Homo sapiens
tcaaacaaggcctttgcccttgctgttccctccacctggaatattcttccccttccttgacattgctcaggtctccactcttatgtcaccctctcagagasggcttccctggccactttccctaaaatagccacccactcctaggtccctcaaaagcatatcctgctttggattttccctatagcaatatgccctatgaag

SEQ ID NO: 1971 - DNA, 201 bp, Homo sapiens
tatcaaatgctttcaggctctggtgagcaagcgtccaggaaaatgtcaagcgcatggagctccaggcctgtctgggggatctgggcacggggaggcatccrtgggagaccatgcaggcactctgaggcaggggctgcaagcctagtgcctgctggggcagcaggtgaacagagaggtgtaactgctgtgacagaagtcatg

SEQ ID NO: 1972 - DNA, 201 bp, Homo sapiens
aataatatttcatcttcatatcttgcctctcatccctctcatcttttctttctggaaaatttccagaagactcttcagaaatgtcagcgcgttgcctgccrtggtttggttgcatggctgttcacaggaaaaatactgtggggatgaaagttgataaggacagagtgactcaaatgatgtagagccaagcagccccagaag

SEQ ID NO: 1973 - DNA, 201 bp, Homo sapiens
cggtggtgaggattgtggggatgggaagggaagtggcttgagacacagagcaaataggtgggcaggtccaggctagctcatgtggtgtaaagacagcatakgtggttgacctcaaattggatttcaggggtctttacacacacacacacacacacacacacacacacacacacacacacacccctattaagtggccctaaa

SEQ ID NO: 1974 - DNA, 201 bp, Homo sapiens
gcataaaatatccttcctatatacctgccccaaattaagtattatttgatagaaacacttagataggaaatctgaagttatactgatgtgatataacaagstgaaaggttcagggccatgggtggtcaagttcaagtgcacttttaaacactatcattttacacacatgtacccagaaggaaagttctcttaccttttaaa

SEQ ID NO: 1975 - DNA, 201 bp, Homo sapiens
gaactgcttcctgtagtaatgttacctgctggttgaaagacgttcacatgaaaggagaatactttgttaatgtgactaccagaatttggaacgggactttygcatcagtaagtatcagttttatttgttagatttatcaatagcaaggaaacataagtctgcactgacaagttcttcccctttgacaaaataagtattctg

SEQ ID NO: 1976 - DNA, 201 bp, Homo sapiens; identical to SEQ ID NO: 815

SEQ ID NO: 1977 - DNA, 201 bp, Homo sapiens
atctgtacttacatttatagaaaacatttaatttgttaaaaaatttttccttcttatcaggttatcaacactggcaatagtatggctcccaatgttagtgyggaaataatggtaccaaattcttttagcccccaaactgataagctgttcaacattttggatgtccaggtaaaaatgtatttcttccatctaacctttatt

SEQ ID NO: 1978 - DNA, 201 bp, Homo sapiens
gccactcaatcctgccctaaccttcctctcctgtctttctcacagactgtttttgaaaggaattgccgttcagaggactgtgccgcagacctgcagcttcrgggtaaactgctgctctccaggtatgtcggtgtttccttcagagcattgttctcaggctcctttttcttgaccccaggtcccaaacctgaatgtgcagat

SEQ ID NO: 1979 - DNA, 201 bp, Homo sapiens
tccatcaacatcacagcgcctcagtgtcacgacggacagcagcctgtgaactgcctgaacgtcaccacctgcttcagcttccatggcaaacacgttccagragagattggtaatgagccaccaagtcagggctcaggatacccgtttagctggagtgggctagtgggatatttccgatgttccctgtcgctgttcctccca

SEQ ID NO: 1980 - DNA, 201 bp, Homo sapiens
aacacgttccaggagagattggtaatgagccaccaagtcagggctcaggatacccgtttagctggagtgggctagtgggatatttccgatgttccctgtcrctgttcctcccagctggttttgcaggcagcaggcacacaggctggacatcctttccctctgaggttcctccccttctatttcctgcttatcaacatgttt

SEQ ID NO: 1981 - DNA, 201 bp, Homo sapiens
gaggctatttctacctgcccggagggcaccagctggccagagaccactgggcagaggaggtggggtggctcatctcgaggctacccctatttgatgatttytgtaggagtctgcttgactctgagacctggggaaggagtcgatttggggatgtgtgagtgagatgacattcagtcaggttgtgccccatcattggcggct

SEQ ID NO: 1982 - DNA, 201 bp, Homo sapiens
aggggccagatgcctctctcctcacactgaccgtgagagcgagtgctcctcatcaacaacgtggggccaggcttgagtcagcagcactgactttatgtgayctagtgcagctcgccagcccacgctgatgtgtgttaatggagggggtgccccttataggagggtggtgtgggctataatttcttctgcattctctgccta

SEQ ID NO: 1983 - DNA, 201 bp, Homo sapiens
gagttggtgtgtgacacttgcacaggtgccagtgttttctgtgtgggagcactttcctgtatgcattattttcttcttaataatggcacctcctgagagtwtccaggtctcagatcccttctggtgacacagccttgccttgtaagtcaactgtttgctggcgttaaacaagttggggcagatggctctgctgactaggaa

SEQ ID NO: 1984 - DNA, 201 bp, Homo sapiens
aaataatgttggaccccaagcattctttttgcaaatatgagggctagactgaagcctcattggaccacaggtcctatgggactggtggagatatagtgccyggagcctggcccttagggaacattcgagcagttagaaagcagaagtgacaggactttggaggctccttattgagcttgtagcatcagccagatgtcaggg

SEQ ID NO: 1985 - DNA, 201 bp, Homo sapiens
ctgcatggggctacaacattgcagttcatgctcataatggcagcaaatgcttgagggaatccctgagtatgcatctatttcttgaatcatggcatctgctmtaggaaatcctcttaaatgtattcttatctccctaataaaatggaaattggtacttaattggtaaaattttaaataattacccagcatctggtggttcat

SEQ ID NO: 1986 - DNA, 201 bp, Homo sapiens
tcagctggctatgttaagtaggggcttggctcagcctggcctaactgatgttagattttgagttactttaggttttgggtgggactagaaaagcagggagrgctaggagaccacgcatgtgcaagcacacatagatatatattgcccatcgttcctaaccctcctaagggcaggaggccagaggtatgtgggttaggaatg

SEQ ID NO: 1987 - DNA, 201 bp, Homo sapiens
gaaagtcaaagtgagcccctagatagctgtaaacctggttctattgtactttgaaaacaaagcatttctcttgtcctccacagtgaggacatcaggaagtragcctcccctgggggaccatgcagataaaggcagaaggagtaggtcagaccccagaagatgggacttttctgattcaagaagttcagtatctttgtgagg

SEQ ID NO: 1988 - DNA, 201 bp, Homo sapiens
gattatagcagcagctagattgacttttgagagtgtacgcgtgtgtgtgtgtgtgtgtgtgtgtgtgtcttgggaggcatggaggcatatgtacctaatgyctaggtctgtttggacagcagtgttcctcacagcctcttggcctctctctctggcttgtttgagcctcttcacctcgctgcatacacagcatacagacgt

SEQ ID NO: 1989 - DNA, 201 bp, Homo sapiens
ctcctcaattctgttcctgccgagttagaactgctgtacgccagcctaggatccttccatgttgttctcccattcaagtagacctttttgcaattttaacwatccgaataggtacacttagtgtataattgtcattatcttttgaataaaaaatgcatcaccaaacttggttttgcatttttcctcagaatggctctgcct

SEQ ID NO: 1990 - DNA, 201 bp, Homo sapiens
ccctgggccccagctcttgtcatgacctgcccctttcctcctggaacctgctccttacacttctttgccttggttcttatgctcacagaagtcagaggccyggtttgtgtcatattcatgtagaaccatctaccacctgcatgatttttacatttttttggtcttaaactcatactgcctgtgatattttctttcatattt

SEQ ID NO: 1991 - DNA, 201 bp, Homo sapiens
ttcttgctttggctgagaagttatcctttgttcctagttaccaagggtactggctatgagatgccacgtagagtggcaatagtgaagtgcaggccagaggmagggctgtttctatggtggccctgagggttactgggaaggatcagggttgcgcaaggggttggtcctgctactttctgatatctagggttgccagactta

SEQ ID NO: 1992 - DNA, 201 bp, Homo sapiens
agtctgctcagcagctgcctccaccacattggttcacccaactgtggcctctggcttgtcttccagcaatgtgtatctgtagccatgactttgcttaagcraacttggaaattcacttcatttaaatgtaatctttcttacttcagggcagttgttcagggaagttgtgatcagtagaaagtaaattggctagagttcagt

SEQ ID NO: 1993 - DNA, 201 bp, Homo sapiens
cctcaggagaagagatgcaggtactggcagttgcaatttgggccggacagcagagaaatggtaaaagccaagaggatatgggtgggggagcaataccatcmgttccatcttcctgtgttcctttccacccaggttttctctgagctcagctagttcatctctggtaagatagtccagtctcgctgttctctccattgtctc

SEQ ID NO: 1994 - DNA, 201 bp, Homo sapiens
cattcttggcctgggaacagcctgtggccccttggagcctcctggctagcataggtgaaggtggtgaatgctttgcccaaggggaccctgcccctcacccrtggacggtgcttgtacctactcactggccaggctgaagcctaaacttgcttgtcaatctctggaggctgggaatcaagctggcagttctgggctttcacc

SEQ ID NO: 1995 - DNA, 201 bp, Homo sapiens
agctgccgtgagaaactgttgctgggataagctgctaggaataggaagcagggaggaaggagcgagttcctttgccctctccagccttgcaggctccctcygatgctccatattagcagagcctcacagcaagcctctggcaaaacaagtgaggtttgcagggtcccagctccagtgtcacagtgcagggtagagaagggt

SEQ ID NO: 1996 - DNA, 201 bp, Homo sapiens
attcagcaaggaaggcagcctcttggctctgcacagtttggaaggtcagtcttcagatggaggaaagatgggcacttccaggacacagataccctccactyccatccaagctcagcagagggtgctggccaactctgtcatctccaggcctctgcctcaggaacccacagctgagacactgggttaccagccttcctactc

SEQ ID NO: 1997 - DNA, 201 bp, Homo sapiens
ctgagcgcagaggagatgtgggtgcctcctcatgctgttcccgaccagtggctctttctggggccccatctagcatgagcctttcacagactgctaagcayaattagaatgaaggtctaggcttagccatagccccagaagtgttggggtaaagtggaagaggctggcagttggatggcatcttgtactgtaccttgtggg

SEQ ID NO: 1998 - DNA, 201 bp, Homo sapiens
gccacacctcaaatgttctaccttatttaatatgttcatccttcttggctgtctcattggcaatttctcttgatcttcaggtatattgaataagctcaackattaaacatatttattttatcattttttaaaaagagcttagaaatttcaacattgaatgaaaccataccataaaacttgggaactggttagtgagggagg

SEQ ID NO: 1999 - DNA, 201 bp, Homo sapiens
caggactttgggctccgctttggacttctgaatcagaatcttcattttcacaagagccccacaagattcctgtgcacatttaagtttgagaagcactgctstggagcacacatgtgtgcacacacgcccactcatgcagaaatatttacgtgagctagttcattcctcagccacacctcaaatgttctaccttatttaata

SEQ ID NO: 2000 - DNA, 201 bp, Homo sapiens
acagaggcttaggtttctaaaagaggggtgctgctttggcagctcagaattgaaaagaggcaggcattgtcctgacagctggtaactgtccctgccatttktctggctggggaaaatcaacttgctagcccagctctagagactggattaaaccccagaacaagatagaaccagtgttgattggaattcagagcacgtgat

SEQ ID NO: 2001 - DNA, 201 bp, Homo sapiens
cactttgctattaccagctgggactccacttatcaagttcttttaggaaattacccaatgaattggtggaggtaaatgatgcaggaggtttgaccaactgsatggggctacaacattgcagttcatgctcataatggcagcaaatgcttgagggaatccctgagtatgcatctatttcttgaatcatggcatctgctatag

SEQ ID NO: 2002 - DNA, 201 bp, Homo sapiens
tttactctttgtttttgtgggatgtccttggggagcccacaggtgctgtccattcatcaagcactgggagatggtccatggcagggaggagagtatggctwtttattgagtttcatttggtcataagactgggcaggttgatttcttctgccctgaagcactttgctattaccagctgggactccacttatcaagttcttt

SEQ ID NO: 2003 - DNA, 201 bp, Homo sapiens
atgactccatgagttttgaccactgcatacgctgtgtgactaccaccccaccacaataaagaatacttctgtcaccccagagagtttccttgtgcctctgkctggtcatacccctctcctgatagacaaccactgttctgacttctatcaccatagatccatcttgcccattctagaatttcacattggtgggaatataca

SEQ ID NO: 2004 - DNA, 201 bp, Homo sapiens
actcagtaggaaaacttacgaatatggaaactattttgccatgaggcatacatagtctgaggggcatttatctatccagaccatcctcttttcattagaartacataacaggagattaataaacttcggtgattcagcccacaaggcaggaggaagagagctttgggcacagtttgggggccacatctgagtcacaagagc

SEQ ID NO: 2005 - DNA, 201 bp, Homo sapiens
aaggcagagagtgtagtcattggctaccatgacattctccttccctcaaaaatgcatctcaggctatgggagaccatcctgctaagcaggtaaaagggackcattttgccagcaggagagagaagtttgggttcctgtaattctgcccaggtgtttcctgtcaatgagtgtgctctagcagggcagcattcaaactctggt

SEQ ID NO: 2006 - DNA, 201 bp, Homo sapiens
cataggagcaatcagttgctggtgttcctctcctcttccccactacactgaaagaaagaaattaatgcatatttgtgttttggggtggaggtttcattcayccaagaaatcatctcaccttgactgttttcaaggtgtaaattgtgtttatagtgaaaaagaagacttggtcatgataaaagccagacactcgtgggatgg

SEQ ID NO: 2007 - DNA, 201 bp, Homo sapiens
tctgtagaaatggtaaaaatgcctacgtctagttcacagtgatgcgggtgcctctatgctaatgatagcagctttcttttctccctaattgcagaaaacaygatccagttttatagtttttccttcagatgattgtgatgaacttcatagtccctgtcaagtcttaagatgacccctccgcaaacccctctcactggctat

SEQ ID NO: 2008 - DNA, 201 bp, Homo sapiens
atcccgggcactcctgcccagctgctcatgccaacttgcagtacacagaggaaatatatggcttctcccaggcccacctacataccccggttcctctaggkgttctgctaataaatgcatcttgggaaaaagctgcattgcttattgatgggattccacaaatgtgatttaggtagtggtggcctttgcttagagaagctt

SEQ ID NO: 2009 - DNA, 201 bp, Homo sapiens
caaaaaaagagtactttttacttctaattcatctgcagtcctgttgttttagcctccaaaacacatcccaaatatgacagcttttattactattacaatcrcctccattatcaccatcatgcttctagaaaggccaccaccatcacctggaggtacactggccctgattggtcttcttatgtctattatgcttttttaaaa

SEQ ID NO: 2010 - DNA, 201 bp, Homo sapiens
ttctgtaggagtctgcttgactctgagacctggggaaggagtcgatttggggatgtgtgagtgagatgacattcagtcaggttgtgccccatcattggcgrctgtgcagatacatgaagcgtgtgagcatcccctcctagcagccttctctccttagtggagagacttgtttgtttttcgagacagagtcttgctatgtca

SEQ ID NO: 2011 - DNA, 201 bp, Homo sapiens; identical to SEQ ID NO: 1908

SEQ ID NO: 2012 - DNA, 201 bp, Homo sapiens; identical to SEQ ID NO: 1909

SEQ ID NO: 2013 - DNA, 201 bp, Homo sapiens; identical to SEQ ID NO: 1910

SEQ ID NO: 2014 - DNA, 201 bp, Homo sapiens; identical to SEQ ID NO: 1911

SEQ ID NO: 2015 - DNA, 201 bp, Homo sapiens; identical to SEQ ID NO: 1912

SEQ ID NO: 2016 - DNA, 201 bp, Homo sapiens
ttagctattgggaagtggtagggcctgcaggaggtagagagtcgccatagctctgattgctggacttctctttgggctcctgtcttacaggccctgcctcygggctcacctcgctgtgacctgaaggagaatctgctgaaggataactgtgccccagaatccatcgagttcccagtgagtgaggcccgagtactagaggac

SEQ ID NO: 2017 - DNA, 201 bp, Homo sapiens
attaaccaaaattgaaaaattaaaaattcagttcttcagctcatcagtggccacatgtagctagtggctgctatattggacagatctagaacatttcaacrtgatagaaagttctcttggatagcactgccacagagagtccctgctgacagattggggattataattttaagtccttctactcagcagggtactgagttg

SEQ ID NO: 2018 - DNA, 201 bp, Homo sapiens
gccagcaggtggttacctgagttcctggcctggctgcggctcagctacctgaggcttcctctgtcccacaacaagtcccagccctctccagttttatgacygctccaatccagccctcagtctctctgtctgcttctttttcagatctgctgagtttcctaaaaaggcaacctccctggccgcctggggggaggggcggga

SEQ ID NO: 2019 - DNA, 201 bp, Homo sapiens
cagctctcccggccgctgggcctgctctcgcgccatccgggccaggtccaacacggccaggctgagacactcaccctgctccttgagactgaggcccacgsggaggcgcccactcaccaggtcactgcggtgctggggggccgccacagggagcatcagctgaggccacccaacttcaagccctgttgttaacctgcagac

SEQ ID NO: 2020 - DNA, 201 bp, Homo sapiens
tcccgagtgtcctccgtgtggtacagcacagcccacctgccggcagctgacacgttgacccacaggcatgggtactggggcaccttcttgcccttcagctyctcctggtccctgatgttggtctcaatcaggtggcacttggattcctgggtccacacgctgaggagaccacacacatgcacacatacacatctcagaact

SEQ ID NO: 2021 - DNA, 201 bp, Homo sapiens
agcatcaagcgtggcactttatatacagcgtctctgacttgataacagctcttcaaggtgcagcattagcattccactttacaagggtggaaactgaggargtgagaggctaagtggcctgcctatgtttacacagccagttagcggcagattcaaacccaggtctgtgtgactccaacacagaagagctagggctggctc

SEQ ID NO: 2022 - DNA, 201 bp, Homo sapiens
catctcgcaaaggggatcaggaaagcacctactacatgaaggcacatgccagggacagatggattggaccccaagctggggctatgtagactacatctttrggtcagaacatctagattcacagtatcttgtatgttcctgttgtcatctcacatctcttgccaacgcattgttgaaacattcttacttggtcttgttatt

SEQ ID NO: 2023 - DNA, 201 bp, Homo sapiens
tttttttcagcatcagcataagaaacttgtaaaccgagacctaaaaacccagtctgggagtgagatgaagaaatttttgagcaccttaactatagatggtrtaacccggagtgaccaaggattgtacacctgtgcagcatccagtgggctgatgaccaagaagaacagcacatttgtcagggtccatggtaagctatggtc

SEQ ID NO: 2024 - DNA, 201 bp, Homo sapiens
ggacagtgggagccctgcccccctctctccaccactgtcaaacttccgagggaccgcttcacttggtttcacagagctgaaagcactggtgattttcggastttcctggggctccctaggttcagctggataggacgcgggcagtggttttgcgtcacttgatcttgaagacattctcgtcacaggaaatgggctacctgc

SEQ ID NO: 2025 - DNA, 201 bp, Homo sapiens
ttactgaatctgagaaaaagttcatcaaaggaactgctgacttttttgctctttgctttggacccaccttgagttttcaacttttggaccctcacatgaarttccgccaattggaatctcccaacctgaggcaactgctttcctggattgaccttgaatttaaccatcctcaaatatttattgtggaaaatggctggtttg

SEQ ID NO: 2026 - DNA, 201 bp, Homo sapiens
tatcccgagagcatgaagaataacctttcatctattctgcctgattttactgaatctgagaaaaagttcatcaaaggaactgctgacttttttgctctttsctttggacccaccttgagttttcaacttttggaccctcacatgaagttccgccaattggaatctcccaacctgaggcaactgctttcctggattgacctt

SEQ ID NO: 2027 - DNA, 201 bp, Homo sapiens
tggaaaaaaatctctaagattatctaacataaatgatgtgaatttatatttttaaatcctaatggagacattcattttggcaatagtagaatgcattcatktaacacctttctcatttggagtcttgaggaacttgaattaatttttaaaaacccatttgtaaatgagaaactgggttataatatttgtaattacttaact

SEQ ID NO: 2028 - DNA, 201 bp, Homo sapiens
atctctggactttgtactaggttggtttgccaaacccgtatttattgatggtgactatcccgagagcatgaagaataacctttcatctattctgcctgatkttactgaatctgagaaaaagttcatcaaaggaactgctgacttttttgctctttgctttggacccaccttgagttttcaacttttggaccctcacatgaa

SEQ ID NO: 2029 - DNA, 201 bp, Homo sapiens
gtattggttctagctgatttttatattgttagtcattaagttaggcttgatgagaaacagatataatctgatttggggattcaagtattatattgcatttstcctcacaactagagataaatttgccatggtttttctcttcataggctcatgccaaagtctggcatctctacaatacttctttccgtcccactcagggag

SEQ ID NO: 2030 - DNA, 201 bp, Homo sapiens
taagctattataacaaattcttttatttcattagcttttcaaaatgtggataactacacactcaacccaaggaatctacatttttccactgactgctaaaraccaatggaaataactctagtccccgtagcacctcactgtggggtgacctacctttgaaataatgtattggttctagctgatttttatattgttagtcat

SEQ ID NO: 2031 - DNA, 201 bp, Homo sapiens
tagagtaaaataaaaggttttggcaatcatatacagcagtagactttaccttgaagatttaacaaaggtttgaaagcaaaatgctatgatactgaatataytaatgtttgagggcttgtgaaaaggtcttaatataggaatcatatatcttcttttagattgtgtcttggggaacattgggggtcagtttttctatcagtg

SEQ ID NO: 2032 - DNA, 201 bp, Homo sapiens
aacattgggggtcagtttttctatcagtgttagtatgtagtaagtaatggcatacatctaagcttgagattttgctcatttctgtattcttagcacttatrtatccaacatataataggtgttggataatatttgttgaataaatgactaaataaatgtcttggcatgagaattatgccatctacaaaaccgtcactttta

SEQ ID NO: 2033 - DNA, 201 bp, Homo sapiens
taggatgctgtaaagagtaatcaaataagtttcaacagggttttggcatgaggtgagcagttaatccaaatgatatctgaaatgctttctaatgctgcaartgtattcctctgtaaaataatcaactacttaaaagacactctcacttgcattatgtcatttaatcctcacagtgtccctacgggacaatagatgtcattc

SEQ ID NO: 2034 - DNA, 201 bp, Homo sapiens
atattcataaagatccaacatcagactaatagaagttctggaaagagagaataaggaaatacaggtcaggaaatttgtaaagaaataatataataaaatgscccagaactgaagaacatgagcttttaactttaaagagccgactgagttcctagctcaatgaatgtatagacatgtaagggtattgaaagttcaccttca

SEQ ID NO: 2035 - DNA, 201 bp, Homo sapiens
gcttttatcatcccagagagtctcttcccatgtcagcaactccagattcacttcctctcctaatataggacagtcacatgtctctattccagcaaaacaayctcagggaaggtatctcattggcctggcttgggtcattcaacttgaagtacaagaagagaaaacagtattcttttatttttatagatttcctgtaaaatc

SEQ ID NO: 2036 - DNA, 201 bp, Homo sapiens
tttggtgaaaaataaatcccagttactagacttcccagtattaataattttggtatgccaggaatttttaaaacatttctaacaaattttttcagaaatcrgaatgactgaaaggtataacaataggaaattaggaaatcaataagtaatcattgaaaagtgagtgattgaattagttggaacaatctatgccatccatcc

SEQ ID NO: 2037 - DNA, 201 bp, Homo sapiens
aatcagagaagcagaagaacataataaatgcccactgtcctactcaatagagactataactgctatctctgtacaaatcctttaaaatcctgtcttatgtrtatttattttacatctgtacatatgattccaaaattaggtaatactgtacgtggtctatctatagctaactatagtttgtaatttaataagctatatttg

SEQ ID NO: 2038 - DNA, 201 bp, Homo sapiens
catagtagttacttaataaatatttgagtgaaaggataaatgaatgaataattccacattattggatgttcaagttgtttccattcaactttattgttgtrggggagtataatacaatcttggtgaagagccaccaacttaggaagaactatgaagaagcatgttatttactcctgcttgtgggtggggtgcattgggaaa

SEQ ID NO: 2039 - DNA, 201 bp, Homo sapiens
tgaatggagttttcaaagaggatatgttaggggaataaaggctgataaacaacacttgtatttgtaggaaaatagggagagtaaatcaaggaattcaaagrgaaagagaaactcacttcaagtaggggagaaaaaacccctataattttcactcttccttgtaaataaaaaggaaacaaatgaaaataagatattagaagt

SEQ ID NO: 2040 - DNA, 201 bp, Homo sapiens
ctgataaacaacacttgtatttgtaggaaaatagggagagtaaatcaaggaattcaaagagaaagagaaactcacttcaagtaggggagaaaaaacccctrtaattttcactcttccttgtaaataaaaaggaaacaaatgaaaataagatattagaagtcagtaagaatttatgggagtataaagttggttttatggatg

SEQ ID NO: 2041 - DNA, 201 bp, Homo sapiens
ttgtactgattcttcttgggaagaaagaagattgcttgttagaattttagctacgagagatgactatgaaacagtaaattaactccaacgacctgagtcaytttgaaaactcccagtctcaggataaaaaatataatcctatttagaaattcctggtgtgatcacagatgtagcattggttcttttcatgaaacccgtaaa

SEQ ID NO: 2042 - DNA, 201 bp, Homo sapiens
caagagtccgtctcttaaaaaaaaaaatgactggatgtgtcatcttttatgccaggatatgtgagcccaggagaaaggcttctgagctccctcctgctcgstgtgcaattttctgccctgccccgactctctccttctctcccagcctcctgctatttgaaatctccttatcctaatttccctcctcagagtggattccac

SEQ ID NO: 2043 - DNA, 201 bp, Homo sapiens
taccgccatagccacagaaccaacccttcactttccttaagtctatggtcacaagctccttctcaaaggaggcacacctctaaccacccccatttggtgayttcctgtctcctggaggcccccggaactagtcttctctacttccagcaacccactttacgagcagcggagaagactgactacttctgggggcctcgagga

SEQ ID NO: 2044 - DNA, 201 bp, Homo sapiens
ggaacccctctgtgtctccagtaataattctgtgattaatgggttagatggattctggtcacaagctggatattttgttaacaacctagcgtcaatgactkggaatgattttcaccgcagcatgatttagtattgaatagaatgatttaactaatgttaattagttctgtacagataaattaatgaagcaagaagctcaat

SEQ ID NO: 2045 - DNA, 201 bp, Homo sapiens
gcccaagttggtctcgaactcctggcttcaagtgattcgcccgcctcagcctcccaaattgctgggattataggcgtgagtcactgtacccagcctgttgycagtatttttagttgtaggcatcttagtgggtgtgagtgctcgttggggttttaatttgcattttcctgatagtgttgatgttgaggacatttctatgtg

SEQ ID NO: 2046 - DNA, 201 bp, Homo sapiens
ctggctaaaaatacgagctcaggggtgcaaccctgccttggtgctcacctggttgatgcacagcacagggctctggaaggcactgctcagctcacgcagcrtggcccccagggactgcagatgcctggccctgggggcggaggcctggctgtcaaattcacagcggaatggggctgccaccgagtcgatgaccaccaggcg

SEQ ID NO: 2047 - DNA, 201 bp, Homo sapiens
ccttggtgtacaggctagtcacttttgtttacctactgaattttacctagagacaatgtttttaaccatcttgccccttaaaatatatttttatgtatctrtataaactatttttcaaccatatccacttctctttaaacaggggttaaattaaaaatatttagcaagcttttttttttttttgagacggagtctcgttct

SEQ ID NO: 2048 - DNA, 201 bp, Homo sapiens
tgtttccagaacagaacttagtaacactgtcaggttttggcggcccagccctgaccttctatcttctcttgcagtgaccccgacctggccccgctccaggrtgggactgccgagtgtggcccggagctggcccgggacagccagggcggcagggagggcccctggccgggagccgcagcgctcactcatttctcctgcgtc

SEQ ID NO: 2049 - DNA, 201 bp, Homo sapiens
gccagcagccaggcagtggtcaaggatctgaggtcacctgtctgagctgggtgcccagcaggccttggccaggtggagcccctgtgcccctagtgagggcygtcttcccctcaggggcaaggggaaaccaacacagctatctcaccagggcagcagcctggagagcaggtcgcatccttctcagggcggtggtctcctggg

SEQ ID NO: 2050 - DNA, 201 bp, Homo sapiens
accacatacaccagatattcggctcagtttttctcaatattcataagtaacattgaaaacaaagagttatgtggtcaaagaaaggacaaactggttaatgrtaatcgtcccctgtgggccctgggcgttggtgtcacacagaactgagaagcaaagcgggtggtgacagaccctggtaatgtgcagggagcgtccggatcg

SEQ ID NO: 2051 - DNA, 201 bp, Homo sapiens
gccactctgttcacgtggagtttaagacaacgtgggaatcgcatgttgacaccagggaattagtttaaaagttaaggagctactgagaaacatctctcctmctcacagctcacagtttaaaactacgtgaacttttaacacctgagagacccaggcaggcatgctctgaacgctttagtccaatgcagggaaccctcgttt

SEQ ID NO: 2052 - DNA, 201 bp, Homo sapiens
ccctcacaccccactgataaggaggttctgctttgctgtcttctcccgggtacttgaggggagacggcagcacgtgagcagcaacattcagagcactgttygtcgttactgtcagcgcagaccaagtcgtctccagggaaagcatgctgataccacacagacctggcccagatgtttctgttgacagagtggccagtggtc

SEQ ID NO: 2053 - DNA, 201 bp, Homo sapiens
acttgcatctgctagtttgggaaacataaaagaatatatgttgcatcatttggatataatacataaatactttgctgtcagggtggaaaaacaggccttargttttattttcctcctcctgaagacccttcccttcagtcataggaacctcaaagatgttcagatcaacactttaacctagtacattttaatcttgtttgt

SEQ ID NO: 2054 - DNA, 201 bp, Homo sapiens
ttggtttacggggtggcttctgaagggactctgcaccttgtgggcggggctgtggccgagcagccagcctttcttccctgcaggagcctggatacctcccrgccctctctaatcacccagacccctggccactgaatccaagcaaagccccctccctgccgggaccctggggctgttctgcagggaaacgtgagtctctca

SEQ ID NO: 2055 - DNA, 201 bp, Homo sapiens
agtggatactgctgtgtatcatttaggatttgatttggctgccagtatcaaaaaaacaaaaacagtggcttaaaccacaagatgtttgtcaaataagtacygaggtacactctcctggacgggttctgtagctacacagtcatcggggatactcaggttcctaacatctgccacactgcaccttggcagcctgtcttgggg

SEQ ID NO: 2056 - DNA, 201 bp, Homo sapiens
ccctgggggcagggctgcctcaccacacaggtgtctttgccaccttccaggtgtccgacacacagcatgaagtctgtcaccttctggacgtgggctttttygcactcatcattaggcaggattttgaggtccacacactggagatcatctggaaatgagactacgaacccgggagaaaaagggctgcagcccgacctcacc

SEQ ID NO: 2057 - DNA, 201 bp, Homo sapiens
atccccgccttgggctacacagtctgcccccacatacaattctctggttcgatgctgccccagccggaagccaaacaggtgctccccacttcgggttcctsggtgggcaactccacgaccttcacagcatctgtgatggtatcagcaggctctgtcaggcggagcagcatgaggtcgtggctgtagtcctcgtctgcttgg

SEQ ID NO: 2058 - DNA, 201 bp, Homo sapiens
gccctttgggatctgagcctttccctgcctgtttgtctgcacctgtcacagccccttcctttccccacctgctggtgacctcagacttccaggcatgagaytgacacagctggggtggccccagcctcagccgagtgggtccaggtgcaccacatctggaaagataggtgatggcagaacgtgacacacattggatgcaca

SEQ ID NO: 2059 - DNA, 201 bp, Homo sapiens
ggcgtctgcctccgtcttcccccaaatctaggagctcttccccccgaaccaggctccctcaggaccctgagcccctgccttcataccggctttggcagtgkgccgcagacagcacccagtgtggggagatgagggaagcgccacagttaaagcgtccacgctcgtagagagccacttgccatggctgggagtggggtgcac

SEQ ID NO: 2060 - DNA, 201 bp, Homo sapiens
ggaacttccccaaggaaaggagcatgtggtgggagggtgtggtgtttttcctgggagagctgggggtgctgggtgggaagggacatttgcagacccccccmcataccagatgggggatcccacatgccagtttgggaagcagggttttctggtgaaatttgggggaccctggaaggactggggagaccagatgtcagggtc

SEQ ID NO: 2061 - DNA, 201 bp, Homo sapiens
gtcagcacccaactctggtccaccaggacacccgcgcagtggaacgagaggccgttgaagagcgagacctgccagggctgcgagccgcgcgcgcacggggmgccataggcttcggggtccaagcgcgtgtcgttttgggggagcagcgccgcctctgcggctggagaaagaaaggggacggaatcaaagcacggagggcag

SEQ ID NO: 2062 - DNA, 201 bp, Homo sapiens
acccactggcctgaaagcagggcgcctccgcagaggaagcggcgcctgggacccgccagcagggccgcctgccacggctgggagctccgggtgcacgtatrgccaccaattatcttgttctcatcctcttggctctgtgtcatggctaggagtggacaggattgggtggggaaagtagatgagcaaacactctccactcca

SEQ ID NO: 2063 - DNA, 201 bp, Homo sapiens; identical to SEQ ID NO: 2056

SEQ ID NO: 2064 - DNA, 201 bp, Homo sapiens; identical to SEQ ID NO: 2057

SEQ ID NO: 2065 - DNA, 201 bp, Homo sapiens; identical to SEQ ID NO: 2058

SEQ ID NO: 2066 - DNA, 201 bp, Homo sapiens; identical to SEQ ID NO: 2059

SEQ ID NO: 2067 - DNA, 201 bp, Homo sapiens; identical to SEQ ID NO: 2060

SEQ ID NO: 2068 - DNA, 201 bp, Homo sapiens
acgcgcaacactgtgtcccgcgaggagctcatgatggtgctggccagcctggagcagctgcagatccgtgccctcttctcacagatctcctcggctgtctycctgcgcagggtggcactggaggtggccagcccagcaggccagggggccctggccagcaatgtggagctgtgcctgtgccccgccagctaccggggggac

SEQ ID NO: 2069 - DNA, 201 bp, Homo sapiens
ctcacgcctgtcgtgttcagccgcttgaggtccacatacttgcccagggccttgatgcctttgacgcagccacggactgagcctccggtggggaagagccrtcgcaggctgtggggaagcggggatgcgggtcagggcgccacctccaagcccagcctaccgccccaacagcctggcctcggagccccagctgcgcacagt

SEQ ID NO: 2070 - DNA, 201 bp, Homo sapiens
ggaagacagccgaggagatctgtgagaagagggcacggatctgcagctgctccaggctggccagcaccatcatgagctcctcgcgggacacagtgttgcgmgtctccgtatgccggaagttcccctgtgggtccaggatggcacctcagtggggccacactcaatgggacagaacagggagcctagaacagaccccccaac

SEQ ID NO: 2071 - DNA, 201 bp, Homo sapiens
accatactgcagtcccttgtcggtgatcctggcgaccaagccggggttggcacccagagcctctggggtggacgtaagcagcaatgccagcagtatggacrgcagggctctggccaaggcccccatcctagattcccagtgcagtgggccaggactgtcccagctgtggattgggcccaggtcccttaagtagccaaggct

SEQ ID NO: 2072 - DNA, 201 bp, Homo sapiens
atttaatcttgcttttagaggggtttttttgtttttcgtttttttggttttttggttttttttgcacctcacctttccagagtatttatcttaggttttcrtagaaagaacccttatagctggggccgggcatggtggctcatgcctgtaatcccagcactttgggaggccgatgggggtggaccatttgaggtcagaagt

SEQ ID NO: 2073 - DNA, 201 bp, Homo sapiens; identical to SEQ ID NO: 844

SEQ ID NO: 2074 - DNA, 201 bp, Homo sapiens
ccaccatctgtataggctcgcaagaccaggtggtaacttgttttaccttgaagatcagcaattctcagtgtcttctgggatatgtcagtaatattcttaayttttatgtcagaacgacctatttttaaaatgaagtatgttagcactaatctctaacccgtttcaaatgcatggttacccacacctgtctcaccaactgcc

SEQ ID NO: 2075 - DNA, 201 bp, Homo sapiens
tccctaattctcattcttttttgggggttgcaggggagttcactgtgctgtttgctatatttcaagcctcaaaagacaatgaagttcccaaatgctcttcwaggcagaacaaatataaataatgattctcacaccaaatgtgtgcaaagttcaaatattgcattaatggtgctttttattgtgcaaatcatacgactaacc

SEQ ID NO: 2076 - DNA, 201 bp, Homo sapiens
agcaacattgttgtgagactgtaaatttctacaaccactttagaaaacagtttgacactacctaataaacattgctgtagcaataaagattgccatctatragtgaactcccattcacaattgcttcaaagagaataaaatacttaggaatccaacttacaagggatgtgaaggacctcttcaaggagaactacaaaccac

SEQ ID NO: 2077 - DNA, 201 bp, Homo sapiens; identical to SEQ ID NO: 1651

SEQ ID NO: 2078 - DNA, 201 bp, Homo sapiens
ttttgccaaaatgtgagtctaagagaaatttgtccctaggaagtgagcttaaagcatgggtcttctaaccaatatttgagttggctgttgctcctcttatkgttttaatcaaatacatacgcatttgggtagttttctggggtcctctgatgccagtgtggtatcatagatgaccaagattgacaggtccttcctgtgaca

SEQ ID NO: 2079 - DNA, 201 bp, Homo sapiens
tcaccagcgtggggtgaagaccacaggtgagcgagtacctgcttagctttagcaaggcaatatctgcttgtgtgggctccaagaacagcctagacacttcyatttcctgaacatgagattcgaggttcacttcttggtgtgcacccaggatgaccttgtaggatgaaggccttgaggacctagaaaagatgaggatgtcaa

SEQ ID NO: 2080 - DNA, 201 bp, Homo sapiens
cacgtacatacaaatgtttatctgtcaggctgtctgtaagtctctataaaactgcatgatctattcagtgtttgatttgctgatttgttatttacctaagsaatccatccacatgatctacattcatgaatttatttacatacagttgatctcaatatctacttctcagctttcacacctggaggatgctatagcaatggc

SEQ ID NO: 2081 - DNA, 201 bp, Homo sapiens
aacttacgaattgcatgttccactgaaacgatacccaaaatgtccaggttctgtgggttcggactgattactcttcatttatggggatcacaacccataayttgttcatgtgtttgtgaatagatgaatagcctcggcattgaattcaatgattcacaaaagtgtaaaaaaaaatctgtgcctgtgatagactgtaggtaa

SEQ ID NO: 2082 - DNA, 201 bp, Homo sapiens
tgagcttcttgactatgtgagtttatcattttttccatatttagaaagtcatcagccatcactgcttcaagtattttttctgttccaatatctctttcccytcctctgtgacttgctttaaacaaatattaaatattttgatattttcatagatgtccttgaggctctgtttatcttctcaggctttgtataagcgtgcta

SEQ ID NO: 2083 - DNA, 201 bp, Homo sapiens
cacatgccttgtcacctgtcccaaacctgcctctcctacaaatactgtttcttagctgattgtactgtcacctaggtccaaatagactaactttaagtgaygtaagcaaaggtatcactttgtcaggcttaataaaacaaaatttcaccaggaaagagaaaatcaaagaagacaacaataatattattatttgcatttgta

SEQ ID NO: 2084 - DNA, 201 bp, Homo sapiens
tatccatctacccatcccttttacttttcagcatccctctctgtgctgactctcatctgccttccttccttggatcttctcttgctgggaacctctatccyttcaggccactggtacttaggaccaagagattttctccctattggaatacaggtagaaatagaaacagatcaattcacctgtccataagtaagcacataa

SEQ ID NO: 2085 - DNA, 201 bp, Homo sapiens
gcttcttgaatctgtggtttttaatattcttcttatttgaaaagtttttagctatccttgcttccagtatttgttcctgtagcaatctctccttcctctcsttctgtgacttcctacccacatgcaggaaatctttttatattttcccgcctgtctgtgaggatcagtggatttcattttttagtatttgtggaggtgtgt

SEQ ID NO: 2086 - DNA, 201 bp, Homo sapiens
ggctactggccaaaattttattcccttggagggatggctggtatctttggcccaggattctgcattgcaacaaagtagatatccactactcttcttctcaragaccaacacagatatatgttccatgagaaggaggggcaagaacactgagagatccctcccatcaaagcctagttgtgcaggactggcttaagatggaga

SEQ ID NO: 2087 - DNA, 201 bp, Homo sapiens
actctgtatgactttaattcttttaaatctatggagacttgctggaaggtcatgtgtagagtacacctcagtgaatgctccatgcacactttaatgtgtaytcggtagttcggtataatgttaaataggtcgacgtttttattgagaacaaagatactatgtctaattttctgcatatttgttctagcctgttgtgtttgg

SEQ ID NO: 2088 - DNA, 201 bp, Homo sapiens
cccatctgtgccactttttttgatgcctgaggcaagaataggcacagcctgtccccaggagagcaaagctaagtgactccagaatgaagctctatagctgyggctttcaccccacagccctggactctgacaaaagtgaccagcccaagaccttcccaaggtctctttcattttttatgacaagatctatgcaaggtcact

SEQ ID NO: 2089 - DNA, 201 bp, Homo sapiens
tggaagttttctgcatcacaaagattttgcaaatctttttatcccaatgtccgagggtatggttgtctgactgcaggcttcttaccttcttcagaaggaasctctgtgcttggaactgggaccaccgtgggagttgtgaggagagttgattccatcactggacattgcgtcaggttgcagtactcccatctgacactggga

SEQ ID NO: 2090 - DNA, 201 bp, Homo sapiens
cccaatgtccgagggtatggttgtctgactgcaggcttcttaccttcttcagaaggaagctctgtgcttggaactgggaccaccgtgggagttgtgaggasagttgattccatcactggacattgcgtcaggttgcagtactcccatctgacactgggatccatggtataacaccaagggcgaatctcagcatctggattc

SEQ ID NO: 2091 - DNA, 201 bp, Homo sapiens
ttttcttcatatttggaaagttttcagccatcattgcttcaggcattttttctgttcaagtatctctttcttctcttgtgatatctgatcacaagatcaartgatcatatgtatattttaaatgtttttgctaattctatcatttctgtcatttctgggtctatttgtattgaatgatttttctcctggttatggatcaca

SEQ ID NO: 2092 - DNA, 201 bp, Homo sapiens
tttgcaatgaggtctcttttctagctggtaagaactcaaatatcccccagtgctttgtgagctctgccatctccattgaactcattgttcccttgtagttrttctttccccagtagctgttctttgtcctactttcattgtggaatcactccctgtgcatatgcagatttatattacactgaggtgacttctaggtacatg

SEQ ID NO: 2093 - DNA, 201 bp, Homo sapiens
cctgagacattctgtccaacattctgggtctgagagaaattgggtcataagaagttagctggaagcatggctcttccaggagaaatttaagtgggtggctstttctcttgggagaaaactcaaagacatacccatttgggtagtattctgtggttctctgatgccagtgtggtgtcatagaggaccaagactgacatgtcc

SEQ ID NO: 2094 - DNA, 201 bp, Homo sapiens
gtggtggagaatgagcctcgataactctgtccatcaccatggtagcagtcctggactgtggggctttgctccgttggtgctgaaattcaaagaggagaaawcaaactgagtaatttccagaacacagaagcatgagaaaaaaaatccatgatagaaacaggacatcatctctgaaaatgacgaccatgctctgttctacat

SEQ ID NO: 2095 - DNA, 201 bp, Homo sapiens
catgagaagcagggatgagaacactgagaaatcccttccctcaaatcctaggtgtggaaggcatgcccaagatgaaggtaggctggggagataaacaattyggtggctatgtactgcttcaaagtctcaggacaatacggatctaatgaagacatgttaggtttctcaagaacaacagcctcaaaaatggcattccttcaa

SEQ ID NO: 2096 - DNA, 201 bp, Homo sapiens
ttcaatcatacatcacaaaagctcttattagggtaaaacacattgagcattgctacatattcctcaatgaacaatttttacttctctatgtttcaatgctsgtgtggctctaggattcacacctgtgtgggtgtgggtgtgtgcacgtgtgccattgtgtgtatatatgtgcagctatttctgtagattctattgaattat

SEQ ID NO: 2097 - DNA, 201 bp, Homo sapiens
gtctcttttcttgttcactgaatgtcactggtttggactacttccttccatctgctttccttggctcttatttgctttttttttttttcttgtgtagatayttaagctgtggtcttagatcaacaactgtcaaagtctttgttcataggggattccaaagagcttttctttttcaaaacacaagatgaatatttatagtat

SEQ ID NO: 2098 - DNA, 201 bp, Homo sapiens
tacaaatatttctctgtcagcctctctgtatgtctctctacaggactacactaactattcagcatctggtttgctgatttgttgtcttcctcaggaattgkcccacatgattaacattcctgaatttattcacatacaattgttctcaaaatcttcttttcagctttcagaactggaagatgctatagtaatggcacctct

SEQ ID NO: 2099 - DNA, 201 bp, Homo sapiens
agcaggcctataaaatcctagctaccacagtagtcccaaattccaatctctctcctgcattcaggaagatggctacagtccatctgggctccatcaccttrctcttcagtgcaagaagggcctccaggaagaaagccaaggtatctatggagttgatctcattgttccccctgtcactattcttttggtccactactgtct

SEQ ID NO: 2100 - DNA, 201 bp, Homo sapiens
aaccaacaaacaaaaacaccaaagaaacaaattcctaacactttagaactgtagtaagttcttagaaatatttcacataaaagcttagaaaaaaaggacaratgagagggcttctcaatggaaactgtgctcacgtgcaagcacatttatgggaatttctactgaatgttcatgaggactatggggcagcaaacagcaaag

SEQ ID NO: 2101 - DNA, 201 bp, Homo sapiens
ggcagagaaacggacagacatgaaaacaatgaacgtttcataacaaaaggcaaggtcttcagcttctgggccatgggagagacaacagtccttcgtctagractgcagacaaagacacttcagttatcagggatgggtggaggcgaacagcttactcccctgcaggagagatgaaatcctctcatgacccacatcctgagt

SEQ ID NO: 2102 - DNA, 201 bp, Homo sapiens
tgtgcatagcgtttaagcttgctgggtttttttccttcttttcactctaaaggtgttattccattgtttctgacttgatctttttttttcttcttagcatrttattccattttttctgacctgatcttttcttcttcttactactctaaaggtgttatttcattgtttctgattttatcttgttttccttcttaccactct

SEQ ID NO: 2103 - DNA, 201 bp, Homo sapiens
tggacccacaaattcaacctttcattaatattacataccatcgtggataaggtaagaaacttacaatggtacacttccaattattccccacatgatttagkctatatgttcaaatttttacctctacatatgctaaagttaaatatattgctatcattttgcttcaagtagtcaactctcatttaaaaagatatagaaatt

SEQ ID NO: 2104 - DNA, 201 bp, Homo sapiens
ttgtcagctttcagacctggagtatggtatagcaatggctcctctcccctgttacttcaaatggtgatggttgtactccctccttggtctgtcatctgttyagccagactgtggtcaatcacatgaatcttttcaaagaaccaactttctgtttcatggatttactcctttgttggtctattttcttgttcactgaatgtc

SEQ ID NO: 2105 - DNA, 201 bp, Homo sapiens
tgctcaggaccaagtgtgtttgtacccattgaaaaagaagtagatagaaaaagatttgcctctccatagatgtgcaagtatcaattccctgtgacccaagrtgcaaaaggccaacacaacattcacttcagggactagagcttagaatgatagaattccaaggtgaaaaggttgtattaaccctcagccgatgttgtagaa

SEQ ID NO: 2106 - DNA, 201 bp, Homo sapiens
ccttctgctccacaaaactaggaggaaggtgaggcagcttaacatttctcttctctcagacccttagctccaaggaaatcatcctgagacattttgctacrccatctgaatctgacacaagttgagttcggagaactcagcttgaagcatgtctcttgtcacagaaacttcagttggccctttattctcttatggtaaaga

SEQ ID NO: 2107 - DNA, 201 bp, Homo sapiens
cttcccttcaggaattggaagtcagaataacggaattccaactggaaagtcttcattgacgcttagtgggtgttgggcaagggtaatctaagtgtttggtsgttcgtcattctgactttcttcataaggtgatctcctcgcctcctcatttcccttctgctccacaaaactaggaggaaggtgaggcagcttaacatttct

SEQ ID NO: 2108 - DNA, 201 bp, Homo sapiens
tgcagtgtcatgtgaggccaactactggaggagacttctatgcgtatttgtagagctcctttcctccacaaaccagttcttatttgtagcggacctagaawataccagagtcatcccaaactccaatccctctcctctgctcagctagatggctacaggctgcttgagctccatctccttgctattcagtgcaggaagggt

SEQ ID NO: 2109 - DNA, 201 bp, Homo sapiens
tgtattgcctgatttattttctggtcatggatcacacgaaattcttttctacacgtagtcaaatttttaatttaggactcactctggggataccgcatagytgaggcaattgactttgttgtttacttctgaagagagttgagatttcctctcacaggcacttcattgattggaaacccatttgatgcttggacacttgct

SEQ ID NO: 2110 - DNA, 201 bp, Homo sapiens
taaatatctgaaatcagttatcatactgatatgtcaaattttcatgcaattctaattatcgatgtcatttctgagcctgtttgtattgcctgatttatttyctggtcatggatcacacgaaattcttttctacacgtagtcaaatttttaatttaggactcactctggggataccgcatagctgaggcaattgactttgtt

SEQ ID NO: 2111 - DNA, 201 bp, Homo sapiens
tcgaaacgcctatttgatgcattgaatttcgtgtttttgcgattttgttaatattcttgatcaatgaaaagttttcggccatccttgattccggtatttgyttctgtttccaatctcccgttctcttttctgtgacttgcttcccatatgcaggaaatcttttcctattttgcaacatgtctgtgaggttcggttggtttt

SEQ ID NO: 2112 - DNA, 201 bp, Homo sapiens
ctgccagaggcaaatacattggtttctttcaacagaaattagtttttcctcttttggaggaaatgtaaatgatctcatgtaaatgaactcatacagaatayacatggcttctttcctgagtatatttttgagctccatccatgctatttaagatactcagtgctgaatagtattcaagtgtaccagtaggttgcaaattat

SEQ ID NO: 2113 - DNA, 201 bp, Homo sapiens
tggagctgcctttattctaggaatatacaaagtctactcataaagtctgacttttctgaggtctctactgaatgcccaagattttcaatgaggtctcttcyctctagctggtcaaaactccaatattccagagcactatgtgagctctgtcacctttattaagctcactgttcccttgtagttgttgttcctcaatatatg

SEQ ID NO: 2114 - DNA, 201 bp, Homo sapiens
ttcatatcctttgcccactttttgatggggttgttttttttttcttgtacatttgtttaagttgcttgtacattctaaacattagccctttgtcagatggmtagaccacagaatttttctccataggttgctttttcactctgatgagagttttttgctgtgcagaagctctttattttaattagatctgatttgtaaatt

SEQ ID NO: 2115 - DNA, 201 bp, Homo sapiens
gagggtctgtgccccttttaaagacaccatccctcacaaggcactcaacatcccagctctggtccccccagagaaggcactgaagcttccttcccattggytgtccatgacttcaccttcgacttcctgtgcagcatggaagttttctgcatcacaaagattttgcaaatctttttatcccaatgtccgagggtatggttg

SEQ ID NO: 2116 - DNA, 201 bp, Homo sapiens
cttgactttgttgtttacctctaaagagggttttcctctcccaggcagttaattgacttggaaatgattttaatgcttggagacttgcttttcagttttgycagggtttgtctagagctgcctttttttctagaaatttactaattctactcctaaagtatgacttttctggagtctctactgtattcccaagaggttcag

SEQ ID NO: 2117 - DNA, 201 bp, Homo sapiens
tactgaagcttctgtatggtgtgggggtgaagttcccaggtcactggagttgtgtacctaggaggattatggctgcctctgctgagtcatctgagttgtcrgggaagtggagggaagctgtcagtcacaggcctcacccagcacccatgcaaactgaagggctggtcttactcccaccatgcccccaaccccgcaacagct

SEQ ID NO: 2118 - DNA, 201 bp, Homo sapiens
ccatagacccaggaccatatggaattaatgcagccctgttaggtttctcgaggatgacaggctccagagccacatttctcagaatctgcaatgctgaagaytgctctgaatgctggctacttgaagaaatccccggaaaagcttactggcttggaaagagtgacacacctgacagcatgttacaataaaaattttggctgg

SEQ ID NO: 2119 - DNA, 201 bp, Homo sapiens
cagttgccaggtaagaaaagatcaatagatcaaagtcttgtgctctcccgtctcagtctcagtcccttagacgtcagtcccaaagtggcaaattcaggaargttttgtcagtggaagaccccagtctaagtgttgctcagaaactccccagatctgtccctgaatgcatattcagatcatctaaggagacgtcttggggct

SEQ ID NO: 2120 - DNA, 201 bp, Homo sapiens; identical to SEQ ID NO: 2078

SEQ ID NO: 2121 - DNA, 201 bp, Homo sapiens; identical to SEQ ID NO: 2079

SEQ ID NO: 2122 - DNA, 201 bp, Homo sapiens; identical to SEQ ID NO: 2080

SEQ ID NO: 2123 - DNA, 201 bp, Homo sapiens; identical to SEQ ID NO: 2081

SEQ ID NO: 2124 - DNA, 201 bp, Homo sapiens; identical to SEQ ID NO: 2082

SEQ ID NO: 2125 - DNA, 201 bp, Homo sapiens; identical to SEQ ID NO: 2083

SEQ ID NO: 2126 - DNA, 201 bp, Homo sapiens
cctggtggataaggtgcccaagctagcatggacccctgaatccttgctcgcctcctctgttgccttttaaaagtgccactttctgctcctaaagtgaagtrgtacggcaggactgctgcatttcttcccctaagctagctttggaagcaaatcactttctttataccagacttctctcttcttaattggattctgcaagtg

SEQ ID NO: 2127 - DNA, 201 bp, Homo sapiens
tacctgatttcagaaataaaagaagtagaagaaccacttccttatgttccattttgggactggccagcagtgcccagaaagtgtgtcccaatcccaggacrttgttgacttacatgagagtaaacgcacccacaaaccagatagtcaaattaagttaatgattctctcagagacccatgccactggctcagcagggttcaa

SEQ ID NO: 2128 - DNA, 201 bp, Homo sapiens; identical to SEQ ID NO: 2084

SEQ ID NO: 2129 - DNA, 201 bp, Homo sapiens; identical to SEQ ID NO: 2085

SEQ ID NO: 2130 - DNA, 201 bp, Homo sapiens; identical to SEQ ID NO: 2086

SEQ ID NO: 2131 - DNA, 201 bp, Homo sapiens; identical to SEQ ID NO: 2087

SEQ ID NO: 2132 - DNA, 201 bp, Homo sapiens; identical to SEQ ID NO: 2088

SEQ ID NO: 2133 - DNA, 201 bp, Homo sapiens; identical to SEQ ID NO: 2089

SEQ ID NO: 2134 - DNA, 201 bp, Homo sapiens; identical to SEQ ID NO: 2090

SEQ ID NO: 2135 - DNA, 201 bp, Homo sapiens; identical to SEQ ID NO: 2091

SEQ ID NO: 2136 - DNA, 201 bp, Homo sapiens; identical to SEQ ID NO: 2092

SEQ ID NO: 2137 - DNA, 201 bp, Homo sapiens; identical to SEQ ID NO: 2093

SEQ ID NO: 2138 - DNA, 201 bp, Homo sapiens; identical to SEQ ID NO: 2094

SEQ ID NO: 2139 - DNA, 201 bp, Homo sapiens; identical to SEQ ID NO: 2095

SEQ ID NO: 2140 - DNA, 201 bp, Homo sapiens
catgttttcttaaatcctagaactcaattattatatagtgatatgtcaaatttttatgccattctaatcatttctgtctcttctgggtctgtttgtattgrctgattttcctcctgcttgtgggtcacactaaaaggtttctatgtgtagtcaagttttatatttaggcctcacactgtggatactgcatagctgagccac

SEQ ID NO: 2141 - DNA, 201 bp, Homo sapiens; identical to SEQ ID NO: 2096

SEQ ID NO: 2142 - DNA, 201 bp, Homo sapiens; identical to SEQ ID NO: 2097

SEQ ID NO: 2143 - DNA, 201 bp, Homo sapiens; identical to SEQ ID NO: 2098

SEQ ID NO: 2144 - DNA, 201 bp, Homo sapiens; identical to SEQ ID NO: 2099

SEQ ID NO: 2145 - DNA, 201 bp, Homo sapiens; identical to SEQ ID NO: 2100

SEQ ID NO: 2146 - DNA, 201 bp, Homo sapiens; identical to SEQ ID NO: 2101

SEQ ID NO: 2147 - DNA, 201 bp, Homo sapiens; identical to SEQ ID NO: 2102

SEQ ID NO: 2148 - DNA, 201 bp, Homo sapiens
caaaatatcattgagaaatagatattttaggcccatatccatgtcttcaccccgcactgtttctcatttgaactctcttttccaggaagagttgtgcttgrgtaaattctatagctcacagtgtgacttcaaaacacacaataaattaataaggtgcttcctacagtgagttcagttaaacattttgaagagtgtttttga

SEQ ID NO: 2149 - DNA, 201 bp, Homo sapiens
ctgatgcattctgaacctaatccactaaaaagcacttgatagatatatcaaaatatcattgagaaatagatattttaggcccatatccatgtcttcacccygcactgtttctcatttgaactctcttttccaggaagagttgtgcttgggtaaattctatagctcacagtgtgacttcaaaacacacaataaattaataag

SEQ ID NO: 2150 - DNA, 201 bp, Homo sapiens
tgttgggaataaataaaaagtgaactaaattatgttctcatcttgggcaaaaattaagcaaaaaaaaaatggaggatatgaagctcctccacaaagaaggycatttttgtactaggcttactacagtgacacaccactattagttggggagaattcagtttttccaaggtgttgataggcatccagatttcagaggaaatt

SEQ ID NO: 2151 - DNA, 201 bp, Homo sapiens
taattacatcatatcacaaaatttcacaccctgattttttcactcaacattacataatgagttttgtatagtgctatgatcttcataactaatattttaawggagagctactgattaatgagcatgaggtttcctttggggatgaggaaaatattctggaaatatgatgatggttgcacaccactgtgaatgtactaaatg

SEQ ID NO: 2152 - DNA, 201 bp, Homo sapiens
aaacattctgattttccattattgtggcctcaccaccgccagatattctcctgattttatcaaactctcaggaaagagagccagcttaacatttctcttcwatcatactctttgctcaaagtaatgtttctcagacattttgccatgcattctatgtgtgagaaaaatttaatcataagaagttagcttgacgcacacctt

SEQ ID NO: 2153 - DNA, 201 bp, Homo sapiens
tcttaggaatttctcctttgccctcttccctccctatcagcatgtatctagcagcattctgaaaagttaactgcacagtgagcgactgctgggcatcttarggggcattcttttctacctaggtattccccctcctccactcatgtctagcatgcaggacttgggtaatctctggggtttcagattctccagacctccatt

SEQ ID NO: 2154 - DNA, 201 bp, Homo sapiens
aaagtccttggccacagtccacctgctccccacctctgtgactttgtccttcctcaatttaatatgctctatgctggaaaactggattattgaacaggcaytggctgatgcattctgaacctaatccactaaaaagcacttgatagatatatcaaaatatcattgagaaatagatattttaggcccatatccatgtcttca

SEQ ID NO: 2155 - DNA, 201 bp, Homo sapiens
acttgaaaatgctggttttacaaatgaggggttggagtcaagtcatacaaagagttaacgtgcctagtccaggtctgtctggctagtggcagagtcagaaygcttttctagggctccagactcataatgtcctcaccagcacctctgagaaagtcagcagagtcagaacgcttttctaggttccagactcataatgtcctc

SEQ ID NO: 2156 - DNA, 201 bp, Homo sapiens; identical to SEQ ID NO: 2103

SEQ ID NO: 2157 - DNA, 201 bp, Homo sapiens; identical to SEQ ID NO: 2104

SEQ ID NO: 2158 - DNA, 201 bp, Homo sapiens; identical to SEQ ID NO: 2105

SEQ ID NO: 2159 - DNA, 201 bp, Homo sapiens
gtggctcggttgatttcatttttcagcatttgtggatgtgtgtgtgtgtttgtaagcttatacatgtttgagtgtgtgtgtatgcatgcgtgtgttttgtwtgtgtgtatctggttctgtaggttctatgcaattatttttcatttggtattttcttctgaaatgtctaactagatggggaggccatctagtaattttttc

SEQ ID NO: 2160 - DNA, 201 bp, Homo sapiens
ccagcttctgtctatcttcccgcactttttattgtttagcatctgtctcatttcttactttcatctgccttcctgcctttgcttctctcttcctggcaacscgtattccttcagaccactggtgctcaggacccagggtgtttctacccgttggaatagacatagatatagaaaaagatagattcgcctttccatagatat

SEQ ID NO: 2161 - DNA, 201 bp, Homo sapiens; identical to SEQ ID NO: 2106

SEQ ID NO: 2162 - DNA, 201 bp, Homo sapiens; identical to SEQ ID NO: 2107

SEQ ID NO: 2163 - DNA, 201 bp, Homo sapiens; identical to SEQ ID NO: 2108

SEQ ID NO: 2164 - DNA, 201 bp, Homo sapiens; identical to SEQ ID NO: 2109

SEQ ID NO: 2165 - DNA, 201 bp, Homo sapiens; identical to SEQ ID NO: 2110

SEQ ID NO: 2166 - DNA, 201 bp, Homo sapiens; identical to SEQ ID NO: 2111

SEQ ID NO: 2167 - DNA, 201 bp, Homo sapiens; identical to SEQ ID NO: 2112

SEQ ID NO: 2168 - DNA, 201 bp, Homo sapiens; identical to SEQ ID NO: 2113

SEQ ID NO: 2169 - DNA, 201 bp, Homo sapiens; identical to SEQ ID NO: 2114

SEQ ID NO: 2170 - DNA, 201 bp, Homo sapiens; identical to SEQ ID NO: 2115

SEQ ID NO: 2171 - DNA, 201 bp, Homo sapiens; identical to SEQ ID NO: 2116

SEQ ID NO: 2172 - DNA, 201 bp, Homo sapiens; identical to SEQ ID NO: 2117

SEQ ID NO: 2173 - DNA, 201 bp, Homo sapiens; identical to SEQ ID NO: 2118

SEQ ID NO: 2174 - DNA, 201 bp, Homo sapiens
cacctccagggctcatatggcaatggggatttaatagggtttatttgttggtgaagaaacattaaacaaatcttttaataggaaaaatacttttatattayaggcaaaatgtagatgtatattgctactgaagtaaatgtattttattaatggtgtgagaatttcttcctcactgtggtgtgtgaatgtgtatgcatattt

SEQ ID NO: 2175 - DNA, 201 bp, Homo sapiens
atgctacatgttcaaatttttacttctacatatggtaaagttaaatatattggtatcattttgcttcaactcgtcaactctcatttaaaaagatataaacrtttgatcaagaaaacatgtagcattttcatctacatttgccaattgctaggttcttcattatataggctgcagaaagttcccttcttgttctattcttct

SEQ ID NO: 2176 - DNA, 201 bp, Homo sapiens
aaaagacttagcaatttgtgaatagaagatgtttctccgcttctcactgagcatggctgtaaaagaaactttttcctctccccgggcattccagcacacaytggaaagataacacgtccacagaaagcctggctttccaaaagagcttatcagagaatgtgccccccaggtcgattaaaacatatgttaatcctgtggcag

SEQ ID NO: 2177 - DNA, 201 bp, Homo sapiens; identical to SEQ ID NO: 2119

SEQ ID NO: 2178 - DNA, 201 bp, Homo sapiens
cgaggatgacaggctccagagccacattttttgaaatctgcaatgctgaagattgcactgactgctggctacttgaagaaatccccagaaaagcttactgsgacagaaagaatcacacacctgacagcacgttacaataaaaattttggctaagacactgagatagcccattttagaaggaggtgagttgtgaagcccatc

SEQ ID NO: 2179 - DNA, 201 bp, Homo sapiens
cacggactcttctcttccccattcccagagccagtagaccggccccctgtgctgttgatagccaactcccagaacatcttggccacgtacctgagtggggyccaggtgtctaccatcacacctacgagcacgcggcagaccacagccatggacttcagctatgccaacgagaccgtatgctgggtgcatgttggggacagt

SEQ ID NO: 2180 - DNA, 201 bp, Homo sapiens
ggatgattgccataatgagtcctcttttggtttgttttagctgttgtgacctgccagcagggctatttcaagtgccagagtgagggacaatgcatccccarctcctgggtgtgtgaccaagatcaagactgtgatgatggctcagatgaacgtcaagattgctgtaagtgtttggagaggaatcttgctttggctttgtgg

SEQ ID NO: 2181 - DNA, 201 bp, Homo sapiens
gcaaatatagaaggaaaatccagttcaggagggaagatgattattttcagttgggacaccttgagttcaaggcaacttgcagaggtccaaaggtagttgastatacaagactcaagtgtgggcaaaaatctgggttgtaaacacagatttaagtctcatcaggccacagagggtcactaaagtcatgagaatggtgagact

SEQ ID NO: 2182 - DNA, 201 bp, Homo sapiens
gtgggttaaatgctatttctattaataaagataaaatatgtagactagcaaatatagaaggaaaatccagttcaggagggaagatgattattttcagttgkgacaccttgagttcaaggcaacttgcagaggtccaaaggtagttgagtatacaagactcaagtgtgggcaaaaatctgggttgtaaacacagatttaagt

SEQ ID NO: 2183 - DNA, 201 bp, Homo sapiens
gatataataattataaaaccataattaacacccttctccatgcttaattgattatatcttccttgtcattttgttccttctttctgtttaattagcaaaayggtgtcttataattctggaacagcaaacaaaatttttcaagtcagcctacttctaacactaaataatttcatattttctctaagtaccttatacctgtgg

SEQ ID NO: 2184 - DNA, 201 bp, Homo sapiens
ttcacataaaattaaagaactttcttttattcccgagaaggcaagtcatgggttgtctcaaacaaaatatgaaaagaacctgggtcaggtatcagtgctcrttcaattaccttggctttcttctttacgtcaagcccaaataattctaaatgttgtgcttaggttttcaaagggcttacgaagaagcaattaaaagctcat

SEQ ID NO: 2185 - DNA, 201 bp, Homo sapiens
ttcttgagcataacataatcaaaattaaagattgggaacctatctcacttccaaattgctggggtatattcataattcttcagtacatccgtactttcaayatcatccaacccctgaatgagattgctggcataggttcccttatgatttaaggccctgctccacatttataaagaatcatcccattgtgtgtaacttctt

SEQ ID NO: 2186 - DNA, 201 bp, Homo sapiens
ctcaactctgttctcccctaggggctccctggtgttggcctcacaccttcagctgcccagactgcccgtcagcaccccaagatgcatcttgcccacagcamcctcaaacctgctgctcacctcattggtaaacatccacctgacctcccagacatgtccccaccagctctcctcctacccctgcctcaggaacccaagcat

SEQ ID NO: 2187 - DNA, 201 bp, Homo sapiens
agttctatctttttcctgcatcctgtctggaagttagaaggaaacagaccacagacctggtccccaaaagaaatggaggcaataggttttgaggggcatgrggacggggttcagcctccagggtcctacacacaaatcagtcagtggcccagaagacccccctcggaatcggagcagggaggatggggagtgtgaggggta

SEQ ID NO: 2188 - DNA, 201 bp, Homo sapiens
cctgggccttggtgggtttggttttggtttccttctctgtctctgactctccatctgtcagtctcattgtctctgtcacacattctctgtttctgccatgrttcctctctgttcccttcctgtctctctctgtctccctctgctcaccttggggtttctctgactgcatcttgtccccttctctgtcgatctctctctcgg

SEQ ID NO: 2189 - DNA, 201 bp, Homo sapiens
ctttatgctttggttgactgtttttcttggcttctttatttgatttgttccctggccttgagttcggagtgctcccccttttatttttcctggtgctgatkgtaggtgttctccctgcccctttctgttttgtttgttttttatgcacttcactctgcagtggcagtgatagtatggattatgacgattcaagctcttctt

SEQ ID NO: 2190 - DNA, 201 bp, Homo sapiens
tcttactggatggctcatgacaggtggtgctacagtcccgagactacaatgcactctccatgtctgtgatggcattcgtggcaatgatctacccactggartatatgtttcctgtcatcccgctgctacccacctgcatggcatcagcagagcaggtgagtctcaaggcgacttccggctttctcacctctgtcttcctga

SEQ ID NO: 2191 - DNA, 201 bp, Homo sapiens
ctgtgaactgctgagggttcagaaggtgaaaacgatttcaaatgattctaaaatgttatttgctgttttcacggggttacatttgcactgatggtaccaamgcagtgatgggtaaaactgctggcactgtaacccaagtgaagacaatggccccaaactatgccagcagccattgcattccttgccttcatatactctcag

SEQ ID NO: 2192 - DNA, 201 bp, Homo sapiens
tgtattcctttggcacttgtagactcatgctatctgaatctgcacctattcatagatttatttatacaagcagttttgaagtaatcatgcttgcatttctyatttcatgagtgaggtcttggggagaaggaacaggagctctgcttgtcaagtctcctcccctccctatccgctactatttactgcatgcagtagataact

SEQ ID NO: 2193 - DNA, 201 bp, Homo sapiens
aagatgatttgctcagaattttctcaggttgagaagatggctggagaacccattgagaccaggtctgatttgtcctacttggttcttaaggcatctggggwcctctttttccagtgggtcctgagtggggggtagtccttggaaaggtgactaggatgggctgaacgggtctgggaacagcctgtgctgccgtcccacccc

SEQ ID NO: 2194 - DNA, 201 bp, Homo sapiens
tgaggcaccatgtagtagtgactctagactccaggatggtggggcttggctgtatcctagactctgtgaagccaagtgcaatggcagcgaataccccagcrtggcagagcacagctgtcatttgggccctgggggtcagggagcagcacagcaatgactccactccccaggaagagggtatcttagcagctcagactctag

SEQ ID NO: 2195 - DNA, 201 bp, Homo sapiens
ttatacatcggttccttctaatgactccatctcttccaacaatccttgtagcaggcagcatgtcagtagttctgttttgtgtcttcacctagggaaaccaygagcgtaaggcagaaaacctgaccatggggatgccccaggaccacctttccctgtaggaaacagtctagggagaggctgtcagagacaggaaccactgag

SEQ ID NO: 2196 - DNA, 201 bp, Homo sapiens
ggtaggatccggttgcctttctgcggtggaggaggaagtgttggatttcagcgctaaggcgtcggcggtgcacctcacgtgcatgtgtagcatgccttggkttttcctttggcatctgaaaaaggcacaacctgaaagacctagaacccagtgtcggtccccaggccctttgggacaggaagagaagagccgtgtggccgc

SEQ ID NO: 2197 - DNA, 201 bp, Homo sapiens
ctgaagcagctcagtgaagtagcaccacctccccgtgctgggccagccagtggtcagaaagtttgggacacagcagactggcgacccccaagctccactaygtccatgtcacctgctgcaatctctctagcagcccagtgcgctagccagcctccctggcgccgctctggtctccacctggcctctgtgccagacaaaggg

SEQ ID NO: 2198 - DNA, 201 bp, Homo sapiens
tcattctgtcgctgcagctggagagcagtggtgtgctctctgctcactgcagcctcaaactcctgggctcaagtgatgctcccacctcagcgtcctgagcmtctgggaccgcaggcacccaccaccatgcctggctaagtttgtgtattttttgtagagatggggtttcgccatgttgcccagcctggtctccaactcctg

SEQ ID NO: 2199 - DNA, 201 bp, Homo sapiens
gtgatgacttcctcattttttttttcatgtctgggaaagacttagtttatccttcatttctgaagcacaactttgctgggtatagtattcttgactgagawtctttttcttgcagcgctttgaatatatcatcccattctctactggcttgtaaagtttctgcagagaaatctgttagtttaatagagattcccttaaatg

SEQ ID NO: 2200 - DNA, 201 bp, Homo sapiens
gcctgggtctgccgggcctaggcagggtgcacgtggggaccccagaccctgggctcaccatggtcttcttgtcggctttctgcactgtgtacccccagagytccgtgttgccgacatcctggggtggcttccactccagagccacattaagaccccaggcgtcagtcacccggagatcctggggaggacttggcttgtctg

SEQ ID NO: 2201 - DNA, 201 bp, Homo sapiens
atattataattatgcaatatgttatgcttgcgtctctctcaggattttaaaattgactttaatagctttttataataaaaagaacaactcaaaggtgcaaracagctgagaagttccatatgtcacagaactgcaaaattgttaaattcactttaattaggatatattaaggttttacaactgtggcataagtaaatcata

SEQ ID NO: 2202 - DNA, 201 bp, Homo sapiens
ctctcatttaagaaacacaaacattctcaaagcacattgctgaaacaccataaaaacttaataacctaccattttctttgcactcttctggaggtttagcytttttcgcaagtcgtggatccagccatgatgttgtctttgtgttatggctgaaaagaaaagagatcactctgaacagacacatactaaaaggaatcaagt

SEQ ID NO: 2203 - DNA, 201 bp, Homo sapiens
acgacagtggaatatccatcctacctgatttattttggataaattgtattatttcctccacaaaagatttatattcctaaaatgttggtatttctgagtasttctgacccgaaaagactggaaagggcactatattattggatgaagcatatctcaaaatgttgctaaagcacatcatgattaataccagtcagctacaaa

SEQ ID NO: 2204 - DNA, 201 bp, Homo sapiens
cctcagagagaaaaagcaaaaccacatggccctgctgaaatgccgagttaattctctctcttatctgagcattaaacattacatcgttaaaattgtttcarctagattattgcctcttcaggtgagactctcatttaagaaacacaaacattctcaaagcacattgctgaaacaccataaaaacttaataacctaccattt

SEQ ID NO: 2205 - DNA, 201 bp, Homo sapiens
gaaagactgggctttggaaaatcaagaggcaatttttatcctcccctcaagtggaacaacatgtggtcctggaggcatgggggtaactggaatagagtacrtagtctttctggtttcaggagacaacccatcaataaaacctgcttcctctgcttaaaagaaaaagaaaaagaaagtatacaacactcaaattctgatgtc

SEQ ID NO: 2206 - DNA, 201 bp, Homo sapiens
aatattacctaaaagcacttttcttggcaagaaaacttaaaataggtgtccagaataataacattctaacaaactagatgttagtttccactgtaaaaackgtccgataatataaagaatagagtctaggaattatttattttgtagtgaatgaaaacaaatagcagttgaccaagttacaaatcatcctgatctataaac

SEQ ID NO: 2207 - DNA, 201 bp, Homo sapiens
tttctcatcaacatccaggagaggaatatagtctgtttttccaacagtttctcccacaacatcatcaaaggcctctgcctctagtgtggcaatgaagtccygctttatctctccctcaatgtctggagatggttctgttaatgcatctgcaagactgaggtcagccattctgcaccactgcaactgcctggtgaagaggaa

SEQ ID NO: 2208 - DNA, 201 bp, Homo sapiens
gtatcctggagagacagtcatgaaaattgttaagaaaaaaaaaatccatgtttctctgaatagtaagatgtgtgcgtgtgtgtgttcacagaaaaaggaawgggaggatataaaccaaattgttaatattaacgacctcagggagtatgcagtatttattgtttggctataagaaggggcatgaatttagaggtcagacca

SEQ ID NO: 2209 - DNA, 201 bp, Homo sapiens
ctttgctatccctactgtcaccctcctcttttctcctgccacatcaacagcttcttgcactgcaaatgttttctggaactctccccatgactgacaggctrataaggagttattttatttgctgtttgagtcacaaataccatttttatccaatcccaactttgccttttttgtagggttactgctacattaatgttctct

SEQ ID NO: 2210 - DNA, 201 bp, Homo sapiens
tgaatgaattcagaataggcaacctaatccacttggaaagcactaggcgtaaagtaacttaaatcctgtaatttcagggtgatgctggtttgactggacgsaaaatcattgtggacacttatggcggttggggtgctcatggaggaggtgccttttcaggaaaggattataccaaggtcgaccgttcagctgcttatgctg

SEQ ID NO: 2211 - DNA, 201 bp, Homo sapiens
gaagcacttgctcatttttactggttattttaaaggatacaaacaaacagccagatgaagagatacatagggtgaggtctgggagggtcccaagtgtaggmgcttctgttaccatggagttggggtgtgccaccctcctggcacgtggatgagttcttattcactttcctgtcagcctccacctgttcagctctccagaaa

SEQ ID NO: 2212 - DNA, 201 bp, Homo sapiens
aaattcagaaaaacgaacttgaattagggagatatttgttctccctcctaacaatagatgacaaagcagggagacatggattcggaatacgtttgagcatyttctacactgttgagcttttgtttcctgcgcaactcctaacagcaaaatcagataattgccattttagtcagaaaatgcttttcatttaattgtttaatc

SEQ ID NO: 2213 - DNA, 201 bp, Homo sapiens
ttgggaaaattggtcagagaggtggtatactaacagtttggggaagggcagcatccttgcccatatttagaaaaatactttttcaagtgtcttctcccaartaactcttgggacttttgttaccagtcaagtaggtacagtgagtttggcaaacaacatagtggcaaagtatcttctattgtgttactatgagagaagatc

SEQ ID NO: 2214 - DNA, 201 bp, Homo sapiens
aaatgtgtcctcctttgttttgatactatgaaattaataaaattaactgctactaactaaaaaatccaagtagaacacagaaaggagagtgtggcacaagrtaaggttgcagaagtagcagccaaatcacactggggccttgagtatgtagagattttagtccgtatcccgacagcaattgaaagccactgaaaagtaatt

SEQ ID NO: 2215 - DNA, 201 bp, Homo sapiens
gcctcggcctcccaaagtgctgggattacaggcgtgagccaccgtgccccgcccccttctgccatctttatattcgttcattttccgtttccttcccttcytttcttgtctctccctcttgaacatttctaagcaccttgtgtgtgccaggcattcagtaacaaagcttgagcaaaacagcccaccttctcattatcatgg

SEQ ID NO: 2216 - DNA, 201 bp, Homo sapiens
atgaaccactactgcctggctcctatagcctgtttattcaccacactccataccctagagataactcacatttgctgctaatcttttttggttaacttgcygaaataattcttacaaatttttacaatttcaaatgacacgagttagtacaggaaaagtataaatcccacccacagagatactcattgtaaagtttggcgt

SEQ ID NO: 2217 - DNA, 201 bp, Homo sapiens
ccatagaaaatgcttgctttggccaggcatgatggctcatgcctatagtcccagcactttgggaggccgaggtaggcagctcacctgagctcagttgttcragaccaacctgagtaatatggtgaaaccccctatctacaaaaaatataaaaattagccaggtgtggtggcatgcacctgtggttccagctacctggcaag

SEQ ID NO: 2218 - DNA, 201 bp, Homo sapiens
aaggagagtcaggctgggaaacaaggtaggagaagagggtctgtcaacatgggggcctccggagggtgtcagtgggaggagggggcaacaggacacctgarggatggaagggtcaggaggcagacacctgtaagaattgctctcctttactgagcacctcccatgtggctaagcagcctcctgtcactcaacaccctgcga

SEQ ID NO: 2219 - DNA, 201 bp, Homo sapiens
ccttagctggggtcagctctgacagtctctagagtctgtgctcttgaccactgtgccatcctcccccatcactgggtgtccggggtgtggatggtggtgaygttggaggcagagtccctcagcactccacgccgtagcggtcgaagttgcggagcagcaggccgatctccaggtgcacggtgccaccagcagctgtgtgca

SEQ ID NO: 2220 - DNA, 201 bp, Homo sapiens
ggctaggggtcttggtgtggaaatgaaccaggcttgggggaatacctgtgtgaatgccccacttgcagaagaggctactttccgagaaaccgctggccccyatgatctgcccgatcacgtgcacctcagccatggccctgggaggggaaaaatataatcacaaccctgtgaggtaagtgtattatctccatttgacggggg

SEQ ID NO: 2221 - DNA, 201 bp, Homo sapiens
cactaatccattaacccattaatccatgaatgggtaatgagcatagtgagcacgggataagtcttcaatatcattttattacgattctcaccccatatttwcaagcctagtccaaggattaagatggggccaagggtaccctccaggagcgcatcctgaaacacacataacaatttcgatcctactgaggggtgataatga

SEQ ID NO: 2222 - DNA, 201 bp, Homo sapiens
agacagatagggaggaagacagagaggagggagaggaagggttggagggtgatgcagagagggagaggcggggagatgtcagagacggagacgaggcaacmggaccgtggaggagaaaaatagaaagggagagaaaatagtcggagagacaaaaaccaggagacccatgcgtggacagaaagactaacggagacgaaaaga

SEQ ID NO: 2223 - DNA, 201 bp, Homo sapiens
acggcagacatgaacatggatggcagacaaaaattcctgcccccgtgaagctgatatcctagacaacgaatgtagtaaataagcaaattatagggtagatyagatggtggtaattgctgtgagggaaaacagagctgggtagggtgagggtggggataccgctttagcaagaaggggatcaaggaagcttcattaagaagg

SEQ ID NO: 2224 - DNA, 201 bp, Homo sapiens
tttgcctttgcaaccttgggcaaaaaatacatcaaaacattctgtgtcttttaaaacagggaaacagtaaatggcttaccttctttggattttctgcacayctcttgacactccgcgttactctctgcacagatttgctctccaaagtgcttgctgcaggctggctttttgtctttcttgatctcaggcacatggagtctg

SEQ ID NO: 2225 - DNA, 201 bp, Homo sapiens
tccctctacatctgctttcctgatacttctcttgggtcgttgctttgtgcttgttggggtgtccactgggtctgactgtggagagtcgcagggtattttartggttttaccagcagccactaattcctcggtgtgaccaggagtctggaagagctctttaaagccagccaggtcttctagagcctgggccttttccttagg

SEQ ID NO: 2226 - DNA, 201 bp, Homo sapiens
caccatcctcaggcggcagctgcaggggcgaagggccggactgagtcatggtgaagagagtgtctgagatgtcggacaaaaagcaattgaggtccaggagstgccgcccacccggctcctcctctgggtcccccagcagcacggggaccacactggagaagagctgtttgcaccattgctccggcggcggccacctgcctt

SEQ ID NO: 2227 - DNA, 201 bp, Homo sapiens; identical to SEQ ID NO: 1658

SEQ ID NO: 2228 - DNA, 201 bp, Homo sapiens; identical to SEQ ID NO: 1659

SEQ ID NO: 2229 - DNA, 201 bp, Homo sapiens
ttcccagagcatgccccactttggaacccgatacgtgtgccagtttccagaccaggaggaagtgcgtctcttctttccgctgcacctctgggtgaagaatrtgttcctaaaccagactcggactcagcgagtcctctttgtggacagtgtaggtaagagccatcctcctgtcaccctgccccctccacttgctgcccccag

SEQ ID NO: 2230 - DNA, 201 bp, Homo sapiens
cctcatgctgtgggccctgattgtaaataaaaatgcttttgcggaaacagcaaaatttggggaagcctgtcttccacctccttgactgaaaagtctggtcrgaggtgccacctggctacttcctcctcatccttctaggaccttcctctggacccctcagttctgagccctccatgaaaccctcagccatcaaggggactc

SEQ ID NO: 2231 - DNA, 201 bp, Homo sapiens
agggaacaagcatgtccactctcactttaattcaatatgaaagtatttcaataaggcaagaaaaagaaataaaaggcatgcatattataaaggaaatgcaraacagttttttattctcagattacctgattgtgtgtgtagaaaactccatggaatctttttttttccttcaacttttattttaagttcaggggtacatgt

SEQ ID NO: 2232 - DNA, 201 bp, Homo sapiens
tgcatgagtgtagtacaccaaaggctgagactaagataagacagctgagagaggacccctgaggcatagccttcccataaccagatgatgactgagggaaragtaatagaacactaggataagtcctaccatggcactccttcatggaaagttctgcagctacactccaagaaatgggacagggcagcagaaaagagagag

SEQ ID NO: 2233 - DNA, 201 bp, Homo sapiens
tcttatcagatatgtggtttaaaaatattaatattttctcccatcccgtaggttgccttttccctctgatgagttttttcctttgctgtgcatttccttcrctgggtgtatttaaatttgatgtaatccttcttctctatttttgcttttgttttctgtgctttctgatgtcatatccaagaaatgattgctaagatcaat

SEQ ID NO: 2234 - DNA, 201 bp, Homo sapiens
ttacatgcccaccaatagagcgcaagtgttccaatttctccacatcctagccaacgcttgttataggatttgtttttgtaatggccattgtaacaggtatkcggtgatatctcattgtggttttgatttgcatttccctggtgattattgacgttgaatgtcttttcatatacctgttgtctatatgtatgtcttctttgg

SEQ ID NO: 2235 - DNA, 201 bp, Homo sapiens
gcccaggacatcaagcaatgtacatatttggaatgacctcatgctgtgggccctgattgtaaataaaaatgcttttgcggaaacagcaaaatttggggaascctgtcttccacctccttgactgaaaagtctggtcagaggtgccacctggctacttcctcctcatccttctaggaccttcctctggacccctcagttctg

SEQ ID NO: 2236 - DNA, 201 bp, Homo sapiens
atgaggaaaggcctggggcagaagagcccaactccttctcatagctgaccctcatcctcctgccttggcctcctggctgctttctccccttccccccagcrtggcaggatctcttcctgttagcaaggatgaaagagagaggtcagtaggactggaacttggtaactgcaagggcctcaggtggggcaggtgcagagggca

SEQ ID NO: 2237 - DNA, 201 bp, Homo sapiens
atatagtgagccactcttatcagttacagaatggtggaaccctcctgaaaactaagttcccagataacagccaagggccaatcttgtaagcagacctttcyagagatagcagtctcaagcctgccatgttaactatttctgcacaacccctaattgcaaattaagtatacacttcttcatatgtcaaagaaaaatgataag

SEQ ID NO: 2238 - DNA, 201 bp, Homo sapiens
ctcacatctaacagcatcacactcaatggtgaaaaactgaaagctttttctctaagattaggaccaagacaatggtgaccactctggccacttctacccamgataatactggaagtcctagacagagcaatctgtaagataaagaaataaaaggcatccaaattagaaaggaaggagtaaaattgtctgttcacagatgac

SEQ ID NO: 2239 - DNA, 201 bp, Homo sapiens
aggaatctaggctgggtgctgtgcttagtcccctagccacctgggagcttgcttaaaaatgcaaatcttctgggctctgacaacaaggttttgtggggcargtctaggaatctgattccaatacttgaggtccttgacctaactgttgggaatgaagatgtcttagtcctgatgatggcaatggtagtgtgctccacccag

SEQ ID NO: 2240 - DNA, 201 bp, Homo sapiens
aacccaggattttcttggtgtgctgacctcttagcattatgctggatcctctttctggccttgcaatgtgaggaatctaggctgggtgctgtgcttagtcmcctagccacctgggagcttgcttaaaaatgcaaatcttctgggctctgacaacaaggttttgtggggcaggtctaggaatctgattccaatacttgaggt

SEQ ID NO: 2241 - DNA, 201 bp, Homo sapiens
agcagacctttctagagatagcagtctcaagcctgccatgttacaagatacaaatatcaggaataaagagagtatcactggaaaccctaaagacattacarcataagagaatatcatgaacaactttatgccaatgaatttaataacttagacaaaaaggaaaaaattcatgaaagccatggattaacaaaactgacaaaa

SEQ ID NO: 2242 - DNA, 201 bp, Homo sapiens
catttttcagtttcactgttacatgccttgaagtgatgaggaggtttctgttactatatgctacacagcagggacaggcaaaggccatcgcagaagaaatrtgtgagcaagctgtggtacatggattttctgcagatcttcactgtattagtgaatccgataaggttagagccgttacagtggattttaccgttttgtgct

SEQ ID NO: 2243 - DNA, 201 bp, Homo sapiens; identical to SEQ ID NO: 2195

SEQ ID NO: 2244 - DNA, 201 bp, Homo sapiens; identical to SEQ ID NO: 2197

SEQ ID NO: 2245 - DNA, 201 bp, Homo sapiens; identical to SEQ ID NO: 2200

SEQ ID NO: 2246 - DNA, 201 bp, Homo sapiens
tgaaaggtggtggggatctaagtccagtaccgtagtttggaggaaatggaaactgctgtgcatttgcctggggaatccgagggttgctcatagttgctggsataccactaggagccaccatgcttggtgtcatattcaacccttgtcctctcatcatcaaagttcgttgctgaacttgctgttgctgatgcatttgtctct

SEQ ID NO: 2247 - DNA, 201 bp, Homo sapiens
acgatgcacatctttttctagatgtctccatatgcttgagaggtttttttccccccaagccagccattaggagacttggttctctctgccaccaagaatcytaccacattttcaaggattgttgcaaagaattaagtaaaataatgtgttgctcttcagcatacaaaagagagaagggcatatgtcagagtgcccataagt

SEQ ID NO: 2248 - DNA, 201 bp, Homo sapiens
taatctccctaattgcatgcaatgaatgccaaaaccttagctctggaatccatcagagttgtaactatcaaatgaaaccatttctcctttaaaaaaaggamctactctctttatttgcacaatctaccttctcccaagggtatgaccaagaaggtttcagttgtaattccaaacccattacagagcatcaccaataatatg

SEQ ID NO: 2249 - DNA, 201 bp, Homo sapiens
aaactgtgagtcaattaaacctctttcctttataaattacccagtctcgggtatttcttcatagcagcgtgaggactaatatatacacccgttagtctcaraacaattctctcaaattctgatatacagacctttaaaaaacagacatcatctacatggcattctaaattttctgatattttcattctttactagccactt

SEQ ID NO: 2250 - DNA, 201 bp, Homo sapiens
acatttgtgtacaagtttttacacagatgtatgctttccattctcttggatatatagctaggaatggaatcggtgagtcatatggtaactctatgtttaaytttttgaagaaatgcgaaactacttcccaaacttgctacaccattttacattcctaccagtaataaacaaggattccactttttttttcaaatcttcccc

SEQ ID NO: 2251 - DNA, 201 bp, Homo sapiens
tactctctatctctatggatttacctaatatgaacatttcatataaacagaatcaaataatatgtgaccttctatgtctcacttgtttcaattagcataaygttttcaaggctcagcaacactgctgcatgtatcagtacttcatttctttttatggccaaatattccattgtatagctataccaaattttgtttacccat

SEQ ID NO: 2252 - DNA, 201 bp, Homo sapiens
atttgctaatgttaacagccctctcacaggctccttttcatctgttcagtaactggagactctttccaacatggtctttagagctttctagagatacgacygtgactttgttggtcttcacgcactgggtgtgtctgtaaatacagcgctgtccacggtgtctgtcctgcttccatcccaaattcaggctttagcttaaaa

SEQ ID NO: 2253 - DNA, 201 bp, Homo sapiens
gaggattgcttaaggccaggagttcaagaccagcctgggcaacatagcaagactccatctctaaaaaataaaaatcaaaagaagattgcagtcattcttaygccgttcacctgtgtgtaatgcgtcatctttctctggctgcttttatggtttcccttttcatcactggcattcatccatttgattgtggtgcgtcttggt

SEQ ID NO: 2254 - DNA, 201 bp, Homo sapiens
tctgaaaccctctctccagcagtagaaaaaaaaatgaaatcctttctttttaaatggctgatagaaaaccaggttaatttgtaatgaagtacaaaaatgaygaaactaaaatatgatactcttgttttgtcaagggtttgcttcttgagttttagggttcaggaaaactaggtacaccttatgccaaactaagtaaatact

SEQ ID NO: 2255 - DNA, 201 bp, Homo sapiens
aaactgcaggcaaaagtgcccattggtggaactgctcacagaaagaaggtggttcacagaacagccacagcaaatgataaaaaacgtcagttctccttaargaagttagaaatctctggcattgaagaggtgaatatgtttacaaaccaagcaacagtgatccactttaacaaccctaaagcccagacatctctggcagtg

SEQ ID NO: 2256 - DNA, 201 bp, Homo sapiens
tatacaaatgtacattctagtgtatagtcactcatagagaaatatctaaaataaactctatggacagaggaatttttatgcacttttgtagatcgaagttmaaaaattcatttccagtgtaaaggtaggagatggaaaatactaaagagcagcactgaaggttctaaaatttcatttggtgaccagctctaaattaatagt

SEQ ID NO: 2257 - DNA, 201 bp, Homo sapiens
caacaagttccatttgtatcactagaggaggctctatgtcatatcagaaagagatttttggaaatatatagtttcaggttcaaattccagaactacctacstgacaatatgatttaattcatctctctataccttagtgttttcagctaaaaatggggtaagttctctctcccaagctactggtaagaatttgatgaaata

SEQ ID NO: 2258 - DNA, 201 bp, Homo sapiens
tccaaaagaatgactttgcataacatcgttgagggcttcccactcatacacgatcttaagaatgggaggccagtgtgagctctgtggagagcatgtcacasgagataatgggcatctgcaggggaaggcagagggctgggaagatgtggtgtacacatctgcatcctggctatggaagcttctaatgtgaattaagcactg

SEQ ID NO: 2259 - DNA, 201 bp, Homo sapiens
caacttatgggtcacatttcaaccttatgtaatttgaaacagctacggtactgaatccttaaatacagggcatataatggaaggactgctcacagatcctygatgttactgaagcttggaaagctttaataagatacaactataaataaagacaactaaggagcattacccctttatccacagcccaaatccccctccaag

SEQ ID NO: 2260 - DNA, 201 bp, Homo sapiens
caagagaaaaggtgaataagaaaaggaagaactgaatattttcaataatgagggcaactgtttgcaatgtttcttcagagtctgtgtctttgtgaacaaartgcttcgctgtaaatgagcctgcagcttttcgtctgatccttccactgcaccaattaagtttgttcccaagaaacacaatgaggaatatgaaaacaagaa

SEQ ID NO: 2261 - DNA, 201 bp, Homo sapiens
taaatatacgcagcaccatggctctggccaagcaatgaaggcacagggagaatggggctgagaggacagcagactccagggagcaaaacaagaaagaccaygagaacaaaggaagtaactgtaaggcgagtgcaggctgcttgtggccagggcgcaagctctctgtggacagggtcatggggcacgtggtggggtggcgtg

SEQ ID NO: 2262 - DNA, 201 bp, Homo sapiens
taattccccaccacatcccaagcaaccatttgcctgatttctaccactacagcttactttgtccctgttcttaagattcatatgaaaggaaatatacaatwtatgtctggcttctttatttagcataatatttttgagactcatccatatggtgttagtttatcactagtttgttcttttttattgctaaatagtatccca

SEQ ID NO: 2263 - DNA, 201 bp, Homo sapiens
agttcttattaagtcagattaataagttgaaagttaaaaggatacaatataaagtaaggcaaagagctctttagacaagtgaattaataatagtgaattartaagtagaagtcttttaaggaagtcataaaactactgaagagatctgaaaatattagttacttgaaataagaaatcccattttcttaatttactagagaa

SEQ ID NO: 2264 - DNA, 201 bp, Homo sapiens
ttgatgttgcagtcttcagtctgaaggaagtctggaaacagaattccttccttcttgggggacctcagtttttttgttttttttttttttctcttaatgckctcagctgatttaaatgttcaatgagcactgctgatttcagtgttaattacatctaaaataccttcagagcaacatctagactagtgtttggccaaacaa

SEQ ID NO: 2265 - DNA, 201 bp, Homo sapiens
aaaaaaaaggaaatgtcatatctgaaagcaaagccacaaaactcattcttcaaatacagtatgtggaaagtggagaaaaggaagaaaaggtgtatgcaaaragcattaaaaaaattacttgggaaaaatgtttagtcaactgtttaatttgatggtaacaccagctctgactttttcagaaaaatgcaatgtttttgaaga

SEQ ID NO: 2266 - DNA, 201 bp, Homo sapiens
tgatgtattccatatgcctgattctaccagccagttttctgttttctagactttactcccatattcatatctttataatagctttaatgatatataatttrcatgccatacaattcatcaatttaaataaaatgtacaatagtttttagtatattcagagttgtgcaaccaataccacaatcaattttagaacattattaa

SEQ ID NO: 2267 - DNA, 201 bp, Homo sapiens
caattcagactcattaatagtttgttttatctcactaaataacttattgtattcccttgaaatgaaagaaaagtcttcaataagtttgtacagcaatcaayaggagatacaattaacctgtatttggaaacagtgaaggtgagcaagaggtgaaagaatcattgtttttttcttaaagtaagtcattctaactttgatcta

SEQ ID NO: 2268 - DNA, 201 bp, Homo sapiens
aaaagggtgaagaattcagagcttactcttattctcacaagaatgaaacatatgtattttctagctaatttgtcatctattctttaattctgtattgaatytgtgctttgaccatttctcaatattaaaaagaaaaaaatcaataatatgaagtgatagaaaacactcagaaatatggctttaccaatgtaatcggaatct

SEQ ID NO: 2269 - DNA, 201 bp, Homo sapiens
taaatagcttaaaatatgaaaattatatttaaaaagttgtttataaaattctaagactttggtcttagttgtgcaacttttaaaatctcctaaatcacaaytctgtttattagcgcagtaaacctcatctcccattattcctagcttatacaccatagcaatatttagtatctgtctccccccaaatgcatcacattcttt

SEQ ID NO: 2270 - DNA, 201 bp, Homo sapiens
gcgcagtaaacctcatctcccattattcctagcttatacaccatagcaatatttagtatctgtctccccccaaatgcatcacattctttcaagattttgascattctctcagattgttccattggcacagatgcccttccaccccttctcttggaagatgccaccacagctccagaaagctcatgtcaacgaagttaggcc

SEQ ID NO: 2271 - DNA, 201 bp, Homo sapiens
aaactcattggtgtttagatctttgctctcacgtatccgaatatggattgggagctcaattaaaaccttgatttccaaaaacagagagggtttagtagagyatatgaaagtacctcaggggctcttcagacgaattactataataaactatttataagaaggaaagtaaggcctggtgtgatggctcatgcctgtaattcc

SEQ ID NO: 2272 - DNA, 201 bp, Homo sapiens
acttgaagaagttactgggagctgctattttatattatgactgctttttaagaaatttttgtttatgggtctgataaaatctagatctctaatatttttawgctcaagtcccttggacactacagctcttttcagtttttgcttatacgcaattcattctttgcagctaattaagccgaagaagtctgtgaataaagtttg

SEQ ID NO: 2273 - DNA, 201 bp, Homo sapiens
actgcctcaaaaaaaaaaaaaaaaaagtagccaggctcctggacttgtttcttcccaatcataaaattttcctgtcaaaaattccatgattcgttcaataytgctaataagagagtcagctggatactactagggttggtgtaatattaaacccaagtgacaggacccacatctgatgtgcaatgacgctccagagtgatc

SEQ ID NO: 2274 - DNA, 201 bp, Homo sapiens
aacccaataacaactgacatcctgaagcacaaagaaaactgtcatggacacaaggaaaggaaataagtagtcagcttataaaattatgcctaccgctaccyttgataatgagttcaaacacatcaatatatagggcaggaaaatgaccaaaacatttccccaacctagaaacaaaaaacgaaataagttacattttgtatc

SEQ ID NO: 2275 - DNA, 201 bp, Homo sapiens
tccttcaggtttgttctttacttgattgtaagaaccttctgggacagtgacaaaataaatgtggaattggaagagttatcttcttaattctaccctgattwagcatatttggatacacaaaatatctaatacaactaatttttcataacatttaagagctatataccttaagttcacggtataaattaatttcatatctag

SEQ ID NO: 2276 - DNA, 201 bp, Homo sapiens
attatttatccaaaggagatttcagtaggtaccaggcaggctgtgcacatccattttctttctcacagaggaagtagacttactaagacacccttcgccamacaagaagcaaaacagcattctttcctatgaggtttgaaatttctaatatatcagaaatgctttgcttttttccttcatcaagaatatattttatttata

SEQ ID NO: 2277 - DNA, 201 bp, Homo sapiens
ggttctacaaagtccagatggtatcttctgtcctacacaagttaggctgtgtcgtaagactcttctaccaggtactttcttgacatctgtgagaggcaagsaggtatttccccagtacttaaacactaggtctgctaattactgagtcagatttaacgaatacgtaaactactctggctatgctaaacacttagggaggct

SEQ ID NO: 2278 - DNA, 201 bp, Homo sapiens
gactcttctaccaggtactttcttgacatctgtgagaggcaagcaggtatttccccagtacttaaacactaggtctgctaattactgagtcagatttaacraatacgtaaactactctggctatgctaaacacttagggaggctgcatcagatttttcaacaactggtcagtatgtactgagtccactgagtacgcagcta

SEQ ID NO: 2279 - DNA, 201 bp, Homo sapiens
tcacactaaggacaatcttaacttcactcagtcctgtcccagtagtcctttaccagccactaactcacttcactgcctttgcttaagctttccttgcctarcttcaaagttttccattcatattcaagattaagtatattcttgaagtttgctcgaggagattaatacattcggcttctgtcatcactttccttaaaacat

SEQ ID NO: 2280 - DNA, 201 bp, Homo sapiens
atggtactacaaattttaagctaatttttaaattgctaaaactgtattaaattacagattttttcctttttacagatctcttcagttgcctaagagttcayagctacaagtaacagatattccttacgttaaaatgtctaaaattaatgctatgtattaatttatgtgaaacttctaaaaagtctaacattttgatgttat

SEQ ID NO: 2281 - DNA, 201 bp, Homo sapiens
tgatgttttgttgatgtggcttaagttatctcagaggaaaaattcatactcaactacaaatcaatgaaaagtctgcaccttctcacatgattcccccgaaratagttctaaggtagatttcaggagtatgcactcttctactttaaggcagtagcaaacattctctagaaaacatatgctttgaaaatgtgctttcttaac

SEQ ID NO: 2282 - DNA, 201 bp, Homo sapiens
tgaaaaatatgtttgcataataacaatcttgaaaaaatggcagaacttcacttaagcaagactgggaaaagacatttattcttatatggcataaactgtgraaaagctgatagtttattattctctgagatgtgaacagtaccaatataatgaatttatttatgggaaaaattaagatgatcaaagcctacagtaattaaa

SEQ ID NO: 2283 - DNA, 201 bp, Homo sapiens
tgaatttaaaataatctactctgaattataataccaaataactaaccaagatttattgaacaccaactgtatgtcaaatacctatcactgcaggtgattcraagtgacaataacaacagcgaacatttacaaaaattggggcgcaaggtcacacttgtttaagtgatggagttggatggcaatccagacagtgctacacca

SEQ ID NO: 2284 - DNA, 201 bp, Homo sapiens
caacttaacttagaatacatttagaaacgtaaagttccacgtcaagtgatgtttatatgaagattcctgagacagggcaagatttttaatgtgtgtagccstttcatgtaaaaatacttttagtagaatattttattatttttttttaaatttattttttgttactaccagctgagcagtttgggagggtagaatattttt

SEQ ID NO: 2285 - DNA, 201 bp, Homo sapiens
aaaaggaaacctgctgagttcttttttaaaactgaataatctttagcaatacaaatgatcaactcctacttaaattattttatatgtaggaatctgatacmttaaaacaggttgtctatgtagtattactctaattaaaaaaacaaacagctaaccaaagaagaacaagcttagcggagaaaatatgaaaaaaattttgaa

SEQ ID NO: 2286 - DNA, 201 bp, Homo sapiens
aactcccaacctcaggtgatctgcccgtttcagcctcccaaagtgctgggattacaggcgtgagccaccacgcccagcctcaagttttctttagctcagcrttgtcctaggccttcttgaaaaccatctacccatgtagtgctggagccgcccagagccctgagctctgatcagcacagccctaaggccagcctgtgacag

SEQ ID NO: 2287 - DNA, 201 bp, Homo sapiens
cactgcactccagcctgagtgacacagacaccatgtctcaaaaaaaaaaaaaaccccaaaaaacaaacaaaaaaaagatgaatgtcaattagtaaaaacartagctggcagtcatagaaaaaaatcagataccagaaattaaaatttggaaaagtcttatgtcatagtacaaaagcaaaatgctgaacacaagttaacaaa

SEQ ID NO: 2288 - DNA, 201 bp, Homo sapiens
ccctcagctggttctggctgctaacgccaaaggtcttaagatatgccccagaagtcaggggaactttactgacccccaagtgggaagaaccatgatcagcwcctgcttgctgaattcctctcagtaagaaaataaaaaaaaatgtaagaaaatcagtgtgctcgtcatcactaacataatcaaaataatatttaggtaagc

SEQ ID NO: 2289 - DNA, 201 bp, Homo sapiens
taatgaaatagtaggttaaatattgatttctgtcaatgtagcatcattatttccttgtattctttcaaacttgaagaaaaatgacggaagacacaagttgrtggattatgcacttatttctaaaaaataggatgaataggatgaaaagaatgaataagatgaggggaaaaaaagggcatgggagaaacaggtcatttatta

SEQ ID NO: 2290 - DNA, 201 bp, Homo sapiens
tgctctgacatacttttgttccatgattacctccagcctggtggggaacaacattggcagtgtgggtgcccaagccttggcactgatgctggcaaagaacrtcatgctagaagaactctggtgagtttgggggattctctgctctggggaagtggatcacaatctctgttgatcccctggcctcatccataggagcggttg

SEQ ID NO: 2291 - DNA, 201 bp, Homo sapiens
cccctctggcccactccccacagctctgcattcagcacggctggaccccaggaaacggtcgcttcgacgtgctgcccctgctgctgcaggccccagatgakcccccagaactcttccttctgccccccgagctggtccttgaggtgcccctggagcaccccacgtgagcaccaaagggattgactgggtgggatggagggg

SEQ ID NO: 2292 - DNA, 201 bp, Homo sapiens
gccacagacaatagagcagtcttggcagctacatggtgctgtgacctcatccacagactcgtcacagcctttggtggcattgttcatgggctccatcccayggactggaaaatctacagaaaggaattgtgttgagtacaaatctcaattaaaaacatccaaaattttgtattatacttaaactcaaagaaaagcccactg

SEQ ID NO: 2293 - DNA, 201 bp, Homo sapiens; identical to SEQ ID NO: 1626

SEQ ID NO: 2294 - DNA, 201 bp, Homo sapiens
gtttacagtttcttcttagcatcattagtaccaagtgaacaaaactacgtaactcagatctgccattggttaatttagaaaatgaagtttaagtgcttgcygcaagtgtctagcttcccacaatgcaaggacagtctgctcacacccatgagtgactcactctttttcccaggcctgggccctctggagcttctctgtatc

SEQ ID NO: 2295 - DNA, 201 bp, Homo sapiens; identical to SEQ ID NO: 1627

SEQ ID NO: 2296 - DNA, 201 bp, Homo sapiens; identical to SEQ ID NO: 1628

SEQ ID NO: 2297 - DNA, 201 bp, Homo sapiens; identical to SEQ ID NO: 1629

SEQ ID NO: 2298 - DNA, 201 bp, Homo sapiens; identical to SEQ ID NO: 1630

SEQ ID NO: 2299 - DNA, 201 bp, Homo sapiens
taatacagctcagcactcacctttgggagctcagaatcactgggcaagaggcaggcaaatacagcccagtgccatcaatggcacatggtgcatggcgctaygcaggcacagaggagggagcaaacactaaaaggcaaaattatagccaagaggaagagactgtacagacccagagctccgaggatgagggggatttcacca

SEQ ID NO: 2300 - DNA, 201 bp, Homo sapiens; identical to SEQ ID NO: 1632

SEQ ID NO: 2301 - DNA, 201 bp, Homo sapiens; identical to SEQ ID NO: 1633

SEQ ID NO: 2302 - DNA, 201 bp, Homo sapiens; identical to SEQ ID NO: 1634

SEQ ID NO: 2303 - DNA, 201 bp, Homo sapiens; identical to SEQ ID NO: 1635

SEQ ID NO: 2304 - DNA, 201 bp, Homo sapiens; identical to SEQ ID NO: 1636

SEQ ID NO: 2305 - DNA, 201 bp, Homo sapiens; identical to SEQ ID NO: 1637

SEQ ID NO: 2306 - DNA, 201 bp, Homo sapiens; identical to SEQ ID NO: 1638

SEQ ID NO: 2307 - DNA, 201 bp, Homo sapiens; identical to SEQ ID NO: 1639

SEQ ID NO: 2308 - DNA, 201 bp, Homo sapiens
ctgcagacctatactgcctcaactcctcagagggaggctgcctcccaaatagctggggcactacaggggactgggctatatatctgagacagaacaaaagrcaccaaaggctcttctatctttaaatcttgtggggggtgtgatacatgacactgtgttagcgacccaggcacgaggtaaagggtgagaggcagctgcact

SEQ ID NO: 2309 - DNA, 201 bp, Homo sapiens
atataatatgtggtctttcatgaccggcttctttcatttagcataatgttctcaaggttcatgcatattgtggcatgtatcaatacttcatttctttttayggccgaacaacatttcattgcaaggacatatgttttgtttatccatatatcaggtgataaatatctgagttgtttccacagtttggctattatcagtaat

SEQ ID NO: 2310 - DNA, 201 bp, Homo sapiens
tatctgttcaggttgttttgtccatttttcaattgggctgtttgctttcttattgagttttaggagttatttgtatattttgaataacagtccttactaayatgtcttttgcaaatactttctcccagtctgtgtcttgtcttctcgttcttgaggtcttcaatttttcacaatcacaatagtgttacagtgggtgttctt

SEQ ID NO: 2311 - DNA, 201 bp, Homo sapiens
tagcttctggttttttatgtgactcacccaaggtcatattactagttagtcttagacatttaggagccacaaaactaaaacaaaactatgaaagtgggtgycagtatacactgtctgcagttttttccctatggaatgttcacagtgtggtgactgaatcaggggtcaggccagcaggctaaacccattcctgatctatta

SEQ ID NO: 2312 - DNA, 201 bp, Homo sapiens
ctccctttgtgcacatctccacgcttaagcaatgcaccccccactctgtccagccttatttttctcctcatagcactaatctctagctggcacgatagcayatgttatgtgttcatcaaccgtctccctccattaagatgtaagcttccagctgggcatggaagctcacgcctgtaatcccagcactttgggaggccgagg

SEQ ID NO: 2313 - DNA, 201 bp, Homo sapiens; identical to SEQ ID NO: 1640

SEQ ID NO: 2314 - DNA, 201 bp, Homo sapiens; identical to SEQ ID NO: 1641

SEQ ID NO: 2315 - DNA, 201 bp, Homo sapiens
tatataaggatagtatcagtgtattacacctaagaaaatagctggaatgggtcctgtactgtcgattctcatttaccagtctctgcttgctagaaacttcscaggatcttctttccctaatcttcaaggagatgcttacacattcattttgttttacccttgttctggaaagacaggttaactagggtgacagtcatctcc

SEQ ID NO: 2316 - DNA, 201 bp, Homo sapiens
aagtgctggattataggcatgagccactgtgcccagctgtttttggtttttggatttctttttaataaaggttcctattttccacagccttgtcaacactkcttgttatgtgactttgattctagccatcctggtgggtgtgaagtggtatctcattgtggttttgatttgtatttccctgatgactcatagtattgagca

SEQ ID NO: 2317 - DNA, 201 bp, Homo sapiens
gtgggggcctgacagggggacagtgtcttgttctgttgcccaggctgaagtacagtggtgcaatcgcggctttttgtggccttgaccacccgaactcaatyaatcctcctgcctcagcctcccagtagctgggactaaaggtgtgcaccaccattgctggctaatttttgtatttatgtagagatgggattttgtcatgtt

SEQ ID NO: 2318 - DNA, 201 bp, Homo sapiens
attgagcatctctcatgtgcttgttggtcatttgtatatcttccttagagaaatgtctactctattcagatcttttgccattttaaattgggttatttatytatcattgagtagtaagagttttttttttttttttttggagatggagtctctgtccctcaggctggagtccaatggtgtgatctcagctcactgcaacct

SEQ ID NO: 2319 - DNA, 201 bp, Homo sapiens
caatcctgttgctttacattcttcccaattttggccttcttgttgaacttacgacaactttgttttcattctcattctctgtagtcaacaggagaagagayaccatatttacaaaaagaagcgatcaactttagacatgacagtgcaggagttttcatgccctcaacttcaccaaaacccagcacaaccaatgttttcact

SEQ ID NO: 2320 - DNA, 201 bp, Homo sapiens
aaagtcaacctcatgataagagctgtgtgcacccaggaattggtgactgcaatagccatgaccatgctgagcaaggctacacacatatggtggttcataayagtactgtaatgaagagggaaacaaatggccacatagcggtcataggccatggtggtgaagagaaccatctcagctcccagagaccatgtgaacaagaag

SEQ ID NO: 2321 - DNA, 201 bp, Homo sapiens
cagcatcttcggtatgatgcttgttgtgcagatgatgtccacaacagccagtgtcagaaggaaaacatacatgggcgtatgcaaggtgttgttatagattwtggcaatgatgatgagcatgttgccgagaaaagccacaagatagacaatgagaaaaaagaggaagataattccctggagttcaggctttttggtgaggcc

SEQ ID NO: 2322 - DNA, 201 bp, Homo sapiens; identical to SEQ ID NO: 897

SEQ ID NO: 2323 - DNA, 201 bp, Homo sapiens
gaccaaaggaaaatgtcagcaggaaaccattcctcagtgactgagttcattctggctgggctctcagaacagccagagctccagctgcgcctcttcctccygttcttaggaatctatgtggtcacagtggtgggcaacttgagcatgatcacactgattgggctcagttctcacctgcatacccccatgtactatttcctc

SEQ ID NO: 2324 - DNA, 201 bp, Homo sapiens
gcgcggcagcccttacccccacagcgctgcagccctgcagctggccctcagccctgggaggagccttccttttccagagagacctcgccctgcactttcascttccctatggcctccgccttcctagaggcctcccggtagcgccactgcctggagggttggtaggagctctcgtcgctcactgggccctgccggccccgc

SEQ ID NO: 2325 - DNA, 201 bp, Homo sapiens
cagccgatgaggaaggcccacagctcgcccatggatacgtaggtgaacaggtaggcagagcccgtgcgtggcacacgtgccccaaattctgcatagcatarggctgccagcagggaggccacagcggccacaccgaaggacaagagcacagcagggccagccacctccttggccacggcacctgtgagcacgtagagaccc

SEQ ID NO: 2326 - DNA, 201 bp, Homo sapiens
cccactcctcccaggtccaatgccttggagacctgggaccccacctattttaagcactgccgctatgaaccacaattcagcccctactgtcccgtgttccrcattggggacctcgtggccaaggctggagggaccttcgaggacctggcgttgctggtgggtcccaagttgggggcagggttcctagagggctctgggaga

SEQ ID NO: 2327 - DNA, 201 bp, Homo sapiens
gtgaggagactccttcttcccctcgtttctttcctccccagctgcgtgcacttcgcatgtgagaaaactgactgtccagagctggctgtggagaatgcttmtctcaattgctccagcagcgaccgctaccacggtgcccagtgtactgtgagctgccggacaggctacgtgctccagatacggcgggatgatgagctgatc

SEQ ID NO: 2328 - DNA, 201 bp, Homo sapiens
aggtgccttggaaaagtgacatggaaacagctaactagacagatcagcaaaggggtgtgtgttggggagaaggaagaaatatatgtagtaggcacaggcawggatagtatgtggaagcacattgatgagaaaaaaaaaaaaaaaaacatgccacagatttttttgtttgtttgttttctttttctgtactcacccaagcaa

SEQ ID NO: 2329 - DNA, 201 bp, Homo sapiens
cctttctcacaaatggaaaaactgaggctattcaaggtttaaatcttgataacatacaaagctttcaagtggcaagatttgaactctggtttgtctgttgycataacttgtgctcttaatgagaaactttaatcgctgcctctagagtcatcttcaccctagccagcacccctttctgtcctcagtctcaagccccctgaa

SEQ ID NO: 2330 - DNA, 201 bp, Homo sapiens
accagtagcggccctcccgctagcccaggggttgtggctccccagtgagagagctgtgcttaccagtgcgagcgcaggaagttcaggagcaggatggtgaygcttagagagtagcaggccaggtagggggatccgaaggccctgctcagcttgcgggtcttgtgttcccatcgtgcaacctaaaccgtgagcagagaacaa

SEQ ID NO: 2331 - DNA, 201 bp, Homo sapiens
tgctaaatgtcactgaattgtaaagcttaaaatggttcataacagtttatgttatgtctattttactgcacaaaaaagaatacccacctctagacagccaytgaagcgaggcatgcatgggaaagggtgtgggggtgtggggtatgcaggagctggtcccgagggtcctgtcagagcctggcccaacagcccggtccggct

SEQ ID NO: 2332 - DNA, 201 bp, Homo sapiens
gtagcattgaggctccatgcccccagcaggaagtggtagaggcgattgtgggggccagagtttggagctgacatcagccacgcagaagctgtgtgtctggycttggcagctggcactttctgctccagctcagccagggcctggatgacagagtccatgagcaggggcagggaggctgcaggaggaaagaatgtgttagcc

SEQ ID NO: 2333 - DNA, 201 bp, Homo sapiens; identical to SEQ ID NO: 1605

SEQ ID NO: 2334 - DNA, 201 bp, Homo sapiens; identical to SEQ ID NO: 1606

SEQ ID NO: 2335 - DNA, 201 bp, Homo sapiens; identical to SEQ ID NO: 1607

SEQ ID NO: 2336 - DNA, 201 bp, Homo sapiens
tttttttttaaatcaggtggtcatgtgggttagaatacagaaaaaagaaagcaaagaggcaaagttaccttgatgttgtcccccaaccgagatcagattgrtcatgggaggtgaagggcatctctgagccactgccctcctacggaataaaagggagttttagctccgactgtcagatggaaatgtatcatccacaatcag

SEQ ID NO: 2337 - DNA, 201 bp, Homo sapiens
caagggcattaggttagggttaattgagattaatgactgacagtgattagactgctgatcaggacagctacctctttttcccggtgtcggtaaacatggcrgccttgcttcatttttgatggagcatgggagaccaatttcaaccggaccttctctgaagatctgttcagtatctcttaagcagcgagcctggatgacaaa

SEQ ID NO: 2338 - DNA, 201 bp, Homo sapiens
agccatcctgtcttgctttgatatctccccctcctctcctctccgtgtatagggacccagggtcctgatgaaaagaagtagacagctttggacatggagtrggggaaacctggggctcccagctgcaccttgggataccgactaaggcttgtaggtttaacttaatgtcttccttattaaccttattcaaatgtggaaatc

SEQ ID NO: 2339 - DNA, 201 bp, Homo sapiens
tcaacaattttagtttttgcaaatgatgcagcaacacactgttggcaatggtaagggcatggcatttggatacagaaaattctagctctagttttatttcrcagacatttattagctgtggaaatgtgggcagatgaattagcccctctgggcttcagtttccaattactactgcattctctaacttacaggactgttgtg

SEQ ID NO: 2340 - DNA, 201 bp, Homo sapiens
gcatgtgctgttgattacttgaggcgttcctctcaccttaatatgtgatgcgttgatgtaaccagtgttgttttctttagttgggaccaactccactctcrcatcatcataaggaagaacatcttggaatcgatttctttctgcattttcagggagtcgtgctgttgagcactccccatcaactagccgtttcttaagaat

SEQ ID NO: 2341 - DNA, 201 bp, Homo sapiens
ttggacgacatcggcgagggctgcaagtagggctgaggattatttaaggagttggtgctgtgtgcactgtagacactgccattacggatccgaccgttgargtcaatctgggctctatccaagcttgtctgagagtgacagtagtatccgttctggttgggcacaaagaggttatctagaaaaaatgagttcaaaatgaga

SEQ ID NO: 2342 - DNA, 201 bp, Homo sapiens
aaagttaaagtcactcacataaaaatcccttgaggtcttctggacagccatgttcaggccagtctgtgtattggaggtgccagacggtcctctcttgcccrgtaaggaggtgcttcatcttcaggcctgtggtggcatagcagccagagtctgtgcggaaccgggtcgtgatcttaaaccttccataggtgacagtgttgt

SEQ ID NO: 2343 - DNA, 201 bp, Homo sapiens
cttgttgtagtaccagaggctgaagtaagtgacctggaaagacagaaggtcattgaaggaggcaataacatacaaaaggatttcaatgacttcagtcgcamtaatccctgacctgtgaccaaatgacagcagtctcttattgcctttcttctcagagaagaacaacagcaaaaactgaaggaaaaaaaggaggtaagacct

SEQ ID NO: 2344 - DNA, 201 bp, Homo sapiens
aaggcaaatttctgaagaaagtcctgggattcatactgatcaaagtcaccaaaatccgctatatagaatgacaaacattcacgttaattatatttaaattkcattgcaaaatatgcacaacaaaattcaatacgcagtatatctagatggtatgctaatatttcagaagtcaaatttgttatagctatataaagtatattt

SEQ ID NO: 2345 - DNA, 201 bp, Homo sapiens
acttagggttagggaatggcagacctggagaaaagggttccgctactaccctcggctttgccaaacttaacattttgaaattccattccacaaatgtgtaytgcgtctctgggaacaagacagcgtaatgagcatcgtgagaaatctaagacgaatccctaaaccgtcgctgtctttaaagagattacaaccatgctataa

SEQ ID NO: 2346 - DNA, 201 bp, Homo sapiens
acttaaactgtaagcgaatataacctcatcaaactcactgactggcatatctttcttcttaaaatatgacctattagcagacaaagtctttgaactagatraatacatagcatagtattaataaatgtatatgtatatagtcatgtgtcaaggatgggaatgtgttgagaaaggcatcatcagattttgtcactgtgcaaa

SEQ ID NO: 2347 - DNA, 201 bp, Homo sapiens
acaaagtctttgaactagatgaatacatagcatagtattaataaatgtatatgtatatagtcatgtgtcaaggatgggaatgtgttgagaaaggcatcatyagattttgtcactgtgcaaacatcagagtatacttacacaaacctaggtggtgcagcctactccacacctaggctatattgtatagcctactacacacct

SEQ ID NO: 2348 - DNA, 201 bp, Homo sapiens
aacacaatggtatttgtgtatctaaacacagaaaaggtacgctaaaaatagtgttataattttatgggaccactgtcctatatgaggtcttttgttgaacraaatgtcattcggcatatgattgtacatatgtgtgtgtatacacacatatatacatacttctatttattgtactgtttgctctgttgacctataacatga

SEQ ID NO: 2349 - DNA, 201 bp, Homo sapiens
cattattctagatgctggggataccgtactaaatggaaatcacagacactctgccagtgcagtctatggagccatctggaatccaaactgtcctccgtatytggtgcctgtgaagtgcaacccagttacagttcatgtttgaattcctctgacagcccacccctttaatcatttcatatgagtctttatcatcttatttca

SEQ ID NO: 2350 - DNA, 201 bp, Homo sapiens
atagatatttttgtatagctgtacaatgtgtctgtgttttaacctatgttattacaagagtcaaaagttttaaaaatttaaaagtttgtaaagcaaaaacrttatagtaagctgaggttaatttattatcgaaggccaggtgtggtggctcatgcctgtaatcccagcactttaggaggccgaggtgggaggatcacctga

SEQ ID NO: 2351 - DNA, 201 bp, Homo sapiens
gtttttaaagagtaaactaggattaaaggggaaattttagtagtcacgtgtcccttaacgatgtgggaatgcatcattaggctatttcattgtgtgaacaktatggagtgtacttacacaaacctaaatggtatagcctcctacacatttagggcatgtgatatagcctactgctgctaggctacaaacctgtacagcaca

SEQ ID NO: 2352 - DNA, 201 bp, Homo sapiens
cagtggatcccttaagcccgggagtctgaggttacagtgagctatgatcacaccaccacactccagcctggaagacagagcaagaccccgtctctttaaawaaataaataaataaaagtgttagatggtggaaatacctagcaaatgtttgtctcaatgacttacaccttttgagctcactatagtaagggtaaggaagaa

SEQ ID NO: 2353 - DNA, 201 bp, Homo sapiens
ctaactcttaaagtgattgattactgtggagatgtgtgatgacagattggcacctactaaggaaacctctcttgcctggtacattattaaaaataatccartggggaaataggactaatttaattacatgcctttatgcagtaagatccacagttgaaaaatagaggcagtagctttaattgcactgtaatgttcacacac

SEQ ID NO: 2354 - DNA, 201 bp, Homo sapiens
agagacagggtctggccctgtggtccaggctgaagataaacttcttaagatgtggaaatactcatctgcataaacctccttagcatttggtatagccccayacagagagagtatagagtaaatgttaattgactgcttaaacttcagcttgggggtttgttataaatacaattccttatacttctcatgtgaaaactgcag

SEQ ID NO: 2355 - DNA, 201 bp, Homo sapiens
aaaaaaaaaaaaaaaaaaagaagagtgtcagtgtcaggatctgattcaggttaaactaagatcattctggctgacatatggaaaataagctacaggcagcraaggcacagaaacaggaaagtcagaaggctacctcagtattctgatgagaagtagtggcagccagcactaagctgttaacacgagtggtaaaaatggtca

SEQ ID NO: 2356 - DNA, 201 bp, Homo sapiens
aagaaacacccaggaagcagatgcagaggaactgctgctagagttccctggactggtttcccagatgtagaaagttccgaagacctacagagtaactattmaggaagacaaaagtctgaatgagatctatgatcttataggtaagtataaaaattgaaaaagtttggccctccttaggaactctatttcaagaccatttca

SEQ ID NO: 2357 - DNA, 201 bp, Homo sapiens
cctccttgcccctaatagatctgcacttcctttcacatttcctctctgttatagccccaccatctactgaaaacctgaatatcaaccaggacccatgctawcccttctctattactcggtaggtcctgatccagattccaaccacctctctccaaccctatccaactccaggtggctaccatctgtacctgaaccactccc

SEQ ID NO: 2358 - DNA, 201 bp, Homo sapiens
tctgtctcaaaacaaaaaacaaaaaacatgaaaaagcaacatacttggacccaattaatgtagccttccacaaaaatatttttgccttacattatactgtyatgagaattgactcttccatatttgctctaacttattcatttctggttcaatgtcttatataaaaaatcacacctcaaagtttctgtttaaatgctatac

SEQ ID NO: 2359 - DNA, 201 bp, Homo sapiens
ggttgcagtgagctaagatggtgccattgcactccagcctgggcatcacagagagagtctgtctcaaaacaaaaaacaaaaaacatgaaaaagcaacatayttggacccaattaatgtagccttccacaaaaatatttttgccttacattatactgttatgagaattgactcttccatatttgctctaacttattcatttc

SEQ ID NO: 2360 - DNA, 201 bp, Homo sapiens
agtgatacttaagaaaatctaaagtaccttgaaaaggaatgtggctccatgtgcatcaggcatttgtttaaaaatgatacatgtctccatgccttcttatrgctgaaggagttttattaataattattctgattaaatttcactcccaaggctaaatgccagttattgtttgaaataatgccccatcagaaatcttcccag

SEQ ID NO: 2361 - DNA, 201 bp, Homo sapiens
cggacatgaaccaccacacagagcccctagacagtttcaaacaaggatgagaaagtcctcaaccacatgacacttacacatattaaagtatatgtgatgarttacttatcccagattatagttatttcaaaattaaaacgatcctataagacaattagtcatctgcttcatgccctgtaaaacagtccccacaatttcttt

SEQ ID NO: 2362 - DNA, 201 bp, Homo sapiens
tgcccaggctgttctctaactcctgggctcaggcaatcctagtgcttggattcaaaatgttgggactacggacatgaaccaccacacagagcccctagacrgtttcaaacaaggatgagaaagtcctcaaccacatgacacttacacatattaaagtatatgtgatgaattacttatcccagattatagttatttcaaaat

SEQ ID NO: 2363 - DNA, 201 bp, Homo sapiens
gaaccagcttgatagtttcccattggccaaatttgagaccagtggagcatcaaaatttgatactgcatgtttttacatacattcaagaacccaaatatacstggatcatctgaggtcaggagtttgagaccagtctggccaacatggtgaaaccccatgtctactaaaaaatacaaaaattagccaggcgtggtggcgtgc

SEQ ID NO: 2364 - DNA, 201 bp, Homo sapiens
gccgcgtttctggacggacgcgctctaaaaggaccggtccctcggctcccgaagggaacatttaaagggaccagcgcgtgccctactggcggtggagaggytgggcgggccccataggatgcccgctttggagccacaggacctcaaaatacgctccttacaacgtgttttatagagcgaagtctcgctatgccacccagg

SEQ ID NO: 2365 - DNA, 201 bp, Homo sapiens
agaatgtgttggcgctgattgctctggactgaccataccaggtacacagtatgccttttcaatagagagcttcaagtcattttcctttcaaggaagttttyagaatgtgttatagctagaatatacaatttgttatatagtttttggaatttgttctttgccaatgttttgccttagatcatactgttagaagaatgtttt

SEQ ID NO: 2366 - DNA, 201 bp, Homo sapiens
gcaaatgccattatttcattcctgagtagtattccatggtgtgtgcgtgtttgtgtgtgtcacattttcccttatccactagttggttgatggacatttargctggttccatatttttgcaattgtgaattgtgctactataaacatgtgtgtgcaaatgtctttttcatacagtggcttcttttcctcctagtagatacc

SEQ ID NO: 2367 - DNA, 201 bp, Homo sapiens
gtgtcttggtttcctcatctacaaaatagagataatagcacctacatcacaggatttgttatgagaattaaattaataaagtacttgggacagtgtctaayatacagtaaaaaacataagtggttgttattatatgttattgtattatccctcaaatactttaatggaagcaactaaggatggatgaatggatggatggat

SEQ ID NO: 2368 - DNA, 201 bp, Homo sapiens
taagctagaaaagaaatggttcatgtggttctgctgtccagcagaaggtaaagctgggaaggcaggatttaaccaacttgtaggaggcctttaatcccagrgtaatgaacttgggctagtagaaagcatgaaaatacccatgagcacgtggaaggagaaggagagaggtaagaggaaactgatattctagggagattaatc

SEQ ID NO: 2369 - DNA, 201 bp, Homo sapiens
aaaggtcttgttcttaaccacgacaaatctacagttatagatatttctagtatttttattcatttagtatgttacatgacagtccacaaaacacaatggtygagagcaaggacccaggagccagcctgcttgagtcccagttccagtatatactagcagtgtgaccttgggcaaggtgttcaacccttctgtgtcttggtt

SEQ ID NO: 2370 - DNA, 201 bp, Homo sapiens
ctgccaccacgcccggttaattttttttttttttttgagacatagttttgctcttgttgcccaggctggagtgcaatggcatgatcttgactcaatgtaasctccacctctcaggttcaagcgattctcctgcctcagcctcctgactagctgggattacaggcatgcaccaccatggccagcaatattgtatttttagta

SEQ ID NO: 2371 - DNA, 201 bp, Homo sapiens
tacttgggacagtgtctaacatacagtaaaaaacataagtggttgttattatatgttattgtattatccctcaaatactttaatggaagcaactaaggatrgatgaatggatggatggatggatacacagacagatagatttttttttttttttgagacagggtcttgctctatagcccaggctggagtgcaatggcgtaa

SEQ ID NO: 2372 - DNA, 201 bp, Homo sapiens
gttatgagaattaaattaataaagtacttgggacagtgtctaacatacagtaaaaaacataagtggttgttattatatgttattgtattatccctcaaatmctttaatggaagcaactaaggatggatgaatggatggatggatggatacacagacagatagatttttttttttttttgagacagggtcttgctctatagc

SEQ ID NO: 2373 - DNA, 201 bp, Homo sapiens
caaccattttatggatagattcccctggacatcagagaaatgattatcttggcagtgtgtttgttgaaatggagaagcatgtctgcctcagtagcaagtgrctgctgtgactgtaattcccaacacttagggcttttgatccaagtatgtctatgccatgtgataatcactattggaaaacacttgtccattcagcccaca

SEQ ID NO: 2374 - DNA, 201 bp, Homo sapiens
aggccacacaggtggcagccaatctgagtactgatacccacacctctgactctcaggccagttttctctccacaaaccaccaggcctgtttttcctgcttytgcccaccaacccaccccaaaaatgagttttccatataggaaagagaagagcctggcttatcttcttcaggaggtaactgtgccttccccagagagctca

SEQ ID NO: 2375 - DNA, 201 bp, Homo sapiens
aaaatgcttgtcctatttcatttactaaagggttttaaaaatacatttctctttagagcttgttaaacagtagaatctttctgcaaactaattgacagaaytgactgccttacaccaacttttctgtgcatataattgatttttaatttgctgtctcatttccgaaaggacttgacaataaactccattctatccatacta

SEQ ID NO: 2376 - DNA, 201 bp, Homo sapiens
agggtttttaggtttgcttggggttttttttctcttttgttcactggtgtattctaaacatctataaactatgcctggcagatagtagctgttcaataaayacacgctgaataaatctgttgaacgaacgtgtatatgtatatgtctttttctggaaacagaattcacagtttttatcagattaatgaagtgatctgctac

SEQ ID NO: 2377 - DNA, 201 bp, Homo sapiens
gcatcattctaagtaaaatcttacaaagtaaacttacaaatccagcaaggaaaaaaaattagattacatactgtaccttgctctgataagaactttacaayggctttgaggaactcaacaaggaaaatcagtgtttccaagaagaagaaattcggcaggacttggtggttcacacctgtaatcccagcactttgaaaggcc

SEQ ID NO: 2378 - DNA, 201 bp, Homo sapiens
aaggcgatcatacgatgatgaattttgactttgctttttatttctaatccttcatcataaaagaaacacttcctttgcagtttcatattcttgtactaaascatagctcaggaacattttcatttaaaaaaagaaaaaaaatactcccagtatcatctagtagttataagagatacggaaggcattaaactacattattcc

SEQ ID NO: 2379 - DNA, 201 bp, Homo sapiens
gggatatggggagaaaagcaaagctaacaagaatgccttcggacggctttcaagcacagacctcagaggactcgactcttctttggaaaaatggatgccaraggaggagataaagaaggtttaactgaatggtagatgttgtgttctaccaaaaagaaagaaaaaccagaagccgagaaggtgggggcctggatgcaggag

SEQ ID NO: 2380 - DNA, 201 bp, Homo sapiens
tccatcccatctgccctatcccgtggcctagccagagggaagactctctccccatctgcctctacaccaccagggaaggagatgaggagggaggcaaccayagggaaatgagaatgaatcccttccccgcattctcttcatataatttcactctgtattttcctcagcaaatccttctacctcacgtttatcgggcacatt

SEQ ID NO: 2381 - DNA, 201 bp, Homo sapiens
acatctacagttttaagttttccacagtgttcacttcctgaattaaaatttgtcaggacaggctgataacaagagtaatgactgctccaagatagaggtasagcaggtacacttttctttccaggtattttcttgctcctactcaggaaaaacagctcctctcacaaatgctgaatttatagtaaacttatgtagtaaata

SEQ ID NO: 2382 - DNA, 201 bp, Homo sapiens
aggcaatacaattcagtccacggcactcgcctacacaatttctttactgattgtctctaggcagaaattaaatctttgtatcgagagagaaagatagtttkaaaggatggctttaaagggggctgaaggtagcttactgagatttagacaatgtaaaataaaatttaagaacagatgagggtatttggtggagaataatag

SEQ ID NO: 2383 - DNA, 201 bp, Homo sapiens
agaagacgtaatggcttttgctctggaaagggaaatgtcactctaacacttgtattcactgaataagaagtaaggcattctcataaacagtaacctgatgyagagaatacttcaaaatatgccagagaattgcagatgaagctgcaagatatcactgaaatatgaagtcagcagatctgcaaactcagacagaaataaaac

SEQ ID NO: 2384 - DNA, 201 bp, Homo sapiens
cagtcatactcatggtccaaatctcatttaagagaaccacttcctggctggatacagcggctcatgcctataatcccagcactgtgggataacaaagtggrgaaatcatttgaggcaaggaggcaatcatttgagaccaacctgggaaacacagcaagaccccatctttacaaaagaaaaataaatttaaaaattagctat

SEQ ID NO: 2385 - DNA, 201 bp, Homo sapiens
caaaattagcacagatttcagcaaggtcatagtatttaaagtatctaaatgcttcttgattcctaaaatgagacgagagcttctgtttattgttcaagccmtaagaggctctggatgctttctatatgaaaccgtattcacaacagacttcgttcaacaaatgagtgcagctgctctaggccaatataacacttaatgaga

SEQ ID NO: 2386 - DNA, 201 bp, Homo sapiens
atttaggaaagtaaagcaacgcagcgagagatctgcagagtattttataatagattcagaagacatatcatatgcataactaaactatagtgtacagacayctacacctgggtgacaaaactataatggaatataattactgtatatcaagatagtgatgaattccttagggaaagaaggaattgtcattgcagaggacct

SEQ ID NO: 2387 - DNA, 201 bp, Homo sapiens
cagtactagattacaattaggtaatctaggattacagttcagtctgcaactgctagttgcaacctgagtggagtcccccaaccctatgaaaagtgaagggrtggaacaaaattgtttctatgctctctttccattcttacatgtttatatctagatttcctcctcaaacaaaaccaagtagataaaatgatgctgtgggag

SEQ ID NO: 2388 - DNA, 201 bp, Homo sapiens
tgcggtggttcacacttgcaatcccagcactttgggaggtcaaagtgggtggattgcttaagtttaggagttcaagaccagcctgggcaagatggtaaaasctcatctctatgaaaaatacaaaaattagccaggtgtggtggtgcacacctgtagtcccagctacttggggaggtaggattgcctgagcccaggagtttg

SEQ ID NO: 2389 - DNA, 201 bp, Homo sapiens
ctttcaacccaaattttctcatttttctttttctgaataaaagtaaagagcaaacaaaaagccactttagatgtcaaagacattaattacaactcctcccmaagaagtttactgaaggactctggagtcattttttttaagtatgttactagtgtatgtccagaagcataaactacacacacacacacatacacacacaca

SEQ ID NO: 2390 - DNA, 201 bp, Homo sapiens
tgggagagaagaatacacaattcaaatcaattttttctaaaattaaaaaaaccactttgtccactataatacttaaatttgtagtgagtagattatgtacstctatcaaaggtaagtaaaagctgtaacatgaaaattgcctaagttttatcttaaagaatttcctacttcccagaaacaaaaaatgtctacaacgttgta

SEQ ID NO: 2391 - DNA, 201 bp, Homo sapiens
actgcaacacatttaaaaacatagtagtagctacttaagagaagcaacttcacaaatttctttttgaaactctaaacattttgaaaaagaccaaacaatcmgggtaaagttatggagtgcttggccttgtcacacaggtacagacacagtgtagatggtattgtgagcagggtagctaaagaaaactgtattttctgcaaa

SEQ ID NO: 2392 - DNA, 201 bp, Homo sapiens
tttttgactaggcacatagtaatttccagcacagaatatactttctagcttctcttgcagttatgtgtgaccttgtgattccgttataatcgaagggacayagcagaagcgatatgtacaatttctggaaagtatcttcacaagaagggagtgtgcccagcttttgccttttcctccttcctgctggtgagaatgcagaac

SEQ ID NO: 2393 - DNA, 201 bp, Homo sapiens
gctgggatttgaactcaattctgagttctgttggcttagcaaccattctgtaaaatgtaccaaggaacaaaacctttctgatcccagttaccaaactcatkttgagcaaaatcacactcacacaggaaaaaaaaaaaaaaacacatgaaactgtcaccaaaatggcaataacccaactgtgctacagttttatttcctgct

SEQ ID NO: 2394 - DNA, 201 bp, Homo sapiens
gaagcagcccccacacagcatgctttctgaatgcactgtgggtgggactccagttcccacttccaggatgaagagtgggactcaaatggtttaccagtgcratgtggggtcaccatgcagacctgcccctagggtaaaatacaggctgcccccaacacctgtcttaactccaggatctcccttgctcaaaagtggcctcaa

SEQ ID NO: 2395 - DNA, 201 bp, Homo sapiens
ggttcatgtcagctttgcctccctgtgaacaaactaaagttaaggcagaaatggaatgagagaaaaatgaaagaaaaaaaactagaaacattttcaacagmcaaaacaagcctatcccaactgaaaccaaacacggtttttaagagaaactggaaatgtcgctatttgacgccagaacctgaatttgagccagtagctgct

SEQ ID NO: 2396 - DNA, 201 bp, Homo sapiens
gaatcccatgatctttaaatcaagtaatcggctagataaaacttctgggctaagaggtaatatggtctcaggaaattcctagaacatacaacagttttagygacaagtgatataaaaataaacaaaaataatttcaaattagatctgagatatactttcctcaaactatataaggaatatttattgggcatctgctaggca

SEQ ID NO: 2397 - DNA, 201 bp, Homo sapiens
aacaacgtaaatgctcatgcacaagagagcagttatatcaactacagtatatcaacataaggaagtaaaagagaatgagaaagtcctctatgaactgatargagcaattcccacaatatactgtcatcaagtgaaaagagcaaagtacaaaagaccatctacagtattctacccttcatataagaaagacggggttttaag

SEQ ID NO: 2398 - DNA, 201 bp, Homo sapiens
tccagcaactggtcaaagtgaacattaccagcaactggacaaataagaattgtatactgacaggatacagaagaaaagaacacaaaatttctgtgatacaygatctaactctaataataaggaaacaccataaatgcaaactgagggacagctgggcacagtggcatacaccagtagtcccagctactagggaggctgagg

SEQ ID NO: 2399 - DNA, 201 bp, Homo sapiens
atcacaacctaagatcatcataaagcttaggtcaggaaagtctacgtattatttactgaaaagtaaaggcacagtcaatgaaatctaggaatagtgaccayaatgcctcattcattcattcattttgcatagacagggcctcactatgttgcccaggctagtctcaaactcttgggctgaagctatccccctgcctcggcc

SEQ ID NO: 2400 - DNA, 201 bp, Homo sapiens
ggactaaagaaatgcagtcgataatgcgtaagtctgataattaagtcactgtgtgtacacttgaatgtgtgcacaaagagtatgtgtaattaagtcgctayctgatgatatctcccagcatcatctatggtcctaataagacataattactcatcctcagtaagtttttattacaaaggaggagaaatagcttcttgttac

SEQ ID NO: 2401 - DNA, 201 bp, Homo sapiens
atgaatacttcctaagagaatgaaagcttcctaatagaatacataattcctacctttaaaacctcagctcagttaggaacttaattgcttgatactatcayagcctccacctaccctgtggaagtgtgggctcgaaatacacctaccagtgtaggacggtggtgtccctatgtgttttgatggttgaatattaataaagca

SEQ ID NO: 2402 - DNA, 201 bp, Homo sapiens
gcaccactgcgtgccagcctggggaacaaagcaagatcctgtctcttaaacacgcacgtgcgcacgcacacacacagacacacacacacacacacacacamaaatgtacttctgagtgttagttactagaaatcacaacaatcccgtgagtgatttttcttcttgagtgattactctttcatggaagaggaaacatccaca

SEQ ID NO: 2403 - DNA, 201 bp, Homo sapiens
cttttcaccatcaaatctttacttatttgtatattactgtctgttttctcccactagaatattttctccatgaattaaggaatatttgggtttgtttcacytgctgctgcttcctcagcacttagaactgtgtgttgaagcacagtaggtgctcaataaatagtggttgaatgaaagaaaatagacagtcccagaaattaa

SEQ ID NO: 2404 - DNA, 201 bp, Homo sapiens
ataaactgctacattcatacatggagttctatgaaatagtattatagaagggaatgagaaggagctctatatactgctatgaggagaacacaagaatataytgttaaaagaaaggtagcaaaaggatgtatattatgttattatttatctaagaaggggcagagggaatgaaaataagaagcttaaataataataatctca

SEQ ID NO: 2405 - DNA, 201 bp, Homo sapiens
ttcacttgttgattttttgtcacaaagatgaaatcccactatttatgttatacagcaagtcacttctctcactttacagaagaccattaacatcccattcytgtttattactgcaaagaactgaacagtgtgggagtcccataattattatataacaagccccttattgagtctttttcacattttttactcttataaaca

SEQ ID NO: 2406 - DNA, 201 bp, Homo sapiens
tacaaacatatgcttattttttttaattacgagatataacctgtcactacactggactgaaacttactgctacttgagatatttgttcctgatatataaaytctgttttactttatcctcttgaagcatcattctaagtaaaatcttacaaagtaaacttacaaatccagcaaggaaaaaaaattagattacatactgtac

SEQ ID NO: 2407 - DNA, 201 bp, Homo sapiens
gatgagggtcacagacttagccagtgataggacctactactctgtaatcatccatgggcaacagacaagggctgtcagaggacccaacagacggaagccartgctagaagacagaactagtttcctcaaaaaaaaaaatcagtcaaagccaggaacggtgtggctcatgctgtcatcccagcactttgggagcctgaggca

SEQ ID NO: 2408 - DNA, 201 bp, Homo sapiens
tgctttaaaaaaaaaaaaaagaaaagaaaagccaatttatgccattagatgaaaatccaagtatcatcacctattttcaatgcaaaatgcaaactgtctawatagccacctaatgaaccctgccctaacatgttcccacaatccaaatccagttagtgactggaaattatccacaggacgacaactccaggaagcagttgc

SEQ ID NO: 2409 - DNA, 201 bp, Homo sapiens
atcctttcaggccccaccctggcctggccactgaaggctgtcagccatcggtcagtgcacagccaggctgtcccagggagctgcttccccaaaggctcagyaggacagcttgtctgaagatgggcccaggggtgtgacagctctcctgatgtgtcacacaaataccagagtatcaccttagctggggatacattccagacc

SEQ ID NO: 2410 - DNA, 201 bp, Homo sapiens
agaaaccactctcacacttccccaagctctgttctctgcagggtatgttgggaccctgaaagacatgtttcattagtgttactcgctttgaaacactctgygtgcagatgccgtatcttactcatattcttacattcaacaaacacacattaagttcccactatgtgccatgcactgtaaagcctgaagccacagcagtaa

SEQ ID NO: 2411 - DNA, 201 bp, Homo sapiens
tctactaaaaacacacacacaaaaaaacaaaaaaaatcagccgggtgtggtggcacgcccctgtagtcccagctactctactgtttagaatcgttttcaaygtccaaaaatgtgactgctttagagatgccaaataagactaatttaaataacctaagattgctccaattaccgctggtttttcaggtggtacaatgtata

SEQ ID NO: 2412 - DNA, 201 bp, Homo sapiens
ccactccagttactaaacagttttatgtgtaacatcacttagactctatcctaaggaaataattgtaaatatgagatgacatttatctgctagaatataarttccatccgggcgcagtggctcacacctgtaatcccagcagtttgggaggccgaggtgggcagatcacgaggtcaggagttcgagaccagcctggccaac

SEQ ID NO: 2413 - DNA, 201 bp, Homo sapiens
aacaggtattctttggggtaagggaggaaaatgaaaaacaaaaaccctctatagtataaaatgtttctgaggctttaaagagctcatgtgcattataaacktatttcaccccacacttaaaatacttgcagcatattaggaagccataaatacagttcgggaaacactgacttgggtaggcaggtaggtagacaggtagtc

SEQ ID NO: 2414 - DNA, 201 bp, Homo sapiens
caagaggttagcataaatgattcacagagagatctctctccagtataatcttcctctcctgggagtttccttcggatgtttcatcaaaccactcaagctaytattaaaaatgcttccctgcgataaaaggagggaataaacaatataaacacacttccccattcccattcaccaatgactcttccatttgagtgatctata

SEQ ID NO: 2415 - DNA, 201 bp, Homo sapiens
aatcaagtctccattgtctagttagaaactgagttatataactccttgcaaggaagaaatatcatctccccaagtctgagtgctaacagagtaattaccaratgcaaacttcaaaaccttatgtgtatttctatgctgtgaaatagtggtaattaaactactacttttcagttaaactgttcctaaggatgtaaaaataca

SEQ ID NO: 2416 - DNA, 201 bp, Homo sapiens
acaatcccttaaatttgccttggttggccatataccccaggttatgaatctcagcatgaatggcatacaaagcagccagaacagttcagatttacaagtgstggcatggaaataaattcaggacatgttaagaaccacatcacaaaactgcgaatagcttaactccatatacgttcactaagaaaactgaccatacaacaa

SEQ ID NO: 2417 - DNA, 201 bp, Homo sapiens
aatcaacattctttcctatagcattatccagtacaaccattcagaccaagtaatttagctcacccatgtcaaaatgtcaaaagtacaccccaacgtcatcmagcaaacagtgactgaatccaggattgtattagtaccagttagctatgtccgcataggatgctagggtggagaggatttgatttgtaacacagtactcca

SEQ ID NO: 2418 - DNA, 201 bp, Homo sapiens
tttacttatcaagaactgatgatacttaaacttccttccagaggtctctactcagtttaatttgtgatagcacttgtatgtgagacagcaaacactatacrttttaagcaaagaaaaatactatagaagacttcattttttacagagtttaaaggaaagctcattctgatgttcagaaatacagtggctcgggagtggtgg

SEQ ID NO: 2419 - DNA, 201 bp, Homo sapiens
aacaggaaactgaatgtttaagtatatataaaagcaaaaggaaggaaacaatacatttagttccatcaaaatcaacagaaaaccatctactatgagcctcygttgacaacttctcccaagtgaaacaatacagatgagggtcacagacttagccagtgataggacctactactctgtaatcatccatgggcaacagacaag

SEQ ID NO: 2420 - DNA, 201 bp, Homo sapiens
tgtaagacagggatgagtaagtcacaatcaaggcatgtattaattataaagagctatctcaataagcagtctttaggaacatatacaatgttttactgagmctctttccttggacagcagaaaaataacaacaaaaccatgagtcatttaaactgacctatttcacatgtcaggatcatttcaccatagaagatttcacaa

SEQ ID NO: 2421 - DNA, 201 bp, Homo sapiens
gagtgatgaaagtggaagactggagaggaattaggagactgttacttctagaaccatgcctggcacgtagtcagtagtcaatgtgttcaataaatgaatgyttcaatatcaaggtaacggaagatgagggctaagacttgggtggtaaagtgctacatgtagaaaccattctgcctcattcaacatctgtgagtgtcacaa

SEQ ID NO: 2422 - DNA, 201 bp, Homo sapiens
taaaggcagcaaatgggataatttaaaataatcatcccatttttattgatggttctcaaatctctctccagatctgacattttgccctagctcagacttgyacctacactttctattcagactaacgtcctccatagttttaggacatcaccatcccaacttgggcactgacagcccacaggccacatcctcctcaagtag

SEQ ID NO: 2423 - DNA, 201 bp, Homo sapiens
gacctaaatgaccagcatagcacacgcttccttccttcccagcccttcctgtattcccagcccagtccagactagacgtccttctgaccagaagctcaccytagcaaatcccaactgatgcctcgcacgacgtcccctagagacctactgtcctctcacacgcagttctccaaaaggcctcataccccaacccccgagccc

SEQ ID NO: 2424 - DNA, 201 bp, Homo sapiens
cttacagtaaaaaaacagtatcactacgacttctcaaaactgaatttaacgttgtctaaacattttaaaatgtttaagatgtttctttctctttaataatmacgttaagatttttatggttttgtttgttttaaaacagcttcatgaactctgtaagtctgataaagttaaagtcttaaggaactattcaacaagcactcc

SEQ ID NO: 2425 - DNA, 201 bp, Homo sapiens
cacatttccaaaacagagcacttgtgggaagaagaaccaagttctgatcttagaagccctgtgcctaagtcaataaccaccaaatcccaaaggtgctggayagatgctgctccggccccgaaaataatcaaacacacaaaagttactattaatatttcttgccaaacaacaatcaaaaaaatccaactcctgcacatggga

SEQ ID NO: 2426 - DNA, 201 bp, Homo sapiens
gcagtgagccgcgatggcgccattgcaccccaggttgggcaacaagagcaaaactccatctcaaaaaaaaaaaagatttccaattcaactctagaccctawtgaattttatttccaccaaggtagaagtgggcctgattaccaacacacttacagatagatctcaagaaaccctgcttcactgggccacgtcggatttatg

SEQ ID NO: 2427 - DNA, 201 bp, Homo sapiens
ctgaaatcatttcaggaactaaaagctaactctggctctctctacatctttatattaaagggtcctggacctgtgattgttgaggtggcagggaaaactgytacctgttcccattcctaatagaaaccatcttttgatgccattcccattgtatttttccacaaaaaatgtatttacagatttctgggactgaaaaattgc

SEQ ID NO: 2428 - DNA, 201 bp, Homo sapiens
gctggggggggaaaatgtaatgaaaaagaaaatgcatatagcataaatgttttttagagaaaaaacatggaactcctctaacagctatcattttggagatyagaactattagaaactgggccgggcgtggtggctcacacctaatctcagaattttgggaggccgaggcgggtggatcacttgaggtcaggagttcgagtc

SEQ ID NO: 2429 - DNA, 201 bp, Homo sapiens
acggccattcaagggccactattattatccccattttacagacagcaaaaagacacagaggctaagtaacttgccagtgaagtggtagggacaggatttgycttgcgtgtctgtgttcttatacaccacatgctgctactcttcaaatggaaaaaaaaaaattcactatcacccagaaggcgatcatacgatgatgaattt

SEQ ID NO: 2430 - DNA, 201 bp, Homo sapiens
tgttattttatagagcaaggatgaggccttaatttttataagattgaaaatgtgcacatgtccaagcacctcattaatattacagcagtcattaaacatcyctggatctcaggcagtcttattagcataaactctgcgtattaccacaaggtttcaagtttctattctggcttctcatcttagctaccattttctgtctgc

SEQ ID NO: 2431 - DNA, 201 bp, Homo sapiens
tgacaaagcaagcacactgtcttttcttaacttggggctaggggatgagggtgggtggaggaaaggagggagccagcagctcagaaaagaggaaagacacmcatgtaaacaaactaacaaaaaaatccccatccatgaaaacactcacagtgctaaatgaaagctgatggggatgacatttgctcagtctggaaaatctaa

SEQ ID NO: 2432 - DNA, 201 bp, Homo sapiens
tattcttctaaaaaggaataaacaaatggtaataatgttaatacattaatttagaaaaataaaaaaacaataaaaccattgaattaagccacattccccasgccaaacactaaatgaatggctcctgcacaggcttcacttacactttagggattaaggttgtgcctcttaattttcaagtctctgtgaaagctgaagttt

SEQ ID NO: 2433 - DNA, 201 bp, Homo sapiens
tttttaaattttttttaaatttcaaaataagtaatatattttagtaatattttatataatagtcattttaactgtggtaggccaaaaaatgaccaccagargatatacacatcaaatccctggaacctatgaatgtgaccttatttgggaaaagggtctttgcagatgtgctaaggatcttgaaataaaggagatgattct

SEQ ID NO: 2434 - DNA, 201 bp, Homo sapiens
ctcaaccctattaaattaggaaattccaataaaacctcaatgagataccagactacacatccattaaaatggataaaatttaaaaaaaaataactgacaayaccaagtcttggtgaagatgctaaagacgtaaaattataacacactactgatgggaatctaaattggaaccactttagaaacctgtaggccgggcgcagt

SEQ ID NO: 2435 - DNA, 201 bp, Homo sapiens
atggtctcagaaacagtgaagtacaaaaacacggcttctagattccaatcttgggggtatgaccttaaattgtgacttaatctctctcaacttatttcctkatgtctaaaaaggtgataataatagaacctagaggccgggcgtggtggctcacgcctgtaatcccaacactttgggaggtcgaggtgggaggatcacaag

SEQ ID NO: 2436 - DNA, 201 bp, Homo sapiens
ttgagctgggaggtcaaggctgcagtgagccatgttcgcaccactgcactccaacctgggcaacagagcatgaccctgtctataaaaaaggcaacaaacawaacagtgtcaaagaagatggcctaaaaggaggcacatgctcttgtttttctctcatggatctgatacccatacccactgtgtttgaaattgttaaaaata

SEQ ID NO: 2437 - DNA, 201 bp, Homo sapiens
tcgcaccactgcactccaacctgggcaacagagcatgaccctgtctataaaaaaggcaacaaacaaaacagtgtcaaagaagatggcctaaaaggaggcayatgctcttgtttttctctcatggatctgatacccatacccactgtgtttgaaattgttaaaaatacattttggaaagctatcgtttcctttagggcacct

SEQ ID NO: 2438 - DNA, 201 bp, Homo sapiens
caagctatgctctgagaagcactgattatggcacattctgaacttcagcaagtgctggaggctaaaattcatctagaagactccagctttcttctttgatkaataacaacagtagctaacatttcagcacttactatctgtcctaggtgctctacagtattatctcatttctaggtattaaggcatttaattcatgttttg

SEQ ID NO: 2439 - DNA, 201 bp, Homo sapiens
ctaacacacacacatgcacctagtgtgtgtaagtgagaaagtggcaggaaatgtttaatgctgaacacacccaatattataaattatggaagtagagcttmtttttttcaaaaaaaaaaaaaaaaagaactccaagatgtataaagaaaaacataaacactcaaagagagtaagaagaaagtggatcagtaaatagttatt

SEQ ID NO: 2440 - DNA, 201 bp, Homo sapiens
tgaccacatgcacacgaacctcagccaacgcagccaacgctccccagaggctacttctgcagctaagcatctgtcctttcagctcctggcagttcctgccytttctcttgccaggcaaccagagctctaaagggatcttaatgcactaatgagaagccatgacaaccaagacctgcggtagctgcaaagcacaaacaccag

SEQ ID NO: 2441 - DNA, 201 bp, Homo sapiens
tactctgtttatatctctgttcaaagagattgtatctatgttaacgtaaatcatagtctgatgatagcttttgtctgtttaacaaagcaccctccttactsactttactctagggaactaccacttcatatggggacctaataacatgtagtttgggtggatccagggttgctcaccatactaaatcctcctggccaccat

SEQ ID NO: 2442 - DNA, 201 bp, Homo sapiens
tgcaggcacctggagacatttgaagctggaggtaggaaaaaaaaaaggtgaaggtgagcttgacctagaagggcaactgtgaacaaggtgctttgaggaakcaatgtcaaacctgtgtggacctttttgtaaacaggttaatttcctaaattcttttgtgggaatataagacatccgtgtttctaaaacgggagaggagag

SEQ ID NO: 2443 - DNA, 201 bp, Homo sapiens
ggaagcttctcatggataacaggattataaacacaatttctttccgaagctatttcacaggtcttcgaagcccacctaccactgtcagctgagcagactgyagttacgtgatgggacaggagccaacaggggcagggctgctgagtgcacatccttgtacgcacctgaccccatcgcagagtcttagaagtaagcatttag

SEQ ID NO: 2444 - DNA, 201 bp, Homo sapiens
gctggtcattacggaattctctttttgtgtgacagaattgtgacaggctcccaggacctaaacccagaaggaagcaggaccatattgctgcctagagaagrggatggagcagattccaggacaccgatgaaacagaagcttccatcacagtgctttctgctaccttatgagacagttcgcatctcaacagctctaggatac

SEQ ID NO: 2445 - DNA, 201 bp, Homo sapiens
tctcaacagctctaggatacaaaggaagcacatacatttatactttataaggtggccaaggaatcctactgtgaacaaagaatgtctaagataataaaatyccactttttttttctataaaaagcaaatcttgtcccagatgcaagcacttgcaacagaagctctgtgggggaagcctacctctcaaggccctagttcttg

SEQ ID NO: 2446 - DNA, 201 bp, Homo sapiens
aaatcaaaatgagtttcacatataaatgggcaattgaattaataatatcaacacccatcacagtgtaacaaataacttgattattaacttctactgacagycccatgcttccttcctcaagagtttcagactgcccgtttgtgctttgtgcagctagagggttccgaactctcaagaggcctcagggaaagttgactctgt

SEQ ID NO: 2447 - DNA, 201 bp, Homo sapiens
ccagccttcggtctgcagcccctaggccaggacaatgctggtgtccagacaggctccatgaatgagctgcatcctcgtgtctgagggagctgatcacgaayaccagcaaaccagttttaatgtgagggagggacagagtaggccctactatccccccagcacctgaccttggccgacttcttcactgtctctgctttactg

SEQ ID NO: 2448 - DNA, 201 bp, Homo sapiens
agaaaacacacacaacgggaaccaccaggggttcgggtgtaatttatgaaaacagccatggatctccgaatctgtgactgtgactgtgatatgggctccamggattctctcctggtccatatctaggtctcctcaaaggttctttacagagggcggctggctctcccttaagaggcccaggaagtgtgggactggcagcgc

SEQ ID NO: 2449 - DNA, 201 bp, Homo sapiens
catatgtcccagaaatgtgccaataagtggccttcacctgcctcttgatccaaaagcagtgatgcctgagtctagataaggtagagtccctaaagagataygggctctgcccaaaaaaagatgtttgcatacacctactatacaaagcatctttccaaactgcttccagctagaagtatctatttaaatcagtggttctga

SEQ ID NO: 2450 - DNA, 201 bp, Homo sapiens
tggtaaactaaacactatccaccaacacaactgctatttaatttcccacaggcagtggaatgctacgggaagagaacctgtaacctgtcctgtgataagcyacatgtcttctctctctttaggggcatgggggagtgaaagagtagaagagattgttgaagaagaaggcactggaagcattttgactataaaaggctcact

SEQ ID NO: 2451 - DNA, 201 bp, Homo sapiens
taaaatgttgtcgacatgaatggcctataatgatcattttgctcctgatgctctcacctcatctcacaacaaggtctcacagtcaacatatcttatgtctsggtgctataattgcacacagcatgaggaactcaactggtttagtgcctgggcagaaatgggaaaggaagagggcgaagtcatctccaactgacagtgttc

SEQ ID NO: 2452 - DNA, 201 bp, Homo sapiens
acaggtgtgagccaccgtgcccagccagaaactattcttaacagtccaaactggaaacaacctaaatgcccacaagcaggagaatggataaacaaataatrgtatccccacattcactggactacaacttggcaattaaaaggcacagaccaccgacacatgcagcaacaccatgctgcatgaaagcaggcagacagggac

SEQ ID NO: 2453 - DNA, 201 bp, Homo sapiens
ccagagatgagaataaagaccagtcgctcctggagttgggagaggaactgggcttgcccaagaaacagccactgagctgcccgtggactgcatgaatgggrcccgcctcctcagcccagcacagcttgacttccagacaccaagaacaagtacttgttgggtgtctgctatgtcagaccccaccgctgttgtacacatggg

SEQ ID NO: 2454 - DNA, 201 bp, Homo sapiens
cactgcaccacctcctgccctcacctcctatctcccagctccagccaacacaggcgctggcagggatttcagggttgccacctccagccatgctgccctgsggtccctggaagattgggagcccccgctctgcctctgtggctgctcttgccccgatttcccacagcttgccctttcatctcctccatgtttctgctacct

SEQ ID NO: 2455 - DNA, 201 bp, Homo sapiens
aaagggagggtgggggaagggctagcaaaatcaagcttacgggaaataaacctaatcaaagccgagtagtaacaaagggcaccagaaacatttctactgtwtcacatcccacaggctggccaagagcccggaattttcattacaactttcaaagagagcaagaggaggagggaaaaagatttcacaaaagcattatcaagg

SEQ ID NO: 2456 - DNA, 201 bp, Homo sapiens
gttttgaaggcagagcctcacacttcttaaggaaatatcagttgtctcaaaaccagcagagggagtacaacgtttgagaagaggaatggccaacccgattsctgaggattcatgtttagccccgacaatggttgtaaagctgagctatctaccataacttctgcccttgctctcctgtcacccagcaatagtaaacagaaa

SEQ ID NO: 2457 - DNA, 201 bp, Homo sapiens
cagcagagggagtacaacgtttgagaagaggaatggccaacccgattgctgaggattcatgtttagccccgacaatggttgtaaagctgagctatctaccrtaacttctgcccttgctctcctgtcacccagcaatagtaaacagaaagaaaagctatactacctactcagatggaattagcttgttctaacaaccgcatg

SEQ ID NO: 2458 - DNA, 201 bp, Homo sapiens
tctcatcacctgttctccagtttgactcaacgtctcttaatatatattcactgcactgttaagtttctaactctctaactactactgacaaaaccattagrtgttcttcgttcaaacccactagaggaactacaccatcccctccgtgatgccagctcagcatccagagtagagccagtgatttcctttgtcaacacacct

SEQ ID NO: 2459 - DNA, 201 bp, Homo sapiens
tatacatctctgtcagtgcccctctgggtctagataattacactgagtacactgaagtcctttcattattgcaggcccaacaaaaagtactgccactgggygaatatcagaaagcatgcatcaatgcactttcaagtcaaatgagaactggctagttaagcagcagcattaacagatgtagagattgtgccagccaaatgc

SEQ ID NO: 2460 - DNA, 201 bp, Homo sapiens
gatggtctcgatctcttgaccttgtgatctgcccgcctccacctcccaaagtgctgggattacaggcatgagccaccgtgcccggccggccaaaattttayaagcaaatggctcaaaggaaacttgatgagttacaggattctaaatctgtaagttagaaaacaaaccacatgctcagaaggtctggttttttttggtact

SEQ ID NO: 2461 - DNA, 201 bp, Homo sapiens
actcagaaattttatatacaaggaataaatcataaggatctcatataggactattcatatactaaattatgtataataaccggggagtctttctcttaatrtttttgtcaggagctctgaaaatgaggttttagaagccacagcatacctattcatcttaaaaggtaagatggcttgctttcagtttagctaagctttcat

SEQ ID NO: 2462 - DNA, 201 bp, Homo sapiens
aggtgcaagttacatggttaaagtgggggaaagcattctgggcagagagaaaagcaagcacaaagttctgactcaggcagaagcatgcctggcatgtccargcaacagcaaagggacatggtggctgaagcagtgagcgcaagaagaattggagatggagagatagctcagtacttactcaaataagggaaaagccatggt

SEQ ID NO: 2463 - DNA, 201 bp, Homo sapiens
acatctgagagagaaaaaagacacaacaaataaccatgcaggaaaaacatatgaaagccaggtcatatatcctagctatacccttattcagtcagtactaytgttatgtatatcttatcaatgcaaaagtaagcactgagaggctgagcaagttgaccaaactcacacaactatgtgtgagacctaggatatgaacccaag

SEQ ID NO: 2464 - DNA, 201 bp, Homo sapiens
tacaattatggtggaaagagaaacaaacacatccttctcatatgacagtaagagagagaagggctgagcaaaggtggaaaggccccttataaaaccatcakatcctgtgagaactcactcactatcataagaacatgatggcggaaactgcccccatgattcatttatctccacctagtcccgaccttgacacgtggggat

SEQ ID NO: 2465 - DNA, 201 bp, Homo sapiens
tatcacttgcattttcgaagaaatcagtctatctcttcttttttcttccacacaggttatttgttttttgtattctcttcagggttttatgcaaatgtccrttcattcttggctttaaccagttctcacaggcccataccattttacaaaccagctgtgtgactttggcctccatgtctttgtttcctcatctgtacagca

SEQ ID NO: 2466 - DNA, 201 bp, Homo sapiens
aaacacatgggtcaatgtcaaatacaagccaatctctgtcaagaaaaagagccaaattcctgcatttccatttaaattacgttatccaactcaaataccaycatgccacttcaaatgaaaatagtttccctttaaacagagctttttacaaaactgatagagtataacagattaaacaactctttcagcaattttcttagc

SEQ ID NO: 2467 - DNA, 201 bp, Homo sapiens
ttttctcagctggtgaagctgtcagaataaatagaaggcaatatctggaaagatgacaaacacatgggtcaatgtcaaatacaagccaatctctgtcaagraaaagagccaaattcctgcatttccatttaaattacgttatccaactcaaataccaccatgccacttcaaatgaaaatagtttccctttaaacagagctt

SEQ ID NO: 2468 - DNA, 201 bp, Homo sapiens
acatatattgaaatacttatcataatataaaaaacttgtaatatagtaatatgtgtacttttttgttgattcattaaataacaggatttactagaggtcaytccctgaataacctccatactttcaaagtaatgtggaatataaacattattttgagatgttttttccatgtgatgtgataggagaatacctataatttat

SEQ ID NO: 2469 - DNA, 201 bp, Homo sapiens
acaaaaattgggaaaagtgcacctccataaatgaagccttcccagtccttacccttactctgtttatcaactgttatcaaaatcagctgcatcatcttaargattctaaacttggtgggaaaagatcccagataacatatatctttgttcccctcttttttaaacataataattacattccatgtattgaaatgtctatag

SEQ ID NO: 2470 - DNA, 201 bp, Homo sapiens
tggggacaaaaaggtgaatgaaacacagccccttctcttaatctagctaagaggacagacacgtacagaggcatgatgtgagaatgatgctggctgacagygcctctcaggcagaagcgagagatgactggaagtgggaggtggagaggagaggctcacttttatttttcatttcaatgtataccttaatatttttaacat

SEQ ID NO: 2471 - DNA, 201 bp, Homo sapiens
gggggcaatttctctgaaccaggagctgttccagacactggggacaaaaaggtgaatgaaacacagccccttctcttaatctagctaagaggacagacacrtacagaggcatgatgtgagaatgatgctggctgacagtgcctctcaggcagaagcgagagatgactggaagtgggaggtggagaggagaggctcactttt

SEQ ID NO: 2472 - DNA, 201 bp, Homo sapiens
cagctggacacccaccagggctggattccacacacagaaaccacatccaatgctctgttactagaagtcgaccatctggatttcaaagacctctgtctctytctgtcctttgttaatcagtctcccttcccactcaaccctctcccctccatgccagagaaaaggatttttaaatctgatgagtttttcagggaagcagaa

SEQ ID NO: 2473 - DNA, 201 bp, Homo sapiens
atgtagcatgggtattattttggtttgacagctatggaaactaatgtcctaaaaggttaaatagcttgtctaaagtaacacagccagcaagtatagacccrcaaacaaaagccagctaggtaccctttccaaaacaactcacctctccatgaagtgaaatcatctcatcacgactgtacataaaatacgctgtaaatgatc

SEQ ID NO: 2474 - DNA, 201 bp, Homo sapiens
ctttctttggaatcctaatcagcaccacctcaggactaagtcagtcccttgcaggaacactcctaccaccattgcttttggggtaaatccatctgagagcyggccagacagaacaagtaaacaaaccaacaaggtaatttcagatgataatcagtgccataaaaacaataaagatatgaaaactgagcagtatcttagaaa

SEQ ID NO: 2475 - DNA, 201 bp, Homo sapiens
acattcaacaaaaatattctgcctctattctttgtctaaaaagtttttctattctccagtcaaattctttccaaccttgtgagtcccaccttaaaagctcstactttgactaagtccttccctcagaaaccactctcacacttccccaagctctgttctctgcagggtatgttgggaccctgaaagacatgtttcattagt

SEQ ID NO: 2476 - DNA, 201 bp, Homo sapiens
tgataccgggcaggggtagtggtcacggtatagagaacagcatattctcaccatcaaaggtgaaatttcacaggccaattagggtactgatttaagatgayaggaccagggtctcttttacatagatctgagcctggcctaggaaaaatcctagaaaaaacttacatgcttgtacctctgacacagactagatcatatcaa

SEQ ID NO: 2477 - DNA, 201 bp, Homo sapiens
tctgcctactaccatcacatgatgatctttaaaacaagaatcaagaaaacgttcctaatcctctgtgttcagaaaagcttttactgtcaaaagaaaacttyaatagctgactcttggtaattaacacataatagagccaccactaacctattaacaatattaccgtattctataattggagggtaaaaattagctatagag

SEQ ID NO: 2478 - DNA, 201 bp, Homo sapiens
acccagctaatttttaaaatttttttgtagaggtggacatcttgctatgttttaagccactaaacaggagcacatccaatctgcttaacaataaagtttcrggactctgggcaaaaaaaaggggagggggagttgtttctgggctaaattatagaccctggctggatttctcttgaaatgaagaacatatgtcgatttaag

SEQ ID NO: 2479 - DNA, 201 bp, Homo sapiens
ctggttagcatcgttaagtatgcaaaatagagaagaggaatcataaattgcaagaataacaataacagaatgtacagtttttgtcaacaaagtatcttctkggctatgttttataccccttagtaagaccctatattttgccaaaatggattaagcacaaatggaaaaagaagaaaaacaactatcttatcctagcacctc

SEQ ID NO: 2480 - DNA, 201 bp, Homo sapiens
ccattaagccagtgcgtccacacacacgtgacactacactactaggccggcacgtccacacactcatgcaaaattgcaccactaggccagcacatccacamacacacgtaaaattgcaccattaggccagcgcgtccacatgcacgagacactgcaccacaaagccagcgtgtccacacacacgtgacactgcaccactgg

SEQ ID NO: 2481 - DNA, 201 bp, Homo sapiens
acaaaaaaaattaagattattagcttagggggaaaaagtccaaaactgtacaaaatctgtaacaaggaagatttttaaacactcctgaaagacaaaaaagrggatatgaacaatggtaaaacatccatgttcttagataggaaaactcaaactggcatttctccacagattaattaataaatccaatacaatcccagtaca

SEQ ID NO: 2482 - DNA, 201 bp, Homo sapiens
gaacactccctgagtgcagaaatgtcaaaaacaaactccaaaagcaaagcccaattacctcagggttcaaagtcaggtcaacattagatttaaggctctcwcatttttcacaatctcttagtagtttgtattctacttgggcaaaaaattatgccccctaaatttttgcccaattaagttttgttcccgctgagtggagcg

SEQ ID NO: 2483 - DNA, 201 bp, Homo sapiens
ttccaaggggcatcattcaagtaacaactcatcctaaaaggcccatactggctttcagttgagtgtattctgtattatgctctggcgtctttcctgaaaaytggaagacaatagagtaacgccttcaaatttttgaggaaaatagtctccaacctacagttctatacccggccaaactgtgagataatcaaggatgagcat

SEQ ID NO: 2484 - DNA, 201 bp, Homo sapiens
ttaccaatttcagcctcctatcacaagtacctgtactgacatacaagcatcgtcaccctactggaagacaagcgccttaggagaaggttcaatgtctaatygaactgtgagtctcccacaaattctggtgaaaatatacttgcacacagtaggtacttaaatatttgacaaatgaatgaaaaaattacaaatcagctttct

SEQ ID NO: 2485 - DNA, 201 bp, Homo sapiens
tatgctaataatcagctgaaaaggtcttggttataccagaaaacctcaactgcgtgatctttttctgcatcctcactaatgctatgattaacagcacaacwttctgttgacttcaatatcctgttattacataaataaaacactggcaacagtgcctgtcaaggctgatttatatgatgtgctgttctgaaatttattgga

SEQ ID NO: 2486 - DNA, 201 bp, Homo sapiens
ggagctttactgttgatactgctttgagatgtatcatttggttttggttttacatatttaacattttaatgaaagggtgacttgagtaaggcactactttktcaataaatagcaacagaaccaatttgcctgggaggagacctgccagcaagccatgaggggcatttccaaaatttccagtataggctgctcccaatttct

SEQ ID NO: 2487 - DNA, 201 bp, Homo sapiens
ccaaaaaaaaacctgtttatgtttatagagaaatgcattctgaagtccaaacaactgaccacacaacaatttctaaacccttccactactacataaaacayctgcttctgtgctaaacttttgtaaggcacagtttctgcttcaagaaaatctgtgatgcttggaattgaggtttatcttactgaagaaaaatctgaagaa

SEQ ID NO: 2488 - DNA, 201 bp, Homo sapiens
accattttatttcatctgaaaaaaaaaatgctaaagcatttgtccatatccatacttaactgttaaatattaaacagaaaagttatatttatcattaaatrccaataaaaacttttctgttgtcctgaatattttgttacaacattaaaaaaagtacacacacacaagaaaaattcagacaaactttaatgtattttatta

SEQ ID NO: 2489 - DNA, 201 bp, Homo sapiens
ggggggtagagacagggtctcactgtgtcacccaggctggtctcaaactcctggcctctacctcccaaaatactgggattacaggcatgctccaccacacytggctattatattttaagggttactttctaaaccataggaaaattagctgggtgtggtggtgggcacctgtaatgccagctactggggaggctgaagcag

SEQ ID NO: 2490 - DNA, 201 bp, Homo sapiens
cagggtctcactgtgtcgctcagactggagtacagtgtggtgtgatctcggctcactgcaagctccacctcccaggctcaagtgatcctcccacttgagtygtgtgccaccatgctcagctaatttttttatttttgtttttgtagagaagaggtgtcatttcactatgttgccaagactgatctcgaattcctgggctca

SEQ ID NO: 2491 - DNA, 201 bp, Homo sapiens
aacagcttcataatagggaaacttacctttacaacatttggggaaaattactggcgatcaggacatctttctttccttcgacacatttactgagtgctcarctatgccaggcactctattaggtgctgggatatatcaaatagcccttctttttttctctctttgagacagggtgttggctctgtctcccacactggagtg

SEQ ID NO: 2492 - DNA, 201 bp, Homo sapiens
aatctggcttcaataaggattaggaattgcaattagctgaaatccatcaaataggtttaagaatactccaatgtattatttgaaaactgggtaaataaacrgaagcaaccaaacctttattctgtctttcctatataaattgtgcaactgggtaacaagacagtagatgacagacaacactaccatataaaattattctag

SEQ ID NO: 2493 - DNA, 201 bp, Homo sapiens
catatctgacgacaaattatacttttggcattattatggaaagaattcaaataactgagtgacactgtaacaaaactatcattcccatctacttactcacrtaaacaaggtttctgggcacttacgtgtttaaaaaaaccatacaatttatttccaataaatgttaagcaaaaatgaaaattatatcaacatttacattat

SEQ ID NO: 2494 - DNA, 201 bp, Homo sapiens
ttatttaagatgagtatctagaactcttacaaatctagaaaaagacaatcaaattgaaaagtaagcaaaagatttatataggcccttcataaagaggaaayacaaatagccaataaactcattaaaggatgctcaatatgactggaaaccagggaaatacaaattaaaatcactcagacatttcaagtttataatgttggt

SEQ ID NO: 2495 - DNA, 201 bp, Homo sapiens
ggggaaagaaaggaaaagaaggaagacagaggaggagtctgagaaaatcttagttcttaagcatgagaatcagaactgtgggcttcagggtaaaaaggaargagagactgaaaagtaacatctatgtttaaatgggtcctttagagaaaagaaagcactcagctaggattaaaggaaaagaattgtacctcctcaactccg

SEQ ID NO: 2496 - DNA, 201 bp, Homo sapiens
tagcattctcggactccatgattacttccagatggcaaattatttgtattatacttcttaatgcctgggtttctataaaaatatgattttattgtttttcrtaaacaaacaaatcatttcttttagaactaaagtgaatgcccttcttgtcaatcctattcagaatgttctccaaagaagactgacatccaataatgccac

SEQ ID NO: 2497 - DNA, 201 bp, Homo sapiens
taatatagaagaacacaaaaactatttttgaagtaaacatactcaagtttcaaaaacatgaaagaccctggaactgcatcagaagttccacatcctcaacrtaagcaacataaggaggagaccctgtctttacaaaaaattttaaaattagcagggcatggtggcccgtgcctgtagtcccagctactcaggaggttgaga

SEQ ID NO: 2498 - DNA, 201 bp, Homo sapiens
ctgcaagtttaaaatagcagagatttgatacaatggaagtgacaccacaagcagcagccttggagagcaagaggggccttggagagcctgcactgagccasaagctaagagcttgctacaaaacccagagcaggatgccaccctggggcccctcgaaggagagaacagagaactcttcccagcccacaggcaagctaccgc

SEQ ID NO: 2499 - DNA, 201 bp, Homo sapiens
atacaatcccacattataccattaaagtatatattataattctattccatctggtcacactcctcttgcctagcaaaagttgcacatgaaccagcataaastgcacattctattgacctcactgttctatttacttacctatcacacacaaagcaaaacaaactattgctaaatatccatatgcaataacaaggtctcatg

SEQ ID NO: 2500 - DNA, 201 bp, Homo sapiens
ttgcaggcctaccttgaaggactgtcaaaaacaaaaacagaaacaactgatgtgtcacacaggaacaaatcatcatagcgtaaggcatttttcataacacwtggccttttctgggaggttcacacgtatactaggccctcatttatctttgctgaaagtcagtcatatggaaaactcaaaacaatataatgatgcctaaaa

SEQ ID NO: 2501 - DNA, 201 bp, Homo sapiens
cctgagtgacagagcaagactccgtctcaaaaaaaaataaaaataaaaataaaaaattacccaggctttctgctgtaggcctgggtggctgctataaaaaygggcaagttcatgaaacctggaaagtggtgctgttctggccagacgctatgccagatgctactcaggaagcaaagatatcatcatgaagaacactgatga

SEQ ID NO: 2502 - DNA, 201 bp, Homo sapiens
tcccagcactttgggaagctgaggagggaggatcgctgaagcccaggatttagagaccagcctggggaacatagtgagacctcaactagacaaaaaatttwaaaaatgagccagggatgatggcgcacacctgcagtcccagctacttgggaggatgaggcaggaggatcacctgagccaggtaagttgaggctgtggtga

SEQ ID NO: 2503 - DNA, 201 bp, Homo sapiens
attcaggagcactgtaaaacggaagagaattatctaaagggattcaccggctactgactaattttaatatgaaatgcctcacaaatctccctgtgccaccracaaatcaccagctgaggcaaatcccagataatgaaacattgtaagaagggctctttttaatagtttagcccatcaaggagtgagtattgattcttattt

SEQ ID NO: 2504 - DNA, 201 bp, Homo sapiens
ggcccagagtgggacaggctgcccgtgaacagtctcccctccgcccactgtgatgccaagacccctactcacagaattcactggacgggggtctggagggygtgttgacgggtgtggacgcggtgcgagtcttaatcctcctgaacacggcctgcctgcggtgcctacgatgggctcgggagctggctgcttcgggggtct

SEQ ID NO: 2505 - DNA, 201 bp, Homo sapiens
ggagacaaatgcccatagtctaaaatggaaaacttcaaaatcacctagacccaagaaaacaaaaatcacatattaggacaatttgattttcccatgacatrcgtggcgctgtagatgcagtttatcctacctccagtcaagtgggtccatgaatagaaactctcaggtataaaccactcctctaccacttcaccccagggc

SEQ ID NO: 2506 - DNA, 201 bp, Homo sapiens
aaagttctacactgcattttgtggtaagagacaaataaaatatatgttccccatacaaaaagacttcttaaatctattaagatggaataaatagtatgtasaggataatggagacaaatgcccatagtctaaaatggaaaacttcaaaatcacctagacccaagaaaacaaaaatcacatattaggacaatttgattttcc

SEQ ID NO: 2507 - DNA, 201 bp, Homo sapiens
gcgctgcagggctttgccagcatcgtaaccgctttcatgcagctaaaacaacaacaattatagttagctaactgcaccaaataacagacaggacacaatcratccaaggcaagctcctcattgactatctcccacagaagagtcaggaaaggggcactgagactccatcatttcagtaggcgcaggaatttgttctcatcc

SEQ ID NO: 2508 - DNA, 201 bp, Homo sapiens
gagtttataaacaagactaatttgtaattcaaaatcccttaaaagtgattaaaatgtttaatttataaatgagatttataagctgaattttttaaaaagtrtaacagtgtccttcaatttgcaactttaacaaattgaatatcaatttttttaaacctaggtaaaccttctggacagtcatttctgcatataaatatcaat

SEQ ID NO: 2509 - DNA, 201 bp, Homo sapiens
actttactctatggtggttatggataaagtgtgatgaaataagatcagcagctgtagaaacttaccttgaaaggtagagataagggatagctaaggtcaasaattcaaaactaacagcaatgcagtaatgctgaacttcaacacacatttctacaactgcgaagggctcagattttcttataggaagaaactctggtagga

SEQ ID NO: 2510 - DNA, 201 bp, Homo sapiens
tgccctaaagttgctactaatttaccttgaaataactgactttagctatgtagctttgcaaaaaagactccaggtggttttcctgaataccatctgagcaycagaatggagaaattattgtaactcattgtagttttaagataaaagctaccaaaatcctagtattttgttaaaaccatattacagtacttaacaaaaaaa

SEQ ID NO: 2511 - DNA, 201 bp, Homo sapiens
tccaactttctctaaagaaaaaatgtagaaataatcatgtgtccacaaaaccacaaaatgtctagacataagagaatgctctcagatattattcctcttayagccatatgacccacttaagaactttaatctagggccatgctgtccagtatagtagtcactatctacatggctatttaaataaatttcaattaaataaaa

SEQ ID NO: 2512 - DNA, 201 bp, Homo sapiens
caacagtgaagtacaaaaattaaaacagcacataacttttcaattcatcacaaaatatgtacacataacctaagacacctgagccatgtcaggctagtctraagagtttcagtgtcataaaaatgaaaaattgtacaacaaaaaaatctctgggagtgctaacaaaaccttcagaaggagcttgccacaaagaaccatggg

SEQ ID NO: 2513 - DNA, 201 bp, Homo sapiens
ttttcaactaatcaaaaagagaaagaaaactaatctcttacagacaatttgccattacattgtaccctaaacacattttattttctaactgtaaacaaaamcaatgccactaatcagagatggaataaagtaaaccaaattgcattttcttcagggaagaagggtgctttcttaaattacatttgacatggcagtggttgg

SEQ ID NO: 2514 - DNA, 201 bp, Homo sapiens
tattttaactcctcaatagtccaaccctcatctgcttttccttaaaattatttcattattccagctgaggagaattaaatcatgtgaaaagccccatatcrgcctttcatagtagcatttcttctttctttcttttttttttttttttttttttttttttttgaaacagtctcactctgtcaccaggctggagtgcagtgg

SEQ ID NO: 2515 - DNA, 201 bp, Homo sapiens
cattggttttatagagaatgtcagtttactcagttctgcagatctttcaaatatcaaccagttctttatacagcattttttaaaaatcatattaatatcayctatctcataagaaatgcctttcagtgtagagaagctgtcaggctcagagtggtgagtacaagcttttcgaaattctaatttttacttgaaagttcaaat

SEQ ID NO: 2516 - DNA, 201 bp, Homo sapiens
aggtgacaggtgggacgtgaagggcattcccggccctccagcagaagcaacgtcacggagctgggtgctgggtgggttgcaccgttctgaggcagcacggktctctccaatgactctcacacaggaaccagacctgactctgtttcttccaggacggtcctccctcactccacagcctctcatggcagctggacacccacc

SEQ ID NO: 2517 - DNA, 201 bp, Homo sapiens
acctcatgcccataaggtgctccgtggatatccccttggagaaaactctcatcaacaaggatgtcttcagagaggctgctcttaaatgcaaggttactgasaggccagggtcaagttcaaagagaggtacaagacagtcaagaacaagtggttcttccagaagctgtggttttagatgtttcatttaggttattaaatttt

SEQ ID NO: 2518 - DNA, 201 bp, Homo sapiens
ccctattgaaaccatgtttagagcgaaaaagtctatattctttttaggggattagtagtcaccattaaaaggtatgatatttcaattacccacagttattygagatcagcagtatttcctcaaaggacagcacctaaaacggaattttctctaggcacctgtggtataccataacaccaaaaagcatccctcaaaaaagaa

SEQ ID NO: 2519 - DNA, 201 bp, Homo sapiens
aaagtgaggcattattttatgtttttgcaaatctcattaatatttgacttaatagaaaagacagctagattctcctatctacttttgaattcaatctgctscaatatattgttgtggttaaattatatgaagataatacagcctaacacagtgatgtaactagaaaagggaagaatatagcctttttgatactacaccaaa

SEQ ID NO: 2520 - DNA, 201 bp, Homo sapiens
tgcaaagccatgagggctcagaagagatcaggagacaatggttctggctggttgacctgctcccttctgagtgagcgggggccgggctgccagcagcctcracggcatacaaggggcagaggaaagtggatggtcccacccacctgccagaaggggccataagggaggctgaagggaaagaccctgtcagtaccctcagcc

SEQ ID NO: 2521 - DNA, 201 bp, Homo sapiens
gtagtaaaatacagtgcaagagaaagtagagaatgggagacgaaactgagtggcattaggttgagtatcaggttcccagaccgaaaatacagccccgaggyggcagtcaggcccacctaatggaacacaccaacaaaagactctacttgaacaagcagacactgtcctcctgcagcttctttcagtctgtatcagttataa

SEQ ID NO: 2522 - DNA, 201 bp, Homo sapiens
cctctactttctacctggccaatctcatatataatgcgttcatcaccaatcagataccaggacacacaggaggatccacacaagtacatgtctaccagatytccccttcagcttcagacacatgtgaaaactgttcacctggggtctcttcttggatatctcaaaggtacctcaacatgcccaaaccaaaggcatactctg

SEQ ID NO: 2523 - DNA, 201 bp, Homo sapiens
gcccagccatggagaggcttcagttaaatgccctgctctgtcaggaactcagcaagccaagccacggaggagcgtcagttaaatgctctctgctctgtcarcacaacagcaagttttgtctttttttttttttttttaaggtaaatggtgattttaaaaagcaagatcaccaagaaatagaatcaaaagacagatatgaat

SEQ ID NO: 2524 - DNA, 201 bp, Homo sapiens
tacaggagcacaccaccaagcccggctaacttttgtattttgagtagagacaaggtttcgccatgttgcccaagctggtcttgaactcctgggctcaatcyacctacctacctccacctcccaaagttctggaattacagacgtgagccactgcacctgacctatagtcatttactttaaataggttttagaaataacgta

SEQ ID NO: 2525 - DNA, 201 bp, Homo sapiens
tcggaggacagaatgactagaatcagatggagggaagaaaaggttttcatttctaccctcctgataaggaaaacagccatacattcaagaataaaataacytttatcatttagaggagcctaattcatttatttatttatttattttgagacagagtttcactctcgtcacccaggcagttcaatggcacgatctcagctc

SEQ ID NO: 2526 - DNA, 201 bp, Homo sapiens
cctcagcctcccaaagtgctgggattacaagcgtgagccaccacgcccggccataactttctatattacttaagtagttgtatacaactacacataatttygtctaaagttcaagacaattctgggagagaaacacccttatttacctctaccattttacagataacgaaactaagctcagaaaaatgcagtaacttgcca

SEQ ID NO: 2527 - DNA, 201 bp, Homo sapiens
actaaggtctcatctaaatgttacttaccaggactttcctgatcctcccttagctaagacagtaccccacccagctgattctccctcattaccctattctrtatctgcttcaccacccccggcacatactcatttatgaaggtctcccctcttaaaacttaagactcccaaggagggacaacacctggcacgcaagcaggc

SEQ ID NO: 2528 - DNA, 201 bp, Homo sapiens
caagacagactggcctttagtaaaactctgaatagcacactttaaagtgaaataacataggtacaacattaaggttgggcattagttacaaccttccttcrtgttttactttccaacatagtcccaaacatagatatttgtttgtttgtttgttttttgagacggagtctcgctgtgtcacccaggctgatgtgcagtagc

SEQ ID NO: 2529 - DNA, 201 bp, Homo sapiens
agttttctatctatctatctatctatctatctatctatctatctatctatctatctatctatctatctaactttctatctatctgtccatctttctatctrtctgtccatccatccatccatccatccatccaggaagcttgctgatttacctattagctttaacaatttggatgggcccgggggctcacaaatataatga

SEQ ID NO: 2530 - DNA, 201 bp, Homo sapiens
ctgcctggaaggctctattcctatacctccgcatggctccctagcctgttcaaggccttgtccaaatgtcacctcttcagagaagccatccctaaataacytacttaaaatggtaccatccgtacaccctgtcagtgtctctctctttgtctgagtatcatggttgcctcattttataatttgtttaatctgagtcagaac

SEQ ID NO: 2531 - DNA, 201 bp, Homo sapiens
tgctaggcaccagacactgttctggagatggttgctgagtatatagaagtgggaaaaacaggaagtcccagtcctggtagaacttccattccaatggaggwgaagaccccttaccaattcccccaaccctctcctctaaaatgtccaataacggttaagtgcttttagaaagttatgatgaatgaaatctgccacttagta

SEQ ID NO: 2532 - DNA, 201 bp, Homo sapiens
aagcacaaaaaagaaataaaacacatagatcataaaggaagaggtaaaactatatttgcacacgacatgtttagcaggaccaaaaaaagccaacatataamaactgattgtgtttctatgctatcgaagaccatttagaaattaaaattttagttacaacagaatcctcaaacaggaaatacttaggagtaaatttaacaa

SEQ ID NO: 2533 - DNA, 201 bp, Homo sapiens
ggaatttctctgtagacacccgtgttcattcacagaccattttttagattttccgtgtggctgagaggcctccagccaaacaatgcccacagagcgcgggrcacatgtgcgccagggacgcttaagggctgcaagtaaaacaaagtaacctattacaggagtttccttctcagcaaacaaaaagtggtcaagcaggtctcc

SEQ ID NO: 2534 - DNA, 201 bp, Homo sapiens
ttaaattcgcataaaaacaagcaaaagcaaagtacattatacaaacctcatataatgttactattttaaaaagagaatacagaacagaataacacccctayagacaaggacagtacaacaactgggctcataaaaaacaaaaaactataatgtactacttcaaaacatgctaaagatattattaaataaattataccagat

SEQ ID NO: 2535 - DNA, 201 bp, Homo sapiens
ccagcctgggcaacagagcaagactctgtctcaaaaaaaataaaataaaatcttctagtgttggactggaattgaaattaatataaccttacaagtctggrgttaggggaagttaataggcacaggctggtatacatacacatcctagctctgcctgctaactggatctagaaacaatgatatccagtagtaacacacatg

SEQ ID NO: 2536 - DNA, 201 bp, Homo sapiens
tgatgtctaatgaagtactaagcatgtatagacaaaacaataaaaatgctgtaggtcaaagttatttcacatataaaaacaactgtagattaaagccagakaaggattcttaaactgcaaaactaagagctctgagacaccatgaaactccttacagaacttgcaggagctaaagggtgttttttgttgttgttgttgttg

SEQ ID NO: 2537 - DNA, 201 bp, Homo sapiens
aggtcttcccgtatccccaggcatgcgcaaactccaaagactcaggacaacgtgcacgagcacacacagaatgtttacagtagcaaatctgttgaaagctwttattatcattattaagatggagtcttaagaataaaaaattattaataataaaaaataaattattaataaaaaattcttttttttttttttttgagacag

SEQ ID NO: 2538 - DNA, 201 bp, Homo sapiens
caaaaccttgtctctacaaaaaatacaattagccaggcatggtaatgcatgcctatagtccctgctactcaggagattgaggctgcagtgagcaatgatcrtgccatagcacaccatcctgggcgaccctgtctcaaaaagaaatgaaaaagaggtaacacgaccctgccaacaccttgctgttggatgtgtggcctccag

SEQ ID NO: 2539 - DNA, 201 bp, Homo sapiens
ggcgtgagccatcatgcccgggctgatttgaggttttaaatgacaaacagcagaaccttcgctgtttttaatcttaacttttaaattattttcaacacctmagcaatctactgattagcatccatagtcaaaaagtaaagatcctctttccagaaaaatgtacatatatagaagattttgccagcagtttcaggatgttca

SEQ ID NO: 2540 - DNA, 201 bp, Homo sapiens
gtcaaaactcatgaaactgtgtacttaaagtgggtgcatttttacggtattcataccatatatggcaggttacgtcaataaagctgaagaaaaacaacaamaaatccaggccgggttttattagctgcctctcaaccactgttatgcctatcaagggattcaacactggaatgaagcgagtctaggatcggaaatggcata

SEQ ID NO: 2541 - DNA, 201 bp, Homo sapiens
atattttcatttgctccactaattaagtgtctacatttttaatataaatatatcacctacaaatcagttttgtctcttcctttccattcctgtgtcatatrtgtgtgtgtgtgtgtgtgtgtgtgtgtgtgtacatatatattatagtttgacaaagtcatgctctgttacccagactggagtgcagaggtatgatcatag

SEQ ID NO: 2542 - DNA, 201 bp, Homo sapiens
agcaaccaacccagtaagaatgaataccccagcacccagtatgtaaataccacttcccactacaataaaagagggctcttctgagacaagtttaattccasatctagggaagacaatgtataaggtgaggcagtaaaatcatgtcttactagagaaaaacgattaagtgaaaaggacaaaaaccactgggattaagtgaaa

SEQ ID NO: 2543 - DNA, 201 bp, Homo sapiens
caaaagattagatactatatgattccacttgtaataaatgtacagaaaagacagatccatagggacagagagcagattacttgttgcctagggttgcaagrgtaaatacagagtaactgctatggttatggggctgcttctgggaatgatgaaaatgccctaaaattgattgtggtgatagttgccagtatctgtgaatat

SEQ ID NO: 2544 - DNA, 201 bp, Homo sapiens
tcactctaaagtattaaattcaaccaaaaagccaaacattcaaagtctgttcaccaaaaacactcatcataaagatgtttatttactatccatataaggaygcaaaatggtattcctaacagccaatacacagaatcaacctaagtgtccatcaacagatgaatggataaagtcacatacatatgtatacacacacacaca

SEQ ID NO: 2545 - DNA, 201 bp, Homo sapiens
aactgctatggttatggggctgcttctgggaatgatgaaaatgccctaaaattgattgtggtgatagttgccagtatctgtgaatattctaaaatgcactmaactctgtgtgtgtgtgtgtgtgtgtgtgtgtgtgtgtgtgtgttgtgtttttaagacagggtctcactctgtcttctgtgaatattctaaaatgcactc

SEQ ID NO: 2546 - DNA, 201 bp, Homo sapiens
tcacattaaatacagtgtttgtcctggcagtgaaactgaagtggttttattattccacacgatatgtttatcttttggtgaggcacatgtatcgaatttayggattacagttattgatggaggacacatggaagaggattcgtttcccagacatactacgagtcttttggctaacaagagttacagctcaggctacagtgt

SEQ ID NO: 2547 - DNA, 201 bp, Homo sapiens
ccaggcagctctgaaccatgtttatgcaacgtttaatgggctctaataaaacggctaataattttgatccgcggaagcaccgactcgctcgctaagccgartctgcgagggtgaagctgcaactccaacgccggaaagcgcggctaccgaaaagcgcatgcgccacggggtggcacgaagctagagtaagctgaggaggtg

SEQ ID NO: 2548 - DNA, 201 bp, Homo sapiens
ttgatttagggatgcactttacagcaaaggaggtgtatcagcaggtacataaccatgagatccactagtcctatcacatactatataaccgagaaaatgckggtctgatggaatgatgaaaaacccttttgaaggtgaaactgaagcaaaagcttgaagataatagcctgtgaaaatggaatgaccttgtccaccagggta

SEQ ID NO: 2549 - DNA, 201 bp, Homo sapiens
gcaactttgtgaattagaagtcctgattcccaagagaggaaccttttcatcaagagacacaataatagatcctttaaactttaacttgctgaggtttcccrgttcaaggtccttgtgctaggagaccagcaggcaaggaagagtcaccatgttagttggggtaaatgaatccaatcatcaggaggaaatagcgttattgct

SEQ ID NO: 2550 - DNA, 201 bp, Homo sapiens
acttgaggctggcgcaggaagtagcggctcttgggctggtccttgaggcacagctgatggccttccaggatgacatggtggggctccaggcggagcagggygagcatggcagtgtccgtgggcaagtcagtgacaggctgccctgaggccagcactgtgggctggcgacagagtgggcacagcaggcggcgccgggctgga

SEQ ID NO: 2551 - DNA, 201 bp, Homo sapiens
tgttcagttcacagtgcagcgaaaactagaaaattctgaagaatcaaacttaccttcaaagctttcatttatgactccactgttgtttgcttcatctctgsacttataaatgctatttaagaaaaaatttctgaataactgaagttggtcctgaattctatgaaaagtaggtctttggtcgggttcttgagcccagcactg

SEQ ID NO: 2552 - DNA, 201 bp, Homo sapiens
ttaccttcaaagctttcatttatgactccactgttgtttgcttcatctctggacttataaatgctatttaagaaaaaatttctgaataactgaagttggtyctgaattctatgaaaagtaggtctttggtcgggttcttgagcccagcactgggtcattaaattccacctaaatatatggggaaagatgggaaagtaaata

SEQ ID NO: 2553 - DNA, 201 bp, Homo sapiens
aagccaccatcatccataaaggcaggttcatcctgcccgtgcaccattacccgggccccagtcactgtggacagcaggggaatgaagtcattctgctctgygcgcagcatcagggacagacctaggggtgcagagagagcagagttggcagaggcgggaatcctagaaaagagttaggagatggaaatccactctcccttc

SEQ ID NO: 2554 - DNA, 201 bp, Homo sapiens
ttcttccctacagataccagggtgcaacaaggtcgtcagggtgatctcaccttggagagcttcaggggtgcctcctctgtgaccccggagaggtcagcccyattgctgaagaccttagtgatgcccagttgacccaggacgctcttcagatcataggttccagtaatggacagtttgggtaaatgtaagctggcagacctg

SEQ ID NO: 2555 - DNA, 201 bp, Homo sapiens
aagaggtgtgggcagcttcttggtcaccctcaggttggggaatcaccttctgtcttcattttccaggaacttggtgatgatatcgtgggtgagttcatttwccaggtgctgtagtttcccctcatcaggcaggaagaagatggcggtggcattgcccaggtatttcatcagcagcacccagctggacagcttcttacagtg

SEQ ID NO: 2556 - DNA, 201 bp, Homo sapiens
cctggcaagcaccagggaggagaacttctatgtggacgagacaactgtggtgaaggtgcccatgatgttgcagtcgagcaccatcagttaccttcatgackcggagctcccctgccagctggtgcagatgaactacgtgggcaatgggactgtcttcttcatccttccggacaaggggaagatgaacacagtcatcgctgc

SEQ ID NO: 2557 - DNA, 201 bp, Homo sapiens
actccaggtagccctttctccatcctactgtctgtgggatctatggattgctcagccaaaattcttggttctaagccagccacaaaccttttgtaatagcyacttatggagacaacagggagaggctgatggatgtagagaaatcagccatggctgcggagtctagagacaccagagctatgctggtcccttcttaatgac

SEQ ID NO: 2558 - DNA, 201 bp, Homo sapiens
tgcctaggaagaggaggagacaggtctgtagggcagagaggaaaacacagttccaggtgatctcacgggcctactatccaagtgacacagtggccttctgmatgcttggaatgtccccattcaagcctcaagggtttttaggtaagatataaaaattcccagaaatttaaatcctgtttcatcctctacttcttggaatgg

SEQ ID NO: 2559 - DNA, 201 bp, Homo sapiens
ttgggcctgaggtcagagatagagggaatccattggccgcttctcctcctggctactgcctcttcaggatatgcagcccttgctttctttctacttactcrcttattacctactttagccttgctttcttagttgtttactgatgattgattgattgaagagttagatgccctgagtaacttaagaaccattcatagattt

SEQ ID NO: 2560 - DNA, 201 bp, Homo sapiens
ccatgatgtatacatttcattatcattttcattatatttctatggggtcttccaagaatctttagcagggcgtggtttcaggtaagcaagataacaaaacrgataagtgtgtagctgggtggttggtgaacttactttaagaaaatgctacaaaaatatgacaatgcagagggtatgtatgaacctcacagggaaagggaa

SEQ ID NO: 2561 - DNA, 201 bp, Homo sapiens
gttagatgccctgagtaacttaagaaccattcatagattttgcattggctccatgatgtatacatttcattatcattttcattatatttctatggggtctyccaagaatctttagcagggcgtggtttcaggtaagcaagataacaaaacagataagtgtgtagctgggtggttggtgaacttactttaagaaaatgctac

SEQ ID NO: 2562 - DNA, 201 bp, Homo sapiens
tggggctttaagttatgtattattgattaatgttgctcacattgaagtattttcatgaaaagattatttttggtgtaaagaaagatagatagtccttcccrtcattttcagtggagtatgagctggaatgcattgtttgcatcatggtgcgttatcacccccttgtggtattacacctaaattacaggttttctttggtgg

SEQ ID NO: 2563 - DNA, 201 bp, Homo sapiens
atccaccccaaaagcgaactgctctttctggtgcatcatggggacatgcacagtgacctgctcgcccaccaggaatgggaagttctttcttgtatattcarggtgaaagggcttctcccacttggctagcacaaagagagaaaagaagtctttatgtcaaagtacaattagtgaggcaaagacagcaaactgaaatgggga

SEQ ID NO: 2564 - DNA, 201 bp, Homo sapiens
cagcttggacttttttgcaaatattttcattcaactcactttagaaacctgcagggagtctctctttgcaattccagaaaaatcagcatttttgtcaaagrcattttggatgcccatcttcgggaggatggtttccagattgtaggaggcagaaatggaaaatctggggatgaacacctctatccacctgtggagtaggga

SEQ ID NO: 2565 - DNA, 201 bp, Homo sapiens
gctctgtcatgtgacacagcccaggactgggggactgcattccttcccccacacctggatgggacaaaagtccttacaggacacgtggaggctgatgggtrcagctaggctcgtggtggctgagcctggggcctgggcttggcaatgataggccccagcttgtgtcaaagttatggctgcaaagcggagcgtggccgaggt

SEQ ID NO: 2566 - DNA, 201 bp, Homo sapiens
ctgtcaggagcaacagatgcgctcagccacaagggtgtgtccccagacaactcacacttcacttggaggtgaatctcgctctgagccctgtgattggccayggagagctggcagcgcaggatccggccgtggtcctgccaggacatggccatgtggagggtctccaggtggccgacgccggtgggctcaaacttctggctg

SEQ ID NO: 2567 - DNA, 201 bp, Homo sapiens
acttctagaaggaacagactggagcaggctcctcctcaggctccctccactctccctggctgccagtgcccatcttaccattggcatggaagtccagggtrgaggttgcatttccaagggagttggtggctgagcacttgtactccccactgtcagtttcctccaggtctcggatctccaggcgcagggagttgggaccag

SEQ ID NO: 2568 - DNA, 201 bp, Homo sapiens
agtgctgggattacaggagtgagccaccacgcccagccagaagaccctacttttctatttggcttcccacatctgactgctagcatagagcctgctcccaragtttcataattaaaaaacaatgaatgcttctgagggactctccaagtttagggtcagggtaggtgcaaaaggaatgatgtgacctgttgtgtttccctt

SEQ ID NO: 2569 - DNA, 201 bp, Homo sapiens
caggatttttcaaagattatcatgaaatgggattggcatgattccttacatcctaagaatattgcggcaaaggcgagctggaaaatgctgtagatgagcgrgaaggtgaatacgacattgagctcctcaggagtgaaggagagctgaacgatggtggaacatagctgcgtgttctgcatccccgtttcaaaagcaaccgtt

SEQ ID NO: 2570 - DNA, 201 bp, Homo sapiens
agttcaaggaaaaagacgaagacttaaggcatcaaatgcgcacaaggtgggagggtgatgggggcagcagtgagcaccaactcacacgtgcacaggaaggytgtcgggggtgccatcatggttgtggtctgtgaggtcattaatggagcttactgaggtgactgcttgtccaattgtgtagacaatggagagcgacacaat

SEQ ID NO: 2571 - DNA, 201 bp, Homo sapiens
actgcacccagtgagatacctgttggtgagagggcccacgaatgggttgaccagaagttgcatcacagcctttgaagcaaacagaaccccgacccgggtartctcttcctccaagaaacctgtgccttgcaagcagttgtttttatgagctgagatggcttcagtggctggaggtgggatggtgctggcagtgtcattcat

SEQ ID NO: 2572 - DNA, 201 bp, Homo sapiens
tttatacaagggtgtaacttaatgtaatgattaggagagtatcaactaaaaaaagcaggattctgagggaaagaaccacaaggaaggcaaggtcttgatamtaaatcagatatccaaataaaatatgctgtttttatagagcagagtccagaaaggcacccctgtgagaagatctcgctgcctcagaggcacttggagtca

SEQ ID NO: 2573 - DNA, 201 bp, Homo sapiens
ttaaccagacaaaatcagcaggtattaaattatactgaatgcgcagctctgctagactctgtagcaaatgcaaaataaaaataacatctagttattgtccktgaagagaggcagtgtgttgaagatggacacccaggaaactgagatccaacaggaatatgtcatccaaaacaataagagaaatatggctctgtcctgcca

SEQ ID NO: 2574 - DNA, 201 bp, Homo sapiens
cagcaggtattaaattatactgaatgcgcagctctgctagactctgtagcaaatgcaaaataaaaataacatctagttattgtccgtgaagagaggcagtstgttgaagatggacacccaggaaactgagatccaacaggaatatgtcatccaaaacaataagagaaatatggctctgtcctgccaggctcccagacagtc

SEQ ID NO: 2575 - DNA, 201 bp, Homo sapiens
gtgggatcttgagaggctctaatgatctatattattctgacattaaaccattggtggctcaaagaacataagcaatttatgaaaaagcaaatacactttaygagcaagagcagtgcagagatttcctatttgtggaactggtgggcccctcctaattgtgggaattaactagggaactttcgatttaacgctaaaaaaaaa

SEQ ID NO: 2576 - DNA, 201 bp, Homo sapiens
cccatcaagcccactttctagtggaggaagtgtgtgtgtgtgtgtgtgtgtgcgcgcgcgtgtgtgtatgtatgtgtgtgtgtgtgtagggagggacacarataattaaagcatggtgaaagtttgacagtaaaatgttgcatgcaatgaaagcacagtcaatgtctcaggaatttcaggcagccacgagggctttgccaa

SEQ ID NO: 2577 - DNA, 201 bp, Homo sapiens
ttctggggagaatttcattttctttgacgtggcttctgttgtggtatcaacaatatcactcatttaaattttaaaatagattaccatcatgaaatctatcrggccctaaaaattgtatactctttgacttagtaactctactacaaggaacccatcctacaaaagaaaaaaggtcagagatgcagccaaagacttatactc

SEQ ID NO: 2578 - DNA, 201 bp, Homo sapiens
tcccaccctacagtactggcactgtgcttggcatgtaataagtgaaagcatgtagcttgtcaattaagttgtatgagggaggagcctcaaagaaagggtarttttatcgtttggggcttgggtttccaagcccagaaaatcggagtctgtatcctggctgtggcgtttcctagctgtgtgatgttggatggtgttttcgcc

SEQ ID NO: 2579 - DNA, 201 bp, Homo sapiens
gttgtgcacgtgtaccctagaacttaaagtataattaaaaagaaaagaaaagaaaagaaaaacgcgagggagaaggaggtgtgttgttggagagcagaggwtcagcagggccatcgggaaccaaggctggatccacaggctgccttcccctgccttaacctgctaacgctaacccttttcattccttcttcctttacttct

SEQ ID NO: 2580 - DNA, 201 bp, Homo sapiens
aattataggttcattcctgaatctccccgatggctgatatcccagagaagatttagagaggctgaagatatcatccaaaaagctgcaaaaatgaacaacayagctgtaccagcagtgatatttgattctgtggaggtaagcatttgcagatgtttcctcttgagatcagctatgcattcttgattttatggaatttaactt

SEQ ID NO: 2581 - DNA, 201 bp, Homo sapiens
cctatctgattgatgttcttatgtcccgggctttacaggtgcttacaacagaatgctgccctacatcgtcatgggtagtctgactgtcctgattggaatcytcaccctttttttccctgaaagtttgggaatgactcttccagaaaccttagagcagatgcagaaagtgaaatggtaagtaggacttttaacaaaatgata

SEQ ID NO: 2582 - DNA, 201 bp, Homo sapiens
gctaccaggaagctcaggcaaatttgaaatttaactacatcaatgatgcagcttttaccagccacatatatatatattttttactgtttttaaattgaacmgttgaaatataattttgtcttcgcctgtttaggatgccgtaacaaaatcctataggctgggtggtttaaacaaccaaaatttattttccacagttgtgga

SEQ ID NO: 2583 - DNA, 201 bp, Homo sapiens
tggatgctcctaatttacatggagatgcctacctgaactgtttcctctctgccttgattgaaattccagcttacattacagcctggctgctattgcgaacsctgcccaggcgttatatcatagctgcagtactgttctggggaggaggtgtgcttctcttcattcaactggtacctgtgggtaagaagttaaccaagatga

SEQ ID NO: 2584 - DNA, 201 bp, Homo sapiens
acattaacaaaaagacaacattggggctcatctcccaaaagctggtttgggcactcgctgatctgggaatctgttgaaagccatgggggccccacacaggygggtgtcagtgccctcactttctcttttgactaaaggaaacgatcaagaacacaggtgccctggccatccttttcccaataaactgtgaacatcaccagc

SEQ ID NO: 2585 - DNA, 201 bp, Homo sapiens
gagcttatgcgtctgaattaagcaagtgtgtcctaggtacatgggcttcttagttcttacatttcagcctatatccctgatgcaaatgttcttgggtagtsgtgctactaagctaataaaaaattagtcactagttctatctaaactactcctattactaaatgggaaaatcactaagatcccttgagcatacttatttgt

SEQ ID NO: 2586 - DNA, 201 bp, Homo sapiens
gtgccttcatgggcagaaacaggttgtataggtggccaaaaactctagcaggcatactttgagttggaaattgactgatatcgcttgaggaaatctgggcrgtgagagttccactctggagcttctaagcacatagttagatgaatttgccctgcagggagtgtccagtgaagaggaggttaaaaggctataattgcactt

SEQ ID NO: 2587 - DNA, 201 bp, Homo sapiens
ttgggggtacaagcgatgaaaagaggctcaacatcactaatcactagggaaatgcaaatgaaaatcataaggaggtaccactttgtacccttaaaaatagytactacaaaaagaaaaaaaaaacacccagaaatccactttgggaggccgaggcaggaggattgctagggggcaggagttcaagacagcactgggcaacat

SEQ ID NO: 2588 - DNA, 201 bp, Homo sapiens
cctgagagggtccacatgtcagattttaacagactttaaggcataaggcagccattataaatatgttcaaagaatgaaaggaagtcatgcttttaaaagtrtgatgacaatattgcatcaaatagagaatagcaataaagagagaaaaattacatttatatttttaaaagctgagccagacatgatggcatgtgcctatag

SEQ ID NO: 2589 - DNA, 201 bp, Homo sapiens
gtttctgggataaaatagctgaattccaggttgtatttgactaaaataaaccaaagggtgtggtctgggctgaggagtttggtaggtgccttcgcttccaycctctggccctaaggaagggttggcaaagctctgcatgataatttcacattaacttgggaagccaaattactcccactgtcaaagtagtgcagaaatgag

SEQ ID NO: 2590 - DNA, 201 bp, Homo sapiens
tgcaggtgggtcttcccaaagggatgctcatcagtctagtggttggggtatggagggatgcttagagctgacatggaccctgccgcctgctcagtatgagwcaagctctccagcaacacctcactgctgtttagtctgaattcaatctacagagagattatagtgtgctacctcatttggcactccattgacttttgaaat

SEQ ID NO: 2591 - DNA, 201 bp, Homo sapiens
gtacatgctcttaacaactgtgatttttcacttcatgttacaggcagtagcattaacttggataggaaaagatatagagtagagtattgtcttagaaagcratctcaagcatccttggcttcagaagaagcaccttcaacctgcttctggtacctgatccaaagacattttggtggctccacccaggccagggacaaccac

SEQ ID NO: 2592 - DNA, 201 bp, Homo sapiens
agtggctttgctttgttataataccagggttattctgctgggggcatgttctggggctctacaatccaaatagtgcaagagagaaaaggcaatgtggctgygagctgtgtaagtgtctgatcattcctagaaaaaaggacactcacatttggagaggacctgctgtgaaggcaggcctggcactcccacttcttcataata

SEQ ID NO: 2593 - DNA, 201 bp, Homo sapiens
cattcttctgccatggcttcagccagtccctcctttcggggtccctaacttcctgcaacaggtgtattcatctttttctttttgacttgtgcaaactcttygcaatggaagaaattagccccttgtatatatgttgtaaatatttttcctagtttaccatttgtattttcactttatgatatctttgtaatgaagacaatt

SEQ ID NO: 2594 - DNA, 201 bp, Homo sapiens
atttgtattttcactttatgatatctttgtaatgaagacaattttagtttttatatactcaaaggtgtcaatctgaaatgaaactacagaggtgtttcagyggcatgttcaatctgatgtaggatctgacaccccatgcctggtcctcattaaggactctactggtgagaaatgcagacacacctcatcaattgggcaatt

SEQ ID NO: 2595 - DNA, 201 bp, Homo sapiens
acaaaacctaaacataaggctaatatacttaatatacaaaaagctcatagtaaccagtgagaaaaagacaaacaattcagtaggaaaaccagcaaaggacragaacagacagtttacagaagaagtcacttcagtgtccaatatatacatgaaaaaagttatttgtccacattaataaggaaatgcaaaaataaaacaatt

SEQ ID NO: 2596 - DNA, 201 bp, Homo sapiens
ctctgactttgctaccaagtctggggttccaacaaatcccctccttgggtttgattatttgctagaatgactcacagcactcagaacactggccactagcrgtttcttacaaaggatacaaatgaacagccagatgaagaggtacatacagagaggtctggaagggtcctgagtgcagaggttctgtccctacggagttaa

SEQ ID NO: 2597 - DNA, 201 bp, Homo sapiens
acagcccttacaccattaaatgctccccatttgttgtgcttttgttgagcacgtgactaaacctcctgtttcctaaaaatggcttaagatatattttgccrgtagatacaaaatcagaaaaactgcacaaaccagttagattggtagaggtggtttatgtgccccatagccaagagaggtgtgcaccaaggaggatatcat

SEQ ID NO: 2598 - DNA, 201 bp, Homo sapiens
caacatagtaattttgctgcttctctggaattagctcttaatcccttagcctgtgcctagggcatataaacatgactgagaaaatctctcttaaaaggcargcatgaatgacctttgaattatctgttttgtatcttccaggccacttctctatagcatgggcagatccccaacaaaaggcagagccattgccattggtca

SEQ ID NO: 2599 - DNA, 201 bp, Homo sapiens
agccattgccattggtcacatctccgccccaggtgtagtgaaccaagggcagactctgtggaaagggcccagagctccgtgacaagagaaggagctttgtycttggactcccatctggtgccatctctgctcactgtggcactgagcagagcagaggccaatagtcgcctgcatgtcctttcccaaaaagcagtgcccgca

SEQ ID NO: 2600 - DNA, 201 bp, Homo sapiens
tcattttcaggtacaccaatcaaacgtagatttggtctttcacatagtcccatatttcttggaggctttgttcgttcccttttactcttttttctctaatsttcttgagttatttcattaatttgatcttcaatcactgatatcctttcttgatcgaatcggctattgaagcttgtgcatgtgtcacaaagttctcgtgcc

SEQ ID NO: 2601 - DNA, 201 bp, Homo sapiens
gtggttagtgggtgctgtcttagtacagatacagaacatttcagaagtttctatcggacagcacagttctaattactgagagtcagtgacctaacattatygtagttcctatagggacccactaaaggcatattctgaaaaatgcaaactaggctcatttttcaactcatgtgctattaagctggagaggggacctgctgg

SEQ ID NO: 2602 - DNA, 201 bp, Homo sapiens
agccaggatggtctcgatctcctgacctcatgatccacccgcctcggcctcccaaagtgctgggattacaggcgtgagccaccgcgcccggcctctctttwttttgttgtgtctctgccaggctttggtatcaggatgatgctggcctcataaaatgaattagggaggattccctcttttctattgctaggaatagtttca

SEQ ID NO: 2603 - DNA, 201 bp, Homo sapiens
ccaaatgtaataaatgtaaataaaatagagccaagagtaaataaatcaaaagctagaagaaaatataggtgacatttaattttaagatgaataggaaattraagataaatagattttactataaacttttaaagaattctgtacaacagaaaatcttaaaattaactcaagttggaaaagtattaacaaaaacatactgga

SEQ ID NO: 2604 - DNA, 201 bp, Homo sapiens; identical to SEQ ID NO: 2581

SEQ ID NO: 2605 - DNA, 201 bp, Homo sapiens
actatgtggcagcatttgtcctgggtatgaccatcaggttggagttgagtacttgatcctgtatttcaccatcatcccatcacctacctttctggagacarctgtgatgtccctcaagggggacagggtttctaacaaaactagccagagcttcctggtgaaccttacttacaggcagggaaactgagccagacatgagac

SEQ ID NO: 2606 - DNA, 201 bp, Homo sapiens
gcatattttatgcatttggctacatggtgctgccactgtttgcttacttcatccgagactggcggatgctgctggtggcgctgacgatgccgggggtgctrtgcgtggcactctggtggtgagtgtgaccttgtgccccatgtgcccactggcaggatgatttctgtctggccttcactagagggcagcaacaacccatga

SEQ ID NO: 2607 - DNA, 201 bp, Homo sapiens
tgccactgtttgcttacttcatccgagactggcggatgctgctggtggcgctgacgatgccgggggtgctatgcgtggcactctggtggtgagtgtgaccytgtgccccatgtgcccactggcaggatgatttctgtctggccttcactagagggcagcaacaacccatgaatccctattttgtctcccagagacaggaag

SEQ ID NO: 2608 - DNA, 201 bp, Homo sapiens
cagttcagcacattcctctatgctctgcatttcctcaaaattggcagttggatccagagacttgagattcaggttctgattcaggttcagtccttttggcmagaccataggaagcatgcaattcctgactgtctctttatgatgttaacagtaattagtatataatgcatagatctattaatccattgggggctataaatg

SEQ ID NO: 2609 - DNA, 201 bp, Homo sapiens
cttttcatttaaaagttagaatacttttgtacatgatactacctcttatctattattggttgctgttcacatagtttacaaaggaaaatcaggacaaatgyttctttctctttatttgccagttttcatttataatgaattgtttctctgttattctccaaatttggcagattcttttttaaaaaaaatatcattatgaat

SEQ ID NO: 2610 - DNA, 201 bp, Homo sapiens
gatatagactccatgcctagtaagaagagccaacaaatctgactccgtaattcttgctaagtaaagaaacctgagctgtctaagctgaatgtatctgtgayccggttgactaggtaatatgccatgattcacttctgcagtagcctggcttgcctcccctgggtcactgtgactctgtcatgcccctgagcatgggagagg

SEQ ID NO: 2611 - DNA, 201 bp, Homo sapiens
ggctaattcaggatccctagttccttatgactttcctttaaaacgtctaccagaaattgggggaaaaaaagtgttattataggattaatgttggtcttccscactatactgtgaatatcattgagagcttggtccctacaccttaaatcccccatcgtcaactattttttcccatctcagtgtcccatgatcaaggagacc

SEQ ID NO: 2612 - DNA, 201 bp, Homo sapiens
cttttccatctattctagaatgcaataaccagtctttaaaatgcaagcagaatatttcacatttcatttttgcaggtatctctgaggggaatgaatttacrtttctactaccacaaataggatggtcaagtttgttgcaatgcaaaattttttctgtggaattcaaaaactgtcctgtacctcttgaagccgaattgtggg

SEQ ID NO: 2613 - DNA, 201 bp, Homo sapiens
tgtttagatttccttgttaaaaatctgctggccaggttaggttccctttctgtagctttattttcaactcataatatagtgactattaaatattctttacycaacacattatattgtaaaaatatacacttagttctgtttctatcactaagccactactattttaaaaaggaatatcttgcattgttaagtttagcagcc

SEQ ID NO: 2614 - DNA, 201 bp, Homo sapiens; identical to SEQ ID NO: 2593

SEQ ID NO: 2615 - DNA, 201 bp, Homo sapiens; identical to SEQ ID NO: 2594

SEQ ID NO: 2616 - DNA, 201 bp, Homo sapiens; identical to SEQ ID NO: 2595

SEQ ID NO: 2617 - DNA, 201 bp, Homo sapiens; identical to SEQ ID NO: 2596

SEQ ID NO: 2618 - DNA, 201 bp, Homo sapiens; identical to SEQ ID NO: 2597

SEQ ID NO: 2619 - DNA, 201 bp, Homo sapiens; identical to SEQ ID NO: 2600

SEQ ID NO: 2620 - DNA, 201 bp, Homo sapiens
agatgaccaattcgcaggttagagaaggcttcccagaagaggaggcctctccgtgagcctagggtgttcagctcagcataatagtgagctgaaggccccartgcagcagcaagaaaccacccagcaggacggcggagttcacagagaggggagagttcatagagagggagagtgccacaggccctggcacagcttcaagcc

SEQ ID NO: 2621 - DNA, 201 bp, Homo sapiens; identical to SEQ ID NO: 2602

SEQ ID NO: 2622 - DNA, 201 bp, Homo sapiens
tttaacagactgctgaaaggattataaaaaattatggggatttgaactatcacccaatgcctccgtctgttgacacagacaagtttaaagcttgattttgygaaccttgagatgatcttcctccagcactgcaaatgtaatccttctcatctaaaactcccattctaatgccctactgtgctcctgcccctgcagagccct

SEQ ID NO: 2623 - DNA, 201 bp, Homo sapiens; identical to SEQ ID NO: 2603

SEQ ID NO: 2624 - DNA, 201 bp, Homo sapiens
agggctaatatagtgtttttcaaacctttctaaacattttggccacagaactttcattaaagtaggataatttaagtctagtaaatgaaatacaccctaartggctaaaagtatggctgttctgcctgcagcccctgccttcaattcccaatgccctgcctcaagcctgtctgtgcccccttggaaggcccagggccctgt

SEQ ID NO: 2625 - DNA, 201 bp, Homo sapiens
gcggggctctgatgaggggtttgtgggctcttcccaggtggccaatatcctgctcaacggcgtgaagtatgagagcgagctgacgggctccagcgagcgckcggagcagcctctgtccgtggggcgcctctgctccaccatctgcaacatgcccaaggcgctacgcaccctctgcgtcaaccacttcctgggtgagctccc

SEQ ID NO: 2626 - DNA, 201 bp, Homo sapiens; identical to SEQ ID NO: 2379

SEQ ID NO: 2627 - DNA, 201 bp, Homo sapiens; identical to SEQ ID NO: 2394

SEQ ID NO: 2628 - DNA, 201 bp, Homo sapiens; identical to SEQ ID NO: 2395

SEQ ID NO: 2629 - DNA, 201 bp, Homo sapiens
tccctgaatggcttcacagaggtccccacccatcaggcacacttctgccaacctcatgtggaagtaagcttctattgcattaagtccctgaggtgctgaakctcatcagttgatggcaggccacttgcatgcaaaatagaaaaggacatcggtatttttttcaagctgttaccctgttatagagataaaagaagccagaac

SEQ ID NO: 2630 - DNA, 201 bp, Homo sapiens
tccttatcgaaagcagacaatagaacagggatttagcagctccccgagggctgacaccgtctgatgccaggctctccttgttggagggtccaactcataaygcttggtgtcatgtgagcctggaaggtcctgaaatttcttggattcccaaggaaagtcgtggctgcttagggccttagggtccaaagtggaggatttaag

SEQ ID NO: 2631 - DNA, 201 bp, Homo sapiens
agaagaaagacaatctctgagtgggtggggtggtggaagagttttggatacaaatctggagtgaggaatttcagagtgattcataaataatttattgtctrgtgatagtgtgatggaaagtggtatggtaagttaatgtcaggaaaaaagtggcttacttttgaagcttaaaactaattttgagagaaagcccgtgatatt

SEQ ID NO: 2632 - DNA, 201 bp, Homo sapiens
gaagctaaggtagatttccatacttaccaatatataaaggagaattttcaaatttggcaaaatcttctatataggaaatacccaaaggcaggatgggagtktcacccattccacgtacaatattgcctactaggacgtacacccacattaatgatttaacttcctttgtacactctgcattaaaaaaaaaagacatgacat

SEQ ID NO: 2633 - DNA, 201 bp, Homo sapiens
cttcagactgctctgtctcttggtgatctgcaattaagcagaatctcattattaattagaagtatttacatggtcctgagaagggaataatcccaagtttsggctggtcctgagaatcttttcaccagactcaactccacaagaaaaggtcccaaatccccattgtgtaaattgacaaaactgactgcttaagtggaagtg

SEQ ID NO: 2634 - DNA, 201 bp, Homo sapiens
cagctgcatgatctgcgcgttgatgtgaggttccagggcgccgtagtcgtagggcaggtcggggaggctgtgcttctgcctggagcccagataccccaaarccggagccagctgcctgctggtgctgaagacgagaaagcacagcccggtcagtcagcgccgcgggaccgtctacgcaggctgggctgccgaggaacggca

SEQ ID NO: 2635 - DNA, 201 bp, Homo sapiens; identical to SEQ ID NO: 1424

SEQ ID NO: 2636 - DNA, 201 bp, Homo sapiens
gcggacccgatgatgtctggccaccagtggacaggcgctctcagccctcctgcaaacggctggcacacctacctgagagaccaaacatttccccaaagcayattatacaacaagaacaatttcaatttgcaaaaaaaacgagtgacacagtagagctttcttttcaggccctacaattcaccagtgctggcaatatgtgta

SEQ ID NO: 2637 - DNA, 201 bp, Homo sapiens
ttggcgatgcccaggagcacagaattcctgtagcccatgatgagtggcattcggtgacacccaaaccaagtacacggcaagtacatgccacatttgtgtcmgagtaacagggcaccgacagctccaggagccacactctgcatttcaactagaacctttttccaaagtaatgaaaggaacacaaaagaccaaggaacccta

SEQ ID NO: 2638 - DNA, 201 bp, Homo sapiens
aatttatcatcattataaaaaagaagaggaagcccatgttgagggtggggagagagcaaaatctatcatttatggattactgtgtaatgtactaggcagtmatgcttcagacaaattcctataagtattatttcctaatttgtataaatattggtcagcagtttggggttttgctctgacaattatccaaagtaaaattac

SEQ ID NO: 2639 - DNA, 201 bp, Homo sapiens; identical to SEQ ID NO: 1429

SEQ ID NO: 2640 - DNA, 201 bp, Homo sapiens
atttcaagttgcaatgaagtgtacaataaagttgtgatttctcaacatcaaagtttaattattacaaaatagttcaagcaacagatagaatttcaaaaacwgtatttgctttgcttccttgttttgctccaacactaatcatgctgaggtttttgaagcacagctatgactagggcaggcactgctgattcagtcacaaaa

SEQ ID NO: 2641 - DNA, 201 bp, Homo sapiens; identical to SEQ ID NO: 1430

SEQ ID NO: 2642 - DNA, 201 bp, Homo sapiens
ccttgccaaaatcctggcataggaatttgaaccctggtgtatgaaaagtctgccctttgcatactcaggtttcgcatcccgtgaatgctgtatttttgatycgagtactgtattttttaatctgagtttgattgaaaaaaatccaaatataaatggacccatgcagctaaaacctgggttggtcaaggaccaactataata

SEQ ID NO: 2643 - DNA, 201 bp, Homo sapiens
tgcttgcatgttttcatttctttgagatacatgtttaagagtgcaactgctgagttatatggcacattcatttttagttgtattaataaaaggaactgccwtacttcttcagataccatttttatattctcacctgcagtgtaggaaacttcagtttctctgaatcctcaccagcgtttggtgttgccactaatttttatt

SEQ ID NO: 2644 - DNA, 201 bp, Homo sapiens
tctcaaatctccccctgttgtgcattcctaccttgagtttaattactcttacatacacacacatacacacacacagtggctgttataaaagaggtaacatygtctctaggaggaatttgtgattcaattgggaaagcttactaaacttaatatttaagtgaataatttagatattacagaagtttcctattgtggagtcag

SEQ ID NO: 2645 - DNA, 201 bp, Homo sapiens
aaaggaaccaaagtcacgtttgatggcttccagcaactcccctattaaaaaaaaaatccaaaaccacccacaaatgaacagatttcaataattacagtaamatgttatattacatgtattaaaatatttttgtcatagggcccaagaaattagacaacatcagaatgcgacacctggatctaagtttcacaattttaattc

SEQ ID NO: 2646 - DNA, 201 bp, Homo sapiens
ataagctggaatttatattgaacagcatccatgatactttagtattacaactaaagttgtacatactgagtaggtaggatgccttagtaactagataaaasgtataccacctagccatagtgataaatatagctgttttcaaactgtcattcacagatctctaccacagtacctgttacgtgaagttcctggttggttctc

SEQ ID NO: 2647 - DNA, 201 bp, Homo sapiens
gtgaaggtatcactttaagttcaaagtcccaaccctctgccagacaactcatggctctatttcccatactcttcagtgacattttttaaatccaattaggmtcaacagcaaagtatttggtgagcccagcctggcacttccaagccgaatattttcatatactctaccaaagagccccagaaaggcagaaggtctggaaac

SEQ ID NO: 2648 - DNA, 201 bp, Homo sapiens
gtgattgtggactgggttttgctacaaagagcactactggaacaattggtgaatggtatctgaatggcatctgaggattacaagatggtaaggtatcagcrtaaatttcctgattttgatggccatatggtggctatggaggagaatggccttgtttgctggaaatgcacataaagtattaagcggtgatgggacgtcacg

SEQ ID NO: 2649 - DNA, 201 bp, Homo sapiens
ctcttttccagtcctccactgccggggctgggcccggccgcgggaaggaccgaaggggatacagcgtgtccctgcggcggctgcaagaggactaagcatgratggcagccggagaggtaaagggcagctgtcaggggctaccgccgcctcgcccctcgctccaggcggcgctcccagcctcgggtccgggcagctgagtgc

SEQ ID NO: 2650 - DNA, 201 bp, Homo sapiens; identical to SEQ ID NO: 2342

SEQ ID NO: 2651 - DNA, 201 bp, Homo sapiens
cataggcttgtattatgcacagagtctctggaaggatgcatttaaacagtaacatagtatatttctgggaagggagactaaaggtcagggtagagaaatcrcttctttttcaaactccatatgccattttagctgttgaatttttttaaccacattgcgtgtattacttctcaaaaactgtttttaatgtttaaaaaagct

SEQ ID NO: 2652 - DNA, 201 bp, Homo sapiens
gatttccacatttggtatttgtcatttataaatactgacaatattattaaactattacctttctctttcagctgcagtagactgctcggttccagtaagcrtgagtaccagcataaagtgtaagtaatttttggacattattacctttttaaaaaaaaattaaggtaaatatacataacataaaatttactgtcttaacca

SEQ ID NO: 2653 - DNA, 201 bp, Homo sapiens; identical to SEQ ID NO: 2353

SEQ ID NO: 2654 - DNA, 201 bp, Homo sapiens
ttacccaaaagtcattcaggagcaagttggtttaatttccatgtaaaattatgtggttttgaggagtactcttggtattgatttctacctttttttccacygtggtccaaaaatatgtttggcgtggtttcaatttttttacatttattgaaacttgctttgtcttcgagcatgtggttgatcttagagtatgttccacat

SEQ ID NO: 2655 - DNA, 201 bp, Homo sapiens
gaagaccactgcgcaggggggcggaacagggggtactgcttggggaaggccgtctggctccacttgcccgtgaaggtgatgctgtatttggccagggctcyggcggaacagatggactctcccccaagaggctggccggcggcgccgagagtggccaggaggagagcgcagagggccttgcccagggcggcggccgggctg

SEQ ID NO: 2656 - DNA, 201 bp, Homo sapiens
gtggcctccgcacagtccccaggacgaccacagggagacctcgcagtccagcggcgtttctggaactggaccaagcaaaggggagaccgaggtgaacgctygcgtgaagaggcgcttcgtacaaacggaagccacctcccaccaacgtgtgcattcatcagaggccacgcccacccttcgggggcacttgcgtttctccgc

SEQ ID NO: 2657 - DNA, 201 bp, Homo sapiens
ggggccctggagacttctgtgatggcacccacatcaacacatgccctggggccccagagacttcagtgatggcacccacgtcaacacatgccctggggtcyctgaggccaggaaagcacaatagcctctcacctgggcagtaaatgttctggccccaaagtgacgcctgtcctaccccagggacccccagctccatgctcc

SEQ ID NO: 2658 - DNA, 201 bp, Homo sapiens
tgcctgattttgattgttggggctcacactagggactgggaaagctcctgaggagagaattgctcctgtcctttcctatatcacagggcattgctggcctygagggtccctctccatgtggggtgctgggttcaccttttcactctgctgctagccaagctcacagcagccctcaggagccctgtctctcccagctgctca

SEQ ID NO: 2659 - DNA, 201 bp, Homo sapiens
ttcataatgataaatgggaactatcttaaatatatatgtacctaataataaagcttccaaattttatgaaacaaaaattgccagaattgaaggagaaagaratacatctataattatagttggagatgtcaacaatcctctattagtaatataacaaataaagggaagtcagtaggattagtgaagacctgaacgatgcca

SEQ ID NO: 2660 - DNA, 201 bp, Homo sapiens
tcctctcccagcagtcccgttgctttcgcccccctccccaaactccactgggcccgcccagaatggggtgtgggtgtctcccgcttgcaggcgcccgcacrcctaaatttcctctagaaagtcggtgggaaacagccccaccttgcggccggtgtagaccttgacgtagccgcccgcttcgtctcctttctgcaccacgat

SEQ ID NO: 2661 - DNA, 201 bp, Homo sapiens
ttttcttctggatcggaatctgaaggagacatttttactagccctaagagaatttcaggcccggagtgtactactcccaaagcttccacttccgcgaacartttcacaaagtcaggatccactcctctgcctctttccggtggaacctcaagttccgataactcatggacaatggatgcctccattgatgaggttgtacgt

SEQ ID NO: 2662 - DNA, 201 bp, Homo sapiens
agtaagcaggctgaaggcaggaagaaaatttaggatggcagaattgcagttggggccagtggaatacagggagtggtaggttgtacctgtagcactaagayatctgggcggtttgggtaggcaaaggagacatcttggaactggacaaggccctccaagtgtaagggagtcaacagaccactgggtgggcagcgaggggtg

SEQ ID NO: 2663 - DNA, 201 bp, Homo sapiens
ctgggagatgagggtctgtgtagagcgggccaactccatgaacatacctggtaccattttcccaccttcttgggcagaaggaaaagcagaggcagggtgaycagggtgaccatggtgagggacactgatccccagagcatgatccccaagagacataggcctcgcaccaggtaccacagaaataagctcagattctcactc

SEQ ID NO: 2664 - DNA, 201 bp, Homo sapiens
ggagaatgaaccagagaccccatggagtctgactcaatgcacatcatgcaagtcacagttatcttcaccaccatcaccactatcaccttgtctggggagcrttttactcttcacaaaaggctttcattcatgtgatgtcagctaatacatgaagagccttataaagaaggttatatcactccatttttgaaaaatgaggaa

SEQ ID NO: 2665 - DNA, 201 bp, Homo sapiens
ataaagagaccacaaaaaaagggactgaggtagagaaatctggaggggacacaaagaaccgcagtcattaacctgaaggaaatatcaagtccctgtctccyaagtgacatcggcaggctcaataggcagacaggagaatgaaccagagaccccatggagtctgactcaatgcacatcatgcaagtcacagttatcttcacc

SEQ ID NO: 2666 - DNA, 201 bp, Homo sapiens
gtagctctctttccagtgcatcacagatgtccctcatccctggcttccactattcccatcactctcactaacaaatctacaaggtaccagcatgaagcagkcccaggtgcaagaatttatggcgccctgcacttcccctgagaggcaaaggaaggccctaggactggaagacacgcatctctccaatccacatggttgggt

SEQ ID NO: 2667 - DNA, 201 bp, Homo sapiens
gtagatggagagcagtacctagagggaggtaagaatagtgaaagtgaggtagtctgcttgccagcattatgtgaagcaagaagggtaaagaatggaaggamatcacacagatggtgctgggccagaggaaggaatcacactggggagtgaaggtggagggacctcacctccacagcctgggtgaactgcatctggtagaga

SEQ ID NO: 2668 - DNA, 201 bp, Homo sapiens
caagaggaaggagatcagagtttgcaaagcttttatgtggaccttggtgctgagatcttgcgatccttctccatggagctgcatcttcttgagatgtttayacagagaacagattagcatcagaaaagatatcagggacagagtaaagggtatgaagctccatagggtagttacagtcaaatatgaaagatgtactgtatt

SEQ ID NO: 2669 - DNA, 201 bp, Homo sapiens
ccccccatcctgcaggcaggacacaagcccgccctccagctcacttctgtccccaccttctactgccttacacccaggtaactgacccttcacacatttayggtgcccatctgacattcatagcatttagaggggggacgaagccaggttacacaggaccttgcaggccatggtaagaattttggattaagtgtttttagc

SEQ ID NO: 2670 - DNA, 201 bp, Homo sapiens
gagccacttcgcctggcctcagtgaaacttatttcaccgtgtttttcacttacatatttaggtgttcataatacagatgtacttctcctttactggactcyttacagaaaaagaccccaaagcctatcacagggtcatagatgcccagtaaatgctgctgcacatcacagaattggtgctttttccgagatcgcggccacg

SEQ ID NO: 2671 - DNA, 201 bp, Homo sapiens
ttgcgccattgtactccagcctgggtgacaagagattgtcagaaaaaaaaaattgtttttactatttttggtttagaaaaattcttttggattttattccwagtgtgatgggaagccttggggggttttaactagggaataatgtgatctggttcacattttcaaaagatcattctgctatatagaaaagtaatgaggcaa

SEQ ID NO: 2672 - DNA, 201 bp, Homo sapiens
tagctgtaagctcctctggttcagcgccatggcaatgagaaagaatcaagggcaaggtcaggggaatggacgtgggaaggtgagagtggccagtaccccaytcacggctttctgtgcctgcagagttcacccatgcagggcagggagggctgattgaagagcccacaggtgatgagctaccaaccaagaaggggcggagga

SEQ ID NO: 2673 - DNA, 201 bp, Homo sapiens
ggggagactcggggctccgaggacgagacggacgacgatggggaagacttcacgccacccatcctcaaagagctggagaacctcagccctgaggaggcggyccaccagaaagccgtggtggagacccttctgcagtaaggagccctgccccgtccccgctcccaggagagcctagaggggcccccctcagctcctaacgag

SEQ ID NO: 2674 - DNA, 201 bp, Homo sapiens
agatttatttgcatttctatttaagcagcatgtctcgctaaactttctttgaacttttctgcactaggtctgcactgacattgatgagtgtcgaaatggascgtgcgttcccaactcgatctgcgttaatactttggtaagtatttctcacagctgttgttatcaaagcagaaccggttattaaaacaagtgtatgtttat

SEQ ID NO: 2675 - DNA, 201 bp, Homo sapiens
aagtaagtgttacggctgctataatgtgtctggtactgattccaaacatatccagcaattcactagttttcccacgttgaggcactcctgacactgccagwtgatgaacaaggatatcaggctccctggagacagctgcacaaacagcttctccaatgccaccttccctgtagtgatcctccactgtgataactcggccgc

SEQ ID NO: 2676 - DNA, 201 bp, Homo sapiens; identical to SEQ ID NO: 976

SEQ ID NO: 2677 - DNA, 201 bp, Homo sapiens
tccgtaatcttgggctctggatttatcagttgttttcctttctgccagtatttagtgtttttcgctatggccagccccaaggattgggatgggttcctatygtaactattgtaaaacaagatttaaaaaaaaaaagaaaaagaaaaaggccaccgggcatggtagctcatgcctgtaatcccagcactctgggagaccagg

SEQ ID NO: 2678 - DNA, 201 bp, Homo sapiens; identical to SEQ ID NO: 976

SEQ ID NO: 2679 - DNA, 201 bp, Homo sapiens; identical to SEQ ID NO: 2677

SEQ ID NO: 2680 - DNA, 201 bp, Homo sapiens
agtcaaaaagtgaaggacttaccacctgcaaatcaccgtcgaggtgagacctgcgaagcctccgatcagcagagcagccagcgacatggagatccaagtcrcccgagggagcctcccggagtctggggcacagaaagaggcctggttagaagaaccttccagggcctgggcaagccaggttgtcctgcctgagtctgggcc

SEQ ID NO: 2681 - DNA, 201 bp, Homo sapiens; identical to SEQ ID NO: 981

SEQ ID NO: 2682 - DNA, 201 bp, Homo sapiens
atggagtatcgctgaggtgatgagagagaatgtggttgttagcaacatggagagagaaagtgggaagcccgtggctgttgtcgcagttgtgactgagcctyggtttacccagcgatacagagaatatctccagaggcagaaactctttgatacacagcaccgtgtggaaaagatgccggatggctcggtggcgctaccggt

SEQ ID NO: 2683 - DNA, 201 bp, Homo sapiens
ataagtgaagattccaattttgaggggtgatacgatttactggaactcagatccttctgactttcaaatagttgtttcttggaccaaaggacaatgaaacrgtgatgactatatctgcatgaaaagggaaaaagggagctgtatctgactcttcactttcagaaaataaggtggctgctgatgctaacctgagagcagcat

SEQ ID NO: 2684 - DNA, 201 bp, Homo sapiens
aaatgaaagtacactccccaggatgggagcagcccctgtctaggggctcaacagctgggttacagaatcttctggggtccaaatacccactagaggtttcytactggtcacttggtgttcaccccatgcaaatgaagtagtggcctgcaatcagaggctgaagtaaagttacaaagttgcactcctatgcaaacgtctgat

SEQ ID NO: 2685 - DNA, 201 bp, Homo sapiens; identical to SEQ ID NO: 989

SEQ ID NO: 2686 - DNA, 201 bp, Homo sapiens
attctaatttactggtttacatcgtcaaaaactgatggctggttttaatttgaaacagagaaatcattcattttagttgctaagaatcatgaagttcttamtactatcattggtgtaataagatttaatcaagttaaggtgttgtcactggtattagttatccccgtatttaaattattttacacaaaggttttactaagt

SEQ ID NO: 2687 - DNA, 201 bp, Homo sapiens
ttacagatgtgagccaccgcacccagatctggttagttcttaagtgattcatgtaactggtcagtagaagaaaaggattataaatgatgccattctgtaarctgcactactacccaaaaaccattgttctaaactgttctggaaatcattactatgcatcgttttggaaaaacttgccaagaattaaaatgttacttctca

SEQ ID NO: 2688 - DNA, 201 bp, Homo sapiens
cggcctcccaaagtgttgggattacagatgtgagccaccgcacccagatctggttagttcttaagtgattcatgtaactggtcagtagaagaaaaggattrtaaatgatgccattctgtaaactgcactactacccaaaaaccattgttctaaactgttctggaaatcattactatgcatcgttttggaaaaacttgccaa

SEQ ID NO: 2689 - DNA, 201 bp, Homo sapiens
ctgaagtggtaagtgatgaatgatttcatgacttgttaatggacattcttggtactaagtttttcctagaaatgattctaaatatgtaaatgctattgggrtaacactttaataccccatttcaacaaggagtaccttctcaattaaaaaaaaatcgcagtaggctgggcgcggtggctcacgcctgtaatcccagcacat

SEQ ID NO: 2690 - DNA, 201 bp, Homo sapiens
ttaagatgatgctttgggcacacataaaaacttggttaaaatttcattttaaactagtatactgaagtggtaagtgatgaatgatttcatgacttgttaakggacattcttggtactaagtttttcctagaaatgattctaaatatgtaaatgctattggggtaacactttaataccccatttcaacaaggagtaccttct

SEQ ID NO: 2691 - DNA, 201 bp, Homo sapiens
aggtgggtggtggattgcttgagcgcaagagtttgagaccagcctgggtaacatggcaagaccctgtctttactaaaaatacaaaaactagtagggcgtcrtggtgtgagcctgtagttccagctaattgggaggctgaggtggaggattgcttgagcccaggaggttgaggctccagtgagccgcgatcaagccactgca

SEQ ID NO: 2692 - DNA, 201 bp, Homo sapiens
ctagataattcccttttacaatgtttgctcctgtaatctgtgtatcaaacttttgttacttgtatactatatattactgtatactataatcacaatatgtyatacccatgtacaacttatttacccattgtgttttcaaattgagttaaaatttaaatacagtgtatttaaagaaatctttaacttccataattaaaaaac

SEQ ID NO: 2693 - DNA, 201 bp, Homo sapiens
ttgagtagaccttaagtggaaggtcaaacctttaatttctttctctgattcctggtgctacagtgtgatatatgtcttatcccttggaagtaacgttggcrttgtgttgtgtgtccgttggcgctgtgttgtgtgtccttgtaaccttaaagtcttagcaatatctgcccaggtgcagtgctttgtgctaatgagggaaga

SEQ ID NO: 2694 - DNA, 201 bp, Homo sapiens
gctagcaatcgtaaaataaatgaaaatattggaaggacctagtggtttttttgttgttgttgttaaagaagtaaaagaatagtaaacttaaagcatttgtkttttgagatggggtctccttgtgttgcccaggctggtcttgaattcctgggctcgagcagtcctcccaagtagctggaattacatgtcaatgcccccaca

SEQ ID NO: 2695 - DNA, 201 bp, Homo sapiens
tcgtttcctcctgcggccgagaaagggaagaggtaaacaggcgaaaatgaggcgagcaggggctgaggaccgggcctcagctctacagcattcgcctgagmatgtattgttatccgtggcagcgccttgtctcattggatggccctaggcctagtgtggccgcgactccgaactgaaagcccaagcgcggcggcgtccagc

SEQ ID NO: 2696 - DNA, 201 bp, Homo sapiens
accagttctcaaactttgtctcaggtcccttttacactcttaaaaattattgagaaccccaggaatcttttatgtgggctatatatggatgtttatcataycagaaattaaaactaagaacatcttaagttactataaaataacccattacatgttactataaatagcattgcttattaaaaatgatctgcaagaagcttt

SEQ ID NO: 2697 - DNA, 201 bp, Homo sapiens
acagtcaccacttactggtcttttgtattcgtttgtctgactgatgctgcagatattgtaataaacaagacaaggacttaagggataatgggagagatttyaggaaaagatttggggttttttacacggcaaaaggcaggtgtttattaaattttaagtcttaaaccagttctcaaactttgtctcaggtcccttttacac

SEQ ID NO: 2698 - DNA, 201 bp, Homo sapiens
ctcaaatagagttttgaggttatgcccttctgactcagatttggtctaacaatgtagactcatctgaaaaatgtttttgtgattcagtctttgaattgatrtagataagaggaatttgagatgatactgcccattaaagtacatggagtgtgggatatcaaccatcacttaggctctcagaagtagatattttttagtata

SEQ ID NO: 2699 - DNA, 201 bp, Homo sapiens
gtcagttttatctttacagggaccttaaatttcattaatagggtacctctaataagctaataatgctaataagctgatctatgaaaatggaactgttattyatgatatactttatttaaatggaaaattggttatttggactataatgagaaactaatctgtatagacttacattttcctattttcattttaggtgaagaa

SEQ ID NO: 2700 - DNA, 201 bp, Homo sapiens
aaaaaaaatcaaaaaagtctcataatgttttaagaaagtttatgaatttgttacgggctacaggcaagctttgcatggcctattgctcctaggcaacaaasctgtatagcatataactactgaatactgtaggcaactgtagcacaatggtatttgtgtatctaagacgtatctaagcatagatatgtaaacataggtaca

SEQ ID NO: 2701 - DNA, 201 bp, Homo sapiens
tgcccccacacccacattctgaacattttatttttaagtgagggatagctacatattttttttttttttaccagcaggaagtcatatataattctcttcayagactttctttcctctgaattcttattaatagaatcttacttagtgcagcctctcccaaatattgtcatggttagtttattcccaggtttctgttcagtt

SEQ ID NO: 2702 - DNA, 201 bp, Homo sapiens
attcattccctcttagatgttagtagcagaattcagtagaactgactaaagcagggaacaaattttgtatacatcaagatttttttgaaggggcgggaaargctaaattcttcctagttttaaggtaagccaggaaatcaaactagtctttcaacagtttgaaaaaaaatgctgattgttttggatagtctgtttttttct

SEQ ID NO: 2703 - DNA, 201 bp, Homo sapiens
aattttgagaggaaaccatcttcaatacttgtatgtaaattcgatttcaaaatgcaagaaagtttactttctgcagttattgtgtcctttccagaattccrgtactataaagtgaaatgtcaggcactgtcctaagaacttcacatctgtaatgtcatttaatctccacaaaaacctctttaagttctatctcattataca

SEQ ID NO: 2704 - DNA, 201 bp, Homo sapiens
gtctgtagcggcacaaaaaagtacgcttcagtgtacttcttagtcaaatctagcagtttatagtaggaacagcaaaactggtggttccccgtaggaatcayatcgataatgtttaactcatgttaacactgtgctcagccatttagactaacttggagaaatatttgttgactaaaattgtctttctgagtttaaatttga

SEQ ID NO: 2705 - DNA, 201 bp, Homo sapiens
aaaaaaaaacaaataataataaagtagggaagttcagtatattttaatgtacatttaagagtacatttccctttatgcagtgtttgacataaactgatgarggacattgcatttagtgaaattttaaaagtaaagactaagtacagtcatgtgttgcttaacaacagggatatgttctgagaaatgtgctgtttcattgtg

SEQ ID NO: 2706 - DNA, 201 bp, Homo sapiens; identical to SEQ ID NO: 1605

SEQ ID NO: 2707 - DNA, 201 bp, Homo sapiens; identical to SEQ ID NO: 1606

SEQ ID NO: 2708 - DNA, 201 bp, Homo sapiens; identical to SEQ ID NO: 1607

SEQ ID NO: 2709 - DNA, 201 bp, Homo sapiens
atctacgacactggagttcaatctgcgggtgtccgattcgtctttgaacacgccttccatgacagccagaggggcccggcccacagccttgtgctcacggmgactatgactgtcgcttggttcctggtaactgctagaaaggttccgcaagctaccaaagcaagagatggagaccttgtcatctgctgcctccccaatctt

SEQ ID NO: 2710 - DNA, 201 bp, Homo sapiens
accctccataaatgtgtgccaagagggtctcctttcctgtcttcctctacagagaatgctgctcggtcctcctacccctcttcccgaggccctgctgccaygttgtatgccccagaaggtaccttggtcccccggaaggagagaaaaaagagagatggactgtggctgcatttcttgggtccttagagtgggctggagaga

SEQ ID NO: 2711 - DNA, 201 bp, Homo sapiens
ggttaataatatggccttcaatgggttgttgggtgaggattaaatgagacagagcaaatgaacagcaagcagcatagtgcctacctcagagtatgtgcccrttggatggtggctgttattcttgctcaagatgtaaaacctcaacagcctgccgtgccagatgaaaataaactagatgcagccgggcgcggtggctcacgc

SEQ ID NO: 2712 - DNA, 201 bp, Homo sapiens
atatcctcagtctcagtcactcagctggtgagtggcagaagcaggatttcaacagacgggtgcaaagcagagccctgctcctagtctctgagctgagtgcygacttagggaggcaatgttataccggtacttgcgcccattcatctgacgacagttagaacagtttcttggatactagacaggagatggggagacaaggag

SEQ ID NO: 2713 - DNA, 201 bp, Homo sapiens
ctttttgggtgcctgtttttggttctgggtgagatgcactcaccagggtgataaagaccctgcctggcttgttcatggcgtctccaggacctagtatggtrcctgaccgtggcactcatagggtgtttgttgagtgaatgaatgatgccttttcagctgaactcgagctagaagactccagggctcactccactgtgccca

SEQ ID NO: 2714 - DNA, 201 bp, Homo sapiens
acactgtcaaggaagatcagattttctctggcctggagccaggttagtggaaaaatcctttgccttgggccccctgctctggttcactggggcagtcctcygatcactgactgggatcaattacctctgcggtagcccctaaagggaaatgcagaattgctgaactctggaagggaaggagaggtttggtgagccatcatt

SEQ ID NO: 2715 - DNA, 201 bp, Homo sapiens
aactcttggctcttgggtattgctcccttgtctccctggggctcattgcctgtttctgtagcttaattgtagcttaatttggggagcatggccccgggaawtttttttttttttttagacagagcctcactctgttgcccaggttagagtgagtgcaatcttggctcactgcaaacttcacctcctgggttcaaacgattc

SEQ ID NO: 2716 - DNA, 201 bp, Homo sapiens
tcttgctatctctgttcctgtttcctccacaggctttccagaattggaaacaacctgttgtcaggaagaaggggaagggttgagagtcagggtttgggacyagattggcaagtcaggctctggaagaatcatgctctgaaatttggggagggaggaggaaaggtcagaaaagacccttgtgatatttttatttttattttt

SEQ ID NO: 2717 - DNA, 201 bp, Homo sapiens
cctaaaggaaaagaatggcagaggtagacatataaaagggactattggtaccagatggatttctagcaggaggaatcaccaggcaaactgtgttcctgctrttgaggatatagctcatttctaggttattctaacaggcaaggcaggtcaagtcacttttttttttttttgagaccaagtctcactctgtcacccaggctg

SEQ ID NO: 2718 - DNA, 201 bp, Homo sapiens
cttttgcatcatcagtacaaatgctagctgttaaaaaggtaaatatctcagtattactacagtaattttgtctttgaagaccccaggagtttctaggccayccaccgagaactattgtcctaaaggaaaagaatggcagaggtagacatataaaagggactattggtaccagatggatttctagcaggaggaatcaccagg

SEQ ID NO: 2719 - DNA, 201 bp, Homo sapiens
gatgggttcacaggtggcaggcacaagccagtccatcctgtagtcatcatagttgttggctcccaagttgctctcctcactggagaacaaggacagccacrtggcgcgggatggccggcgggagttctggttgcggccacggctgtggcctcgttgtgaacggtagcctttgcggttgcgatgcctaaacctttgtttctt

SEQ ID NO: 2720 - DNA, 201 bp, Homo sapiens
tattagctatcctttattcagttccagattgccttcataataatcatttgaaaattaccttggtgatctcatgttcatgtcctttgaaccttttcaccacmtttccagttttccaattataggccacaactgtctgaagagagtgaagattgtagtttcattactcaattcttgttaaagtgacactagcctctactgcat

SEQ ID NO: 2721 - DNA, 201 bp, Homo sapiens
tgcgtctaagcctactgctctactctctacagcggggatggctgccttggcatcttcaacattaagaggcgtcggtttgagctgctctcagaacctcagtytggggacctgacctctgtcactctcatgaaagtacagctggttatggtgggatggaggggtgtgtgctgggggcttagtctgaggcagcttccacattgt

SEQ ID NO: 2722 - DNA, 201 bp, Homo sapiens
atttgacatggagtggccaccattatacaatagagggaaacttggcaaagttgcactaattcagttgtgtgtttctgagagcaaatgttacttgttccacrtttcttccatgtcaggttggtatctctacatttcatttttatatggctgataattgtaatatgtcaactttatccctataaaattaagttcttttattag

SEQ ID NO: 2723 - DNA, 201 bp, Homo sapiens
gcaaaacctaatcctttaaaaaaataaaacataaagagtttgaaatgcttaatctttcattaaactctcaaaatacaaatgcaactacaaatgatgtaaamtatagaagagagtgaacaaagaacagatgctcagatttatgtatcaattagcttttaggaagatagcatactagtattgaccattcatctgtataagtac

SEQ ID NO: 2724 - DNA, 201 bp, Homo sapiens
tgtcactgtattctttcaaagaagccaatgaaataaactgttttctccctctatgtggtgtttttctacttgaacataaatgcacattttattttatttcmagactttttgtggccagcacccaatgaagagcaagttacttgcctcaagatgtactttggccattccagttttaaaccgtgagtataatctcatttaatc

SEQ ID NO: 2725 - DNA, 201 bp, Homo sapiens
cttttattagctggccgttctctcattatctcaaatttatttaagtatttatgttctacctgattcactcacattccttgttttatttaattttcacaacrtacctgtgaggcattgacattttttctgttttagagaagagaaaactgaaattttaagaggctaaatgaccaggatatgtactgctattgctagcaggag

SEQ ID NO: 2726 - DNA, 201 bp, Homo sapiens
ggaaacttggcaaagttgcactaattcagttgtgtgtttctgagagcaaatgttacttgttccacgtttcttccatgtcaggttggtatctctacatttcwtttttatatggctgataattgtaatatgtcaactttatccctataaaattaagttcttttattagctggccgttctctcattatctcaaatttatttaag

SEQ ID NO: 2727 - DNA, 201 bp, Homo sapiens
atgatgaataaattctaagcaggggaagtgtttgggaaagcagggcaggctttgtgctgttgatggcaaatgatgtaccagacaggatgaagttgagaatytggaagttgatcactgattagaaaggcttacattttattttggccgggggtggcagctcatgcctgtaatcccagcactttgggaggccaaggtgggcgg

SEQ ID NO: 2728 - DNA, 201 bp, Homo sapiens
aaaatgtcaggaattcataatgattcatatacccaaggattttcattgatagtgaggtaaggttattcttgagaaagactcaaagtcataaaataatagamtttcgaaactaccagaattatacaagtcaattaaaatgactgatttgttttaagaggaagaaatactaaatgtataattattagatgcagcatattgtat

SEQ ID NO: 2729 - DNA, 201 bp, Homo sapiens
ttttttttaacaaaaaacaaatttacaaaatctttccatgtattcaacttagaatttaatgaaatagggtttttttttttttggtggtcatgtatcatcarctttctttacatttaattaaattaatcaacaaaaaacatatagttgacataaacaaatttgggaccaagcactactgactcttagtaaacatacaagtca

SEQ ID NO: 2730 - DNA, 201 bp, Homo sapiens
tagtagagaaagtgctgggattacaggtgtgagccactgcacctggccttggatttcgtgatttgactgacatcttttacaccaattattgccattttttwattgggtactaattattagtattgctttctttattcgttaaataagaagtaaaagaacttttaaaaaataaaataactttttttcctagtacaaagctta

SEQ ID NO: 2731 - DNA, 201 bp, Homo sapiens
tgctggggattgcaggtgtgagccgccgcatccagccctgtgttccttcttgtgttactttcttgtaattttttcctggaatatgggtagtgatttggctytccagtattgaaattgagtttcctttcttccaattcatgtgtatccatttttatttggaagttttgtttttatacattcaataatcatctttactttctt

SEQ ID NO: 2732 - DNA, 201 bp, Homo sapiens
attaaaaaaaaaaaagtagattgtgaattcagatgtaggtttgtatcccagcttttccagttagtatctgtgtgactttggggaagtttcttagcatcttkgatactcggttaacagttgtaattattatttaaggtattgcttgagaagagcttagtatagagcctgacatttagtaagtgtttaatacatattagctaa

SEQ ID NO: 2733 - DNA, 201 bp, Homo sapiens
gctgtttgacatcagagcttattctttataccatttcctatgttaattagaatacaatattaatttcataaaggtaaaggcatatctgttttgttcctatytgattccttgtgaaagcacaatgcctagcgcacaatagacacttaaacttatctgttgaatggacaggtgaatgcttttaaagtctttccatatagaaaa

SEQ ID NO: 2734 - DNA, 201 bp, Homo sapiens
tttcatttcatagaatggagagcagactctgtaaatattttgccccagacctagctttattacaaacattgtcttaattaggattctgtctacccagaatrgaaattaactcaagctagcatgagtgtatattgaaatttatattaaggataaaggaatgtctcatagatcccactcaaaagaaattagccagcccttagg

SEQ ID NO: 2735 - DNA, 201 bp, Homo sapiens
ccacagtacctttgattagttgccactagtgagtatgatttattacaaaaaccaaaaacttagataagtcacagtttatttcctagaacgtgtaaatataraattagtcaaaagctgatagcactttttttgtacttaaaaatattttaagcctcagtatagtgagacctcatctctacaaataattttttaaaaaattgg

SEQ ID NO: 2736 - DNA, 201 bp, Homo sapiens
atgaacaatatctagatagtcttcattattgaaatggaataaatggtatttttgtattttaggctaacagacaccttgtaccttagataaggccaaccttstcataaaatccctcagttacttttattaataataaccaaattaactctggattccagggtgtactcatgatggaatgatttctctgtcatgttatcctga

SEQ ID NO: 2737 - DNA, 201 bp, Homo sapiens
tacatattttctggctgttcattgtcagttgtatgtgctccagataacttgaacagtctgtggttgccttttaatttttgaattatgtctttagttatgcrgaagtttaaaattttaacataaattaatttacactatttttctcactttagcatgagtctatcagatggggatgtggtgggatttgacatggagtggcca

SEQ ID NO: 2738 - DNA, 201 bp, Homo sapiens
atatttaaagttaaacctatggatggacactggatttcacttctgttaaagtttatttcaaacattacttcctccaggaaatctctgactctctaacttgstgtttcacctatcttatcccatgatactctataattccttttgctatagaaattaggctctgttatcataattacctgtttatatatctgttttcttctg

SEQ ID NO: 2739 - DNA, 201 bp, Homo sapiens
gcagttagaattttgaccaaagatgtgggtaactaacttttcctaactaaatgacatttaggtaactaaactaaacgagattttcgtaactaaattttggygtaactacatttagctttaggtaactaaaacgaagattttattttatctgtggatttttttagtgcgggactaatgtaatttctgattaccattaattga

SEQ ID NO: 2740 - DNA, 201 bp, Homo sapiens; identical to SEQ ID NO: 2046

SEQ ID NO: 2741 - DNA, 201 bp, Homo sapiens; identical to SEQ ID NO: 2048

SEQ ID NO: 2742 - DNA, 201 bp, Homo sapiens; identical to SEQ ID NO: 2049

SEQ ID NO: 2743 - DNA, 201 bp, Homo sapiens; identical to SEQ ID NO: 2051

SEQ ID NO: 2744 - DNA, 201 bp, Homo sapiens
gtgaaactttttattaccaaggattgatttctcctctaagaaatttccacctgttgggcatgtaaatggtatctcttcagagtgagttctcagatggttgrggagagtggagctcttcaggaaggcttttccacagttgctgcactcgaagagtttctgtgtggtacagacttctggaagctgcccaagattggaatatgg

SEQ ID NO: 2745 - DNA, 201 bp, Homo sapiens
aaccatacaaatgtgaagaatgtggaaaagcctttagtgtattctcaacccttactaaacataagataattcatactggagcaaaaccttacaaatgtgamgaatgtggcagtgcctttagggcattctcaacccttactgaacataagagagttcatactggagagaaaccttacaaatgcaatgaatgtggtaaagcct

SEQ ID NO: 2746 - DNA, 201 bp, Homo sapiens
gcacacccatgtgagatgtgtgacccactcttgaaagacattttgcacctggctgaacaccagggatcacaccttacacagaaactgtgcacacgtgggcygtgtaggagaagattctcgttcagtgcaaacttttaccagcaccagaagcaacataatggagagaattgcttcagaggggatgatggaggggcctcattt

SEQ ID NO: 2747 - DNA, 201 bp, Homo sapiens
gactcaagatgtgtgatggactttcttttcagctgtttcccagaagcaggctttgagatgaggattcctatgcaagtgatttattaaggaagtgctttcartaagaggggtaagagaatggaggaagcagaataagaaaaagaagtaagtcaagggtgtgatcgcaggcacagtcctgccatggatggtgtcatcctgatc

SEQ ID NO: 2748 - DNA, 201 bp, Homo sapiens
taactctagaaatgacagcattggaatatgtatctttaatgcctccagaattttgaaactcttcatatctctgccattaattatgagtgctcttacctaarttctagcagttatttaactttaatatcattttctaataaatggtcctcaatatttccagcctacattggtcttgcccatctctcaactaacattctatta

SEQ ID NO: 2749 - DNA, 201 bp, Homo sapiens
gagccactgcatctggccagaagatatattttctttttctgtttcttcttcatgtttgcagagtgaagaggagacagagatgtttaattctaccatattgraacaggaagtcctctatgctgtatttgatccatttcacccttcttggaaatgtctttcttctttgtgcttctctaaaggattcaaattcttccttggttc

SEQ ID NO: 2750 - DNA, 201 bp, Homo sapiens
tgggaagccctttggtggtggctcagaacttagttgacaccagaaaattcatactggtgagaaaccatatgaatgtcagcagtgtggaaaggccttcattsgggcctcacaccttagtcaacatcaaagaattcattcaggacagaggagtgaatgaagaaatgagggatggctcagaatttgattgacatgagaaagttc

SEQ ID NO: 2751 - DNA, 201 bp, Homo sapiens
aaatgatcttctgcgctctcctagttgggacactagtctttggggacaagcaagtactataagagggacttgtatctatacaaagacttgtacaactgggsttgaaattttcattaagcatgtaaatgttatcccactttcttgggaatctttgattattgctatggtttgaatatttgtcgcctccaaaattcatgttga

SEQ ID NO: 2752 - DNA, 201 bp, Homo sapiens
ataatgaagtgaaagtcgatacaagaggtggtggagcttgtagcagatgacaaccatgtcccctgaggtgactgatacctccagtgttagaggtggaagarcatcacctctaaataaaaatgatcttctgcgctctcctagttgggacactagtctttggggacaagcaagtactataagagggacttgtatctatacaaa

SEQ ID NO: 2753 - DNA, 201 bp, Homo sapiens
tgttgtttccagtttggggactatcaagaataaggctaccatgaatatttgtgtaaaaattatttgtatagatgtatgttttcatttctcttggataaatrccaaggattggattggctaggtagtatatggagatacgaattttatgaaaattcttaatttcagacctgtcaattcagtctcagtagcttcatttttctt

SEQ ID NO: 2754 - DNA, 201 bp, Homo sapiens
agccttctgtatctggatgtctgaatctcttgttaggctttggaagttttcatccataattttattaaataggttttcattgctaaataatggtaccacartcacctgttaatgaatagttgtgttgtttccagtttggggactatcaagaataaggctaccatgaatatttgtgtaaaaattatttgtatagatgtatgt

SEQ ID NO: 2755 - DNA, 201 bp, Homo sapiens
tgcctcagtttagagcaactctgaagagcaatcccagctctagagctccccagggaacaaatttcaactgcatcagtttaatttctctttccatccagttytgctttattcatttccttactgctgatgttcccaagagatctccccaataaaccctatcatagatttccatctcagattctcttttcctgggaaactgac

SEQ ID NO: 2756 - DNA, 201 bp, Homo sapiens
gtatttattatacatatgagaagtcacactggtgagaaaccctatgtatgtagtgaatgtgggaaagccttctctcagagttcatccctaaccgtacataygcgaaatcatacagctgagaaaccctatgaatgtaaggaatgtggaaaagccttcagcaggaaagaaaatctcattacacatcagaaaattcacactgga

SEQ ID NO: 2757 - DNA, 201 bp, Homo sapiens
aagcatgattgctgaataatatggtaatagtatggctaattttgtaagaaactgccagactgtcttccaaagtggctgtaccattttgcagtcccaccagyaatgagtgagaggtcctattgctctgcaaacttgtcagcctttgacttagtagttgcagcaggggttttttgttgttgattttttttttttttttttttt

SEQ ID NO: 2758 - DNA, 201 bp, Homo sapiens
cttcctctcccataagctctggcaaccactgatacctttactagtcatcattttgccttttccagtttggaatcatatagtaggtggccttttccaatggrtttcttttacttagcaacatgcatttaaggttcctccatgtcttttcataacttgatagcacatctgtttttatcattgatgaatatttcattgtctaga

SEQ ID NO: 2759 - DNA, 201 bp, Homo sapiens
tttatttccttaattcatatatatttctcacccttgacactattgacattttgggccagataattctttgctctgggggactgccttgtgtgttgggggaygtttagcagcatgcctgcttctactcactggataacagtagcgccatccctctttctccccatcatcttcccagttgtggaaaccaaaaatgtctgtaga

SEQ ID NO: 2760 - DNA, 201 bp, Homo sapiens
agacatctggcaaaaaaatgactcattcattctgcccacaagggggtgcctctgttttagagaactctgttccctgtactttttgttggagataagaaacrggaactgctatctctgggtttcttccctgcctaatccagtctattttctgttctttcctcctattctggggatggagtttagctatctttaaggttcatt

SEQ ID NO: 2761 - DNA, 201 bp, Homo sapiens
ggtggcttggtagccttgcaatttaacagagaattcttttccatttctgaaatgtgtgaagactgtaacttgccagatgaatctagcctttcctttctccrtgtgactatatgtgctccactcttcagtgttaaaggctgattactttgtgtcattgtgtaagttcattcatcctcatcttttataagccctcaagcttgg

SEQ ID NO: 2762 - DNA, 201 bp, Homo sapiens
tcacagagttgtgcaaccatcaccataatcaatgttagaacattttcatcaccctgaaaagaaaccctttacctgttagctttcacttcctgttttccctyaaggctctgatgtaggcaagaataaatgatttctagctctatggatttgcctattttggacatttaatgtaaattgagtcatatgataaactgttatcct

SEQ ID NO: 2763 - DNA, 201 bp, Homo sapiens
agcaaatttcaggcctttgctcacatcatgtttactgacattccttttgccccaacaaagggctcagacaaggcccacattagtagatgggacattagtayaggcaggaagtgaagactcgctgaataatcaatttatcacagtaatattttctaatggaattattttttgttgagtttgtttttgagaccaggacttgct

SEQ ID NO: 2764 - DNA, 201 bp, Homo sapiens
acttttactctttgccaataagataatccagtaatgtcaccttttgaattttgttcagtgaatccctggtactttcaggataaatctccaactctttcacrttcattgcatatttactaaaaagcatattctgtatttagcagagcacaaagcctaatgttggagtaaagtggtgagcaaagatgatgtgtttagtcctgg

SEQ ID NO: 2765 - DNA, 201 bp, Homo sapiens
aaggatacacacccaattattgatagcattgtctctggagattgaatttgaggctgttgattaaaaggagactttagctttgcttgtagtttttatacctkaaaaagactggtagcatataaaataaatcttaaaagctaattatacacaatgacaatatgaatgtttacttgtaatagtgtttttcttgttctttctcac

SEQ ID NO: 2766 - DNA, 201 bp, Homo sapiens
tgtgtgatattagtacattagtaggtaaatgagcagattttaaagaatagaatatccagaagcagattcatgaatatatgtgaactcagtgtatgttagamctgacatcatgaattagtagggaaatgatgacctagtcaataaaattgctgggaatatttgactctccgtattggagaaaataaaattacaacattacga

SEQ ID NO: 2767 - DNA, 201 bp, Homo sapiens
gattacaggtgtaagccaccatgccctggctgaacctggaagttttgtgtggggccccaaatgccagcatctgttgttccttttaatctttttatctcctrtgtgtaggtacatgccagcattcatgaggctaaataacagaaagggattgttgatctcattcatgttagagtgtatggtgaatctaaatcacatgggaac

SEQ ID NO: 2768 - DNA, 201 bp, Homo sapiens
tgtagagggccagtagccctatccaatttcataataccaaccttccctaattcattcacagcttcactttcaggattattgttcctctctctatgatcctygggcactctctttcctttatgtttatggtttcattttcttatgcattcagtatttcatggttgtgtagtaattttaaaacatgtttcacacttaggtttc

SEQ ID NO: 2769 - DNA, 201 bp, Homo sapiens
cagcttatgtctttcacatcatgaaatatacacacatacttcttttgaccatatgatcatatggctcatccagttacttctgttggcgcggtggccctagsaaacctctctggccctcgacaggcttgagtttaaatcttggctcagtgacttatgaagtgcatgactgtggacaagtttcttaatctttttgtgactcag

SEQ ID NO: 2770 - DNA, 201 bp, Homo sapiens
tgcagataataagctacaagctagtaccatgtttacttgtaaaaattaggcactttcctactagtcaggaacacaaccagcttgccagtgctactactacrattttgtatgcctagacataagtaaggggagggaaatgaagtaaaaagcaggatggtgcattcaaaattatgatatctaagtgatacaattatgttttta

SEQ ID NO: 2771 - DNA, 201 bp, Homo sapiens
tcaccaagaccttcacacttaagctttccatgatacccaactgcttaaagtctcataaggcaggacagtttgccatcaaccaaaagcataatgagttgttkcatcacaatggtcctgtctccatggcagatcataatgtccacagtaaagaatctcatctttctctacaagataggtgtttttgccccattagtgcttgga

SEQ ID NO: 2772 - DNA, 201 bp, Homo sapiens
accttataaatgttaggaattagcagggatttatttatgtttcagaatttattacacatcatgatacaactggtgaaaaattgaagacctccatgaatgtraagaaagtagggaggcctttttggtggctcagaacgaagtcaacctcagggaattcaaatgggggagaggagggcagtgaatatgctgagaggagttaat

SEQ ID NO: 2773 - DNA, 201 bp, Homo sapiens
agtattgtcaaccagagaagctcactcaagcttcagtgcccagtttttactgaagcttcattacataggcatcattgattgaatcattttccatgtgcacsaactcagtttccagcatctgtcctccctccttgcctgaaagtcaagctgataccacacggctcaaagtcccaagaccgattacatggtagaagtaggtgt

SEQ ID NO: 2774 - DNA, 201 bp, Homo sapiens
gaaacacagggtgcaattggtctcccttcttacctccatcttctgctctctctacttggagtgctgttcagtgtgttttctgcttgttggaattctgttcyttttctaagtcccagttaatcttccacacgttacgtgaaactttccccacacccctcaatctgagtaggtcactattttcttatttcctatagcaagatt

SEQ ID NO: 2775 - DNA, 201 bp, Homo sapiens
caaagtgctgggattacaggcgtgcaccaccgcacccagtctgtaaatgtttctgtagtcattttcaaacataagaatagagagataaaggagctggtcgyggcagctcacgcctgtaatcctagcactttgggaggccaaggtgggcagattatgaggtcaggagatcgagaccatcctggctaacatggtgaaacccca

SEQ ID NO: 2776 - DNA, 201 bp, Homo sapiens
cagaggtctgtgccctcacccaatattccccatgggtttacagacatgttcacacgtgggtgcaagctgatctccattgtcagtacacagatgcccatgawtaatgccgtggatatacacatgtgtgttgcacaagctacacaagctaaagctggtaacccaaccctgaagaccctcacgagctgctgtgggggatcttgg

SEQ ID NO: 2777 - DNA, 201 bp, Homo sapiens
tccccctgacctcagcgagagcactgttcagcagtttgcctaaccgagaatccacagcttctcgtccctgtctggctccctgtctcggaagcaatgttctmgcgtcttcctccagacaggcagctgctggcatcttcacagctccctctctccgcggctgaagtcaggacccacagatggtgccgctcgttttcctcagca

SEQ ID NO: 2778 - DNA, 201 bp, Homo sapiens
ccaaatacagtttgagttttcttgggctttatcctctccagaaacccaggagtgtgtcaacttcttggttgcattgctttcttcaaagagagagtgaatcyggtagagatagaaaggatgtcctttacgtatcccacagcggcctcacggagaacgataagagaacaatcattaaaactttcattgccataattttctgct

SEQ ID NO: 2779 - DNA, 201 bp, Homo sapiens
ctcaaacggattaagacagagcccaaccaaacacccgctccttggatcgctcccctccttccttttgttgcctctcccctcattaaggaacgggaagggaragatgagggataaacaagcgtggtgacggattggtcctagactgatgcggatgacgtatgcatcagagatttcctgggccttgctctgactttggtcttc

SEQ ID NO: 2780 - DNA, 201 bp, Homo sapiens
attagggatataaaagtccgtaggcagctttggggctgaaaggggttctgtaagcatcttgctgtataatggagcaagtcctgacccagaaaagaatctgyactttgtcccagatgggctataacttgctctgtgactgccatcatgtgtgttctggcagagattcataggcaggcagaggagtggggaagcttcatagca

SEQ ID NO: 2781 - DNA, 201 bp, Homo sapiens
tctactttgcctggcagagctgcagcaggcacctgcagacaccacccaagagacagttctgcagtggctgaaatgtctggaatctgtactcctggagcagyggcgagtgggcacaggtggctatggagacttagaatggggctagtgcaagtgggaaactgcatttgcagttttatgtcattctaactggtttaaagttta

SEQ ID NO: 2782 - DNA, 201 bp, Homo sapiens
gtggccttccggtctcatcagaaaaagtacagagctcagagcagaatcacatggaagcagctctcccctagactctcctagatgttaggtctctgagatcrtagtaatgcagtcagcaatgaaacctacctggttaattagagaaacacagctccatcaatgtaagagagaagtctggtaagccttcttatggaaaattct

SEQ ID NO: 2783 - DNA, 201 bp, Homo sapiens
aattttgggtcagataattctttgttgttgaggggtttttctgtgtattgtaggatgttgagcagcgtctctggtctttattgactaggtgcccatagtcrtgacatgctgcatgtccccagatgagaacgcctggtccagattctttattctagagctaagaaatgaaggctcagaaagggagggtgatatggcttagac

SEQ ID NO: 2784 - DNA, 201 bp, Homo sapiens
agcttctcgtccctgtctggctccctgtctcggaagcaatgttctcgcgtcttcctccagacaggcagctgctggcatcttcacagctccctctctccgcrgctgaagtcaggacccacagatggtgccgctcgttttcctcagcagctctgcttaccgcatttacaggggtggcagaagccagtgcgaatgaatattaaa

SEQ ID NO: 2785 - DNA, 201 bp, Homo sapiens
actgcataccatttaagtgtaaagtttggtaaacattgatgtgtatgcatcattaccacatgaaatataatgaatatgcccattatctcctccaatttccycatgccctttgtaattccttcctcttgccccctacccttttctacacaactattgatttgttctctgtcactatagattcgcttgcattttctagagttg

SEQ ID NO: 2786 - DNA, 201 bp, Homo sapiens
gagatgaagacacgaagggctggcttgcacatcttcacaagtgtagtgcacactcaccatgagtggggctaaaggcgtgttcccctaacactttcctccgkttcctggtggatctggggtagaggggtgggaggatgctggtatgactatgcagttcttgccaagggagaagtacccaggcataatgactgcaattttttt

SEQ ID NO: 2787 - DNA, 201 bp, Homo sapiens
cagccctaaagaagccactaaaatagcaaaagcctctatctaataagtcaacaaagcaaattaaatgaggtattaaaaaaattaattcaaaagaagaaagracataaggaaaaaggaaaaaaaacaggcaaaacaaatagaaaacaaatatcaaaatggtagactttaatctaactatataattacattaaatctaattaa

SEQ ID NO: 2788 - DNA, 201 bp, Homo sapiens
tgaaataagtgggtagctgcagcagtgcagagatgggctgaatctagacatgttctgtatagacgctgactggtctgggctttgcttacccggtggaggaygcaaatgctcactgtgccattcaaaagccagaacagaagatattgcaccaatttggatggcccagtcacatttctttagaccaaggaacacactttacag

SEQ ID NO: 2789 - DNA, 201 bp, Homo sapiens; identical to SEQ ID NO: 1530

SEQ ID NO: 2790 - DNA, 201 bp, Homo sapiens; identical to SEQ ID NO: 1539

SEQ ID NO: 2791 - DNA, 201 bp, Homo sapiens
tgactactgagcatcaccctggacgtgtacaagtctgcgtccttattgttttcttcattgggccgaactttctggtcctcatccaacagctcttctatcaygtgttcgaaagtgtcagccaatgatgtcaagcctcttgaacctgccttgggcccattcacgctctccagagtcccatgggtccgcacacctgggtaggcc

SEQ ID NO: 2792 - DNA, 201 bp, Homo sapiens
agcagcagcagcaacaacaacaatgaaatattaaaatagtaaatataagtatcaaacatcaaaaccccctctccaaccaaaatctctcttcttcgataaasttcccaggaggtaacccaatttctaggttggtgtccaatatttgggatcatttgattcaagactgaagtacttaaaatggcttttaaaaaaggaaaaaag

SEQ ID NO: 2793 - DNA, 201 bp, Homo sapiens
agaagtgaactgactaggttgaccaagtggctagtgaatcaatacagaagtttatttgcaaacaggagcatagttatctgtttctctgcactgcgagcccyggccaactctggtgggttggttagcatatgctggttttagagaaagagcctgaaaatgcatttctcaagatcgtagtcttcatgcatttgataaagttgg

SEQ ID NO: 2794 - DNA, 201 bp, Homo sapiens
atagtgtccgtgtgtcatgaaaaacttatttgtaaacgtttatatggtatgattttgattttatgtatgttcataaatcctgcactgtatgatatatgtgrgttaaaacattggtgcatgaatttattttcaaagtataaaacacatcacttaaacattttatgtgtcaaataaaatttgattatgtaaacacatttgttg

SEQ ID NO: 2795 - DNA, 201 bp, Homo sapiens
gcaggctggatgtagcatgttagccgtcatattctgtgtgctccctgcgatgtgggcacttcccttccatcgtggtgaggccaaagcaaaggcacagagasctgaacacaaacatgaaaaacaccttaccacctgggagtcaggggcaggttcaggcacatccattcctctggcatttgagcagctgttttccacagcatt

SEQ ID NO: 2796 - DNA, 201 bp, Homo sapiens
aaaaaagagcacacggctgggcacagtggctcacgcctgtaatcccagcactttgggaggccaaggcgggcagatcacgaggtcaggagatcgagaccatyctggctaatacggtgaaaccccgtctctactaaaaatacaaaaaaattagccgggcacggtggtgggtgcctgtggtcccaactactcaggaggctgagg

SEQ ID NO: 2797 - DNA, 201 bp, Homo sapiens
cttctatctttcatggagggtgagctgtgcttctccagatgcctgcatgaagcctgcgtcagggctctgggcagctcagtcttacctgtggtcgccatcawtatgccaaaggtagactttgccatccagataacattggcccatggttcctttaagaatgtctcatgtccttaaccactactgtctgaacagcctgaaata

SEQ ID NO: 2798 - DNA, 201 bp, Homo sapiens
atctgggctttttgaagtccactttcacacgaaacaattctaaccacattttctgaggcatccactaaacctaattgttttcaatgtagtgttaacctaasaattatacatgccaaaaatatttttaaagggattacttcaagaggaaagtgtatgctttgtcttctaatcaaatacataaatatttatggtactttctag

SEQ ID NO: 2799 - DNA, 201 bp, Homo sapiens
cgtggtgtcccggctgcttgtccttagacagccctcctcacccagttggctcttggctggactccgagaactcaggttgtaggatggttcccactgccctwcctccaaagagtggctcattgtgcctaaattgtgtgtacaaacagtgtggtttccttctgaggttctggaattttggcaaactttaggcagtgggtgcct

SEQ ID NO: 2800 - DNA, 201 bp, Homo sapiens
gcctaaattgtgtgtacaaacagtgtggtttccttctgaggttctggaattttggcaaactttaggcagtgggtgcctatgtgaccagctcccagagaaarccctggacactgagtttctaatgagtgtccctggtggacaacattcaccttcattgccacgactcattgctggggaagaaagcacatcctgtgtgactct

SEQ ID NO: 2801 - DNA, 201 bp, Homo sapiens
cagtgggtgcctatgtgaccagctcccagagaaaaccctggacactgagtttctaatgagtgtccctggtggacaacattcaccttcattgccacgactcmttgctggggaagaaagcacatcctgtgtgactctgcagggcaaggacccttagacgtgtgtgcctgtttcccccgacttctgcccatgtgttttcccttt

SEQ ID NO: 2802 - DNA, 201 bp, Homo sapiens
gccacgactcattgctggggaagaaagcacatcctgtgtgactctgcagggcaaggacccttagacgtgtgtgcctgtttcccccgacttctgcccatgtkttttccctttgctgattttgccctgtgtccttttgccatattaaataataaccatgagggtgacaaatgctcgttatgacagatgtgaatcattaaagct

SEQ ID NO: 2803 - DNA, 201 bp, Homo sapiens
tgggaacataggtgtttagaataaggcaaagaccttcctccatctgcaatagattccacgctttattagagcctgccccaggctctaatagagtcacgccycaattagagcctgcaccacgaacgttacatagaaccatgaattgtgttccacaatacagagagtccttgggctccctggaagggagtcccttcccctacc

SEQ ID NO: 2804 - DNA, 201 bp, Homo sapiens
atgcacaagtttccatgtccctgggtctttctccaacactcctgtacacacctgtgcctaagattgaggatagctgtatctgtcccgattcctctgtcccrtgttttgaacgtggtctggtgggctgatctcattccatggttagctgctaacaggggactctaaatgatgaagaacagtgtcaaccctcccattgcttcc

SEQ ID NO: 2805 - DNA, 201 bp, Homo sapiens
gggagaatatgtcatctgtgcatgaatccatctgaaaaattcccatttgctaagggaagtcatgtcatttgatgggtagggctctgggactcagattccasatcagcacagtgctaccacagtctgatagtgaccagggagggtgcccttaacagctcttacctaggtttccgatctgcaaaaacaatagagcactatatg

SEQ ID NO: 2806 - DNA, 201 bp, Homo sapiens
ccatctcaaaaaaaaaaaaaaaaaaagcagcattggtgtcactattggtatcactagtagttagcttgaaaataccattcagctcaaccacagtcactggmgatgcccctttcagtatttgatgatgacatgtgcctccaccccatttgtggctgtgctttgtcaccagtctgggcctcttccagtgcatcagggaggcat

SEQ ID NO: 2807 - DNA, 201 bp, Homo sapiens
agtccactggcagtggggctgtgagcatggataagaggcgtctctgtcttttagaaacttataaactagtaaggggaaaaagataaaatatatttatgackttagcaaatgggatgataaccattttaaagtactatggtgcacaggagcaagatatattctctggtctgcataatttgaatagtagttatagttcttggt

SEQ ID NO: 2808 - DNA, 201 bp, Homo sapiens
tgactttagcaaatgggatgataaccattttaaagtactatggtgcacaggagcaagatatattctctggtctgcataatttgaatagtagttatagttcytggttgccacatagcaaccttatcttcaaaatgtgttctattcattcttctgtgactttattaatggtggtattaaatgtaatcactgtgtgctactttt

SEQ ID NO: 2809 - DNA, 201 bp, Homo sapiens
tgtgacatcaaagtgtcaaggtttcagccttgactcggtaaccctggatgtagtctttctccagtcctcggtcttgctgtctttatattaaagctaccttrtagagctgtgttgagttttaaattagaatataggttacaagcgtaccataaaagctgtaaaatggtgcgtgcttataaatgttaattactatatttacta

SEQ ID NO: 2810 - DNA, 201 bp, Homo sapiens
tcttgacaccttttggagctgactttcccctacactggtgtcttcctgtccctgctgccttctgtccactccttatggaattcttggcagcataatgtccyacataaatagaaaccaccatgtccttctttgctttccctctctcttgccttcccccttttctctgcatctcaccacatgagaccctgtgctctgggaatc

SEQ ID NO: 2811 - DNA, 201 bp, Homo sapiens
atggaggcctgttggcttaatctgacattgattcaaagggaatcaatgacttgagactaaaagggagccataagacacttaccaaaatatttgtcactaamatttaagttttacaattctcacttccataattaggaatcttcaggaagtgaatagaaagatcgtacatgtacacatctgtatacacaataataaagcata

SEQ ID NO: 2812 - DNA, 201 bp, Homo sapiens
caaaagcaaagggttttttttttaagtaacagctttaatgagctaaaattaatacacaaaaactacacatatttaacgtatacagtaagatgagtttagasgtttgcatgcaccaatgaaataatctccagggagattccagcaggtttggtggaagaaaaaaatagcttagcagcacccaagaagtccccaggctaggaa

SEQ ID NO: 2813 - DNA, 201 bp, Homo sapiens
ctccaccaattaggtggctctttggatatgatcccaacaatgagcaaggataaatggctaccttttaagatgaatctgttctccttattagtagtctagcrtttgatagtgggaaaaaatgtaagggaactcaattggcctgaagttttcagcacaactcttctctattcttggtagagttatgaaggcttgatagttttt

SEQ ID NO: 2814 - DNA, 201 bp, Homo sapiens
tgatgctcactgcctggtcagccagatcctgtgcaagcagccccaggctgtgcttcctgatgtggttccctttgaaggtgtcttgagacattcagttgacygaagagtttgctaaaaatctccttagagcatggaggcctgttggcttaatctgacattgattcaaagggaatcaatgacttgagactaaaagggagccat

SEQ ID NO: 2815 - DNA, 201 bp, Homo sapiens
ctttctatgatactggaacacctgaactataagttgaagtgtgctgatgtgtttttgtgtgcatccagcaaaacactactgtagcatttcaatgataaacwtttattttcagggactttaccaatttcttttgaccacatgagtataaataaataggtaaggttttacgtgcttacagatttgttttcttgaatggtgaaa

SEQ ID NO: 2816 - DNA, 201 bp, Homo sapiens
tctaagatgccttcgatgttaaagttctgggatgctgctctttttctgtgcatggtgggggcatgtgtggacagggctatttctagtctgactagtcaggraagatacaacctcattgtcttttgtgtgagtgcgcagttggggagggggttgctgaacatgccgggcttctcaggtgacaggttaattattcctggtatt

SEQ ID NO: 2817 - DNA, 201 bp, Homo sapiens
ctagcaattatttgtggaaactattattcttaatacaatttctgaggccaataattctgtgagctgctttaccttgaagtatcgtctgttaaataaaaaawtcaagggcccatttcctgcccaagcagctggggacttcctgcaatcaccctgagtaataccagaaccaccaactggaatgcaaatcttttcctgctatgc

SEQ ID NO: 2818 - DNA, 201 bp, Homo sapiens
aggtttccgatctgcaaaaacaatagagcactatatgctccgtagctcatatatgcaagtgtaatttaggttgcattatttgagctgtacattccacttayataaaataggcttaaatagccaagttgcattatcacttgagaccattgaggtgctataaaacaaatatattaactgtgtgcagaagtattcattattcat

SEQ ID NO: 2819 - DNA, 201 bp, Homo sapiens
aatagagcactatatgctccgtagctcatatatgcaagtgtaatttaggttgcattatttgagctgtacattccacttatataaaataggcttaaatagcyaagttgcattatcacttgagaccattgaggtgctataaaacaaatatattaactgtgtgcagaagtattcattattcatcagtctgtctcttgcatttcc

SEQ ID NO: 2820 - DNA, 201 bp, Homo sapiens
ctttgccatccagataacattggcccatggttcctttaagaatgtctcatgtccttaaccactactgtctgaacagcctgaaataagtgatacagcctctrcaaacacttggctggttattcagcattctcagtatatcattaataataaacaaatacttcccaatagtaattgaatcactcaaaaaatattgtagaagat

SEQ ID NO: 2821 - DNA, 201 bp, Homo sapiens
aggtaggcagacacggtagcaagtttatcgagggcaatttctggaccgtaatgtgtcttcttcattagcagctcaagggccagccagcggagggtagtttsgtatttcgtgttcctccttttctccctaaggcagcctcccatttaggatttcagcctgaatctttttcacagccatgacacatttcctctgccatgtggt

SEQ ID NO: 2822 - DNA, 201 bp, Homo sapiens
gggtggaggctaaaatgactacatctacatcacccttggtactgatcaagaattttgcagaaattcagcagtatttgcacgccagatttccttggataccrccttcaatcacgttcaggttacactattacatgaatcccagctaggctgtgacatcaaagtgtcaaggtttcagccttgactcggtaaccctggatgtag

SEQ ID NO: 2823 - DNA, 201 bp, Homo sapiens
ggagtcttctcctggtcaccctgcagccgccagtatctacacaaatttctaaggtaggaactctttaagctggtcttgtgatctttcggggcctttgatgytcactgcctggtcagccagatcctgtgcaagcagccccaggctgtgcttcctgatgtggttccctttgaaggtgtcttgagacattcagttgaccgaaga

SEQ ID NO: 2824 - DNA, 201 bp, Homo sapiens
tggtcaggctggtcccgaactcctgacctcgtgatccgccttcctcggcctcccaaagtgctaagattacaggcgtgagcccccgcgcccagccgactcartttttatagttaaaataaactaggaccaattcgatagaataaaactcagagtggtataacaaggacaaaaccaaaatagcagagtatgtggcagtagctt

SEQ ID NO: 2825 - DNA, 201 bp, Homo sapiens
ttgtgaaaataatttagttaagacagagtctgcatatactagaacaagaatgtaagattcctgaggcgatggtgggaaagaacagaatccaaagcacatgrtaatatattaacctgaagtatgtctataattcctcattgcaatgtttattgagtatccagtgtgataggtactgagaatagagataaaagatgaagtcct

SEQ ID NO: 2826 - DNA, 201 bp, Homo sapiens
tgctcaaattccatcactactcacagttgtctaatctaagtctaatcccctttgatctctcagactaccttcccttttatctctctactacttaataatamgaatatctttttttcaaacttgaccttcattttgctttcacaatactatactctccatggattatcccttatctgaatccatctttataaccctattcct

SEQ ID NO: 2827 - DNA, 201 bp, Homo sapiens
gagagagaggagcagaaaagataactattgggtactgggcttaatacctgagtgatgaaataatctgtacaactaacccctgtaacacgagtttacctaayaaaccttcacatgtccccaaacctaaaagtttaaaaaaagtattaatctacattaaaaaataaaaaataataaaagaaaagaaaaactcaaaaaaatctg

SEQ ID NO: 2828 - DNA, 201 bp, Homo sapiens
tttctatatcaagagtttattttgaaccagtatgaattttactgaaaccaagtacacacatgtctcattatgaggtaatctagtgtagtataatctatttmcatacactctgtcatcctggaatcagcatattttcatgcttgtatctttacttcctaatagcataactcatggaagtcaactaactcattcattaatttt

SEQ ID NO: 2829 - DNA, 201 bp, Homo sapiens
aatgtatactccaattagaagagtataggcctttggaacaaaatccaaaatccttccaggttttcaaaagtctctatcacctggccccaaattacctcttyagccattttttcccacaacacaaaccttctgctctcatcaaaacgatctacttttaaacatctcctctatgccttcctaatgtattccatttgtctagaa

SEQ ID NO: 2830 - DNA, 201 bp, Homo sapiens
gcactacctgtttgcccagcactgttctaagtgctctacatgtattattgttaaattatcataacactatgaattatgtactataattaccccagctttayagatgaggagactaatccatggggaggttaagtaacttgtccaaggccagacagctagagccggcttttggacccacaccacagtctgactccagcaccc

SEQ ID NO: 2831 - DNA, 201 bp, Homo sapiens
gtctttggtactagtgctcagttactttcattaactaaaaaaggggctactcttcaaattcccttctctaaaaagaatgtactatatcaaaagggggtaamcactactacgtatacattctgcacttagaaatccctatatgttgattttatcattctcttattcaataaatattgtttctacaatgtgtaaggcattact

SEQ ID NO: 2832 - DNA, 201 bp, Homo sapiens; identical to SEQ ID NO: 1506

SEQ ID NO: 2833 - DNA, 201 bp, Homo sapiens; identical to SEQ ID NO: 1507

SEQ ID NO: 2834 - DNA, 201 bp, Homo sapiens
tatgggagaggcccacctgcaaggaatagagggcggcctctggccaacagttggcaacaacctgagacccttagttcaacagtccaaaagtagctgaatgyagcccacaacaactgagcttgctcacaaatggatcctgccctggtcaagtcttgagatgagaccacagccccagccaacatctgaattacggccagtggg

SEQ ID NO: 2835 - DNA, 201 bp, Homo sapiens
tggtatgatggatggaaagtgagaaggagccttagacaggtggtccaggaagacttcttggaggacgtggcttttgagctgagacccaaaagaagcgaggraatgggccatggggctctgtgggtgaagagagttccaggcagacagaacggcaagtgcaaaggccttcaacaacagtgaacccagtgtgcccagaaatga

SEQ ID NO: 2836 - DNA, 201 bp, Homo sapiens
gaatgagaaactgaaaggaacaccctctttcagcggcaaagcccgcttcccatgacagacagtgtacaaagtgcacttaacagacaccaatgttttttcasttggctgaagatgaaaagcgagaaggggcctcatttaggggcaaaggctacagaaagtaaaaggaaaactcaaagcacttggaagattttcaatgatgaa

SEQ ID NO: 2837 - DNA, 201 bp, Homo sapiens
cacatgtatgtttccaaatttaagtcaacattgtgcggtctcacacacaaatctggactgctgaatgggtggaaaaactgagcatctgacaaaaccaggtrcattttcccaaataaccacaatcaatgatggctgaggagcagtggcctccacgtgttcccaggaagtggaggtgtcaagtgaagaacactccagcacgtt

SEQ ID NO: 2838 - DNA, 201 bp, Homo sapiens
ctgagaagtcctagctctgaggaatgacggcgcagccacagatccttcccccattttcccccaatgattcgcgtcactgggaggtgggaggcagtaaagayaagcaagaaaactgagcatggccatcaataccttgtgcctaaattttgctactccaggaagcccagaataaatgcccggaaagtcttcattgaatatgga

SEQ ID NO: 2839 - DNA, 201 bp, Homo sapiens
ctttgtctatgcagccctttcatggaacagaaatatccaaaatcagattagtggtagagtttcctcttttagaataactttcaaatgccccttaatcaccracaatcttttagaacaacatgctgactcataagagcacccccaggccaagacaggcacccacgtttaaaagcgttcaactgcacactttatctctgatag

SEQ ID NO: 2840 - DNA, 201 bp, Homo sapiens
ctgcacattaaagaatcagaggttttattttttccttccccccgacaaccaaagggtgctcaacaacatgtggctgtaggaaatgatgctcccagcccagyttcctcactaagaaaagggcttgagtgagttcagaagttctgtccaatataaataccgcatcaacgatcccctcccatgagtcacttcctcccacggagt

SEQ ID NO: 2841 - DNA, 201 bp, Homo sapiens
ttcccccaataaaacaccctttaacgacaaactggatttgcctgccttgttctttggtttcaggctcctttggaggccactttgtctatgcagccctttcrtggaacagaaatatccaaaatcagattagtggtagagtttcctcttttagaataactttcaaatgccccttaatcaccaacaatcttttagaacaacatg

SEQ ID NO: 2842 - DNA, 201 bp, Homo sapiens
aggaaaagagggagggagggaggaagaaagggagggagggagagagagagggagggcagttttgatccccctctttacctgtaactttttgttctaaatgycttaactgtgaatgttttttaataacctgggaaggggggcatgccaggttaaaacaaaaatagatctgcccatctgacagcatcacagactctaagcaca

SEQ ID NO: 2843 - DNA, 201 bp, Homo sapiens
ggtgcctcaggatgcgtccaccaagaagctgagcgagtgtctcaagcgcatcggggacgaactggacagtaacatggagctgcagaggtgtgggcccctgrggacccagaagtccagccactgggctccttcaggacacaggactctcagccccgcattctcctcctcccctaagaactaggagtctgggccccacaactc

SEQ ID NO: 2844 - DNA, 201 bp, Homo sapiens
tttgcacatatgagactgcatgccaccctctgtacccggactgcctcctgctgaaagcacatatcttacttcacagatgactaaagttctgagccaatcaraggatttaaaactaaactaactaaaatagttacaaggattaactaattttgttttctgtaaaaaatcagaagattgaagagatcaattgcttttatgtta

SEQ ID NO: 2845 - DNA, 201 bp, Homo sapiens
agcaaaagataacaaggaaaaaatacatatacataaggtatttttggttccatacatgtcttccaagacaaatccaaacatctgatttccaggagggtcaygttgggaagtcaagaacagcaccagggaagaacttcagattgagttgccatgagtaatctaagggggattttcttatattcctacccgggcttcaaattc

SEQ ID NO: 2846 - DNA, 201 bp, Homo sapiens
ttgagcacagagtcagcaatgagaggaggcattaagccaaaatcttgtcctggctttgatagaaataatgtctacaacaaatatggcagtcgcaaatttgrtgctactttgtagacagaacagggttttttgattctttttaattcatatgacatgaaattcaccaacttgaagcatgtacttcagttttttgttgtagaa

SEQ ID NO: 2847 - DNA, 201 bp, Homo sapiens
attgggatgttattctagaggcaatgggaagactagaagtttgtgatcaggaatgtgagcagatctttgctttgtgtacagcattctggtgttgcaatagktgggtggataagaggggagaagacgtgatataagaaagaggagttgagaagccaccaaaggagcccaggtgacagatgtagaagggacaaatgatagcgg

SEQ ID NO: 2848 - DNA, 201 bp, Homo sapiens
ccctggagaccagaggggcttggcactgtggtggaagccagagcgagcaggcccttaggaaagaaggcaggaacaggaactggcttcaccagaaaagctaraccctcggactcctcctggaaactctcagaagggagggttatggccctctttgtcccttcatatttctggacaaagaccaccaacccaatatcaagcccc

SEQ ID NO: 2849 - DNA, 201 bp, Homo sapiens
tcttcatatttttcttgactgagaatggtgccaggtatggtctgtgtaagttttgataaattttaactttttataatagatttctgtatatattttatggyagcaaatgatagactagtatctacatgtattttatgcatttatgacatacctaactctttgttctttttttacaatatttctaggttactcagttcgtct

SEQ ID NO: 2850 - DNA, 201 bp, Homo sapiens
taaaatcacacagtgcaaatgatgaacggactggggaatgaacaagagcagaagcagggaaattagagggaggctggtacatagtttgcaaaggactctcytgacagccgccggggcagcaagagaaaatgcctaccaagctcgcggcgcaggggccggttactgggggaaagggaggggtatccctctggatgacaccag

SEQ ID NO: 2851 - DNA, 201 bp, Homo sapiens
cgagatcgcgccacttcactccagcctgggcgacagagcgagactccgtgtcaaaaaataaaataaaataaagtgcggacaacaggaatacatctccattyatctcctaagattaggatatcctcctacataaccgtaatactattaacacagctaagaaaattaacattaattattcaataatattacctaatatacatc

SEQ ID NO: 2852 - DNA, 201 bp, Homo sapiens
gtgattccagctacttgagaggctgaggtgggaggattgcttaaggccatgagttcgagaccagcctgggcaacacagcaaggccttgtttcaaaaacaawttttttaaagtagctggatgtgatggtgcacacctgtagtcccaggtactcaggaggctgaggaaggaggatcactagagcccaggagttcaaggctaca

SEQ ID NO: 2853 - DNA, 201 bp, Homo sapiens; identical to SEQ ID NO: 1934

SEQ ID NO: 2854 - DNA, 201 bp, Homo sapiens; identical to SEQ ID NO: 1935

SEQ ID NO: 2855 - DNA, 201 bp, Homo sapiens
agcaaacatgtcctgagctcaggggaagatacagaggacggagagccatgggcaaagacctgcgccttgtagggtctgcaggggagagagaacagccagayctgcagctaaggtatggagaatattttctgtggttcccacaagcatgggatgatgggagcacagaggagtggccatgtcatccccaccagtaccttgacc

SEQ ID NO: 2856 - DNA, 201 bp, Homo sapiens
ggactttgagaactcacttccagccaggtagatgcaggacaggactctgctattgggtgcagtacccacctctgagtctgaatcttaccccaccccatccytccctccatgtacaggtctcttctctccctaactctcccttcagccctgggaattctctctccttggcctcatctcatccctgaggcttatcttataggt

SEQ ID NO: 2857 - DNA, 201 bp, Homo sapiens
gcagactcaaaatgagagtgacagccagtgctgcagcatctaggagcttgttcacacatttggctttgtgggccatgagcatctgatccctggccattctkcctaggtcatgctcagaccttggccgtggccccattccatgttcatctttgtctggctgtactaggttcatgcctcatctctgctgtatccttagccgta

SEQ ID NO: 2858 - DNA, 201 bp, Homo sapiens; identical to SEQ ID NO: 1838

SEQ ID NO: 2859 - DNA, 201 bp, Homo sapiens; identical to SEQ ID NO: 1839

SEQ ID NO: 2860 - DNA, 201 bp, Homo sapiens; identical to SEQ ID NO: 1840

SEQ ID NO: 2861 - DNA, 201 bp, Homo sapiens
ggtttctgactctgcaggggggtttgcaaaccctgggaaatcctggcatccttccccaaaggctacgaaatgatcgtggactacctgcttcagaggctgaytccacactggaggccaaaggaccaggagcccagccacagaacagagatctcaccattgattgtatggaaaggccagaagaggggggccggggtggggaag

SEQ ID NO: 2862 - DNA, 201 bp, Homo sapiens
ttgctggtgcctgtacctcccaaggccctaaaggtgtgcaacttttgaagaatgaggctgccaatccctggagctgtaaagcagggacaataatagcaggwtcttatcattgaagaattcatcccagaatccttgaaatcgaatacactaccacagtttgcagacagaaatgaaagaaataaccttgtccttaagccagaa

SEQ ID NO: 2863 - DNA, 201 bp, Homo sapiens
gatggagatgaagagaaaaagctgcatcttagaaagttcttcgccaatgcaccgccttttgcccactgaaaaaatcatcactctgctggtcaggtccttgytgatgaggccatccttgtccaagaatcgagctggatcaaagttctccgggttaggccacttcactgggtcatgattcacagaccactggttgacaaaaac

SEQ ID NO: 2864 - DNA, 201 bp, Homo sapiens
tgcttgcatcccattccctcccttcacataacccagttctgactccagtgtcatgtacatgattcacagaatcaaaattgtatccagaactcaggattccmggtaataatctagcctccggatcaggggccggcacactagagagtctgggatagatgcagagggagttcattcaccgtatttgtcaaatttctccttttt

SEQ ID NO: 2865 - DNA, 201 bp, Homo sapiens
ccatttgcttggtcaggagactgaagctcacagagaggttaagttacttgctcaaaggcacaatgccggcaaatggcagaactccatgtgtctgctacctygcaagcctacctatattctttcctctctcgcacatgtcttgctaggaacagataccacaaatctgaaattcaggtatgccgggaaagaggctgatttttt

SEQ ID NO: 2866 - DNA, 201 bp, Homo sapiens
aaacttcagcaataagactaaattatttttctaattctttttcattccaaaatggactttattaaaatgaggatattgggggtctgcttgatttgccattstctaaagctgagtttcattactaaatcttaattgatctgtttactctttgctctaaatgcttggaggggagcccaaagggccatcagtatttgtatgaca

SEQ ID NO: 2867 - DNA, 201 bp, Homo sapiens
tctatagtgacatctgacaaagctgaatggtcaatctgaaaataaagaactgccaaaattaagaaagctgagaaacagctagagacaacagaacaggtcartcgtaacagagttacggaagagatgattgtctccaattgccacagttgaaatggaatgctttgtggtctttaacaaagagataagagttcattaggcatg

SEQ ID NO: 2868 - DNA, 201 bp, Homo sapiens
tcttaattgatctgtttactctttgctctaaatgcttggaggggagcccaaagggccatcagtatttgtatgacaataatagcgtacatggctaaaacacwatctcttaaaatcatttctcattaagagagagggagagaaatctatagtgacatctgacaaagctgaatggtcaatctgaaaataaagaactgccaaaat

SEQ ID NO: 2869 - DNA, 201 bp, Homo sapiens
aacattttcacagcccttatgttttatgataccagcagtcttggagactacagcctttctctcttttaaacagtagtatcttcctgttcctcatttaaagyttctctgatgtttccttgtgattcgagtcaggttagacgactacagaacagacagtgtcctcctaagggcatttatatccagaggcacagatgttcatct

SEQ ID NO: 2870 - DNA, 201 bp, Homo sapiens
cacattgtccacatgaataatttgttccatttgtgatatggtttggctgtgtccccacccaaatctcatcttgaattgtatctcccacaactcccatgcgytgtgggagggacccagtgggagggaattgaatcaccagggcaagtcttttctgtgctattctcgtgatggtgaataagtctcatgagatctgatggtttt

SEQ ID NO: 2871 - DNA, 201 bp, Homo sapiens
aatgacaaattagggttttaagccagcactcttagacttcaaagcctcttaaccattccactgccctgctgtagggcatagggagataagggggataagcyatggttgccatcaaagagttaatatatcaataatatgcggatggtgaggatgatggcagctgctaggggtctacaggcgtgtaccaccatgcccagctac

SEQ ID NO: 2872 - DNA, 201 bp, Homo sapiens
ccccactgcagaccagttccacaagaattactctgggcttcctgaacaagatagctgtctacaatgctttaaaaaccctattaagatgagaacctcaacasctttaaaaaaattttggagagaaaggtgtcctaagcttctgcagttcccattcagctccttccgtattcaaaagtttcaatgctcttccacctcccatcc

SEQ ID NO: 2873 - DNA, 201 bp, Homo sapiens
tttaggcgatgacattcttggtctgtacacttaggtggccacatccactgggatgacagataccaggtacaacatatcaggtacaggtacatatcaggccycgtgacaggcattttacacattctccatctgagaggtctgagcatgcctacctggttagtggcaaactgcgatgagacctcatggtcatcccggttagac

SEQ ID NO: 2874 - DNA, 201 bp, Homo sapiens
aaaaataaaaataaaaaaagcaaatgtgccatacaaagcgtagatatggatggacttctaaatattttactaagagcaatagatcaaaacaggtgcccaascaaaatttttattttattttttttagagacagggtctcactgtcacccaggctgctcgagggcagtggtgtgatcagagctcactgtaacctcaaactct

SEQ ID NO: 2875 - DNA, 201 bp, Homo sapiens
aatacaaaacattagccaggcatagtggcatgcacctgtggtcttagcgacttgggaggctgaggtgggaggatcgcttgaggcggtaactcaatcccagmggaatcccagggagcgaaggtggctcatcccaaaagaaaaacaagaaggaaattctattaccagaagacaaggggatgaaatgagggatgcagaaccaaa

SEQ ID NO: 2876 - DNA, 201 bp, Homo sapiens
tgtctgtttgctgacgaatttgatattccaagtcagaaacatgagcctgaagccagttccagcagctgacaatagctgcccggtctgcagcccatctccaktctgacctgtgtctcctaaaaagaaataaattgagtgaagtccaagagtagtagtaatatctataccagacttgggggtggagggtggaatttaacttct

SEQ ID NO: 2877 - DNA, 201 bp, Homo sapiens
cattccgctgtggtgggaagagtagggggtcggaaattcagaggcctggttttgaattttatctttagcactaactagtcataggtccttggcaaattacytctctgaacttatgttcgcttagtttgaaaaaaaaggattaagagaattcgatgtattataaatgtggccgtgtctagcatgcaatgtagactctctcat

SEQ ID NO: 2878 - DNA, 201 bp, Homo sapiens
ctctgggcttcctgaacaagatagctgtctacaatgctttaaaaaccctattaagatgagaacctcaacacctttaaaaaaattttggagagaaaggtgtyctaagcttctgcagttcccattcagctccttccgtattcaaaagtttcaatgctcttccacctcccatcctcaataacatttccatcctcaactacagct

SEQ ID NO: 2879 - DNA, 201 bp, Homo sapiens
ggtcttgaactcctggtctcgtgatctgcccacctcagcctcccaaagtgctcacaggtgtgagccactgcgcccggccggttttgttaacttctttatgyggtgattgtttgagagctgagagacagccatcacctttcccggcgttcccctgatgctcagccaggcatttgggacagatttgtttacgtgtgaatgtgc

SEQ ID NO: 2880 - DNA, 201 bp, Homo sapiens
ttgtttgagagctgagagacagccatcacctttcccggcgttcccctgatgctcagccaggcatttgggacagatttgtttacgtgtgaatgtgcctcccyagcccaggtctgtccaagttgctggggtggggccaagccagccagcagtcccctcaggcacaggccaaagtccccaccccaccccaccacagcccaccca

SEQ ID NO: 2881 - DNA, 201 bp, Homo sapiens
ctttgtacacccttttcctccattgggcaatgtgggctcccctcaccagtctccccttataaactgctcgtccctaaagatccagcttaaataacatctgycccataaagctttcctggctgatgtcaagccatttcttttttaagatacctcttctagtagagcactcataacatggttatttgttaacaggactgccaa

SEQ ID NO: 2882 - DNA, 201 bp, Homo sapiens
caaataaactattagacccaataaacacatccaacacagttacaggatacaagctcaatatacaagtagtaatcgtatttctatacacaagcaataagcamtctgaacatgaaaagtttctaaaaattccacttacaatagtatccaaaaaaaaaaaaaaaaaacacatagaaagccggacacgatggctcacacctgtaa

SEQ ID NO: 2883 - DNA, 201 bp, Homo sapiens
tggtttaacttctgaaaatcaattaatgtaatacacggtattaataaaggatacaaaccacatgatcatttgaatagatgcagaaaaagcacttaacaaartccaacttgctttcatgataaaaacactcaacaaagtaggaactgaagaaaacatcttcaacctaataaagaatacctataggagaaaaaaaagaatacc

SEQ ID NO: 2884 - DNA, 201 bp, Homo sapiens
tccagaggaagtccaaaactaaaatataagattctgaacatacactaatgccaaaagtgcccagttttatcatttaatagctgagcctgttttctgttttstaaaatgaagtaatacctaccttctagtgatgagaattgaaaataccatccacaaagcaagtaacacaatccatagaccaggatctcagcaaacatagct

SEQ ID NO: 2885 - DNA, 201 bp, Homo sapiens
cgcggtgggaattgcagggcgcggctgggtttctgtgcggtgaaggttgctcaaaggtctgggagcctggggggccccagagtctcgtgaggatggtggcwttagagctaaaaatagccaaatgtagggaaaaggtcaccgatgtgtcagctgctgcctgttctgggatcgctggtgctccgggcggcatccccacctcag

SEQ ID NO: 2886 - DNA, 201 bp, Homo sapiens
ttttaaccttttcatgtttaaactaagacacatagtagctcttcaaaattgcaaaacagtctttagaacatttagtacacaataacccttctaattgcacrtgaaatgaaggactgtaaacttcataagtcacccagaagaacacaatgtaattccctttagagtatcctctttaaaagtggtctcagaatcagactccat

SEQ ID NO: 2887 - DNA, 201 bp, Homo sapiens; identical to SEQ ID NO: 2885

SEQ ID NO: 2888 - DNA, 201 bp, Homo sapiens
tggagacttctacagcaacaatagaacatcttttcacaatggaacggtggtaacttaccagtgccacactggaccagatggagaacagctgtttgagcttrtgggagaacggtcaatatattgcaccagcaaagatgatcaagttggtgtttggagcagccctccccctcggtgtatttctactaataaatgcacagctcc

SEQ ID NO: 2889 - DNA, 201 bp, Homo sapiens
tgtaacacaatctgtaaaagcaagacatgtggtcttgaaaaaagatgagcatatccaaggctggctgtcaaaatgcagtttgagtataaattgtttgactmtttgaaaaagcctggagatctcacttaaaccaacaaataattatgctttatggagtgcgcaaaaccaaatcagaattctgaaatttgctgtcaattctct

SEQ ID NO: 2890 - DNA, 201 bp, Homo sapiens
gtatgactgtgtctgcatatgtatatgtgtattgtgtgcacatgtatgtgtctctatatatgtatatgtctgtgtctatgtatatatctctatctagatayatttacagtgctgtgaatgtatagaaaagaacctggaaggttacgcatcaatccatgaaccctataaacctctgagaggggaaggcaggagagggctggt

SEQ ID NO: 2891 - DNA, 201 bp, Homo sapiens
aggattctgtcccactgaggtacacaatctgcagccccgagcttccagtgaagatacctttacgacctgggttcaaagaaaaatgaacaaattttagtcaraattgcagaatgaaaagccatcaatagggggatgaatctcccatgactctcctatgtccctgccattttacatgtctgaagtgtaaactctccagcagct

SEQ ID NO: 2892 - DNA, 201 bp, Homo sapiens
ccagtttggacaaagaaagacctaatgtatcaaactgttaaccccaaactacaataaaaaacactaagcttagctgaaatctactaagattttctaaacaycatcatgatttcccaaggggaaaaaaaagatttagattctaacgattaaacttgtcttatgtactaaactataactaggaaaagaacacatataaaaatg

SEQ ID NO: 2893 - DNA, 201 bp, Homo sapiens
ctacactccagcctgggcaatagacagagactccatcttaaacaaacaaacaaaaactttgacttgatccagtgagaaatatggagggggaaaaaaaaaamcactgctggggtaggggtataaattggaacaaagtttttagatgaatttaacaatgcttgccaaattttataatgtgcacaccttttgacgaaagtataa

SEQ ID NO: 2894 - DNA, 201 bp, Homo sapiens
atcctacagaaagtagtcagtttaatgttctttcctcaaaacattaagaggttccccactgcctatagaaccacagctttccacaggccctgacctgtcayctttctagtactttctccaagttttcttaactgaactggcaatttgattactctctgcctctgtcattccctagggtagttccaccctacccatcctaaa

SEQ ID NO: 2895 - DNA, 201 bp, Homo sapiens
tgttgcaggagacgtggtgaactctgccctatataatgtggatgctgagcaaagagctgtcatctttgaccgattccatggagtacagaacactgtggtasgggaagggactcactttctcattccatgggtacacaaacctattatctttgactgctgttcttgaccatgtaatgtgccagtcatcactgatagcaaaga

SEQ ID NO: 2896 - DNA, 201 bp, Homo sapiens; identical to SEQ ID NO: 2851

SEQ ID NO: 2897 - DNA, 201 bp, Homo sapiens
tctgcctggagcgactgtgcatgctcctcattcctgccctcctgcatagtagttactcaccatagttacccaggccagcatcatttccctgggaagacttycctgaaccccagaggggctctcaccgcacacttgcagaggccttgctgagcccgtgtccgcagcaacgctacgtttccctgcaaccctatggttaacatt

SEQ ID NO: 2898 - DNA, 201 bp, Homo sapiens
tctttccgctcgacatgtaagaagcttaaaaaagtaaattactgtcctttttaaaaaatgctctaaagcattagtgtaaaaaggacgttaggagagaatcrttatcatctctgtgtgtttacaaagaacacacatgaatatatgcacacacagtcagaaaagtagttctttaagaattccatgccacgaaagatttaatta

SEQ ID NO: 2899 - DNA, 201 bp, Homo sapiens; identical to SEQ ID NO: 1438

SEQ ID NO: 2900 - DNA, 201 bp, Homo sapiens; identical to SEQ ID NO: 1431

SEQ ID NO: 2901 - DNA, 201 bp, Homo sapiens; identical to SEQ ID NO: 1432

SEQ ID NO: 2902 - DNA, 201 bp, Homo sapiens; identical to SEQ ID NO: 1433

SEQ ID NO: 2903 - DNA, 201 bp, Homo sapiens; identical to SEQ ID NO: 1434

SEQ ID NO: 2904 - DNA, 201 bp, Homo sapiens; identical to SEQ ID NO: 1435

SEQ ID NO: 2905 - DNA, 201 bp, Homo sapiens
cctcccttcgttcctttctctctcttctcttcctcttccttttctcttctctttcttgcctgtgcagagcagggctgctccataggcaaagtagcccagcrtatttttcatttcagatactgtatatcccctctagaagtttaatttggattttttttcatgtcttccatttctctcctcatatttattatttcctcttct

SEQ ID NO: 2906 - DNA, 201 bp, Homo sapiens
atctccttgtccaaagacctcatgtccttggcaaacttcttacaatctatgtccatctgctcaacgttgatatctttccacttggtggtcttccagtcctygatgctggtatttacctgaaacgaaaacatcccgtttctccttccactctcatcaaggagaattcaggaagaaaaccctcttacctttctgcacttactc

SEQ ID NO: 2907 - DNA, 201 bp, Homo sapiens
aaaaagaatacaatattacttttggaataagtttatagataaagtaattcagccttgtatatctgtctcttgacttctggagtaataacaggaatactgtsgttaatcagagcagctgattagataaatggctcaatgtcaaggttatagctataattcctatgtgagacagacttgcagtgttatctagccagagattaa

SEQ ID NO: 2908 - DNA, 201 bp, Homo sapiens
tgtgttttcacatttgcttacaaacaattatagtacagtttttaacattttatcaatatgtgttgaccctctgttttgacttaaagtcaattttgtaagaygttaatattgttccctcagctttcattaggttaatatttgccattatatcgtaatatatatttttactttcaatctttctgggtgcttatgttttacatg

SEQ ID NO: 2909 - DNA, 201 bp, Homo sapiens
ttttatctcatatcaaaaatgcagcttttatgtgggtataggattgctgtaagaaaagtgtatctgtagattaatgatttgagaaaaagtgaagtcattamacgacaaggcaaagggaaggtaaaggatctaaagctggatgatttaatgccagcaaaggatggtttgataattttagaaagaggtttgcctttttaaaat

SEQ ID NO: 2910 - DNA, 201 bp, Homo sapiens
atgcccctatattccaatcctgactactctattttttggtttgtgggatctcagagaagttacctaactactctgagcctgagccaccttatctgttaaamccttaaatgagatgagtgcaaagtgcccaataaaatgcccagcacacagtaaacccataaatgttaattctcttatcctcttgcctaaaccaaggttaac

SEQ ID NO: 2911 - DNA, 201 bp, Homo sapiens
caatcagtgcttcgtgttcaatctctgctcttgatctaatacaaaatattgtaagaaattatatttatctttttgaaaactacaattctgaaaagacttarggatgcatagaaataaaaaatttcaaaccattttcaatatttgcctgataaaaaattacaagagaataagaaaaaaggcagtagtttacacatttatgca

SEQ ID NO: 2912 - DNA, 201 bp, Homo sapiens
tattcagcaacaagtgctgctgagtggactagacactgtgcagcttcagcatgattgcttcgttctgagtgcttgcctgccatgttctgcaaccaggtcartcgcagatctggagaggtctggtaacccttggcaattctaattagaacagaaattcttctccattagtatgtgcttcccaagctgggagggagtttagat

SEQ ID NO: 2913 - DNA, 201 bp, Homo sapiens; identical to SEQ ID NO: 989

SEQ ID NO: 2914 - DNA, 201 bp, Homo sapiens
taagtgagaaacttagtgaagagggaagtagaaaaagagtgtgaaagattattctcctaatcctcaggaaatgtgagtggaatacttctgtccactgttcmaaatcaaactcatattctacaaggtaaaaactagtgtactcacccttcagcatcagggtctaaaatgacagccagctctgttaacacaagtcctgccaaa

SEQ ID NO: 2915 - DNA, 201 bp, Homo sapiens
agaatagtaaattcactagtataaaatgtattcatttataaaaattacagctgtttcagttgctttatcctctacattttgtaatactatatatcaatcayaatcccaaaagatcaattttaataatcatttgcttctttatatgcaaacatctatacctcatctggtgatggatgcaaagcaaaaagttctttgtgacgg

SEQ ID NO: 2916 - DNA, 201 bp, Homo sapiens
ctatatgctgagtcccgtaagtcctcctagcaaatcactgaacctgagatggctttgggaagtccctccacaccaccctttctgtgtataggttagtgaakccctgaatttcattttaaatacttgcttcttctccctgtacatattctccatggaaaatcacatttaccaatatagtttcagctatcgcatttattctgt

SEQ ID NO: 2917 - DNA, 201 bp, Homo sapiens
ctgtgctattttttacttccttaaccaacttgtctaattctcaagaataccacttactacacacactcacccttgcagtcaaaccttatgccttttattaycattatggcatgttcccctaaatttccattttaggtatgtcccaccatgccaattaaaaaacaaaaacaaaacaaacaaacaaaaaaacaaacaggccgg

SEQ ID NO: 2918 - DNA, 201 bp, Homo sapiens
gaaaacaaatataagaagtaaacatttaaagcagttgaacaaacacataccttcttttccattcatcataaaataatttcagtgggttgaattgcttatayattgaattctttataaattgagttttttataaaaacagaaccaagtgaagagaaaacaagagaagccccatatttaagattggctattaatttcaggccc

SEQ ID NO: 2919 - DNA, 201 bp, Homo sapiens
ttttcttgggcttaattttcaaagcccaagtcacacacgaatgcactgagaaccaaacataaacaatatccacaaggcagccaatggaagcaacctcttgycatatgactgagatcaagcaattgattaaaagtctccctatcacagtcatctattctccagttttataagcccaatttcgcatacattttgttttttgtt

SEQ ID NO: 2920 - DNA, 201 bp, Homo sapiens
tacatatacattcctactttttgttttttatttatttttagtttttagtttttttgagacagggtctcactccattacccagactggaatacagtggtgcraccacagctcactacagcttctgtctcctgggctcaagcgatccttccacctcagtctcctgagtagctaggactacagaagcatgccaccacacccagc

SEQ ID NO: 2921 - DNA, 201 bp, Homo sapiens
aaaagcaaacaaccaaatggaaaacaagcaaagaactctagacacttcaaaagagagaatccaaatggtcaatcatacttatggaaaagtgcacaccgcayaagtcttcggggaaatacaagctaaaatgagattcaactataaatgaccagattggcaaaaatttaaaaatctgacaattctctaagtattgatgaacat

SEQ ID NO: 2922 - DNA, 201 bp, Homo sapiens; identical to SEQ ID NO: 2686

SEQ ID NO: 2923 - DNA, 201 bp, Homo sapiens; identical to SEQ ID NO: 2687

SEQ ID NO: 2924 - DNA, 201 bp, Homo sapiens; identical to SEQ ID NO: 2688

SEQ ID NO: 2925 - DNA, 201 bp, Homo sapiens; identical to SEQ ID NO: 2689

SEQ ID NO: 2926 - DNA, 201 bp, Homo sapiens; identical to SEQ ID NO: 2690

SEQ ID NO: 2927 - DNA, 201 bp, Homo sapiens
gtatttaggactgcttcatggaaaacaacattcaaatatttagtattcatcttactatttcaaatatttccaatgtctgtattcaggataaatgtacttawtttgtctaaggtttcatctaattttcccccaattttttttatataaatatgctcagatgataatttaactcttcagtgagactagatggaattactcatt

SEQ ID NO: 2928 - DNA, 201 bp, Homo sapiens; identical to SEQ ID NO: 2696

SEQ ID NO: 2929 - DNA, 201 bp, Homo sapiens; identical to SEQ ID NO: 2697

SEQ ID NO: 2930 - DNA, 201 bp, Homo sapiens; identical to SEQ ID NO: 2698

SEQ ID NO: 2931 - DNA, 201 bp, Homo sapiens; identical to SEQ ID NO: 2699

SEQ ID NO: 2932 - DNA, 201 bp, Homo sapiens; identical to SEQ ID NO: 2700
